United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 20

SEQ ID NO: 80610 - DNA, 429 bp, Glycine max
  Peptide Sequence Number=SeqID_197388
atgctggtcctggctttaagaggatgctttggcctgctgcacagaagtttcttgatgccaaaactattgcaaagatacagtcagttgccagactttttgggtggaacatgtacatgtcctggacaaggtggatgtcttaggtctagcaaaggtccatggaatgatcctgatatcatgaagctacaattatatccttttctcatctcccagggacaatgcagtgatacgtcaacagcagaatctgggtcagagtatcagataactactatagttgtgataatagtgctcctgcaaccaagaaagtgtttgaaagtgatgaatttcacatcactcggggaacaatcatcgcataacaatgatacagggaatattgcttgtgtggaaaattccacagggactgcagtcagcaattggttcagcttcgtttag

SEQ ID NO: 80611 - DNA, 1601 bp, Glycine max
  Peptide Sequence Number=SeqID_197389
cccaatatgttgaggacaagttagatagcattgaagagaaatcagaacatctattacatggctcaagacagattcatgattctcttgattcaattggtagccacacaaaacaagtagctcaaactgctaaaaatctggaaggtcacattgattctgtattaacccattcgaggagtgtttacgatcaaactacaaaaattgcattatcacaaacacagataaaagaagggcaagagaatatgaagagaagcttgaaggatggggtagcgatgctcaaagactcttacaattatttgggcaaagaaattgaaaagataagaaatgaagccattgagattgaaaatgaggtaattaaagttggaaatgccatgtcatcaaggatggacaacctgcaaagcaaagctggggatattgggaatatgactgggatttccttagataagcaacaacaacttttagatgggcaatccacagcacttgagggcctaaactcattgactgagtttcaagccaaagcactagaagagagcaggaaaaccctacaatattttgctgaatatgggcatcgacaacatgaagagcttattcagcgtcaacaacagattaaaggatttcatgatcgtttaatggaaaactcaagggaaatattgtcttctcaggaatcttttgaatcaaagcaagcttccatgtttgttgttttagacaggatttttgctttgcaaaataccttgttacttgaatcaagaatgatcaaagctttcttcgtttattccatattaatctttgtcatcttcatgttgaccagtacaaagcaaacatacaatatcaggccattcctatacatagagctttgtgctactctcgttgtggaagtactcattatccgattaacaagtgataacattgagcaccaaacgtggataataagcatggtccgattattcttcatggtagcagccttagttcaacttctacatgccattttcacatacaagaactatgagaccttgaaccatcaaatgctgctaactctgataaacaaggttaacagtatgcaaaaagaaaaggagttgtcatgggacttggattctgattatggggattggtctgaatgggtagatgccgatttacctgatgatgtgaattgcctagatgatcctgactatatacttccacaagaagttgcagagaattcaatgacaggtttagacccacaatctctaataccagcaacaaaaactcttgcaccattagagcctcttgtgggagctcactggacacatgaacttcctctgcacactagtctcgccgtatgggattatgaagtccctgagatgcagagagccattggaaccacatatggccaggtccatggaagtgtgagaaagaaaggagcagtgaatggttgcaagtgtttggttgggttgatcccacagcaaagaagctgtgatggacaagatgacgccggcgtcgtttcttgtggaatcaggaagagcagtgacagaggttgcccacaaggaagcaccaatgcagtaccaggccaagccaccaagtgcaccaagaccatccaactatggctttactttaatgtcactctctag

SEQ ID NO: 80612 - DNA, 561 bp, Glycine max
  Peptide Sequence Number=SeqID_197390
atgggcgagaacagtaaaacggtgcgtttaggcatcttaggctgcgccaacatcgccagaaaagtggcacgagccattggtctgtcaccgaacgccactctctgcgccatcgcgaaccgttcgaaagagaaggcggagaagttcgccgccgagaacgggtttccggcgagcgtgagggtttacgggagctacgatcaggtgctggaggacccaggcgtggatgccgtgtacttccctctccccacgagtctgcacgtgcggtgggcggttatggccgccaataaaaagaagcacgtgctggtggagaagcccgtggctcttgaagtggcggaacttgatcggatcttggaagcggttgaatccaacggcgtacagttcatggactgtagcatgtggttgcatcaccctagaactgctcacatccaagacttgttgttctctgttcctctttctgctaataacagcattggaccagttcgttttagagatgccactgatgcaaccgtaattgcgattgcaaggcaacaattcaaaaccatgattattattatagttgtgtaa

SEQ ID NO: 80613 - DNA, 2235 bp, Glycine max
  Peptide Sequence Number=SeqID_197391
atggatccagaaacagaacaaggctcagaattctcaatcgaattgcaatcgaaagcgttccaagttctaagctcaaacgacaacaccgcaatggaaaccctcttctcccacctcttctactctcctcattccgaacaactccgatcccaagcactcgaattctttcaatgctgcaaacaccaccaccccgatcttctcttcatcaaactcttcttcctcctccgttccactcctctccccgaaactcgcgccaacgccgcacgcgccttgcacctcctcaacccctcccacctctggcccaaccttaagcccatcgcccaggcccacctcaaggcccacttcctcaacttcctctccgacgaaccttccctccacgtcctccgcctcgcctcctatctcctcgctcaaaccgtctccgttatcttcaaaactcaccaaacctggcctgagctcctcaattttttactctcctccatctcctccgatgaaaacaagcgccgcgaggtcgccgcgcttgtcttcgccaggctcccaaacgactgccgttttctcgtccacaacgctctcagggacaacaaacgccttcttcacgcgtcgtttctgcgctgcctcgcgtcgtccagccccgacgtccaggtcgccgcgttcggcgccgtcgtcagcttgatccctctgttctccgaaactaagctcttccacgagctcctccgcgccctcatggttggcgtcttcacgctcctgcatggctacgaaggaagctacttcaaaatcgcgttcgcggagttgataaatctggtttctcgccagccgcagcttttgaaaccctacatgaacgacatggttctcgacgtgcttcagatcgcggagagcggtggcttgagcgacgaaacgcaccgtttggcgtttgagttggtgatggccatggcggaggagaaggagtacgagaacgtcttcgctaaccttccttacaggattgtgagcaagctgttccttgttccgatgaagatgttgcagcgcctcgcggaggacgatggtgagcgtgaattgaaaaacgagaaggtttttgatgtttacgagtttggaatgaagagcttgaagaagctttgcgttgtgctcggagcgagtaaagccgtgcctgttgcgtttgaagtgtttcggcttcacttagatgatgatgcggcatattggaaggagcgccatgcaggaatcacaatgctcagtgtgatcgcagaagagttctctgatgaaatggtattgatggaaaattttctggttggagtggtgaccaaaattttgaagtcaatgcaagactctcatactcaagttcggttggcaactttcaaatttatggagactcctacaaactttgttcaggtggtgcaaatcctttaccatcacaggcttgtgcatgctttttgcactgcactcgacaatgaacaggtcgttaaagtgaaggaacaagctgcctcagcaatgcaatttttcctaaagaacactttgccagaaagcttaacactaaataagactgcggaaactgtattaggaaaattgttgccattgattcaggacaaagatagttccgagataagaggtattgctttgtcaactttaaatatagttgcacaacggtgtcatgaagtggctaacaagtactgtgcaatttatcttcccatcttactggaagcatgcaaggactataattattatatcagagaggaggcagcacggggaattcgaatttgtgcagagcttggaacacaacagttgaagccttttatcaatagaatattgtcagaactcggtgttttgatgaacaatccaagtccactgaatgaaaaagcgcatgatattgcagtttctgctctaggaagaatttgtgaattccatcgtgaatgcattgatggctctcagatggttcctgcctggttaagtttcttgccacttagaaatgatttgattgaagccaaacttatgcatgaacagctttgtttaatggctgaaagatttgataaggaccttttaggagctgatagtcaaaactttatcaagattattgtagtgcttcttgagattattgataagggtgacaaattagctacagcacaaacaatccagcaggtggaaaatttgctgaggcagcttgggcggtgtattccacgtagtgcgtttgatacaattttttcatctttgaatgcccagcaaagggcattactattgtctttgttatactcctag

SEQ ID NO: 80614 - DNA, 816 bp, Glycine max
  Peptide Sequence Number=SeqID_197392
atggtggatcatcggagtcatcttcttgtttttattttactcttattcttattaaggggcgagtcatggggatggttttcatcatctcaggagactccctctagtgacaaggctcatgccaatgaaggcaattttagagttccaagtgctgagttctctattgagtccttcaatgaccacaagggagtgaagttaatagaaaatgctaagaagaaaatgattagctcaaactcgtgttggcaaaatgcttaccaacatctttttgctggatgttctgaaatcttggctattgatgagaagaggtctagattggcttggcacctaagtgattgctttcagagggattctggcagggcacacgcattcaaatatgaaactgagagacttgtgactgaattaaaaacttcagcccagtatgtcgaggacaagctagatagcattgaagagaaatcagaacatctattacaaggctcaagacagattcatgattctcttaattcacttgatagccacacaaaacaagtagctcaaactgctaaaaatctggaaggtcacattgattctgtattaacacattcgaggagtgtttacgagcaaactacaaaaattgcactatcacagatacaattaaaagaagggcaagagaatatgaagagaagcttggaggatggggtagcaatgctcaaagactcttacaattatttgggcaaagaaattgaaaaattaagaaatgaagccattgagattgagaatgaggtaattaaagtttggagatgctatgtcatcaaggatggacaacctgcaaagcaaagctga

SEQ ID NO: 80615 - DNA, 750 bp, Glycine max
  Peptide Sequence Number=SeqID_197393
atgaaacaacactttgatcttgaagtggtggcctcagaagaatatgaatctgaagttagcagcctggttacttccaatatatcaattcaagaaacctatgcaggtccttgcagtgacaacctcaccaaatttttcaatgtcacaaatccaatagaacttcatctccattcagattctatctcccttgacttaactctaaagttcaacaacaatgacttggtggttagaaattcagcaggaatctccttctcaagcactagtgagagcagcattaatgatcctccctctcaaactaatccagcgaacaatccgcgagtcttctcttgcaattactgcaagcgaaagtttttcagctcgcaggctcttggaggacaccaaaatgcgcacaagagagaaagaacaattgcaaagagagcaatgcgaatggggatcttctctgagagatatgaaagtctagcatctctcccctttaatggttctttcaggtccttagggataaaggcacactcttctctgcaccatggttttgtgccaacaacgaaaagcagtgcaagatttgagcaaggatatgttggtcttccaatattcttggaggaggatgaggaagaactcttgtggcaaggtagttaccatcaggttccctctgagggaggccatactcatcagaatttctcactgagtggaagttcaattttgagtttcgttggggagaacgcgaatcatccacctgagttgacattgaaactttga

SEQ ID NO: 80616 - DNA, 276 bp, Glycine max
  Peptide Sequence Number=SeqID_197394
atgacacaacctaataatcctgaaatatcaattttaattgaaactcatagagcacatggcttgagttccaattgttacattaaattgcaaacacatgctggtggcttaaggccaatatctgacgtctctagtgatcttaccatcgaagtaggagcatcaaccttcgcacttgacaagacgaaactttacgacgggtgtccccgaaccatcgtagtcatgcatcaacactacgtcgggtttgccacaaaaactgactttgaccaggggatattctaa

SEQ ID NO: 80617 - DNA, 1566 bp, Glycine max
  Peptide Sequence Number=SeqID_197395
atgggtcttgagggtactatagctcctgagtttggtttgcttaaatcactgcaaaggcttgtgcttgctgataataatctcattgggccaattccaaaagagttggcttttttgcccgggcttgttgaattgaatgttgcaaacaatcgtctttatgggaagatcacgagttttaagagccatgtggttcttaccacaaatgggaataaggacatagggaaggataagcccagcctagggccaagatcatcacctttaggtccactgaattcaacagctccgaacagaagtgaagaaaatgatgggaaaagatccttacatgtagtggtgattgtgtttgttgtgattggtggtgtggtgttggttttggtgattggtttcttggttttttgtctgtttaggatgaagcagaaacggttgagcaaggtgcagagtccaaatgcaatggttattcatccacggcattctggattggacaatgaaaatgtgaagataacgattgcagcttcaagtcttagtgttgatgttagtggaattggaatgcgaaccatggctggcagtgaggcgggggatattcaaatgggtgaagcaggaaacatgattatttctatacaagttctgaggaatgtcactgacaatttcagtgagaagaatatactgggacaaagaggttttggaacggtttacaaaggtgaactgcatgacgacccaaagattgttgtgaaaaggatggagtcgggggcaattagtgggaaaggtgcaacaaaatttaagtctgaaattgttgttttgaccaaggttcgccaccggcatcttgtttctcttcttggttactgcttggatgggaatgagaagcttcttgtgtatgagtacatgcctcaggggacattaagtaaacacctttttaattggatggaagaaggactgaagccactggaatggaacagaagattgaccattgccttagatttggcaagggttgttgagtaccttcatagcttggcccatcaaagcttcattcatagagatttaaagccttcaaacattctccttggagatgatgtgagagcaaaggtttcagattttggtcttgtgcgtcttgctccagaaggaaaagctaccatagaaacaaggattgctggaacttttggatatttggcaccagaatacgcagatattggtttggtttggatgttggctatacatttcaagtcaatggctaagtatctcagcaaaaaaatgtatgtaaataaagactcattccagaaagccattgaccacacaattgagctcaatgaggaaacatttgctagtatccacaccgtggctgagttagctggccactgttgtgcaagggagccatatcaaaggccagacgcaggtcatgttgttaatgtgctttcttctcttgtagaactttggaaaccatctgatcaaagttctgaagatgtatatggcattgacctagccatgtctttaccacaagcattgaagaaatggcaggcttatgaaggtagaagccaaatggaatcttcttcttccatactcctacctcctatgatatga

SEQ ID NO: 80618 - DNA, 1725 bp, Glycine max
  Peptide Sequence Number=SeqID_197396
atgacaactgcgccggtattagccctaccgaacttcactcttcccttcattatagaaacagatgcatcaaacacggctatgggagctgtgctccaccaacacggtcaccccatagcttactttagcaaatccttctgccagcaactccaacatgcctcagcatacgttagagaattgcacgccatcatcgccacgcagttctatttggccaaacttcttggatacgactatgatatccaatataaggcgggtacttctaacattgtcgctaatttgctatctcgtagggatgaaccttcttcaggccagtacttggttctctctgtacctcacccagaatttctcacccagctaaaggcaaccctcatggctagctcaaagttccagaagcaacgagaagccattcagtctcagcctgaagcacaccctgaattttccatttcagatgactttatcatcttcaaaggtgctatatggttagattcccaaaatccgtttattccttccttactccatgagtatcatgcaacccctgtgggtggtcattttggaatcaagaagaccctgcaccgccttcagtccaacttccaatggcacaacatgatcaaggacatcaagactttcgttcgtgagtgtgcagtatgccaacagatcaaacacatcacacgcaagagcgcgggcttgttgcaatcaatccctatgcttgccagagtttgggaggacctctccatggacttcgtgacccacctccccaactcccaaggattcacgacgatcatagtagtagtggatagattctctaaaggcttccacttcggtgccctaccaacgcagttcacagctttcatagtagccacgttattcatggatactatatgcaaactccatggattcccgcgaagcatcatatcagatcgtgacccgatcttcatcagcttgttttggaaggagctcttcaagatgagcgacaccacgttacgcatgagcactgcctaccatcctcaaacggatggtcaaacagaagtgatgaatcgaacactcgagcaatatttgcattccttcgtgcatcaccaacccttgtcttggttcaggttcctcgcactggcagaatggtcgtacaacacctcacagcacgcaagtactgggttaaccccgtacgaggtgatctatggtaaggccccttcaactttctccagctatctccgcggttcgtcccgcaatgatgtcgtagactcagtgctgggtacacgagaagaggtccatgcgctactcaaacgcaaactcctcaaggctcaggaaaacatgaagttcttcgcaaaccagtcacgacgagaagttgtttacgaagtggaccaaatggtttacgtaaagctgagaccccaccaacagtcttcacttcgctcacaaccttcaaacaagttcaccaagcgttacttcggtccctttcgagttttggaacgtatcggcaaggtggcttatcgattgcagttgcctgagggatccaagctacatcccgtattccactgttccttactccgacctcactatggtcccttggaactaccgcaagcccctcttcccccagatgcgtcccacaatagccccatattggaacctctcactattctggattctcgcgtggatttgtctactcaaccccccacacgcatggtcttggtgcaatgggttggggtacccctagaagactcgacctgggaacgctga

SEQ ID NO: 80619 - DNA, 729 bp, Glycine max
  Peptide Sequence Number=SeqID_197397
atgactagaaagaaggtgaagttggcattcatagccaatgactcagctaggaaggcaacattcaagaaaaggaagaagggtctaatgaagaaggttagtgaacttagcaccctttgtgggattgatgcatgtgcaattgtttacagttcctatgatcctcaacctgaggtttggccatccccaatgggggttcaaagggtgcttagtaagttcaggagaatgcctgaattggagcaaagcaagaagatggtgaaccaagagagttttctgaggcagaggatcatgaaggccaaagaccagttgaagaaacaaaggaaggataatagggaaaaggagatgactcagctcatgtttcaataccttagtgcaggtaagatcatgcacaatataagcatggttgacttgaatgatctggcttggttgattgaccagaacttgaaggatatcaacagaaggattgaggtgttgactaagaatgttcaaagtcaaccacaaattgcagcaccagtggtgactgatgttgttgccaaggttgaagacaatggacaagggagtcagcatggccagcaggggtttgatatcaacgtggatctcatgcagaagcagaattggtttatgaatttgatgaataatggcagcggcgacggtggtgctgggaatgaggctatgccttttgttggagatgttaatcaacaaaatggcttttggcctaatccttttttccattga

SEQ ID NO: 80620 - DNA, 270 bp, Glycine max
  Peptide Sequence Number=SeqID_197398
atggtggcagaagcttgttgggctgccttgtattggagacaagcgactgctgtagatttatctgggaagccaatcaattcatggcacttatctccggcaccacagccgcctcgggcaccacggccacctcttcttccagtattatctgccatgagggtgaatgaacaataccaacagcacacaaatagcagcagaggtccaagagaagtcaaacagtatgtgaatagtagctctgatatcaacttgaatatcagactaggaatgatttga

SEQ ID NO: 80621 - DNA, 159 bp, Glycine max
  Peptide Sequence Number=SeqID_197399
atgggagggaatttgaacgttgaccgttcaaaggttgaagatgtggagggtaagagcactgcgcgtgtgctagccagccagcattgtagcgtgtacgcgtgcacctgcgtaagcctctttgcatttgcgttcgctactctagccgcgtacgcgcagtga

SEQ ID NO: 80622 - DNA, 1689 bp, Glycine max
  Peptide Sequence Number=SeqID_197400
atggcggagcacggaacccaccgcaccaccaccgaccgcctagaagaagccattaccgccctttccgagagacattccgaccttgccaacaaagtcgaagccatgtgtgaatgcctctcgcacctctctcaccccaccccgccatcaactcaaccttcgtttccctccagaccacccgtcaagttggatgtccctcggtttgacggccatgatccactgggttggatcttcaaaatctcgcagttctttgagtatcaaggaaccccggaggaagaacgcattacagtagcctctttctaccttgatgggccagcactcagctggttccaatggatgttcaggaacggattcatcatgtcgtggtcggcgctgctccaggcaattgaggctcgcttcgctccatcgttctacgatgacccgcgaggaactttgttcaagttgacccaaaggagctcagtcacggagtacctcaccgagttcgagaggttagctaatcgtatcaccggactctccccttcggtgctgcttagttgctttatctccgatctaagcccggagatcagacgtgaagtacaagcttttcaacctatctcattaccacaagccacctcattagctcgtcttcaggaagacaaaataaacgaccgaaagaaacactactcccggccttcaccttcatcctcatttccaccaccacaaccaccctcctcacatccaaatagtaacctccatactaaacccaaaaccccttttatccaaagaacacaagaggacatggcctacaaacgtgaaaagggcctatgttataattgcgatgagaaatggagctcatcgcacagatgcaagggacgcgtcttgcttctcatcgctgattctgacgagtcttccccgacgggatcatctttcgatgaacaaacgcccacactcccccacgaacctaatcctgacccactcgaacctcactcaaccttcgacccaaccccatttcaaccccatattagcctctatgccatggcaggagttcttgctacaaacacctttcgtctttatggctccattaataacacacacgtcattattttgatcaatagcgggagcacacataatttcattcaaccacgaatcgcaaagttcttgaatcttccctttgaagacacgattcctctcagagtaatggtaggaaatgactcagtcatggattgcaagcaattgtgtgctgctacaaagcttattgtccaagaacatgaattcacggtcaccttgcgtgtacttccggtgagtggagctgaggtagtcctcggtgtcgaatggcttcgcaccttgggtcccgtcgtcaccaactacacttccttcaccatgcaattctcacacgaaggcaagcctatcaaccttcacgcggatgttcagtcaaactctttcctcgcttcagctacccaggttcgacgaatgctatccaccagttcaacttcaggtctcttccaccttgcacttctacccacccctccaatagatcaacctccacacccttcccataccattcccgccattaacaatatcttgctcaagtaccaagcattgtttcagcaaccttcatctcttcccccttccagacaccacaatcaccatattaatatccttcctgcagctaaccccatcaatgtgcgcccatatagatatccccatttctag

SEQ ID NO: 80623 - DNA, 1390 bp, Glycine max
  Peptide Sequence Number=SeqID_197401
atggattcgttttgggattcttgtttgccattaactgtgaaatgggaatgtagatatcgagcgtttgatgagttggaagggattgaagtggcgtggaatcaggttaaggtggcggatctgttgcgtaactctgaagatttggagcgactttattcagaagttcatttgctcaagactttgaagcataagaatataattaagttttacaattcatgggttgacaccaagaatgagaacatcaacttcattactgaaattttcacctctggaacgttgcgccaataccggaagaaacataagcacgttgatttgagagctgtgaagaaatggtctaggcagattttggaaggccttttatatcttcacagtcacaatccaccggttattcaccgagaccttaagtgcgataacatttttgtcaatgggaatcaaggggaggtgaaaattggtgatttaggattggcggctatccttcaacaggccaattcagctcacagtgtcataggtacccctgagttcatggccccagaactttatgaagaggaatacaatgagcttgttgacatctatgcttttggcatgtgcttgctagagttggtaactgttgagtacccatatattgaatgtaccaatgctgctcaaatatacaagaaagtgacatctggaataaagccagcgtcattggcaaaggtggcggatcttgaagttaaagcatttattgaaaagtgtattgctgatgtatcggaacggttgtctgcaaaagacctcctgatggatcccttccttcagtcagataatgataatgatagtgtaggtcaatcttcaagatctcaaacccatcattcaggaaatagttctcatatagctgttgagccaagtagggaattcacggtggaaggtaatattcgcaatatccactttccttttgatattgaagcagacacatcaatctctgttgctggtgaaatggttgaggagttggaactcactgatcaagatgttacaactattgctaggatgattgattctgaaattcgatatcacattcctagttggaatttcagtgaaactcctcttgacattaaccatcaagattcaagctgtacctctgaaactaggccagagacctctcctatgaaaaatgattccattgcttctcctggcagtcttgcattagaaatattaccttcaggtcgtaggtactggtcagattcaccaaggggagttggaggaaactctccatctcaacattttacttcaatcttgtctaatgaaacaggtgtgaatgctgaggaaggcaacctgattacaaatggtgatatttcagctaatgattgtgttgatggtactgctgagcgggaatgtgatgagattgctgattccccttcca

SEQ ID NO: 80624 - DNA, 162 bp, Glycine max
  Peptide Sequence Number=SeqID_197402
atggtattaggtgcgggaacagttaaggtggtgattgtagtagttgttgggagggtcaaagctgaaaatcaaatggcattcattaaaacgacgctcccttttcgttgtggttttgatttctttgttgcaacgaagatgaagacgacgaggatgtgcaggtaa

SEQ ID NO: 80625 - DNA, 168 bp, Glycine max
  Peptide Sequence Number=SeqID_197403
atgtctcaccaccatttattcccgacagcaatgctccctgggtcatcactttggtttcataaaggggaaagaagggctacaggcggcgatggtgtcagagagaggaaaccgaaaagtaaggccacaacacgaaaggcatggttgatggtgaaggaggggaggttgtga

SEQ ID NO: 80626 - DNA, 234 bp, Glycine max
  Peptide Sequence Number=SeqID_197404
atgcttccatccctgctccactgcatggttgtcgaatattcgttctccgttgtcgttcatggccacgctggaaacgtgttgattggcgccacactatgccttgtggcggtgttcaatggttgtgaacgacgcatgaaagtcgctggaatattcatggtggtggccggaggagatgcattgatacctgtgatacaaaggagagacgagagagaaaactgggattttttatattag

SEQ ID NO: 80627 - DNA, 1029 bp, Glycine max
  Peptide Sequence Number=SeqID_197405
atgcccttggaagggattttcattgaacctacttcaacttctataccagatctttcccttcacataagtccaccaagcacttcctctttctcttctttgatttgcagcaataacaacaacaataacaacacatccggtggtggtggtggcatcaattatgaggcacacaattcaagaagcacaaatttcccttctcaagctcacaccgagctttctttgggaaggaatttcagtgttggaggaggaggaagaggtggaggagctcttgaagaaccaccaccacataacaacaacatcaacaataacccttattatcaaacccaaaaggctcatttgcaacatcttcatcaacaccattctaatgcttcaagagcaacgacaagtactactacaagctcctccaatcacatgagtcacataaactatggggtttctttgcttgatgtgtcatcagaaggaatgaggccaatcaaggggattccggtgtatcacaaccgttcattccctttcttgcccttggaacattcaagatcagacaaggatcatcatgccaaaatgtgtttatatcatcacatgcctacatatccctctttgtcctcttcttgttctcctctatgcccttcttcttcttcttcttctccagctgcaccctacttcgtcgcgaccgcagcaacagcagggggtctggatcccatgtcctacctgagctgctcaggtgggaccacaaaccccgcggcgcatagggctgcaacagccacaaggtttaatggattttccggggaggctttcaaatctcatcatccattgcaccaccatcaccactcatcatcatcatcgtcatcaccacaatatggggttggacctggaccctctcatcatgaggtctcttcagggttgatgagatcaagatttttaccaaagttgccagcaaagaggagcatgagagcaccgagaatgcggtggacaagcacactccacgctcgatttgtccatgctgtggagcttcttggtggccatgaaagtaattaa

SEQ ID NO: 80628 - DNA, 276 bp, Glycine max
  Peptide Sequence Number=SeqID_197406
atgctcaaggaaaaatttgtgatgaagattaatcaagcttattacaaagtacacatatacagtagagaaccatggcaacaaaataactctaacgacatagatggtttcagacccccaatcttccagtcgcagcaaatatcaggagggcatcaaattcaggagtgtgattcaacccaactcaagaacagtttgtcaggatcgaatttagagtgcaagaacccaagcttggagttcacattaggaagaccggactggaatggcaaagggcaagcctaa

SEQ ID NO: 80629 - DNA, 288 bp, Glycine max
  Peptide Sequence Number=SeqID_197407
atgcgattctcaaccgtggttgcagctgctaaggactcatccattgttccatatacaatattggaggagattagccgcaaggataatgttgccaaatctagacattggtggtggtgtcagaggtgggtaatgacggagcaaagggtagatctggctggtggtggtgttgtcggaagtgggtgtttaaggaggaggtttagaatggagcacgagaatcatgtacaaaaacaggcgttgaagggagcgaagataatggaagcatcattccaagagtttcaaaagcgatag

SEQ ID NO: 80630 - DNA, 144 bp, Glycine max
  Peptide Sequence Number=SeqID_197408
atggactttgaaaatggctgtatcttgagtgggggaggggatgctactgaggcactggcctcagttgtagatggccatgattgggaaacaggttgggattttggtgtcagccctgaatcccacattaaagccttcaaaagctga

SEQ ID NO: 80631 - DNA, 1170 bp, Glycine max
  Peptide Sequence Number=SeqID_197409
atggaggtgttttgttcgataaataacaagttgaagcaaattgagatagatcttaatgagctaggtattattgatgagagccatggtcttagtgaagatgatttaaagaagaaaaacttgataaagggcttgcttgtggaggagacttgggttgaggagcctacaatggtcaaggaggagggagacatcttgagattcctagtggaattccatagacatggaattatgcctagaggtaccaactcttcttttatatctttgattgataaatgtgagaatccacaaggtttaggtctaaatggccttatgagagaagctaagaagaagaatttgtatgtcggatataaggtgggtaaaagggaatgtgaaattagcttgttgcaatttttcgatgaagcactctttgttggggaggtgaatgtaagaaatgtattcaccatcaaagttattcttagattgttcgaacttgtgtgggacttagagttaactttcataaaagtagctttggagccattggtgttggaggtgaaggttgagacatggcaacctattattatgaaattccaaaagaggatgtatgtaaaagcaagaagtgtcaaagacattggtgtttttaatgaagcacttttgggaaagtggagatggaatctcttccataatagtaggggtgtttgggttgatgtgttactctcaaaatatggaggattggaagggtttgttagtgaacaaaagtctcccttagaaagtctttggtggaggaacttgagaaaagtttgtggggtgggtgcaaagattcatggtttcatagagggatccattggaaagggtggtgttgggatcttgtgtggaggagacatttgtttgagtgggagggtacttcatgatgagaatgattgttggttttgggaatatagcccttcgggtgtctatacctcaaattcagcatatacttctcgtttccttgcggcagaggaggattcttgtatttttgaggagttatggcagctaaaaattccaagcaaagttgcgttctgtctatggagagctctaagagacagattaccatcgaaggacaatcttagaaaacgcaacatcattgaagaagctgatttgaggtggccattttgtaacaactgcagagagacgatcaaccatctttgtatcatgtga

SEQ ID NO: 80632 - DNA, 708 bp, Glycine max
  Peptide Sequence Number=SeqID_197410
atgataccctactccctgcggagaggagttaagttacatgtttctgtggaaatttctaagttgaagcctgatatgacaaaaattgaaattttcaaggccgagttcatgtctcctccatggttctcttcaagtgcaaagaagctaatcaacaaaatccttgatcccaatcctgccactcggattacatttgctgaggtcattgagaatgactggttcaagaagggatataagccacccgtatttgaacaggctaatattagtcttgatgatgtagattctattttcagtaattctacggattcacaaaatcttgttatagagaggcgcgaagaggggcccatggcacctgtggcacctgtgactatgaacgcctttgagcttatctctaaatctcagggcctcaatcttagtagtctttttgagaagcaaatgggactagttaaaagggaaacacggttcacatccaaatgttcagcagatgaaataatttcaaaaattgagaaagctgcaggacccctgggttttgatgttaagaagaacaactgtaagttaaagattgaaggcgaaaagactggacgcaaaggtcatctatctgtagccactgagatcttagaggttgccccttcactatacatggttgagctgcgtaagtctgaaggagatactctcgaatttcacaagagtagccagccatggacaccatcctag

SEQ ID NO: 80633 - DNA, 423 bp, Glycine max
  Peptide Sequence Number=SeqID_197411
atgagcactggttgctaccttgataaagatgagtccggtcaacccattgatggaaacaatatagaggattgtcatcatcaaaaagggggagattatggaagcaatgccttccaagattattttgatggtgccaaagaatcaagagtcaagcaagtttcaagaatcaagatcaagattcaagattcaagaataatcaagatcaagattcaagattcaaggactaaccgcctaagaattctttgtcttaacacattggagcgtacatcctttgtggtacaagtagagcgtacatctacttgggttgtgatactgagaacaagagagggtacatctcttgtggatcagttcaagtggagtgtgcatccacttggttgttcaaagagaacaagaaagggtacatcccttgtggatctttgcttgtaa

SEQ ID NO: 80634 - DNA, 408 bp, Glycine max
  Peptide Sequence Number=SeqID_197412
atggcaatttgtaaggccttgtcttcaaaggccaaggggaaggaaaaagaagaaaaggattcctccaagaaaattgttatgaaggaaaatcattttgcaacaaaagttgatatcaaaatagcactccttcttaaacaatccttctaccttctcctatcaaaggaaaaatcccttagcactgccatacctcttgagcttgaggttattcctcaagtaaaggagttgttggatgagggtttggttcataagagattaactccttgtgctttgttggcgcccaaaataggtattatgaggcacataatccctatgataggtggtatgatgaatgtgttgagtggtgcaaccctcttttgtaaaatcgcccaacatcttcatgattcacaaacatggggactcattaggtag

SEQ ID NO: 80635 - DNA, 345 bp, Glycine max
  Peptide Sequence Number=SeqID_197413
atgtacatagatcacattcaatccttaaaaataaaactaaccgatggtcgcacgaagaacacagaacaagaaaatgacgcaaaaagccaccttgggacggttacagcttgcccaagcgagctgaaacttaaccctgcaacagtgagctcacccaggcgagctggttccttaaccatgaagttatttggtggcccaagcgagccaaatgctggcctaggcgagctggggcctgggaaaaacaaggaaaagacctttttgccctcctttcttggtattttttgtcttcctggtcgaaacaccgaatggttccttgctttgcactgtaactggcgttcaacaccgtaa

SEQ ID NO: 80636 - DNA, 246 bp, Glycine max
  Peptide Sequence Number=SeqID_197414
atggcagaaacagcccgacaatggtggacacgacctaaacgacgccaatggaagttgtggacaacgacaacgcagccgagagcacaccaagaaggaagacaaagaagttttgtcacttcacttaaattgttgggtgcacaagtaatggtactaggtgcacctagcaacaccctcaccaagggtgtaactgcgcaagggaatgtatatgttcggtcgaggcgaaggtggcgtacatcgaacgcatga

SEQ ID NO: 80637 - DNA, 360 bp, Glycine max
  Peptide Sequence Number=SeqID_197415
atgggctcaaaaatctaccctgagtttcataagaaccctagtgccttctttagcagctctaggccaatcctcttggagcctcttacttatggctctggtgactggtcccttcctagggagtattacatcacatgtaaagattgtgaaactattaaagagaaagagtccaagttacacattgagatagagacaaaagccaatgagaaagatacccttcttaagaactttcaggagttggaaaacaaactgaaagatcttcaaaagattctaaaggagcttaatgaactcacaatcatcaaaaggaagaaagaaagatatgatatttggagagagtgtgcacaagcacacaaattattatga

SEQ ID NO: 80638 - DNA, 321 bp, Glycine max
  Peptide Sequence Number=SeqID_197416
atggatgtttacaatttttcatatgatttcactggtattgggcttatctttgtgaaaagaccaactgaactcctaatgagcatgggtgatgtaataatggtaatgggctatgttatatgtccactatcagaattttgctgcacttggcagcttaagcttaccagtcaaacagttgccacataccaacattgcctgattaaggatcactaccctccaaccattgcactttctatctcatcagcactcaacataagctcacgcacagaatgcttccaggctttcaacacctctcacacgatgatcgaaatgggtattatctga

SEQ ID NO: 80639 - DNA, 207 bp, Glycine max
  Peptide Sequence Number=SeqID_197417
atggcaattgctaatgctccaatgtatatagctgtaacaaaagcaaagaaaagagccaggaatcctcctgcagctgccaaagatatcagcagcgatatgacaatggcatttatggttgcagctagaaagaaaagcataaatacaagcagtgctgtcaaagcaacaaaagttcagtatcaagaaaagaaacagccctgcatgctttga

SEQ ID NO: 80640 - DNA, 951 bp, Glycine max
  Peptide Sequence Number=SeqID_197418
atggttaattacccatttgtccgtaaattttccaagtttcgcttccgccacactcactcactcactctgtacaactcccttgtttgtgagttgagcgaagccgaagacatgctgagaactctagttctgaagcgttcccttggtctccactcgcattttcaccacctcctgcttcggcgatgctcatcatccgcggcgcccaactcctccgcggatgcagaaacccgcaagtacgccggctacgctgccctcctcctcttctgcggcggcgccacctactacacattccccctcccggacgacgccaagcacaagaaggcgcagatcttccggtacgccccgctgccggaggacctgcacacggtctccaactggagcgggacccacgaggtgcagacgcgcaacttcctccagccggagaacgcggagcagctggagcgcgcgctgagggaggcgcggagccgtatccggccggtggggtccgggctttcgccgaatggtatcgggctttccaggaccgggatggtgaacttggctctcatggatgggatcttggatgtcgataagcagagcaagactgtcagggtccaggccgggattcgagtgcagcagcttgtcgatggcctcaaggaccatggtcttaccttgcagaattttgcttccattagggaacagcaaattggtggcattattcaggttggtgcgcatggaactggtgctagattgcctcctattgatgaacaagttattgccatgaagctggtcacccctgccaaagggacaatagagatctcaaaagataaagaccctgaactgttttatcttgctcgatgtggtcttgggggacttggagttgtggctgaagtcacgcttcagtgtgttgatcgacaggagcttgtggagcacacagttgtctcaaccatgaatgagattaagaaaaatcacaagtaa

SEQ ID NO: 80641 - DNA, 454 bp, Glycine max
  Peptide Sequence Number=SeqID_197419
gacgaatgacctcgagaagtatttaggggtcctcatcattcataataaggcctctcgacatacttttcaattcatctttgataagttgaatcaaagactcaatagttggaagtctaggaagctttctttggttgttcatatcactttcaccaagtcagctttggcggttgtgcacgatgatttggataaaatgcagagaaccgaattctggttggacccgtggattccacataaggttccattggttagtaaagcctttcttttcattcctgaacctgagttaacaaagtatgtggttgattattgcaagcctgactggtcatgggatcttagtagctttgtcctgtatttgcctcaggatattttggatattgttgtagctcttcccactctagctaaagctcctgatccaaatatccttgcatggaatcattcaataaatgggttgttctag

SEQ ID NO: 80642 - DNA, 321 bp, Glycine max
  Peptide Sequence Number=SeqID_197420
atggttattagagcaaaggtcacgagtttgattcctagtgaggaaattgctgagggggagattgtttgtcgggttgtgatatcaattatcccgtggcagaggcctgggtggatcaactttttgagcaaccctaatttgcagttgatccgaaagaaggtggtaaaaagtgtcaagcaacaaggaagcaactctgaattatatggaaagatgcaagttgtgtttgtagaaatggatacaacaccaacaacaaaagagttggagaatttgaaggagcctgtaatgaaatctaatgaaaagaatgctgccaaaggaaaattttga

SEQ ID NO: 80643 - DNA, 1302 bp, Glycine max
  Peptide Sequence Number=SeqID_197421
atgggaccttttggaggaataattcaagatgtcaaaggaagggttgaatgttataaacatgattgggctagtgcaatctgttctggcattaggatattggctccaactttctacatattttttgcgtctgctcttcctgttattgcttttggagagcaacttaacagggatacaggcggaagcttgagcacattggaaactttggcatcaactgccatttgtggaataatccactcaatatttggtggtcaacctttgttgattttgggagttgctgaaccaactgttataatgtacactattctttatgagttttgcacaaaaacgccagagttaggtgccaagatgtttctgccgtgggctggttgggtttgtgtgtggacatcattcctgctgattattcttgcaattttcaacgcatgcacaatcatcacaaggttcacaagaattgcagaggaattatttggcatgttgattactgtccttttctttcaagaggctataaagggaatcataggtgagttcaacacccctaaggatggaaatcttttgttagaggaaaatcaattccattggcggtatgcaaatggactacttgcaatcattttatcttttggactacttatcactgccacgatgagcagaaaagcaagaacatggaaatatggatcagggtggctacgaggtttcattgcagattatggggttccaatgatgttagtgatttggactggactatcttatactctaccaggaaaaattccatctgcagttcctagaaggctagtttgtccacttccatgggaatctacttaccactggacagtagtaaaggatatggggaaggtacccttgggatatatctttggggcatttattccagctgtgatgatagcaggtttatacttttttgatcatagtgtagcttctaagatggctcaacagaaggaatttaatcttcaaaaaccatctgcctaccactatgatattttactacttggtataatgactctgatttgcggtatccttggccttcctccatcaaatggagttcttcctcaatcccccatgcatacaaagagtttgacagttcttaggaagcagaggaattggttgatgtgtcaagctttgaatggcaaggatattatacgaagtgcggacaacaccatgtgctttttgacctttttgaaagcgaccttcctgggtatattccacgaaggtcttctagtctcttatattttgtcctttttcttgaattcaaatgttagttattcaaacgtaatagagacaaatgggatttga

SEQ ID NO: 80644 - DNA, 1053 bp, Glycine max
  Peptide Sequence Number=SeqID_197422
atgggtttcaagatagaaaaattgaagaacatcatcatcagtcttgagaaggcggtgatggcagaggttgggaagttggtggggaggatggaggtggtggtggtatcagagccaagggttgtggtggaggttcaagaaaggcaggacaacatcaaggtggaaaatttcgttgtaatggcattcttcattgacaggcgaatatgctcattctcttgcgtacgaccagaacttgttgagtatacaattacaacatcatggtcacctttatctcgagagttggcttcattagaagttgttgactgcttggacgcaagatcccggatgagtggttcaacttcattagccatagctgcattggatgcttcatcattcttgtccatgacactcgtgtttgttaggtcaataaggaccccacacacaatggtgttgtctatagctgtagcagagggtttagctagaacagtggtgcctcatggagctgagtcaatgggctatcatttgagcttttgtaatcttcttcaagttgtaggttccctcatattgaatggtgggaaactggagaagacgttggatgaaggactcaccgtcattatttcttgtgaagcagacacaagcatcatcaaagtgatacttcctagcaggtcagaacacttggataacatcgtggtgcacaatagtatcacttccatcatagccagaggtggaggctttagatggagtgtgctcatagtcaaaatgcgtccagatggatgcttcaatagatatggtttcctttaccactcgttcagtgaaaaagactttagagaagggagaaagcggtgtaggattaccgtggatgaaggacagagggaaacactaggcatccatcaatggctcccttgtagtttcccttctgaacctatcaaggaagaggacagatcttccttgtttactgtgaagaaaactgccctttctttgtcatcgatatttgggttggccttggtagcccttgtcttcacctgtcgtggaatgtttgagggaagaatgaatgctcatgatacggctaaaggttga

SEQ ID NO: 80645 - DNA, 600 bp, Glycine max
  Peptide Sequence Number=SeqID_197423
atgtgtgagaaggcaaaaatttgggccaacattctgaacaagagtgtacttcacaaggttggctccaagacgaccctctctgacctccagaagttcgtgttgcttcacttgatggagaacctgccatttgactttccacacataatatatatcaacattttgaggaacctcaaaagtttaggtggtttggatgacaactactatcatgtgttctacaagatggatgagaactccaagcataccttaatagttaaggagactccaaaagtggacgcggaagccatcaacaagcgaaaacaaaagagattggccaagtccattgctgatgaagaccttggtctggacaactttggcattacatggaaaatcaagaagatcatggttgaacaacagaagaagaagaaaaccaggaaacaattccaaagggatgaagaagaggagatgttggcaaatgagcaccaaaccaaaagaaggtataagtctatctcgtctgctcttgctcatccacccgcagtaaacccgattgcacaaaggttgaaagacctaagtgagactgatgatgatggtgaaggactggtacgagtggccttccaaaagtga

SEQ ID NO: 80646 - DNA, 329 bp, Glycine max
  Peptide Sequence Number=SeqID_197424
gaggaatactttttccattaccatttttccttctcataactataagagagcatttgcttccaaagatattcaaacctaatcatcttcaagaactagatgcatctgggtacgaggaaattgttggtgctccacatattacacataatataccaccaagggaaaaagagtcaaatgaccctgacagtgatgatatgagctcagaagattattatgatgcagagatattggataagatgaccacaaataggggagaattgaagcttagaactgtaagccgaaataatagtaaaagcttcagctacagctccagtgaagacatgcaacattag

SEQ ID NO: 80647 - DNA, 255 bp, Glycine max
  Peptide Sequence Number=SeqID_197425
atgccacctaagaagattgagaataaagttacaccactaaagacggaggttcttcatggtgaagaaaccagctcgcctgggcgagctcactattgcagggtcaagttgcagctcagtgtggacgaaaagccaaaggcaaagggtcactttggggcagttgcagctcgcccaggcaagctgaaacttgatcgcgcagcagtgagctcgcctaggcgagctagagctcacccaagcaagctattttcttcaccatga

SEQ ID NO: 80648 - DNA, 930 bp, Glycine max
  Peptide Sequence Number=SeqID_197426
atgaatgatataaacaacaactttggaaagggcagtgttacaagactgggcagtgctggtggagctttggttgaaacttttcccagtggttgtttgacattagactgtgctttaggtggtggtctccctaaaggaagaattatagaggaaaagatgagttggctgccaaattccccaaatgtctctccctttcctagacaggctacttttgctactttcatgatctatattgctcttatgtcagctaatgtcaacttctttgagacctgccctttcttctcttctattcttgagtgtatgatgaccttcttgatcatatatggaccagaaagcagtgggaaaaccaccctagcacttcatgctattgcagaagtgcagaagttaggaggcaatgcaatgcttgttgatgcggagcatgcttttgatcctgcatattctaaagcattaggagtggatgtagaaaatttaattgtgtgccaacctgatcatggagagatggctcttgagaaccgaatgtgtagatctggtgccatagatctcatttgtgtggattctgtgtcagctctcactccacgggctgaaattgaaggggagattggaatgcagcaaataggattgcaagcccgtcttatgagccaagctttacgtaagatgtctggaaatgcatctaaagctggttgtactcttatatttttgaatcaaataagatataagattggtgtctattatggaaatccagaagtgactagtggtggaattgcattgaagttctttgcgtcacttcggctagaagttcgtcctacagggaagataaagtctgctaaaggagatgaagaaattggccttaaagttcgtttaagagtccaaaagagcaagtgcattacagtcaaactcagagagctagctcacaatatagaaagaacaatttaa

SEQ ID NO: 80649 - DNA, 909 bp, Glycine max
  Peptide Sequence Number=SeqID_197427
atggatggttgggatttattatgggaaatgaaaggggcacccaaaaagttgggcggtgctttagtcgaaaacggaatgagaaatgtgcaaccttgcggcggcggtggcgacgacgtcaacatcagatgtgtccccggtcatggcgaacacttttacatgcatgggtacgagaataggaagcgagacctccgtgaagacaaggaactggcaggaatcggttgtggcgtggacgagcttgtagagcaaaatggggacaacacgaatgggtgtacggaggttgacaatggtgacacagacaagtttgtggcaaacaacggtgacgttgtgggacagttcagagagcatgacaacattgatggcggtggttgtcttgctgtcaacttcttctctatgggtggttgtgtggactgcacggtagccatagggagggttgaaatattgagtggggtagtgaagagaaggtttgaaacggtagttggtgtaggtgtttggatggaaggagtggagtcacaatggcttgacggagaagaggtgggagtgtgtgatggaggaggagaaaaaacacaggttggtgatgttggaggttgttgcaggtttgaaccatgctcgtatgggaataccagaaaacttggttggggtggccatggtggtagagtggaaagggcaggtaagagtggtattggaactgtgaggataagcaagggggttgcggaggtggcagtggttcagaaggatagtataaatgtggatgtggatgtggggtgtccatggaccacagttgtggcggtgctgactgtgatggttgtggttgtgttggccactgcagtgaagaggtgggggtctgtgaagggtagtattgtggaggctctaagcgctctatgctacactactcctaaattctacaagtaa

SEQ ID NO: 80650 - DNA, 270 bp, Glycine max
  Peptide Sequence Number=SeqID_197428
atggacccagaggatcccttttgggttgatatgactgatgagcttttggagaaacttaccctagacccttctttattttttctcaagaaaattaattactataaactacacgtccatgagtcaaaaattgatgatttaaacaaggatgcaattcctggagcaaaggatgcagtgagaattgatttggtgggaggctatgctattaaaaaggtgacatcagaaagaagtgcaatatggattaattctttcatcatattcttcttgcagtga

SEQ ID NO: 80651 - DNA, 993 bp, Glycine max
  Peptide Sequence Number=SeqID_197429
atgaaaaaaattagaaacagcattcccccagtaatcccaacggcttgctccatgggagaatgtggagcagctctgcctagcttactgcccaaagaaaatagcaagatgcaaaaacaaacctcacaaaaccagcctctacctccctataaggaggagacaaaatgtgagagaaaactggcaaaggtacccaaatcggtggtggacaagttactgaaattacaacataggtttctgtggggaggcggaccagaacaaaacaaaattgcttggatcaaatgggaggtagtgtgtcttccaaaagaaaaggggggtttgggtctcaaggacatcaacaggtttaaccttgcattacttggtaaatggaagtggcagctcctgcaacaacaatgggaattatgggccaaagtgcgggaatccgaatatggcagttggaggagtattgaagaaccaggcagggtacactacgagtcaatatggtggagggatccaaaaaaagctcttcatcactcagacaagggctcgatccttcacaataggttgagatggaaggttggaggtggagataaaattaaattttgggaggataggtggatttgtcaggaggaaacgttagcagcaaaatatcctagactgtatttgatctcatcacagcagaatcagactatccgacagatgggaactcacaaggacaccggatgggagtggaactttatatggaggcggccaatgttcgataatgaaattgacgcggccgttagttttttaagggaggttggagggaagtccatacagcagcagggattggatgtttgggagtggtcaggagatccgtcagggacaggttgccaacaaagaaaaatctacagcggagacagatgctggttgcggatatgtcatgtcctttctgcggaagtgacgaggaggaggcatcccacctattcatccattgcaccaaaatccaacctatttggtgggaaactatgtcatggttga

SEQ ID NO: 80652 - DNA, 369 bp, Glycine max
  Peptide Sequence Number=SeqID_197430
atggatttgatgttccctctgaaaccccactgtgttattctcaaggcaccactctcttcttctctcttgttcccgtttcctctcaggtttcgggctgtcaccgctttcaagcatgccaatattcaatgcgagcttgaaggcagacccaatggtgctctctctggtgacttcgaccctcgcttcattgacagggatctcagtttgcctccaccttggggctcagttttgcaccatccttcttctgtttcctcatatcccacattcatgcattcttcgttggcctcctctttgccttccctttctctagatgcgatggacactgtcaatttggtgatagcggcagtggctggggtagttggttgcagctag

SEQ ID NO: 80653 - DNA, 603 bp, Glycine max
  Peptide Sequence Number=SeqID_197431
atggttattggggagggggagtgtagagaggagatgtacatccgtctccatattgcagaagggtgcgatccagttaacaaactttactactacgacttgtccaaacttcctaatgcgctggaagactttcggaatggaaattccctcctcctattggccaaacttattgataactttgatgcacagtatgaagccattgccaatgatgacaccgtgtttacatttttaactaataaagatgctccaagtataccaagttctacaacaaatggaggagcagttcaagactttgattgtcttgtctcactatttggagcttctcgagtcagcgggcgcccattgaacccaacaaagctgaagagtgagggacgttgtgtcggtgtttcaacagatgtggtttcggacgctaccaaacccgattacccgatcatgtatgccagtgtcgggtttttcaagatgacgcgctatacatcaaaggaggtcatagggaggaactggtctaagaaattcaggtcaaaatggaagacaggcataagttccaggaagttccaaagccaaaatatgattgtcttttacttggtaagctttcacgatccatgctga

SEQ ID NO: 80654 - DNA, 258 bp, Glycine max
  Peptide Sequence Number=SeqID_197432
atgccagaaccacctgcacctgaacctgcatgtgcacctgtagctgctgatgtggatatgcctcgacatgcagatgcttgccagcagatagcacaaactttggaacacatgatcaacatgaggatggttactgctagaactaaagcagacactctgaccgaacagtgcctgagattgactaggggtcacagaatttggaggatgccacttccagagatggaagatcagtcagggcagacgtcacaagggttaccttga

SEQ ID NO: 80655 - DNA, 630 bp, Glycine max
  Peptide Sequence Number=SeqID_197433
atggttagaaccagaggattgcatcgggctttaggcagagttttaggaagagccttagggagacaagttagagataatgtggaagaagccactaaagctcctcagcatcgatggccaacatcatctacatgtagacaatgggcagctacacctgttgttaaggatgttcaccatgtcgatcatgatgttgacaaggttcatcaggatcctcagaatccagttactgatgatgttggtgctaatacagagggtttttcaggcgggccccaagatataccaatgttgcaggattatgtttatcatgtggcagcctcagtttggacaggagagatagaacatcatgagttgaagttggcctctcataggaggaaggtagagaaatttgaaaggcttgcacctgagattgaaggcatggtggttgcttcaagattaagttctctaattacctgttcgttggacactagtgataggggacttttaccttcttttgccgagaggtggcacaaggaaacaagcaatttccatctaccggtaagagaggtgactattaccctctatgatgtggcatccttgttacatctgcctattacaggtgccttccataccttcaatcctcttgatgtagactaa

SEQ ID NO: 80656 - DNA, 360 bp, Glycine max
  Peptide Sequence Number=SeqID_197434
atggtgtggcatctccaatcatatttcttccttctccattctgctgccattgatcttcaagaagcaaaggactttattgatgaacaagatccaaggcctagaagctccacatggagctacatcaccaatccttataatccccacacattcaccatcgtagacatattaacttatgcaatagatgttactttggcagcatgttgtttcaatcatagttgtgaaacccagtttggtccggccagccggactggtccaatcgagacccggtggcctaattggaccggttccactattcaattggtcatgaaattggcccgggatgaaccagccaaacccggtcgattaagtactggatcctga

SEQ ID NO: 80657 - DNA, 1113 bp, Glycine max
  Peptide Sequence Number=SeqID_197435
atgccgaggcccggccctagaccttacgagtgcatgaggcgagcttggcacagcgagcggcaccaacccatgagaggttccatcattcggcaaattttcagggtcgtcgcggaggctcactccgcggctactaagagcaacaaggagtggcaagagaagctccccatagttgtcctcagagccgaggaaatcatctactccaaagccaattccgaggcagagtacctcaaccccgacacgctcttggaccgactcaatgatgccatcaacaccatcatacgcagagacgaaaccaccgagaccggtcagcttttgccgccatgcgttgaagctgcacttaatattggttgcaagccagtgagaacatcaagaagtgataggcataaccccagggcttaccttacctccagacatcaactacatccttgttctatttctcccaaaactgttgccaacaatgctttaaactttcttccagtgtcggattctgatgatcacaccaacaaaaataactattcctcattagacactttggcttctgttgttcttcatcaccaacccttggcagtggaaactaacccctcattgagcctgggttcggtttacccattatattatggttttgaagtcaaagagcctcaactaaggaccagcatccgaagaagtacttgttcggatacaatatttgttggaagaccggttattagtccagccttggagccatgtagaatggatctattagaaaacttgtcctgtggtagagtctatcatgctccaaaaagaattatgaaagaaaatgctgtaagcgttgcaggtgagtcgcaagatggggaatgtgatttgtctttgaggttgggtatatgtttaaagagcaacaaagcaagttcagcatatggatcagaagatattgggttaagagtgtctgaagagggcaggaaatttggccattcgtctcgacagaaaaatgaagggtactgtttttaccctagaggaacagctgaacctaacatgcaattattccatgatgttgaagatgatcaaaatgctggcaacttttcagaagtacagtgtgcttctagcatatttgcatttgcaattgaagttggtccatga

SEQ ID NO: 80658 - DNA, 429 bp, Glycine max
  Peptide Sequence Number=SeqID_197436
cttgagaggattgatggggacccggtgttgagagaaacgaggatatgggctacgtgggagtacgtgagctcagttgggggtgggcaacaggggatggtgggtttatgcgcgatttgtggatgtggaaaaaacttgttgtgcaccatcgcccgaccgccacctagtaccacatgtgatggagtggtacctggagatatgtcgcgggggtcaggagaccttggggacgtcaggcgagctcctggcagtcaacagataaaaggaacaaagaccacaaagcaaggaggcttgtggtggctggccagctgtgaattttgtgtgatatatgggttgtggcctctggtaatcgattaccaagggtttgaaaacgaggtcaggaagctaggagagcttctggtaatcgattaccaaaggggtgtaatcgattaccag

SEQ ID NO: 80659 - DNA, 1017 bp, Glycine max
  Peptide Sequence Number=SeqID_197437
atgaactggctgtttcattatcttgattttttcaatcagcctatcggaaactggaatacttcaaaggtaactactatgatccatatgctacacgaatgctatgcctttaaccaggatctttcttcctgggacacctcaaaggtaacagatatgagggcaatacttggcaaaacaacgaactttaatcatagtcttggaaactggaatctgaattctttagtgctcgcttcagggatgcttaccggttcgggactaagctgtgaaaaatataataacactctcatgggttgggcaaataatccagcaactcccaacaatctgataatcggagatgtttctccaatggcttactcatctcagcccgcactcaacgcaagaaataatcttatcaacaccaaaggatggaccataactggtgattactacaatactgaatgttcaggaaaagctcaaaatgaatttatcaccgtctggaaaccaagccttccccgttatgcaacacagtataccgggatatctgtagcttctacagatacacagatctggcttcctgctgtaggaaccgattttcaggtatactgggaagaaattggtttcccggcacaccatgccacattaaccaatctcaactctacttaccaagtactgatcgactttgggacccctttaaaccctaatccagcagacgcaacttatcgtttaaaaataactaatggcactggtaattttcataggatccggttttccaactgggatatgtttaatggtgatggcctgataggtgatgtgcataaaatagtaagattggaacaatggggaaacatccactggtcttctatgggacaggcatttcagggttgcagagacttcgatgtaactgccacagacactccagacctgtcagccgttacagatatgtccaatatgttcttaggttgttttcttttcaatcagcctgttggaaactgggacacttcaaacgttaccatgatgggaataacattcagctctgctttg

SEQ ID NO: 80660 - DNA, 285 bp, Glycine max
  Peptide Sequence Number=SeqID_197438
atggcttcagaccttgggcacattcctgtcagacctatccattcaatttacctgccaaagcaagcctatggaattagttggtacttgtttactaatgcaattgagacgatgcactcagtatcctttttggccattggctccaactaccaaagcaagcctatggcattggttggtatgaatcttacaaattcaacccatatgtcttactcacaaatttgtagatacttgtttactaatgcggttcaggccatgcacttagttgaaaaagatgatggaactcaataa

SEQ ID NO: 80661 - DNA, 300 bp, Glycine max
  Peptide Sequence Number=SeqID_197439
atgtgtggagcaatttttgccctatccaaaaatgggaggatgtataatgctgttaaaatcttaggcaggtattgcatgtcattcactcaaccaaggattgagcggttatatccacttgcaactagctactccacaggaggacactgcagcagttaccccataggtgactccatagcctctaccagagcatatcatttcagagctggacctgacatcctctcagccagagccatctgcaccagtgctggacttgcctatttctcaggatccactatctgcaccagcactggacctgaatga

SEQ ID NO: 80662 - DNA, 552 bp, Glycine max
  Peptide Sequence Number=SeqID_197440
atggagacagagacacctgtggtcgacaaactagtcagattacagaggaattttctatggggtgggacacccgagcaaaacaagattgcttggatcagatgggatacagtgtgtaagccaaaggaagaaggaggactgggagtcaaggacatcaccgcgtttaatacatcattgctgggaaagtggaaatgggatttgtttcagaataaggaggagacatgggcaagggtactacaatcaaagtatggcagttggaggaatccgaaaggagctccgagggcatggaggttactcaaagacagattgccaaccagagataatttgagaaggaaacgggggaacaaatggaaatggtggtggttagcactcacttggactatttggaagcacagaaacagcattatcttctccaatgctactttcaacgctcacaaagtaatggatgacgcagtgtttctaatttggacatggcttagacacttaaaaaaggatttcacttatcattacaatcagtggtcttcaaatctcaaagaaggttttcttcggacatga

SEQ ID NO: 80663 - DNA, 144 bp, Glycine max
  Peptide Sequence Number=SeqID_197441
atgtgcgggagccgccatcaacgtttattcgaggaaaacgttagaaaaaccgaaacgaggtttgcgaatattgaaaataagggctcaggagttgtttacgcatggggaagggtcgacaagggtgttgcccttgctcctacataa

SEQ ID NO: 80664 - DNA, 2325 bp, Glycine max
  Peptide Sequence Number=SeqID_197442
atgaagatgtttggaatgtgtggtggtagcgacgatgataatcacagagatgatgaagacaaaagcccgattggggcaagagaagatggcagccaatacagcctcacaggagttcttcttccgtctctcggggccacagctattcgcaatggcagcggtagaccaaagtttcgccaatacattgtctcaccatataatcgtcattacaaactatggaacacgtttcttctgatattggttttctacactgcttggatgtgtccatttgaatttggtttccttgagaaatcaaatattgcagtggctataacggacaatgttgtaaatgtgttttttgccatcgacatcgtgctcacattcttcgttgcctaccttgataagtcaacatatttgctagttgatgaccacaaactcattgctttgagatatgctaaatcctggttgatcttggatgtcattgcaaccataccttatgaagttgttattttaattttgccaccttctcttcagatatatagttacttcaattttcttcgcctttggcgcctccatcgagtgagtgccatgtttgcaagattagaaaaggacaggaactataactactttttggtgcgttgttgcaagcttacatgtgttactttattctcagtgcatgctgctgcatgctttttctattttcttgctgcacgggataatccagaatctacatggcttggacttgttcctgatgccattgaccagaatctatggggaaagtatgtagtagcaatatattggtccatagtgacccttgtatcagttggttatggtgatctacatcctgtaaatacaaaagaaatggtatttgacattttttatatgctctttaatcttggactcacctcatatctgataggcaacatgaccaatatggtagtccactggacagaaagaactaagagatatagagacactgtccaatctgcctcaaattttgcccataggaaccacctgccaaatcgtttgcaagaacaaatatttgctcatttgcttatgaagtacagaactgatttagaaggactacaacagcaagagatcattgattctcttccaaaagccattcattctagcatctcacactacctattcttttcacttgttgacaaagtgtacttgtttcatggagtatcaaatgacctactttttcaactggtcacagagatgaaggctgagtattttcctccgaaggatgatgtgattttgcaaaatgaagcaccaacagacttctatatattcgttacaggagctgcagttgttggcgaggcaaagtctggagatgtagttggggaaataggagtgttatgctataggccacaattgtttacggttcgaaccaagcggttgagccagatcttgcgtttgagtcgaacctcatttctgaatctttctcattcaaatgttgaagatggaacaatgatcatgaacaattttcttcaaaatttacatgaatcagaggatccactgatgaaagaaattttggcagaaacagaagcaatgttagccagaggaaaaatggatttgcctattagtttattgtttgcagctagcagaggtgatgatatattgttgcatcaactgctaaagaagggttcagatccaaatgaaccagataaggatggaaagacagcattgcatattgcagcttccaaaggcaaagaccattgtgtagctttgcttctagaacatggggctaatcccaacatcaaagacttagatggaaatgtcccgctatgggaagcaatcaagggtgggcatgattctgtgatgaagcttcttatagacaatggtgcagacatatcatctggcgatgtaggttctcttgcatgcatttctgttgcgcaaaataacttagaattactcaaggatattgttcaatgtggaggagacgtgacacggtccgcaagcaacggaagcacagcactccatgctgcagtgtgtgaaggaaatgctgaaatagtgaagttccttctagagcatggagcagacattgataagcaagatgatagtggcttgactccaaggattttagcagatcaacaatgccacgaagaaataataaacatattcaagaaagttggacaaaacaaagcaccacatggtattcctacaacgtcctttgttgcaaggtgtcaaagtaaacccactatactaggcattcatcaaggaagcaagccacctaatgaagaagtgacatggtttgataatcatcaaagaagaaagatgagccctttccacaattccttttttgggataatgtcaacggaaaattatggagctaaaacttga

SEQ ID NO: 80665 - DNA, 396 bp, Glycine max
  Peptide Sequence Number=SeqID_197443
atgtcacagaacagggttttgaaagagcataacaagactttcctagattggtttaaagatacaatctttgttaatgataatgcttctgaaacattaagaaagctagcagatggacctaaaagcaatgttataacctggcaaggatatgatatacacaagtatttcttctatacaaaagcacaagacgataaaacttccatcccttactttggtttcattaaagaaatttgggagcttaactatgtgaaattcactgtctattgtagaagcaagcttcatgatgaatcaagattgattcaaagaagttttgatgatgacaaaggtgatgactataagctcaaagatcaagagcaattcatgataacaaagatgatgatctcaagaatcaaagaatga

SEQ ID NO: 80666 - DNA, 1197 bp, Glycine max
  Peptide Sequence Number=SeqID_197444
atggcacaagtaatgacgatgatatggaagttttaccttcagtggaaaattccaatgacaagagccaaccaaactccatcaacaagacctcttgagggttctgtagggcttcacccctttttcttcacaaggtttatgatgagtggctttaatgatttttccatcttctcttggaatgttagagaagcctctattttcaatacatggcggaaattgagggatgttatcaagggatatcatccttctatgtttgttatttatgagacaaaagacaatgttcttggttttgctccgtggtatatgcctctcctatctccaagctctcgtaactctttgcatcttatccaaattggtgaatcatttgatgggacatggatagcattaggagaccttaatgaggtcctttcggtatctaagactatgggaagttccttctcttattcccgggctactactttttctaattgtataaatgtttttgaccttatggacattaacactatgggtggttgttttacttggagaaggcacactaataatggctctcgcatccgtaagaaacttgattgttgtttagcgaattctggctggagcatcatgttccctcatgtgcttggagagatttttcctactcatggttcatatcataattctatcctggtgtcctttttgaaacctaagagcaagaagtttaaagttttccattaccagacaacttgggtatctcatcttgattacgctcctttggttgccaacacttgggtgaatattgcatgtagtactttaaataagttgggggtggttaaagatgagtccatcaagtttaatgtggatatttttggcaacatctttagatggaaatgtcatattgagaccagattaagtggggtccacaaaattcttgataatgcttatttttctgatttggttatgctagaaaaagagcttcagaaggaaagtgatcttaaaaatttccaagatgctagcaagtaccaacctcatgcacttcctatttccaaccttcctttcattgatcaacatatgttacaagctctcttgaagtctgtgtccatgattaaggctatctcaaaagttatggtgcatagagttcggcctttccttaattctaccattggcccttatcagaatagttttattttgggtaggggaaccactgataatgctcttattgcttag

SEQ ID NO: 80667 - DNA, 372 bp, Glycine max
  Peptide Sequence Number=SeqID_197445
atggcgtcgtttcttcaatcgtttctggatccgaagaagaactggttcgccgctcagcacatgaaatccctctccaaacgcctccgcaaatatgggctccgatacgacgatttgtacgatccttactacgatctggatgtgaaggaggcgctgaatcggcttccgaaagaggtggtggacgctcgccacgcgcgtcttaaacgcgccatcgatctttccatgaagcacgagtacctccctgacaatctgcaggttctaagagatgatggatgtgtgtgtgaatttgttggttacaacgaacttgttcttgttgctttttactgtgttgtcaagttacaagaaagatggatgaaaaagaaaaccgtgtgttaa

SEQ ID NO: 80668 - DNA, 3699 bp, Glycine max
  Peptide Sequence Number=SeqID_197446
atgggaggtacagatagaaagcaaggggaaaagaagaatcacaaaacccacatacctgaaggattacgtgtaggtgagcaaatcgtggctgagctggcccagaatcttgttgtgctttctgaccctcgaagccagtactttgtctttcagcaccattcaattggtgctctcgttgctcttctaccatggctgagcactcaaaatctattgtccctcaacctcaaattcgatacattgctccagcgcctcccacaggttccctcggcctactctccattgccaccactcactctggttctgcaaccaccacctgcaaccaatcatcgaatgaaattagacgttcttagatttgatggtactgatccttttggttggatctttaagatcaaccaattttttgagtatcatgctaccctagagcatgaacgactcactattgcttcattttatatggaagggaaggccctcgcctggtttcagtggatgaccagtaatgaaaaggctcagtggcacaatacctgttcgaattcgaggatttggcgaaccgcaccatcgatcttcctcctcattttctcctcagttgcagcagacctggccaagctgcaggaggaaaagttcctcgacgccaggatttccccgtggccacgaccctcgctaccacctctggttcctcctctacgtgcaccttcaccttcggtgcctcttttgccttcaccaccacgctcaccaactccatccttcaaacgcctttcgccggaggagatcacgtcgcgccgagaacgcgacctttgttttagttgcgacgagaaataccatagaggccaccgttgtgcctctagggtttttctctttgtcgcggacgaagacgaagccccaattcctaatatagccagctttgacccaggacttgacctgctcgaacccgttgacctgccccaggcccaaattagttttaattctttggtaggacatctggcaccggaaacactccgcttgcttggctctctcttcggccaccagatacagaacactaccttcagtgtagacctttacgtgcttcctatctccggtgcgaacattgtcttgggagttcaatggctaaaatccctcggtcctgtcctcactgattataactccctttgcatgaagttcttccacaatgggcatttggtagagctaaaggatacaattgcccatcatcctggtgactattttcctgaagtccgcgagttaattgccaagttcagctctctgtttcaacctccttccactctacctcctgtcgaaagcatgcttcagaagggactcattcaaccgagcaccagtcccttctcttctccggtgctgttggtcaggaagcacaatggctcttggaggttctgtgtggattatcgtgcattgaatgccatcacagttagtgacggattcctgattcccaccatagatgagcttttggatgagctaggtggcgcttggtggttcgcgaagctggatcttctacagggatatcatcaaatcaggatgcactccgccaatatcgccaaaacagtttttcgaacccattacaaacattatgaattcaaggtaatgcccttcgggttatgtaatgcgccttcatcgttccaggccacgatgaatttgattttttggccatttctccgacgcttcatcatcgtcttctttgaccatatactgatcttcaatgactcctttgaaaatcaattgcatcatttggagaagacatttcaggtactttctaaaaaccaatttgttcttaagctatccaaatgctcctttgctcagttgcaggtagaatatctcgaccatgttgtctctcacgggcaagtcgccccagttcctgccaaggtcaacgccatcagtcaatggcttagaccccaatccactaggtcccttcgaagcttcctgggcctcaccggcttttctcgccgatttattcatggctatgccaccatcgcggctcccctcgtcaaagccactaccaaggagccatttcagtggaccgacaacgaacagggtgccttcgaccaactcaagcaagtcctcgtcacctctctggtcttagccctcccggacttccaggccccattcacggtggagaccgatgcttcgggggtggggatagggacgatgttgtctcagaacggtcaccctatagctttcttcaggaaaccttttagcgtaaagctcctgcgtgcatcgacgtatgttagggaattattcgtcataacagcggcgcatatgtacttggcgcggctgatgggctatgattatcaaatacaataccattccggtgcgagtaataaggttgccgatgctctgtctcgattaccggaatccaatgcttctacatttctggaagtaatgaatcatcctgattcccatcaaaacttcaaactccttccaaatctcattctgcacaaaggacgcatctggcttcctcagggatttccaattatcccaaccctgcttaccgaataccattccaccccgacaaggggtcacatgggtgttgcgatgaccatagctcgtttatctaagaattttcattggcctggaatgagaactgatgtcactcagttcgttgctaacctctcattggactttattgtcggactgccaccgtaccgtggacacactatcattctggttgtggtggaccgcttctccaaaggcatcctcctgggaatgcttccttcctcacacactgcccatatggttgcctcgttgttcatggatatcgtcgccaagttacacggtccaccccggagcttagtttctaaccgggacccacttttccttagtcacttttggcaagaattgttccatctaagtggtacccagctgcgaatgagctcgacttatcacccacaaagtgatggccaaacagaagtcttgaataagtggttccacaattcagcttggaatacagcaacagggactaccccatacgaaataacatttggccggaagcctttcaattttccagaataccttaccggagcttctaccattgatgccgccaatgatctattaattaacagagagttcacattcactttcatttgcaagaagttgcttaaggctcaagaggcaatgaaaaagcaggctgactccaagcatagagaggcctattatcagataggagattgggttatgctgaaacttcgacctcatagacagagctccgcccgaggctctcaggctcatgccgtccttgaccaggttggaacagttgcttatcgcttatctcttccggaaggggcacgtattcacccagttttccattgttccctgctgaagccattcaaaggcccacttccactagaggaaacaacccagttaccacctgacttcatcaacgcccagtccatcataactcctctagcaatccttgatcaacgacaaacttctaccacaggggactcttggtgggaagttttggtgcaatggcaaggtatttccccatatgagacatcatgggaagattggtcaacattgtgtactgattaccaccttgaggacaaggtggtcctgcaagggcgatggggacacaagggaggtgcagatagaaagcagggggaaaagacgaatcacaaaacccacatacctgatggattaactgtaggtgagcaaatcgtggttgagctggcgcaaaatcttgctgtgtacggatgctag

SEQ ID NO: 80669 - DNA, 712 bp, Glycine max
  Peptide Sequence Number=SeqID_197447
atggcttcagactcttggaaaactgatggtcctgtcttctctatctccggaacaccaacaatcacttcagaaaaattgaatggaaaaaattatttagcatggtcagcctctgttgaactttggtttcttggccaaggttatcatgaacatctagagcaatcctcaaaaaagatttcagaagacaaatgcgagcagtggaagaaacttgattatcagctttgtgctctcttgtggcagtctgttgagccagctatactgacaaatttcagagccttcaaaacttgttattctttctgcaaaaaggcccaaagtgtttttgctaatgacattcaacaattgtatgatgctgctcagaaattgaccactcttaaacaaactgatcatgacatggttgcatatgtttcgaaagcccaatctgcaatggaggagttaaaattatcattggaagccgataaccttgaagacataaagacgaaacttgataatctatttatggtgttggtactacgtgggatgcatccagattttgatcatattcgtgaccaagtcttaactggccaagaaggggacaaggtggtcgtggaaaccgaggaggacgagctggaagaggccctcaatgttcttactgctgattatcaagagtatctccagctaaaagctgtcaaggaatctcaaacatcatctgctataagtggtcataactccactacct

SEQ ID NO: 80670 - DNA, 393 bp, Glycine max
  Peptide Sequence Number=SeqID_197448
atgtttccacaggctgattgttggaattttgaaaataacaactttgggtctctcactaagcgcgaatggcgcactaagcgcaattccaacagagagggaatggcgctgagcgcccaaaggtgcgctaagcccaattcttaccaagaggaagttgcgctgagtgcccaaagcgtgaaaaacatgatttttcactctattcttcaaaatgtcacccaaaccctaaaatctcatttttcatcacccaagaccactggtggccgccgtgagttgccattgcgtgctgttgaacccccacaccaagaggaacactttaatcagagcggaatcctcagaatcctcctcaaggattcggtggagaaaattctccaatcctccgtttcaaagcttctctga

SEQ ID NO: 80671 - DNA, 185 bp, Glycine max
  Peptide Sequence Number=SeqID_197449
gtgtcattgaagttttggtgaatagtgggcggcaaattgatgctgttaacttggcttttgcatttgatcttacagaacaattttcacccattcctttactgaagtcttacttgaaggatgctagaaaaatttcttctcctgtcagaagtgttaactcatctcccactgcacaggaatttggctaa

SEQ ID NO: 80672 - DNA, 123 bp, Glycine max
  Peptide Sequence Number=SeqID_197450
atgggcacaacaggctgcattaggttctccttaggacgatatcacgactcgcgagcttcgagcctcacctttctggcaacaaaggtggcgagattccgacaaagcgatgagagaaaaagttga

SEQ ID NO: 80673 - DNA, 296 bp, Glycine max
  Peptide Sequence Number=SeqID_197451
atggctagtgctcccactccatgcgaagagtttgtgtacatggcgaagctagtggaacaagtcaagcattatgaggagatggtggagttcatggagaaggtctttgcctctaccgagagcgaggagctaaccgaggaccaccttgtcgtcatccgcaactaccgctccaagatcaaggtcgagctctccaacatctacgacaaaatcctcaaactcctcgacacgcacctagtcccctccctcacctctggtgactcgaaggtcttctacctcaagatgaagggagcctaccacag

SEQ ID NO: 80674 - DNA, 303 bp, Glycine max
  Peptide Sequence Number=SeqID_197452
atgcttccaaagagaataacattgatgcggcatggggagtcgcaggggaaccgtgacatggcgatgtacaccatcatacccgaccacaacattcaatcaatggcgcaaggcatagcccaggtctttcgtgtcggcgagcacctccaccgcgtgataggcagcgacacctactcccctgactggcgggtgcagttctacgtgtccccctacacccgcacccgatcgacgttctacgagctcagacgatatttcttaaagaagatgatcatcgacgtgacggaaaagtcgcaagttcgagaatga

SEQ ID NO: 80675 - DNA, 501 bp, Glycine max
  Peptide Sequence Number=SeqID_197453
atggcaacaacattaatcccctcagatctcactgaatttgtgatgcttcaagggaatggagtaaagggcctctctgaaatgggcctaaagagcctcccaagtcaatacatccaacctttggaagagataatgatcaatgttttgccacaagagtccattcccatcattgacatgtccaattgggatgacccgaaagtgcaagattcaatttgtgatgcagctgagaagtggggcttcttccaaatcatcaatcatggggtgccccctcaagtgttggacaatgtcaaggatgcaacttataggttttatgggttgccacctgaggagaaggttaagtacacaaaagagaattcttcaacaaagcatgtgaggtatgggtctagctttagccctgaagcagagaaagccctagagtggaaggattatctcagcctcttctatgtttctgaggatgaggctgcaacaacatggccccctgcatgcagactactatgcaactag

SEQ ID NO: 80676 - DNA, 141 bp, Glycine max
  Peptide Sequence Number=SeqID_197454
atgggaacctccatggggttatgggaattttacggaagcattatgggtgtcccggaagccccagaatccaattttttaccaaaacaagggaggtggttgccacctagctcacccaggcgagctagattgcttccaccttaa

SEQ ID NO: 80677 - DNA, 555 bp, Glycine max
  Peptide Sequence Number=SeqID_197455
atggccagtaaccctgctagagctaagaagaaagccaaatcctcgttaaggaaacaaggagagtgctctcaagtagctttcaacaggttggatacgtggtttacaaatgaaaacaaaaggaatgacttcaagattatctatatcgtgaagaatatgatcattgatgctgcagtctggaaagcagttgtaggactagatatgggtggagtacgcaaatttgaggaatttgcagatggctacagcaagaagcatacatacaaaggtatgcttcttgatcaaacaaggaatctgagaaaccgcctaggagtttatggtttaatagttgaagataaaatgttagtgtatcttatcacctacattctggcaccaaggtcaagcaatgatgctcaagttactgacgacgacctacaaatcatatatgggctgaaattagtagatttcaccaaagcctcaaatcagataaccgaaaggcatctcaagaagcttgggatgagatatgttgatcatgaatggattatggcaagagagccaccagcaatagcaaacatcaattag

SEQ ID NO: 80678 - DNA, 636 bp, Glycine max
  Peptide Sequence Number=SeqID_197456
atgaggggtggaggttgcatagcagcttgcctaggcaagttgcttgcttcctccaggaagcaacctagcttacccaggagagctggttgcttcatcctaagctttctagtgggccaactagcaaggcaacggacaaaacattctggaggtcgattttcagcaaacactgaaacaaatcctaaggatcactacaaggcacttactacaagaagtggaaggattattgggaaagatgttgatgataacttggctatagatgaacaagtagttagaggtaagttgagtgagagtaagaaaaataagagtaaaagtgagagtgaagaggaaaccaatagaaaaaaaatgtataaacaagagaaaaataaaaatggaggtgaaaaggaaaatggagagtgtgaatctaggaggaccaagaatcaaagacaaactgaacaagacataacacagattatcaaacaagagaatcaagcacaagaacataactacgcttcatcctcatccgggttcagaaggctaccaagggatagcctagtttctatgttctcaatcctagtggtaatattttctaaggagctagaacttcaacttggttctcttgatggagatgaagaatggcatccatcttttgaatcataa

SEQ ID NO: 80679 - DNA, 660 bp, Glycine max
  Peptide Sequence Number=SeqID_197457
gaaatccaaggaaagaaaatctccaaatcctctaagaagattgagaacaataacaacaactatatatgcttcgagtgtggtaagcaaggccatatcaaatctgagtgtcctatctactgtagaaaacatgtgtgcctaaaagcaagggattcactatggtacttggatagtggctactctaggcacatgacgggtgacgagtccaaactctctgactttgtgtcaaaagatggaggatatgtcaaaactatgagtttaggtggaaattactatgttttagtaatagtagaggattactcaagattcacttggactttgtttttgaaaaccaaaaatgaagcttttgatgcttttcacaaacttgccaagggtgtcgcaacctacccttcggcaggagggcaacgcgaggctcacgggtgcgtcttccaagggaggaaggtgcacagagtctccaccaacgtttattcgagtaaaacgtcagaaaaaccggaaaggcgtggtctacgaactttaattgtgaaaggttcgggagttgtttttacgcacggggaaggtattagcaccccacgcgtccgtcacaagggacgacaacctttaatcgaggtgtttcccttgctcctacgtatcctcaattgtgatgaggaaatcagacctacgtag

SEQ ID NO: 80680 - DNA, 222 bp, Glycine max
  Peptide Sequence Number=SeqID_197458
atgttgttgcaatctatactggaagtggaggtcttcaattgttggggcattgactttgttggtcccttaccatcatcgtatgataccaatagtcctcttgccgtttcagatggtgtatggaaagacatgccaccttccggtggaactggaacacaaagccagaaggctctcaagtttctaaattttgatccaattgcatcgggagacaaaaggaaattttag

SEQ ID NO: 80681 - DNA, 417 bp, Glycine max
  Peptide Sequence Number=SeqID_197459
atggtgattggaggtatagtactcgggcacaaaatctcaacccagggaattgaagttgacaaggaaaaaattgatgtgcttgaaagactaccaccaccatgggatgtaaaggagaagatttttcatgctatttactatgcaagcaaagtgctcaatggatcacaactcaactacacaaccacagagaaggagatgttggcggttttttatgcactagaaaaagttcaagtcctatcttgtggtagaaaagttctcaatggagtgcaactcaactacgcaaccatggagaaggagatgttggcggttgtttatgcactagaaaatttcaggtcctatcgtgtggggttgaagattgtaatcaacacaaaccacttagctattcaattcgttctcactagggcagacttaaagccataa

SEQ ID NO: 80682 - DNA, 282 bp, Glycine max
  Peptide Sequence Number=SeqID_197460
atggagggaatgatggagggaaagagaaaagtgagaagttataaagcttcccctcaattacgatatgttcacttaagcatgagcatcagctcgcttaagcaacgcggagctacagtagaagctactgtcttgcctcactcaagcaagaaaggtgccatgcttaagtatggtcaaccagggaagcccttgttagccactagcttgccttgtccgagtgggcaaggtgccatacttaagcaaggtcagttaaggaattctctgatggttacttgccttgcttaa

SEQ ID NO: 80683 - DNA, 600 bp, Glycine max
  Peptide Sequence Number=SeqID_197461
atgagaggccctctcaaagagtcaacctctttctttcttgtaaggttaaagtcctttggtacttgtacctattggcttgccttcagaggactgcatgtcctcaccttcagagggctacacgccctcgctatcagaggactgcatgtcctcaccttcagaggactgcatgtcctcaccttcgtagggctacacgccctcacctttagaggaccacacgtcctcaccttcagagggctacacgccctcgccatcagaggactgcatgtcctcaccttcagagggctacacgcccttgccatcagaggactgcatgtcctcaccttcagagggctacacaccctcgccatcagaggactgcatgtcctcaccttcagagggctacacgcccttgccattagaggactgcatgtcctcaccttcgtagggctacacgccctcacctttagaggatcacacgtcctcaccttcagagggctacacgccctcgccattagaggactgcatgtcctcaccttcagagggctacacgccctcgccatcagaggactgcatgtcgtcaccttcgtagggctacacgccctcacctttggaggactacac

SEQ ID NO: 80684 - DNA, 934 bp, Glycine max
  Peptide Sequence Number=SeqID_197462
atggaattaaaagttacaaacaaggccttcgcaattgatatttcacaaagcaaactaacagcagcaaagggagaactagtagtagaacaagaaaaatcagcagtatacgtcaaggaggtaaaggaattcaaccacgacaacgagggaatagaggaactaattaaattcctaggagaatataaggaaggaataatagaggcaactggaatatattacttctacctacacgaaaaactaacggaaaaaggatacaaggtaacagtaataaacccactacacctaacagaaatactagggaaaaagacagacaaactcgacgcacaaaggttactagtagcacacatgaccggagtaatcaagggatcatacataccaacaggagaaataatggagctaagagaactaacgagatatagggaaagcttagtagagaagacaacacaagtaaagaacgagataaggaaaatattagaattcgcgggatataaaatacaaccattcgacaagaagggaagaaaactacttgaaaagctagtaaagggggagggactaagcaaggaagagaaggaggaactaaaagaaaaactagggagaaacttaaacgacgcggaaaaactagcgttaaaacaattagttgaactgttaaaaaacttggagaaaatgattaaggaggttgaggatatgataatttccaagattccaaaaccagtaattgagttgagtaagatccccgggattggtttgattagtgctgcaactatttacgctgagttcggtgatgtttcccgtttttccagttctaaggctgctagggcttatgcaagctttgcacccaaaactaagcagagtggtgatagcgagtctcactccggtatgattaggggtaataagtatttgcgtagagctctctacttggttgccaaggttgctaggg

SEQ ID NO: 80685 - DNA, 450 bp, Glycine max
  Peptide Sequence Number=SeqID_197463
atggctgaagcagcaaaacctgtcaacaatgtcgacgcttccaaccccacgctactgattgcaacctttgccaagccgctgcctgacgtctcaaaaattgaggtgttcattggccaaaacttccgtcgttggcaagaatgtgttcataccttgctggacatgcatggagttgtcttcgctctttccactcccaaacctgatgtcgttgatgatgctagtcaacttcaacaatggattcaagccaataagatagagattcatcatcgccaactactaccgttggactatgaacgaggaaaaagacatcaagatacaaatcacaaataccacaagctgttggaagatctaaagattgaaaacatctctctgcctgacgagttcatttctgaactcctgattgagaagctgtcggagtcctggacaaattataaacaacagttaaagcactga

SEQ ID NO: 80686 - DNA, 381 bp, Glycine max
  Peptide Sequence Number=SeqID_197464
atggcgctaaaagctgtaaactataataaactcccctcacctattatgagctctccttcagttcctctttgcttttctcaaaggtctctctcattcatgctcgtcagtccaaacgcaagcatgcaaattcttgctcagtgcaacttcctctgcactatggctcgcttagcgggccaattctcgctcagcgcaattccctctcaggttggaattgcgcttagcgcgcccttcgcgcttagcaagacatcaaaagttgttattttcaaaatcctaatgctcaaactgtggagaaatgtcttaggaagctccagacaaaatttgaagatgatccaacggttaacgaatctgggatcacgattttactggaataggtttaggtaa

SEQ ID NO: 80687 - DNA, 237 bp, Glycine max
  Peptide Sequence Number=SeqID_197465
atggaaatagtagtgagaaaggaccagtgcatgagaattgatggcgccaatcctgcagagctctcagccatgggtcgagaaatagtcgtggaagacggatatgaattctttgttaacatgcaacttgtacacatcttctcggtacctaagtattgtggagagtttgacaatgttggtgctgtgatgattgttgatgagacacttgtgtgcttttttcaaatattgaagcctgtataa

SEQ ID NO: 80688 - DNA, 2902 bp, Glycine max
  Peptide Sequence Number=SeqID_197466
ggaatccatatctaccgacccatatggaattttcctctcttggaataattctgctcacttctgtaactggcatggaatcatatgtaatcccacacttcaaagagttacagagttaaacttattaggatacaagttgaagggaaccatatcccctcacgtaggcaatctctcttatatgagaagcttggatctcggaaacaacagcttctatggaaaaatcccacaagaattgggacaattgtcacgtctacagattctctatgtggataataacacattagtagggaaaattcctacaaatttggcaagttgcactcgcctcaaagtcttagacttaggtgggaacaatttgattggcaaaataccaatgaaatttggctcacttcagaagcttcaacaattggtcctgagtaagaaccgtttaatcggaggaatcccatcgttcatagggaatttttcatccctaactgatctttgggttggtgacaacaacttagagggacatattccacaagaaatgtgcagtctcaaaagcttgacgaatgtatatgtgagtaacaacaaactgagtggaacatttccttcttgtctttataatatgtcatctctttctctaatctcagccacaaacaatcaatttaatggctctcttcctcccaacatgttctacaccctccccaatctccaagaactttatatcggtggtaatcaaatctcaggtccaatcccaccttccatcacaaatgcatctatccttacagaacttgacattggcggaaaccatttcatgggacaagttccaagacttgggaagttacaagatcttcaatatctatctttgacttttaacaatttaggtgacaattcatctaatgacttagagtttttagaatcattgacaaactgtagtaagttgcaaatactagtaatatcctacaataattttggaggtcatttgccaaattccttgggcaatttatccacccaactaagtgaattatatcttggaggcaatcagatatcaggagaaatccctgaggaattagggaatcttctaattggattaattctcttgacgatggaaaacaacaacattggtggaattatcccaactacttttggtatgtttcaaaagatgcaattgttagacttaagtgcaaacaagttgttaggagagataggagcctttgtaggaaaccttagtcaattattttatttggcaatgggagcaaatatgtttgaaaggaatattcctccaagcataggaaactgccaaatgttacaatatctgaatctttcacaaaacaaccttataggaaccatacctattgagatttttaatctttcttcccttacaaactccttggatttgtcacaaaattcattgagtggtagtatactagaagaagttggcaacctaaaaaatctcaattggctaggtatgtatgagaatcatttgtctggtgacattcctggaacaattggcgaatgcataatgttggagtacctctatttggatgggaattctttacaaggaaacataccatcctctttggcatcactcaaaagtcttcgatatttagacctgtcaagaaaccgcttgtctggatcaattcctaatgttctgcagaacatttttgtcttggaatacttgaatgtgtcttttaacatgttggatggtgatgtaccaactgaaggtgtctttcgaaatgcaagcacgtttgtggttaccggaaacaacaagctttgtggaggtatttcagaactgcatctaccaccatgccctgtcatccaaggcaagaaactagcaaaacaccacaagtttaggttgatagcagtgatggttagtgtggttgcttttcttctaatactgttaataattctaactatctactggatgaggaggagcaagaaagcatctttggattcaccaacatttgacctgctggctaaagtttcataccaaagcctacacaatggaactgatgggttctcaacagcaaacttgatagggtctggaaattttagctctgtctacaaaggaactcttgagttagaaaacaatgttgttgccataaaggtcctaaaccttaagagaaaaggagctcacaagagtttcatagcagaatgcaatgcgcttaaaaatattaaacatcgaaatcttgttcagattttgacatgttgttccagcacagattacaaaggtcaagaatttaaagctctaatttttgagtacatgaaaaatggaagcttggaacaatggctgcacccgagggcacttagtcaagagcatttgagagcattaaaccttgatcaaagattaaatatcatgattgatatcgcttctgcattaaattatcttcatcatgaatgtgagcaatcggtcgttcattgtgatttaaagccaagcaatgtcctcctcgatgatgacatgattgctcatgtgagtgactttggcatagcaagacttatctcaaccatcaatggtacaacttctaagaaaacaagtacaattggaataaagggaacagttggctatgctcctccagagtatggtgttggttctgaggtgtcaacttatggtgacgtgtacagctttggaattattttgttggaaatgcttactggaagaagacccacagacgaaatgtttgaagatggtcaaaatattcataactttgttgcaatttcatttcctgataatcttttgcagattttggacccacggctcatccctacaaatgaagcaacattggaaggaaacaattggaagaagtgcttaatttcactttttaggattggacttgcttgttctatggaatcaccaaaagaaagaatggatatggttgatctaactagggaacttaatcaaatcagaaaggcctttcttgttggtgagtga

SEQ ID NO: 80689 - DNA, 144 bp, Glycine max
  Peptide Sequence Number=SeqID_197467
atggaacacgcatcccgtgagcctcgcgtctccctcccgccgaaggtgaaactactcaaaaccatagaggcacttgctcaagctttgaaggactgcactcgtgctaggaaagaggctcgcatatggtctttaattggtgactag

SEQ ID NO: 80690 - DNA, 603 bp, Glycine max
  Peptide Sequence Number=SeqID_197468
atgactttagtgtacaataggcaattgttttgtggaatctgtaatagccatacagattgtcaatccccaaagccaaaggcaacgcaaccttctcctctggcggcaattcaccacttctctgatgccatcgccttggcctctaccagccatgtcctctattccaatcgatctgccgcatacacttctctcaaaaactacatcgagaagaagggaatatataagaagagcggcggagctaaaggagtaagcatagtagacgagaaaggagaggaagagaatcaaaagaaaaatattgagaaagggcagaagtacaaagtagtcttctatgctaaagcagatggtgcaattaatctagacgtttcatttgttggatcggagaaaggtgaaaagttggcttcaaatggagagttgcctccaggagctggagttattcctagggctgtcaagcagatttttgacacatttgagagccagaatgctgagtacagtgtgaaggaacatacagtgtgtcttgagggatttctggaatactccaatcatccatattttggtttatctcctcaaatcgaacttcttcatcaaagagattatgttttggagtga

SEQ ID NO: 80691 - DNA, 243 bp, Glycine max
  Peptide Sequence Number=SeqID_197469
atggttcccaaaaattgttttagaatgtcaggcgatgacaattttgtaaataacaagagatatctaaaatcgcacccactcacttttttcccttcacatggaatcgcgacaatctcgagagatagcaatgaagatgagctcctccatagcggcagcgagatgtcaactacgaccgacgattccgaaattgagatgctcaacatctcaagcggcaacgaggtccatgtttcgattccagtgtga

SEQ ID NO: 80692 - DNA, 660 bp, Glycine max
  Peptide Sequence Number=SeqID_197470
atgtcaaaagccaattctgagatgcaatctttggagcatgagctgcatgacagtcccaaggaggagaaagaaaatgaacttcggaaggaaatacatgttcttgataaaggagataatctatcaagcccgaacgtgtttcagaacctcaaggacaaacaatctgttgtgacaaaagaaagggacaaattgatgattgagatggaagatcaacataaaagaatggaatttctgcaaaagaattgccaggatgagcctaaaagagataatccagcagaactgaaagagaatggggatagagaggggagagcagcaagagagagagagatgggaaaagggaagagtggggagagacgagaaagcgaggagagaggggagagagaattatcgaaggccaaagtccatattgaggagctgaattggaagctttccgatatggaggccaaaatgcccgtgggtggcctaaaaaacaacaaagagatggttaagctcagaatgagactccgtggaacacaagcaaagctggattctttccgttgtagatacaaggaagcaattgatgaatcagtgttaacgaataagaagtataaagatcagttggcttcaaaaggattagaagtgcttaacctaatgaaacagctagctgctgccaaaggccaatag

SEQ ID NO: 80693 - DNA, 639 bp, Glycine max
  Peptide Sequence Number=SeqID_197471
atgaaacacaatgcatataagaagagaagagattgtcagttggaaattagagatttggctctggtgaagttgcaaccatatatgcagcattcaatggcactgagaaagagtcagaaattgggtatgaagcactttggcccatttgaagtactggatagaattggaggcgtcacatataagttgaagttacctgagacaactcgtatacatccggtgtttcatatttctatattgaagaagtttgttggtagttcaaagcagccttatttacctttaccactcacattgagtgataatggtctagtagtcgaacctaaagcagtgttggattcaagagtggtattaagagattcatctcaagtgcagcaagtgttgatacagtgggagttggctagtccaaaaaaagctatgtgggaagatattacttgggtgaaggcaacttatttgcagttcaaccttgaggacaaggttgttgttaaagggaagggtaatgtaacatgtgaaatggagggaggaattttggctcgtaattctgttagcaaggaggtacacatggcagcagatccgcatagcatgggagtcaggaaaagcacacgcacaaggagagagaatataaggttgcaaggctacacactttga

SEQ ID NO: 80694 - DNA, 414 bp, Glycine max
  Peptide Sequence Number=SeqID_197472
atgcctgcttttgacgatggtcattccaacatcagttctaaaccgatgttgaaactcctccaaaaccgatacaactttgttgttggttttctggtttgggctttcgttgttgttggtcgttgttgtcattttttgttgttatcgtggtgcttttgttttgcgttaccatctgacgcggtggaagatcttcagtatggtgtaggttgcgagacacttgaggttaagggaacgcgagagagtgtttttgaggaggagacccttgaagttgagggaggactagacgacaaggagagaggtggtgtggatgcagaggaagaagatggatatggtgacgaccccaaaagagttgaaggcggcaaggaaggaggaggagaccaagaggaagaaggccaattgggggagtccaggatgtag

SEQ ID NO: 80695 - DNA, 459 bp, Glycine max
  Peptide Sequence Number=SeqID_197473
atgaagatgatggtgcaactaatgacagctatggtatcctccaggggaatagagcccaccaaactcctccctcaagtccagcagcacaaagtaaatggacaagaagaattgattgcatccaaacggatcactcccatgcctcctaaaccggcgaatcctcaggctccgggaccagatgcaagatgtgaatatcatagaggtatacgtcattggaccaatgattgctaccatctcaggcatcggatccaagatcttctggaccatccgttgttgactttctatttgcgagggaggaatgcgtattacgctttgaagaatccatgcccttcattgcaggatgaatcagagagtagtagtatatgtaagaagagaaagacgtcccagatacaaccgctcatttcactcaaagataggctcgttcggcctaaggtgaaagacgctgttattttcttctattaa

SEQ ID NO: 80696 - DNA, 1758 bp, Glycine max
  Peptide Sequence Number=SeqID_197474
atggagtggatttttaaggttgagaaattcttcaattatcaccacactcttgatcaggattgtgtggatattgcttccattcattttgagaaggatgtgataccttggttccagatgcttcaacggttacagacggtgaatatgtgggttaagctccgacgagcattggaatctcaatttggaccctcactatttgaatgccctatggatgagttattcaaacttcaacaagttggtacgattgctgattattatctgaagtttatgggtttagctcatcgctctgaagacatccatagaggtgtagttgctcaagctcctgctgatttgttgcgtgcggtttccttaacaaaattgtataaggagaaatatttttcactgcccagtcctcgttctaccccttttacacctagaaattcaaccttatctgctttaaataatcataatactcaaaatactgcccagaaatatcccattaaaaataatttacctccattacttcctactccaaatgtccctcctattcaaaataataatgttaaaaaaataagcccagctgaaatgcagttgagaatggagaaaggtttatgctatttttgtgatgagaagttttcattcaatcataagtgtcctaatagacaacttttgttgttgcaatataagactgatgatgctgaattggagtgtcatgatagtgaagacaaatttgacagtatggctgacaactctaatgtggttattgaagaccatcatttatcacttaatgctttaaaaggtggtatgggtgtcagcacgataaggtttatggcctatattgggaagcttccagttaaggctttgccacgagttgtgaaatttcttatgttgcctattgagccagcacctttttttaaggttatggtcaggaatggcaattacatggatgctgagggcatggatggtagattctccactttacaaggagacacagacttaaccctaggcacaacccacttacattatatcagaagaatgttgcaaactaatgtggttgctgaggtttttactttgcaattaattgagaccaattcaattcaatttcccttattggagttacctacggatatggaaccagaattagccttgctgttgcactcttatagtactgttttttatactcccacatcatcacctcctccaagatttcatgaccattctattacattgattgaaggctttcaaccggttaaggttaaaccttacaggaggtttgtgaaaggttatgcatctatagtagcacctttaacagatcttttgaaaaaggactctgttaagtggtatgttagtgccattactgcatttaataagttgaaggaagtgatgacttcagctctagttttagctattcccaattttaaaaagccatttgtattggaaactgatgcctcggggactggaattggggtagttttaagccaagatgaacatcctatagcttatttttcaaaaaaactgtcatctaggatgcaaaaacagtcggcttatattagggaatttcatgcaatcactgaagccttggcaaaattcaggcattatttattgagccataagttcattattcgaactaatcaaaagagtttgaaagaactgttagagcaacgattgcaaactcctgaacaacaacagtggcttcccaaatttctgggatatgattttgtcattcaatataagcctgatagagaaaatatacatgttgatgctttatcaagaagcttttga

SEQ ID NO: 80697 - DNA, 423 bp, Glycine max
  Peptide Sequence Number=SeqID_197475
atgaacctcggccacgatcaagaggaaggttcatgggaaggtgaccacacctgggtcattggccctcgaagccaggttcttgcttgttatcatcctcgtgcaataacaatttggtgctctcgttgttcgtcttcaatggaggaaccgactcaatccaaggtgaactccgacagacttgaggactccatcaccaagctcataacccatcaattatcccttagggagacccttcacaccatgacccttaagctggacgaactcattcacaaacttgctaccgctgaatcatctggtcactccccatcgtcctctaccgccattccaccacctttttcgccttcttcttctcatggcatgaagcttgaagtcccaaggttcgatggtacaaaccctctagagctcttgcttggttccagtggatga

SEQ ID NO: 80698 - DNA, 624 bp, Glycine max
  Peptide Sequence Number=SeqID_197476
atgagggtaatgataggggcgagcgttcataggttcggagtttggaaggaggtgtatatggtgattggtaagtcgcgaaggaggcaaggaatggagctttgtcgatataatgcaaatatgaaagcaggcactggctccatcattgcgaaccaaaggacgaagttgaggtggagtgatgagatgaagagaggagtcagtgtcgcccttcaactcaacaatgacgtggaggtcaatggtgaaagtgacgtcctagacatgtaccggaatagcttcacagagaagaaaaccctcatcatcttctgcaatcaaaagaaaagccttagaggcgcatttgtggccgcgatggaacttctcatcgcaattgaaacagaggtagcaaaggggaagaggatgacgccagagaaaacgaaggaggagacaacgtgttggaagatggaattggggcagggcctgaacttcaaggcgaatctccagggtcaagccggaaatgaagcagctcaagaggaattgcggtgcgagaccgatgattcggtttgccaggacctcgaactcagaaagggtcctcatactgggaaagggcaaagcaagtctaaagagcttggagaaatatcggtcaagacatga

SEQ ID NO: 80699 - DNA, 492 bp, Glycine max
  Peptide Sequence Number=SeqID_197477
atgactaaatcaacccctgcgacgtcgtatttgcactgcttcttcttttcttcaaattattattgttacgactctttgacttctccttcatctctttggctggagaaaacccttttcgccggaaaacccaccgcaaccttcgcggttcgcgattccgcttccgagcatatgggaaaaactagttggttgataatattggttacttgtttgtgcctgcttgccttttctgatggtagagaactcaaggttagacataaaaagcctcattaccaatacaatcatacgcttgctacaatattagtggaatatgcttctgcgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 80700 - DNA, 300 bp, Glycine max
  Peptide Sequence Number=SeqID_197478
atggtgctagaaggctcctcgctatgtgaagggccgcctaacacttctagtaaagctgcaaagaagaggtcatgggtcaacgagagtggaaattgtaatactccgattgaatcacaccagaataagaaggatccagaggttgtccaggtatgggactgtacaactaaggatagcttaaaggaatttattggtactacctataccaataagatgcatctacttttcgatagtccatcacttaagaatttcatagttaagcgtgcttggcttggaatagttgtgggatgggtgaccttctga

SEQ ID NO: 80701 - DNA, 3435 bp, Glycine max
  Peptide Sequence Number=SeqID_197479
atggcgagaccttccaagctacactcatcttccgacgaagcgctctccaatgcttcgagttcctccgatgaagaggagcaagtcaacgagcagatcaacgaagaggaagacgaggaggagctcgaggcggtggcgcgccctgccagttctgctgacgacgacgacgaagtcgccggcgacaatccgccggactccgatgaagatccagccgccgatgacgctgacgatgaccaggatggggataatgttgatcccgaaattagcaagcgagagaaggcgagattaaaagaaatgcagaaaatgaagaaacagaagattcaggagatactggatgtacagaatgcggccattgacgctgacatgaacaatagagggaaggggcgtctgaagtatctcttgcagcagactgagctgtttgctcattttgcaaaaggggatcaatcttcgtctcagaagaagtcaaggggaaggggtcgccatgcatccaatttcaccgaggaagaagaagatgaagaatacctaaaaggagaagaagatggtctagcaaacacacgtctggtgacacaaccatcatgtatccaagggaaaatgagggattaccagctggctggactaaactggctcatacgattgtatgagaatggaataaatggaattctggctgatgaaatggggcttggtaaaacattgcaaactatatccttattaggttatttgcacgagttccgaggaatcaaaggtcctcatatggtggttgctccaaaatctactcttggaaattggatgaatgagattcggcgcttttgtcctgttcttcgtgcaatcaagtttcttggcaaccccgatgaaaggagacatatcagagatgaattgttggttgccgggaagtttgatgtttgtgtcacaagttttgaaatggcaatcaaggagaagtctgctttgcgtcgatttagttggcgctacataattattgatgaagctcatcgaatcaagaatgagaattccttgctgtccaaaacaatgaggctctacagtacaaactaccgtctccttattactggcacgccacttcagaataaccttcatgaactctggtctcttctcaactttcttctgcccgaaatttttagttctgctgaaacttttgatgaatggtttcaaatctctggtgaaaatgatcaacaggaggttgttcaacaattacacaaggtcctccgaccatttctccttcgaaggttgaagtcagatgttgagaaaggattgccaccaaaaaaggaaactattcttaaagtaggcatgtcccaaatgcagaaacagtattatagagccctacttcagaaggatcttgaggttgtaaacgctggtggtgaacggaagcgcctcctgaacatagctatgcaactccgcaaatgttgtaatcatccatatcttttccaaggtgctgaacctggtcctcccttcactacaggagatcatcttattgaaaacgctggtaaaatggttcttttggataagttacttcctaaattgaaagagcgcgattctagggtccttatattttcacagatgactaggctgctagacatactcgaagattatttaatgtttcgtggatatcaatattgtcgcattgatggaaatactggtggggatgatcgagatgcttccattgatgctttcaacaaaccaggaagtgagaaatttgtcttcttgttatcaactcgtgctggaggtcttggtattaatcttgctactgctgatgttgtcattctgtacgatagtgactggaacccacaagttgacttgcaggctcaggatcgtgctcataggattggtcaaaagaaagaagttcaagttttccgattttgtactgagtatacaatagaagagaaagtcattgaaagggcctacaaaaagcttgcacttgatgctctggtgattcagcaagggcgattggctgagcagaagacggtaaataaagatgaattgcttcaaatggttagatttggggctgaaatggttttcagttccaaggatagtacaattacagatgaagatattgatagaattattgctaaaggagaggaggcaactgctgagctagatgccaagatgaagaaatttactgaagatgccatcaaatttaagatggatgacactgccgagttatatgattttgatgatgagaaggatgaaagcagatttgatataaaaaaaattgtgagtgagaactggattgaaccacccaaaagggagcggaagcgcaattactcagagtctgaatacttcaagcaaacaatgcgccaaggtggtcctaccaaaccaaaagagccccgtattcctaggatgccccagttgcatgatttccaatttttcaacacacaaaggttgagtgagctgtatgaaaaggaagtacgctatctcatgcaaacacaccagaggaatcagataaaggattcaatagatgttgatgaaccagaagaggtgggagatccattgacagctgaagagttggaagaaaaggagcgcttgctagaagagggattttcttcatggagccggagggattttaatactttcattagggcctgcgaaaaatatggccgaaatgatatacaaagtattgcttctgagatggaaggaaaaaccgaggaggaagttgaaagatatgcaaaggtctttaaagaaagatacaaggaattaaatgattatgacagaattattaaaaacattgaaaggggggaggcaagaatttctcggaaagatgagatcatgaaagctattggaaagaagttggaccgctacaagaatccgtggctagagttgaagatacagtatgggcaaaacaaagggaagttgtacaatgaagaatgtgacagattcatgatatgcatggtgcacaaacttggctatgggaactgggatgagttaaaggcagcatttcgaacatcacccttgtttcgatttgattggtttgtcaaatctcgcaccactcaagaactggctaggaggtgtgacaccctcattcgactggtagaaaaggaaaaccaagaatatgatgagagggagagacaagctcgcaaagagaagaaacttgccaaaagcatgaccccatcgaagcgtgctttggcaagacagacagagagtccatcttctttgaagaagcgcaagcagttaaccatggacgattatgcaagcacggtatgcacacttactaaatgtgttatattccttgttgattacatagtttcttgctgcgtttttattaaagcagttcatgctattgtggcaggggaagagaagaaaataatgaacatatgctctatattgcgtaggataagtaaggggttgttgggttttaaagtccttggtgatttggatgtggcccagacttggcaattgatggccaggcttgccttccaaaagccgtgctag

SEQ ID NO: 80702 - DNA, 2673 bp, Glycine max
  Peptide Sequence Number=SeqID_197480
atggattctccagaaccttccaagaacaacaatggcagttcttcttctgcctccactctcaacaacaacaacaacaacgatgatgctccttcatcggaatcccctcaagttcaaaccttacttgtttacaaggaatccccctttcttagatttgtgaagactttatctccaattcccaccaaggcttctcatatgacacaaggttgtgtagggctcagttctccaccccttgtgttcaagtctccacgtattagtcaccgtgaaacacagctcacgaaaaggccccaaggcactcagtcattcggtggagtaatacctcaaagtgtaaatgaaggcaacaggcttggtgaagctcctggagattccaggacatcaaattctcatcagtcactgccagagaggtttataaatgacactcagcaggtttttgacttcaagaatgatgaaaatactcaatactacagctctccatcatgcattgataaatatttggtggatcctggggatattgatcaaatgtattcagctgaccaggatgtgcaacaacaatctacagatgcagctgaaacatcactaagtgaccaaactcattcaaagaataatatattaaattttgacaggaaagatggtcctggtgataaagtggaagaatctttgcctttgtctgaagattttaacaaggttcatctagaaaaggcagcatatggtgaagaacctgaaaagatggaaggggagaaaaatgatgttgaatggtcttctcaagagcctgcaaagttagagtccattttagctgcagatggttttgataaacgatatagtcatggtccacttcctcagtggatgcctaatcccctgcaggatgttaaaggatgtgaagattacaatgagatggtgccaacctcacatgtaactgcagagaatatcttgcaagatggttccgaggctactctaaagcaccatggcattcgtagacgctgtctacaatttggtgaagctgcctcaaatgctcttggaagaaatgtgaaactgaatgcagcttcaaacacaatgataacagtcaagccgtctgaacttgtcacttccttgtgtcctcggcgaggtagtggaaacttcccttcaacaagtcccaagccatcaggtatcgggttgcatttaaatagcatcataaatgctattccaattgatcaggctgctactactggtgtgagattatcagatagttcacaggggatgaaatccacatcttcaataaggttacaaagaatggagaatgtgaagagatccatactttcatctaatgtcgatgggcgatcattagttgatacaagaactgagagccatgaaattgatgatacagtggctacagatactggaaattctgaggacctcaaccaacctcctagcccctgcaagaaaaagaagaaaacatcagtcactgctgatgacaatggctgtaaacggtgcaactgtaagaagagtaaatgtttaaaactttactgtgattgttttgctgctggaacgtactgtaccgacccttgtgcttgccaaggctgcttaaacagaccagaatatgtagagacagttgtcgagactaaacaacaaattgaatcccgtaatccaattgcatttgctcccaagattgttcagcctaccactgatatttcttcacatatggatgatgaaaatctgacaacaccgtcatcggcaaggcacaaaagaggttgcaattgcaaaagtggatgccgatgtgagggatgtaagaatgtccatggcaagaaagaagattatgttgcatttggacatacttcgagtaaagaaagggtgagcagtattgttgaagaaggatcagactgcacttttcacaataaactggaaatgggggctagcaagactgtttatgatctacactgcctctcacctataacgccatcattgcaatgttctgaccaaggcaaggaggatgctaaatccagagttatttctggaaactatctaccatcccctgaatctgatgtcaatatgttggcatcttgtacaaactacactaagtcttctgaaaatttgcatggcagtgaagcacttctggacacaaatgagatgttgggaaataccccctatgattcccaaattgaatgcagcgatgctgccttacttcagcttactcctctgcctaatcctgagcagtctggcacttcatcattctcatctgtaccaaatgagtgtgcaaagattactcactccagactctcccatggatgtattcgccagttacctggcggttctcttcgttggcgtagttccccgcttaccccgagcactagagtaggtgaagcacaatatttacagtgttctgaatcagatagcaagctctttgacattctagaaaatgaaacccctgatatactgaaggaagcttcaactcctatgacgtctgtcaaagtaaattccccaacccaaaaacgagtttctcctccccagagttgtcatattgggattggatcaagctcctctggaggattgagaagtggccggaaatttatattgaaagctgtacctactttcccttcattgtctccttgcattaattccaaaagcaatggcgatgaggattcttgtaacagtccgagcaagtcacctctcaaagctaatgagtgccctcaacgtgagagttaa

SEQ ID NO: 80703 - DNA, 615 bp, Glycine max
  Peptide Sequence Number=SeqID_197481
atgatgctatcttctactaaagggttacaatcttacaaagacattagaacagtagcaaatgtggtgtatggtacatttaaagaagcatgctttgcaaaaggttttctaggaaatgatcgggatttcattggtgctctacgagaagctaaaacatggggatctacacacttccttagaaagttatttgtaaagttgttatttatgaataccatggatagaccacaatatgtgtgggaacaaacatggcaatggatgacaaatgatattatatttaatcatagaagacaagatgagcagggtgctattttttataagattatgtgtgttgttgcaagtcaatcaggtggagtttattttctttatggttatggaggcactgagaaaacatttatttggaaaactttatcatctgttatacggtctaatggaggaattgtcgtaacaatagtttcaagtgggattgcatcattaccactgcctagaggaagaacaacacattctaagtttgctataccaatgcttgcaacacaaaattcaacatgcaatattcatcaagggagtgacctggctgaattgctaacaattacccaactaataatttgggatgaagcctaa

SEQ ID NO: 80704 - DNA, 573 bp, Glycine max
  Peptide Sequence Number=SeqID_197482
atggcctcttcttctatcgataacaatgtacctcactatgttttattccttgatgagcttttgtctcatattcctcctcgtgtttttggttctatttgttgtgtgcattatcttactcgaggtcttgataagttgatagctcgggctatcaagtgcatctttcttggttattcacgcaacaaaaagagactagagttcgccgtcgccgtcgacaaacatgccgtcgtcgcgctggagctcgcgtggtgctgctggttgcgttggagttcgcttgttgctgtttgtgctcgtgctcctcgtctccttttgcatgcgaaaattgggttagggttgggtcgggtattacctattccttctatcatccctcatgtttcttcccctcccgtaacattttgttttcttatttatcaccgttgtcctcaaccccaacctgtggaagcaccccctactgtagagaccgatgcatcatctcctgcttcaatcgttcatcctattgtggttgactttgacttacccatcgccatccgcaaaggaagcactttcacatcgaggatggcaacaagtgatgattga

SEQ ID NO: 80705 - DNA, 1098 bp, Glycine max
  Peptide Sequence Number=SeqID_197483
atggatcctggtctatctgaagatgtggatcgagaatttcttcttagaatgtcatacatggagatttataatgaagagataaatgatttgttggctcctgaacatcgaaaactgcagattcatgaaaatctagagcgggggatatatgttgcggggttgcgagaagaaattgttgcctctcctgagcaaatccttgatctcatggagtttggagaatctcatagacatattggagagacaaatatgaatgtgtacagtagtaggtcccatactattttccgcatgataattgagagtagggatagaagtgaagatggaggaagtggcagctcttgtgatgctgtccgtgtatcggtgttgaatttagtggatcttgctggttcagagcgtgctgcaaaaactggagcagaaggtgtccgactcaaagaaggttctcacataaacaagagcttaatgactttgggaactgtgattaaaaaattgagtgaaggtgctgagagtcaagggagtcatgttccatatcgagatagcaagctgactcgaattttgcaaccttctctcggaggaaatgccagaacagctataatatgtaatatcacacttgcacagatacatacagatgaaactaaaagcagccttcaatttgcaagtagagcacttcgtgtcacaaattgtgctcaagtgaatgagattttgacagatgctgctttattaaagcgccaaaagaaagagattgaagatcttcgtgccaaattgatgggttctcattcagagcatttggaacaggagattctgaaccttcgaaatacattattacagactgaactggaaagggaacgcatagctttggaattagaggaggaaaagaaagctcaagttgaatgggaaaaaagagtacaggaacaagccaagaaaatcgaaaatttgagttcaatggttttgttttcaaacagggatgaaagtcgtgagcatattaaaaaggtcgttaaagctaattttactatgttttggatacatcctaggaataaaaatattaaattgtatgactgcatcttttggtgtactattgagaggattttgttgctcactgatagttaa

SEQ ID NO: 80706 - DNA, 585 bp, Glycine max
  Peptide Sequence Number=SeqID_197484
atgacatcaagtacattatcgagattaaccaagaggcttctcaaaacccatccaatcataatagacattggaacaagcaatttcgagcacaaaggggttctgactgcaccttccttcctctctggttctgtagaaacccaaaaagagattttgaccatcaacttatcctgccaaacaaagtcactagcacattatcaagatgagtactcaatcatcgactgcttcgaatgttgtgtcaccatcacttatgctgctctagagaaagattggatattcaatcttcacttcatgccaccactagataatcagacatgtggaaggcctctcgcaacccaaagaacacatgtgtggactgtagaacttactcaagctatgatctcagctcctcatccattggtactacccatgcatgctctaacctatgttgatgtggcaaagaagaatatgactgttatggtaaatcatggccatcttctgttgtggaagttgaccttgcatgatgctgaaaaagggctacaatgtgttgctgagccatggtaccaatatttgagagacaatgacttcagtgctggagatgagatatga

SEQ ID NO: 80707 - DNA, 231 bp, Glycine max
  Peptide Sequence Number=SeqID_197485
atggatagtatcattaaaattcttcttgttcagaagcatagcataggtgtggagcataagcctatgcagaagcttctccatgagagattatccaataagaaacaaaactacaagaaggaaagctattcagaagttggaaaggccatcatgatttcaagtccaagtctcaagaactcaaaggaaacacccctccttgtcaaaaaagaaccagcaaccaatagtagacgatag

SEQ ID NO: 80708 - DNA, 357 bp, Glycine max
  Peptide Sequence Number=SeqID_197486
atgcaatcacagggacttgcactacctctagagccagaggttggtccctcaggtcctcgtgtcagcacaaaggagagttgtgttaatccctcaaggatcgatcttgggacgggtgactcagacaaatgcgggctatacattgaagaaaatccttcccgcctggttgccctaggaagactttatgagggatccacaacagttcacaacatccctttgttgcatggccaagtgaaggttgtgttgaggaggttaaagatgcagaggctctcgttcctgtacccactgacgaggaagctgtgtctccagcaaaacctccagaaagcccgaatgaagaggtcgatgatcccctgtacctga

SEQ ID NO: 80709 - DNA, 885 bp, Glycine max
  Peptide Sequence Number=SeqID_197487
atgggaaaatgctataccacttataggtacactgccaacaaatcaatggacaattgtgccttttgcaatgctgatggtgacttcttgatagttccccaacaaggaagactccttgtcactactgaatgtggaaggttgaaagtttctccaggtgaaattgctatattacctcaaggctttcgtttttctgtgaatcttcctgatggtccatcccgtggttatgttgctgaaatttttggtactcattttcaacttcctgatctgggaccaataggtgctaatggccttgcttcccctagggatttccttgttcccactgcttggtttgaagataaatcttatcctgggtacaccatagtgcagaaatttggtggtgagctctttgatgcagtacaagatttctctcctttcaatgttgttgcttggcatgtgttgacagcaccaactgataaacctggagtggcattgcttgattttgtcattttcccacccagatggctggttgctgagcatactttccggcctccatattatcatcgcaattgcatgagtgaatttatgggcctcattcatggtggttatgaggccaaggctgatggatttcttcccggtggtgcaagtctccatagttgtatgactccccatggtcctgataccaagtcatatgaggctaccattgcacgaggaaatgatgtaggaccttgcaagatcactgacacaatggcttttatgtttgaatcgagtttgataccccgtatcagtcaatgggcctcagaatcaccgttcttggaccaagattattaccagtgttggattggcctgaaatctcattttgcagttactaagacgtctcctgaaaacccaagcttgggaaatggagattga

SEQ ID NO: 80710 - DNA, 300 bp, Glycine max
  Peptide Sequence Number=SeqID_197488
atgtatgaaatctataactatcagatctcacaaccgaaacatttccttgaatggaaacaggtcagaagctcctccacagtaccgcctcacaccaacacgatcagcaataccaacacttggactcctcctcaacaacactttttaaagtataacattgatgcagcagtcttcatagattccaaatcctttggcttgggtatgtgcttaagagattgcaatggagattttgtcaaggcaaagaccaataccgttagtggtattcctattccaaaggagacagaagcttgggctttgcattag

SEQ ID NO: 80711 - DNA, 255 bp, Glycine max
  Peptide Sequence Number=SeqID_197489
atgattcagaatgaacctattgtagaagaaccacaagaagttgcattaaggaggtctcaaagagaaagaaggctagatatttcaaaagagaaaaaagaaataccagaaggttgcaagagaattggttgtaagtgggcctttaagactaaagactcccatggcaaccttgaaggttataaggtcagacttgttactaagggttttactcaaagagatgatgttgatcataaagagacattttcactagtcacatga

SEQ ID NO: 80712 - DNA, 375 bp, Glycine max
  Peptide Sequence Number=SeqID_197490
atgcagaattcaaacagggatgtgtacatgggagcttacttgaatggtgcacattggcaaatggtcctcattttgcctaaggaaaatgttgtcatctggttttgttcgttgcataagaggccagacaactacctcaaaggaataattaacagtgctttgaaaggacttgacgatactccacaaagtaagtccaaggttgctgctaggtggattgttgttaaatgtaatagacaaaaaggaagcactgagtatgggtattacgtcatgcactggatgtcaactataatcttaggaagtttcaagaataattgggaaatgtatttctatgatgctagaccattggaaccagagagattgaaggcgcttcgcatctag

SEQ ID NO: 80713 - DNA, 186 bp, Glycine max
  Peptide Sequence Number=SeqID_197491
atgcctatcaaaagaattttgaatgcttttaggatattcgaacttgtgcatacggggaaggaaaaggacaagcatgcaaaaacatgggcacagagtgttgttctagaaaagaaagagaagggaggccctcaagatgccgtctacagtaataatttcacaaaccataagagggttttggtgaagtaa

SEQ ID NO: 80714 - DNA, 175 bp, Glycine max
  Peptide Sequence Number=SeqID_197492
gtggaatggagtggaggttctgaaacaatggaagagatactttgcaggttacatcagcgagaagaagaggcagcagttaaatgagagcgagctatggcatatgcctactctcatcagttctggagaggcttttagtactattttctcaatcacacttagagttttacctagataa

SEQ ID NO: 80715 - DNA, 519 bp, Glycine max
  Peptide Sequence Number=SeqID_197493
atggcatcatcaaaacatcacaggcaaagtctttgcttctacaacaagaagacactcttgaagagacaattagcattccgagtgaaggcaagaagaacattgcaccatctaagaggagcagtgaaatttgaggctttgattcaagatcacatggccagagaacaaacaagcagaatacaggatcagattaaagctcgcagactctatatgatagcagaagccatgattaagcaaaagaaattggaaaaacaattaaaacttgaggctaagattcatgagcttcaggatgtagaagcaaagcttcatggtgaatcaagagtgattcaaagatgttttgatgataacaaagatgatgacaaaggtgatgacaaaaagctcaaacgtcaatcaaagaatgagttcaagatattcaagatagaatcaagaacacttcaagattcaaaaggaaagttgatttcaagaataaagaatcaagattcaagagatcaagatttcaagaatcaagattcaagagattaa

SEQ ID NO: 80716 - DNA, 663 bp, Glycine max
  Peptide Sequence Number=SeqID_197494
atggcgaaaacgaggccaggcagaaaggacgtggactcgtacaccataagaggaaccagcaagatcgtccgagctggagactgtgttctgatgcggccctcggacacgtcgaagccgccttacgtggcgcgcgtggagaagatcgagcaggacaacaggagcaacgtgaaggtgcgtgtgaggtggtactaccggccagaagagtcgattggtggtcggagacagttccacggggctaaggaactgttcctctccgaccactacgatgtgcaaagtgcacacaccattgagggcaagtgtgttgtgcactcttttaagaactacaccaagcttgagaatgtgggtgctgaggattactattgtagattcgagtacaaggccgccaccggggctttcacccctgaccgtgttgctgtgtattgcaaatgtgagatgccttataacccggatgatctcatggtacaatgtgaagggtgcaaggattggtaccatcctgcttgcatgggcatgactattgaagaagcaaagaaactagatcattttgtatgttctgaatgttcatctgatgatgatatgaagaaaccccaagctacattttctgcatcactgggagctgatggcaagggaggggagtggggacacacatcgatgaaaaagaattga

SEQ ID NO: 80717 - DNA, 294 bp, Glycine max
  Peptide Sequence Number=SeqID_197495
atgccaatctacaataaccacaaccgaatagaaagatgcaaaatggtaaaggaaacataccaggcagagaagcaaaagcagacactatcaaacaagtggttacttggagatgaaagaaagcctagacatatgaaagctaaatgtccccagccaaagaaaaagcaatgttctagtgacatgaaaaagaaaagtttgatggtcacctgggatgactcatacaatgaggaaagcaacaactcagatgaggatcaaactaacatctatctgatagcagatgcagacaaacaaagttga

SEQ ID NO: 80718 - DNA, 631 bp, Glycine max
  Peptide Sequence Number=SeqID_197496
atgatggttccccatttaacgacggctttgagtggcccgctagtcccactggaaaagcgcatgctggatgccatgccggatatcgaacactggttccggacacaatggcaggaagtggctgcgccattttatgctagcgtcgatttgcgtaacgcaggttttaaattagcgcctgtagataccaacctgtttcctggtggtttcaataacctgaatcctgagttccttagcctgtctgtgcaagcagcccaggtcgccgtcgagaaaatctgtccggacgcacgccgtttattgctgattccagaaaaccatacccgcaacacctactacctgcgcaatgtggtcgagctctgtaatatcctcaaagccgcagggatggaagtacgtgttggtagtttgtcccctgaaattactgaagttaccagacttgaaacgcatgatggcctgccactgattctggaaccattagtgcgtgaaaagaatcgcctgcaattaaaagcggtgagttttgaaggtgtggattacccggcttttgatagctgtgccattttgctcaataatgatctatccggtggcgtgcctgacatgctgcagaatctggagcagacgttaattccaccactgcatgccg

SEQ ID NO: 80719 - DNA, 801 bp, Glycine max
  Peptide Sequence Number=SeqID_197497
atggctaccattttctacaatcaccgcgatggcaattttaggatcttctgcgggcgcgtaggcaataaaccaggcgtggtcgcgatggcgttcagcaatcagtttttcgttgtatttttcgttttgcttgataccgaccacctgcgccgtcccggttttggccgcaatgtcatagccggcattggcgccgacggcagcagccgtgcctcccgggcgcgtcacatccatcatgcccagtttcacgatttccagattttctgggttcaggttgagctggtcggcaattgcgtgtggcagcatttttacctggttcgttttggcatccacaatggcgttcaccaaatgtggccggatcgctttaccactattggccagtgtggcggtggcgtaggcaagctgcatgggcgtgaccagcgtgtaaccctgaccaataccaacaatcacggtttcacccatgtaccacggttgtttgtaacgcttttgcttccaggtcggggtaggcagcaagcccgagagttcaccttgaatatcaatgttggttttttcaccaaagccaaaatggcggacaaaatctgtcaggcgttcaatgccgagttcaacggccaggccgtaaaaaaacgtatcacaagaaacggtgatcgcttttcgcatatcgacggcgccatggccggaaggcttccaatcgcggtaacgatggcggctgttgggcaaggtgaagtaaccggggtcgctgatggtgaagggcggctggcgtttgccagactccagaccagccaaagccacaaatggcttgaatgttga

SEQ ID NO: 80720 - DNA, 429 bp, Glycine max
  Peptide Sequence Number=SeqID_197498
atggtagaatgtgtttggacgtcatggtggtgtcacgttctccgaagacaatggggtgaaggaatgattggggagggagagaagaagaaaggaagtggtagtgggggcaaggcaatggcgatgacaacaaaggaagggagttgcaaagagtggttgggatcgagagggaggagtgtcgaatcaaagaaagaggaagaacctaactctggggcaaaaagtagtattgttggagtacaagtgcgaagtgatgttctacatcatgtaggaatgagaaggttgaatgttatacaaatcctaggcctgaggatcccttgtatcaaaagtcttcctggaagtggatctaggtggcgtatcatgtgggtggagcgacaatgcaagtatgcagagcatgtgggttatagtgagtaccacaaaaatacttatggatga

SEQ ID NO: 80721 - DNA, 292 bp, Glycine max
  Peptide Sequence Number=SeqID_197499
atggcatcttcagatgatgagggagaggctcaggcactatctgtgtcgaattactattttgtagatgacaaagatgacgagcctgtgtgtttttccgtgttgccaattcagtggagtgagtctgagagtccagttggcaagaaaatgcaattgttcttgcacggttttgtggataatggactacagaaatttttcgggcaagtcgttgcgtggaggtttgatttttcctatgttaggcctgagatatcagtgctatcaaaggatggaagatggattatacttgagaagcctc

SEQ ID NO: 80722 - DNA, 321 bp, Glycine max
  Peptide Sequence Number=SeqID_197500
atgccatttttggcagcacttgaaccccctaaaggtcttgagtgtgtggaagcagcgtttccacaagggttcaaggagagagttcaaggaagagggattgtgtgtggtggatgtgttccaaataagaagttcattttggagcacccttctgtggggtgcttctttacccgttgtggatcattgtctttgccagaggctgtggtgaacaagtgtcagttggagctgttgccaaatcatggtgaaatggtgatcaatggaaggggggtatgctactgcttgaaggttagaatagaagtggagaagttgaaggcctttaagatg

SEQ ID NO: 80723 - DNA, 525 bp, Glycine max
  Peptide Sequence Number=SeqID_197501
atggttctggaagataaggatatgctgaagattaaaaaactttctgatgaggaagttaaagatttagcacgacctggatttataattgatgatattgacaatggtatgattgatgaagattcagatggagaggatgagttgtttgattctgtttgtgcgatttgtgacaatggtggtcaacttttgtgttgtgatggaaagtgcatgaggtcatttcatgctaatgaggaggatggtgaagaatctacttgtgcctctcttggttttagccggaaggaagttgatgagatccagaacttttactgtaaaaattgtgaatataatcaacatcagtgctttgcatgtggcacactaggctgttctgataaattttctggtgctgaggcggtgccccaagtcgtatcatcgcaaatgcttgccaaggacaagctgaaagtatatcttgcacctgttctatacggtaatcgagagagagagagagagaattcaactcctgtgagaacactctcttatgtgagaacatga

SEQ ID NO: 80724 - DNA, 228 bp, Glycine max
  Peptide Sequence Number=SeqID_197502
atggttgtggtgacgacaatcatcgtggtggttgcaatggtggtcatggtggcgaaggtggtggccgttgacgacaatggtggtgatgatagtggtggtggctgcaatgatggtcatggtggtgacaacgacattcatggtggtgatggaattgaatatggtatcaggggtttttcaacacttacacaccctgctcaaccaattgagctagatcccttggttaattga

SEQ ID NO: 80725 - DNA, 429 bp, Glycine max
  Peptide Sequence Number=SeqID_197503
atgactttgttgttcccggaggaacaaaaggtgcagaagactgtgtcagcccctgcatgctatcaagcgttctgtcttacagatagcaaaagaatgggtgcgaataaccataaggtatctccgcgtatcatgggtatctccgcgtatcatgggtgcataatgaccaaacttggtctctgcgtgtcatcggacccgactgcgtctgaatggcaacagggggtgcgaataaccataaggtatctccgcgtatcatgggtgcagaatgaccaaacttggtctctgcttgtcatcgggcccgccgcctctggacaacaaaagggtgcgaataaccataagggtcagtatgattatggggcggccgacaaaagcaaagctcttgctcctacgtatcctccaatgaggaactcagacctacgtagttctggataa

SEQ ID NO: 80726 - DNA, 493 bp, Glycine max
  Peptide Sequence Number=SeqID_197504
atgagcggcgagctaaaggcggttgccagaaaacacactgaaaagagaccgcggaagggaaaagaagctggaaaaatgaacggggacattgctggaggtggaagcgtgccagcaaaggcatcgatacacgctagagaacgatcagtggatggctatgttgatggtggggtcagcggctggagtggtggtcggagaagtggcggcggcggccgaaaaagaaaagtcggaaagggaggacagtatgtccctggtgggggatggtttttgttattctctcaacctgactctgattccacgctagatgaaaaacggtcgccttatgatcttgtctgggacgataagagttttctattgggaaagtcattttatctactgggatcagttgatgcaaacgacaggcagatagagcagtggaatgtaaagccacccccactctacctttggagtcgtcctgattggactgataagcacaaggtcatagctcaggagcatg

SEQ ID NO: 80727 - DNA, 633 bp, Glycine max
  Peptide Sequence Number=SeqID_197505
atggatcatcattccacttccaaaacctctctcattcttttcatatccctctcctccctcctcttcctcgcaaccgccacgcgcaacatccacatcggccgtcccgacatccactccgacatcaccgaattctgcaagaaaaccaccaaccccgccgtctgcgcccagaccatccaaccccacttcctcaaaaacaacctcgaccccttaaaggcactcgacgtcgaagttgatgccacactggcctctgccaaaaaaaccctaatcgacatccaaaccctagaatccaaaaagggcatcaccaaatcaatcaaggactcgttcgacacgtgcaaggaccagtacggcagcatgctcgacgccatcaaggaaacaaaagccgcgattgctaagaaagacatcatcaccgctaagttcaagtttagtgctgtgttgtcgtaccaaggggcgtgcaaggacgcgtttgagagtgggaaaatcccgttctctgaagactctgacgcggtttacaacctcggagggaattgcttggatattatcgctgacatggagaaagctgcgggtcctcagaaaatgccaccagtgcaacaaactccttctgcatttagcaacgtcatcggaaccataaattga

SEQ ID NO: 80728 - DNA, 240 bp, Glycine max
  Peptide Sequence Number=SeqID_197506
atggagtggagatttcatcaccgaacagaagtgtctacttcggcaagtgccacacagaggtatgtggaagtacctggggaagctgaagattccataaaaataaaaacattttggtggaaagttcttcataactttctacctaccaaaggaaatttgttgcataagaagctttatacgctgtcctctttcgcaaccccctttcacatgcaggaagcaaattcaattattgtagggatataa

SEQ ID NO: 80729 - DNA, 1137 bp, Glycine max
  Peptide Sequence Number=SeqID_197507
atgaaccctttggatccccaagaatttaggaggcaagggcacatgatcattgacttccttgctgattattaccagaatatagccaactatccagtgttgagtcaagtagaacctggttatcttagagaactcatgccatattttgcccctctcaaccctgaaccaattgaaaccatccttcaagatttgcagcaacacatagtccctggcattactcactggcaaagccctaattactttgcatactttccctccagtggtagcacagcagggtttctaggtgagatgctgagcacagggttcaacttggtagggttcaattgggtgtcttcaccagctgcaactgagctagaaagcactgtcatggactggctaggtcaggttctgaagctcccaaaggcttttctcttttcaggtagtggtggaggtgtgttgttaggtacaacttgtgaggccattttggtcacactagttgctgctagggataaagtacttggccaaattggtagagaaaatatttgcaagctggttgtttatgtctctgatcaaacacattgtgctgttcagaaagcagctcacataataggaattcaccacaaaaatattagggctgtcaagactatgaagtcaacttcattcactttgctgccagagtcactgttatctgccattcacacagatgttcaaaacgggttggttccttgctatctttgtgccactgtgggtacaacttcaaccactgcagttgatccattaggaccactgtgcaaggtggcaaaagaatatggcatgtgggtccatgttgatgctgcttatgctggaagtgcatgcatttgtcctgagttcagacacttgattgatggagttgagggtgcaaactcttttagcctcaatgctcacaagtggtttctcactaacttagattgttgctgtctttggctgaaggatccagcttctgtgattgagtccctatcaacaaattcagtgtacttagacaacagtgcttctgattcaaatcaagtggtggactacaaggactggcagataaccttgagcagaagatttcgtgcactcaaagtttggcttgttctgagaagctatggtgttgctaatctaagaaacttcctcagaagccac

SEQ ID NO: 80730 - DNA, 711 bp, Glycine max
  Peptide Sequence Number=SeqID_197508
atgcatggagtgaagctcatggctgatggaaacagccctaacaccgatggcatccacgtcaaattctccaccgatgtcaccatccttgcacctagaattcgaactggagatgattgcatctctgttggccctggttgtagaaacttgtgggttgaagatgttgcatgcggacctggtcatgggataagcattggaagcttaggatgggacttggacgaacctggtgtgaaaaatgtgacagttagaaaagccacattctctaaaactcaaaatggttttagaataaagtcttgggggaggccaagcagtggatttgtggaggatgtccattttgaacatgcaacaatgtctgatgtccaaaaccccattataattgaccaacattattgcccatttcgcaatggttgccctagtcaggcctctggggtgaagataagtgatatttcatacaaagacattcatggaacatctgcaacgcaagttgctgtgaaatttgattgtagttctgagcagccatgcgaaagaataacgttggaggatattagattcacttacaagatcaacaaagctccccaagctttgtgtaatcacgctggtggaaccacattgggtatagttcaaccgattatccatatgataagtaatgaccaaaggaagggaactgcttggggcacccaacggtacacccagcagtttaccgatatacggtga

SEQ ID NO: 80731 - DNA, 1281 bp, Glycine max
  Peptide Sequence Number=SeqID_197509
atggcaacactcacacagcgaacagtggcatcttccattttccattcccacacactcccacggaaaccatgcttcttcctccgctttcgctttccctccactttctgcaacttcacattttccctttccaatttcgccgtgaaatcttcttcgcgcctcgccgttatctccgcttcatcctcctccgagtaccaccacaactcctcctcatctccagacatcgccgtccttctcgaagtcgacggggttcttatggactcgcaccgcgtcggaaatcgcctcgccttcaataaagcgttcgagaagcttgggctcgattgcgcgaactggactgaacctgtctattcggatctttcaaagagaagtgctggagatgaggaaaaaatgccatattctgttgtcattgtctctaataagcagattgggtggccttcttcgttacccacaaatgagcagggactttttgcgaaaagagttttacagcaaaaggaaaaggcgttagaagagtttgtgatgtcaaaaagtctacctttgcggcctggtcttgaacagtttattgatgatgcatataatgaaggagttccagtggtaatattaacggcctacggtaaaagtggtgataatattaccggagatgttcttgatcactcagaagctcagcatactgatttgcttacaaaatctttctttaggtgctgtaaggggtccataatggaaaagcttggtgatgatcgaagcataaaggtcattattgtagggaataaggaggttgaacaaagtttatatggacaactagtcttgggaaaggtaattgcttctggtttggatgaagagcttgccaatgaagccaaaagagctgtttctgctgaaaaacaaaggttagcaaaggaggtagcatccatgctaaaattgagtgttgagattgataccagctcatctgaaagaggggaagggaagacaagaaatcaaaggaaaaagtgtgagaagggatgggaagagaattgggtgttaaatctagctaagattgtggctgcactacgtgcgggagctgaatatgcagggatacccgtctgcaactgtgtccttgttgcaggaagccaatctggcgtagctggaggtacacaggtgggcatgccatgtgttgttttacgaagcagtttgacatctagagctgagtttccattagcaaatgctacaatggatggatttggaggtgcagatctaacaatttcaaaattacgtagtctacgccccaagaacaaccaaaggactgaatggtaa

SEQ ID NO: 80732 - DNA, 3249 bp, Glycine max
  Peptide Sequence Number=SeqID_197510
atggacgtaactattcttgccgatgccatatccgacatcctaggacgcactggctcctcccttgcactcccaaaggagaatgttaaagagtttgaagatgttctcagaaagatcaatgacgtggttcacaaggccaagcagaacaactccctagaccccaatgttctgctttggttgaaagaggtcaaggacaaggtcaacgacttgaacgatttgatggatgatctccctcacaagcagggaaacgctgccataatatcgctcatcaaaactggccaaagcatggtgcatcgtcacaaagtcacacaacaactcaagaaagctactgggctgctcaaaagcttcgcaacggagggagaaaaattgtccttcacccaagaagcaaagaagaacgagagaaagctgaaagatataagcggggacaaatttgtagcggttggcagagaaaatgctaagaaggagattgtagatcaactcaagctgtttgtgaaaaacagtggaaacggtgctgtttcttttcctgtggttaccattgtaggggtcgcgggaatagggaagactaaacttgctcgtctcgtttgtgaggacgaggaagtcaaagccctttttgggtcaccaacttgggttcagggaaaccatgaaaccttcgacgtggaatccgtcgcaacatgcgtcactaaaatagttgaccagggaaatcgcttccttcttgtggtggatggtttgaaagatgaggaaagtctccagaagttgcagcgcaaattagcgtgtgttagtggggtggtactcgtaactacacgcaacaattttgttgccaacaacattgctgtcagtggtgcggttaaaccatatgctttgcaagggcttaaccaagacgagtcatggttactgtttcagcaaattcgtggacaaggttcaagcaacatcaaagaagatgtagaacggcagatagtgtgggaatattgtggtggagtccctatgaagatagcaactgcagcaaagttgataaaatgtagtgaatcatcatttttcagagataagttggaggaggagtttctacaagagctgaagtttacctattaccaccaactttccatgcatcagaagctgtgctttgtttattgttcattgtttcctcaagaccatgtgatagaggctgagaaattaattcatctctggatggcggaagggtttctttctcggaacctttgttccgatccgcaagagtttggctgggcgtgtttcaacgactttgttcctttcgttttcgaggagacggggagagacgaatttggtgttgtgaagagctacaagatgaaccgtttaatgcatgaactggcgaggattgttgcatgggacgagaatatcgtagtggattcagatgggaaaagagttcacgagagagtggtgcgagcttcctttgattttgcgttggatgttcagagcggaattcctgaggctttgttcgagaaagcgaagaaactgaggactattcttttgctgggaaaaacaaacaaatctcggcttccacatgaggtgaagatggccacgtcaacttgcgataaaatctttgacacgttcaagtgttttcgcgtgttggatctccatgatttggggattaagatggtaccgagctctattggggaactgaagcacttaaggtatctcgatctttcccataataacatagagaagcttcctagttcaatcaccaagcttgtccacttgcaaacgttgaaactttctcaatgtcatgttctcaaagagttgccgaaggacttggaggatctaagttgcctcatgcatctgtacttggaggggtgccttgatctcactcacatgccacgagggataggcaagctgagttctctacaaacattgtcactttttgtgcctagcaagaaccaccacatgggaggccttaaggatctcaataagctccgagggaacttggaaattttgcatctggagcagttgaagttatctgcctcgaacgccacagataagtatgtgagagataaaaaacaccttgattgtttgactttaagatgggatcacgaggaggaagaggaggaagaaaaagagaaggagaaaggcaatgttgttgttgatgacaaagacaagaagtcactggattctcttgagccaaatcaaagtctgagagtgttatgtgttgtggggtactacggtaacaggttttcagattggctttcttcaatgcaatgccttgttaagtttagcttgaatgattgtcccaaatgcgtatttatcccaccacttgatcacctcccactccttagggttcttgaactaagaaggttggactctcttgaattcattagtgctgatgctgaaggctcctcttcctctacattttttccatcattgaaggaacttacaatctctgattgccctaacctcaaaagctggtgggaaactccaaagcgggaagacgatagaccattctttaattgcatttctaaactgcatgttcaatgctgccctaatctgcattgcatgcctttgtatccttttcttgatgaagagttggtgcttgtggattccagcgtaaggtcaatgagggatacagtgcatgctaaaacttcatcagaagacttcattcctttgtcaaaattgaagtccatgctaattgcgcgcattacagaaactccaccaccgagatggcttaaaagcttcatctcccttgagaaccttcaaattcgagattgccataagttaaagtgtctacccgaaggtttcaagtctttgagctcactccagagtcttaccattgagagatgcccggaacttgatcttgacaaatccaagactgaatgggagggtctgaagcaccttcgtgttctgacgataaaggaaattccaaaactcaattctcttccatggggtcttgaggatgttacctctttgcaagagctcgggctttatgaatgctcttacttgagttttctgccacagagcatagccaagctcacttcccttcgcaagctagtgatttctaattgcaaaagcttggattcactgcccaaagaactagaaatgctcaagtatttaaataccttgatcatcacggattgtccccggttaatgccaaggtgtcagcctgaaacgggtgatgattggccacaaattgaacgtatagaaaatatcgtgctgaagcaaagttctcaagacttgagggacttgtggagtcatggaaggactggtttaggcaaagatttctacttttga

SEQ ID NO: 80733 - DNA, 1011 bp, Glycine max
  Peptide Sequence Number=SeqID_197511
atgcatcaacgaggggatgcagtgagtagcatggtgtatgaggccaatgccagagtccgagaccctgtttacgggtgcgttggggccatctcttcacttcagcaacagattgatgtgctacagacgcaattggccctggcccaggctgaggtggcccatcttcgggcgagacaaaacagatgcttttcccatcatgggcttaggccaactagcccaaccactagtggttttccatcatccaagaccttggactcacatgctaagcctatttttgacatagacatggtggaccagtattttccttctctttctcgtggcgcaacctttgagtgttcactccagaacccttatatcagctacacactaccttcaaaattaaaccccgagaacactcaaaagggtcaaatcacaagtgccagaaaatatctcaaggcattcggataccaagaagacaaaaaacccaatctcaacaacaccgacactagcaacacacgaatattacaacctaaacgtgtcgggaaaactggattcagagaccatgaaactaatgtcgttggcagcccaaaactcaccgcgagtacgaggtttgcattcatccaagggaaacctcaatggccaagctccaagcgacacctcacgtacgtgttcgaatcaggtgtggaggggggtgcaccgttagggcttctccggagggttttcagagaggcatttcggcaatggtcgtgcacgtcttcgttcacgttcgaggaggctcggagcggaatcacagattgggttcttcagtggagaccaccgagcggagatgggtttccgtttgacatgtttggacccgtttcggcgcatgcttttcaaccacctgatggaaggttgcatgttgatgcggataagccgcggaataatgaagtttcgatacagagggggtattatgatttggtgtgggtggcgatgcatgagattggtcaccttcttgggcttggtcatagcccgatgcgtatgtgcatgctggagtga

SEQ ID NO: 80734 - DNA, 663 bp, Glycine max
  Peptide Sequence Number=SeqID_197512
atgattgatgtccagagccttaatgttgattttcttgtggcttcttctcacaagatgtgtggccctacaggcattggattcttatacggtaaaatagacctcttgtcttccatgcctccatttttgggtggtggtgaaatgatttctgatgtatatcttgatcattcaacttatgccgaacctccatccagatttgaagctggaacaccagctattggggaagcaattggtttaggagcagccattgattacttatctgggattggtatgcaaactatacatgattatgaggtggagctgggtagatatctgtatgaaaggcttctttcagtcccaaatattcgcatctatgggccagcgccttcagaaaaagtcgaacgagctgccctttgttcttttaatgttgagaatttgcaccctactgatcttgcaacacttctggatcaacagcatggagtggcaatcagatcaggtcaccactgtgcccagcctctccatcgctatttaggcgtcagctcaagtgcacgtgctagtctctatttttataacacaaaggaggatgtagacaactttatccatgccctcaatgacacagtcagctttttcagttcattgataatcaaatttaagccattgaacatgggatgtaggatgcatgtttaa

SEQ ID NO: 80735 - DNA, 450 bp, Glycine max
  Peptide Sequence Number=SeqID_197513
atggtgagatcatacacaggcactattagttccacaaacctacgtactgggacaaaacttttattgttatcgttgaaatgttcacaaagtagacgctcgtggcctaggtctggacagtcctcttctaggcagcatgcatcaaggccggaagcaacacctttggattttgtggtccgtccccagtctaaaattgatccagaagaaattagagcacgagcaaaacaagctgcacaagatcagcagcgtatgaagatgaataagaaattgcagcaattgagggcaccaaaaaagaagcagcttcaggctacaaaactgagcgtggaaggtcgtggtggagatccagtgagctcgataaatggaaatttgaaggagagggatgtcatgaaaatacatccgtatactgcatttgtgtattcatttagtgcagcaggaaacccaaaatacatttga

SEQ ID NO: 80736 - DNA, 627 bp, Glycine max
  Peptide Sequence Number=SeqID_197514
atgaatggtagtgttacagggaattggcaacgcttgggaatgcatgcttggccgctgtacaagcctaagatgctgcaactgaaagcgttgaaaaagaagatagacaatttggccgaaaaaaaagaacttgattcaacattggtattgatgatcaccaaagcttggtcagctgccaaggagttgaacatgatgaaagatgaggttttgattgatcaaaaagaagaatctacttcaaccaatatgtctttagatacggcaatacataacatagaaatcacactcggaaagagtggacaattaactaaaggagtaggtgctgtaaccaaattaattgcaaaagaggggaaattggccacattattattaccttctggggaggatccggaggagcaactatctgccctcaaagatgcatttacacctggagaagaagttgaaggaacgatgtggataacttgtacacgtacgactccagagaagcttcacacatggataaagagtgtgttggatgcttatcatttgagtggagaaggtaccctcattagggaagcaagagatctgttgaatccagaggtcatccaaaaattggaggtactcaagaaggttgtggaaaagaacttcatgtga

SEQ ID NO: 80737 - DNA, 183 bp, Glycine max
  Peptide Sequence Number=SeqID_197515
atgactcggtccaattggatggattggatcaacaaaatagcaatgggatgggatgggacggatatgagtattgtctctccaatcccttatcccgattccccaacattacccgatacccgacgcatcccgtacccgttagatatcgagtatccccgaccccgtcccatacacgatttaaattaa

SEQ ID NO: 80738 - DNA, 621 bp, Glycine max
  Peptide Sequence Number=SeqID_197516
atgaagcgtttcatgctcccaagaaaccctttcagcgacgcagcagagcttccttcttcgccaagcccaaccccaactaccagctttgccaaactccgtccctcttctcacaaacacaaaccctccaaagagaacgaccttccctccgatcccaatctcgttactccctcccctgccaaattgaagagccccttgcccccaagacccccttcttccaaccctctcaagcgcaagctcaccatcgttgatgccctaaccgacaattctcttcgatttcggcatcaaggttattgtcaggatgaggccattgtcttcggacaaggacgaaggagatcccacagttcagaagattgtgggaagacttatacaatgtggggtcctgccaattgtttatcgcatgaaaatgatcaacaaggacttgccccccgtgtttttcagcaactctttgcacgcataagtgaaatatacaatgagccaatcatggatttgttggatccaaatcagaaaaacctacaggaatggagcaaggaacttatcctccttgggcacatggtcccggttatgtggtctcagttgatatcacgaggacgatgtccaagaaattcagacataaccatttga

SEQ ID NO: 80739 - DNA, 153 bp, Glycine max
  Peptide Sequence Number=SeqID_197517
atggctgagagattcatagcgctttcagctattataccgggcttgaaggtcagtgctgagatgaataaaataacaaccccagcaactgcgagaatagcgacatcaatcagaaagagaggcccaaaaggaatatatcaagacccaactacatga

SEQ ID NO: 80740 - DNA, 1546 bp, Glycine max
  Peptide Sequence Number=SeqID_197518
atggcttattcagccgaaccctcatcatctttgagctttacctcatcttcccatctatcaaatgggtcggttagtcacaacatatgctcttcttatggctctgaccctggacctaaccttgaggctctcagtttgagtaagcttagctccaattttgagcagcttttgattgaaactgattgtgattatagtgatgctgacatcgttgtggagggaatttcggttagtgttcatcgatgtattctggcctctaggagtaagtttttccatgaattattcaagagagagaagggttcatcagaaaaagaagggaaattgaagtataacatgagtgatttgttgccttatggcaaggttggatatgaagccttcctcatattccttggctatgtatatactggtaaactcaagccctctccaatggaagtgtctacttgtgttgacagtgtgtgtgcccatgatgcttgtagacctgccattaactttgctgtggagttgatgtatgcctcttacatttttcaaataccagagtttgtatcacttttccagtacatgaacttcacttgtgctaatgcttgggaacttcacttgatcaggcttaaggatcaagggaaggctcttgtggaagatgtcatcccaatcctcactgttgctttccattgtcaattgagtcaacttgtcaatcaatgcattgatagggtggccagatcagaccttgaccagatttcaattgaccaagagcttccaaatgaactctcacaaaaagttaaattgctccgccgcaaccctcagcgagatgttgaaaacgatgcttctatagtggatgctttgtctctaaaaagaatcactagaatacacaaggcattggattcagatgatgttgagcttgttaaacttcttttaaatgaatcagacattactttagatgaagccaatgctctccattatgctgcagcctactgtgatcccaaggttgtttctgaggtacttggtttgggactcgctaatgtcaatcttcgaaattctagggggtacacagtgcttcacattgctgccatgcgtaaagagccttccattatagtatccctacttacgaaaggggcttgtgcatcagatttgacttttgatggtcagagtgctgttagtatttgtaggaggttgacaaggccaaaggattatcatgcaaaaacagagcaggggaaagaaacaaacaaagatcggatatgcatcgatgttcttgaaagagaaatgtggaggaatccattggctggggatgcctgtatgtcttcccataccatggctgatgatctccacatgaaactactataccttgagaacagagtggcatttgcaagacttttcttcccttcagaagccaaactagccatggacattgcacatgctgagacaacatctgagtttgctggtctttctgcatcaaactcaaaaggttcaaatggaaacttaagggaggttgatctcaatgaaactcctatagttcaaagtaaaagacttttttctagaatggaagcccttatgaaaacag

SEQ ID NO: 80741 - DNA, 453 bp, Glycine max
  Peptide Sequence Number=SeqID_197519
atggtaactgagttaatcaatgcgaaccctatcatatatgaaaagaaagagcgtcgagctccatctgctccatctgctccccatgatgagtatgctgtcgaaccaatcgaccaacaagaggaccctgagcatccatattccttggaagagcttaaggtgattactgaggaagcagttgaagttgatgatcagcgtaactatgtgagggttacatttactccaacagtggaacattgcagtatggcaacggttataggtctatgcttacgtgtcaagctcatgagaagcttgccttcacgatacaaggtggatatcagagtggcacctggatctcatgcaactgaagctgcagttaacaaacaattaaatgataaagagcgggtggcagctgcactggaaaacccaaaccttctgaatatggttgatgattgccttgcttcatcttatgattga

SEQ ID NO: 80742 - DNA, 3030 bp, Glycine max
  Peptide Sequence Number=SeqID_197520
atggctgagtttgtccttgaaactttgcttggcaatttgaagtcacttgttcaaaaggagttgctactatttcttggttttgatcaagacttggaaagactttccagcttgttcactgcaatcaaggcaacgcttgaagatgctgaggagaaacaattctcaaacagagctataaaagattggctggaaaagctaaaacatgaagctcacatcctggatgacatcattgacgagtgtgcctatgaagtattcgggttggagaaccaaggggtcaagtgtggtccgtccaacaaggtacaaggctcttgtttatcctcttttcatcccaagcgtgttgttttccgttacaaaattgctaagaaattaaaaagaataagtgagagattaatggaaattgctgaagaaaggaataaatttcatttggttgaaatggttcgtgagataagaagtggagtccttgagtggcgccaaactacctctctcgtcattgaaccaaaagtctatggaagagaagaggataaagataaaattttagactttttgattggtgatgcttctcattttgaggatttatttgtttatccaataactggtcttggtggacttggaaaaacaacacttgcccaattcatcttcaatgatgagaaggtagtcaaccactttgagttaagaatttgggtatgtgtttcagaagattttagtttggagagaatgacgaaagctattattgaagcaacatctggggttgcctgcaaggatttggatataggatcaaagcaaaaaagacttcaaactatgcttcaaagaaaaagatatttgctggttttagatgacgtgtgggatgataagcaagagaattggcagaggttaaaatccgtattggcttgtggggctaagggtgcttccattttagtcactactcgtcagtcaaaggttgcagcaatcatgggaacaatagctcctcatgaattgtcggttctacctaacaaatattgttgggaattgtttaagcaccaagcctttggaccaaatgaagaagaacaggtagagcttgaggacatagggaaggagatagtaaagaagtgtcggggaatgcctcttgctgcaaaagcactaggaggtcttttacgcttcaagagaaacaaaaatgagtggctcaatgttaaggaaagcaaccttttggagttatcacaaaatgaaaactccataattcctgtcctgagattaagttacatgaacttaccaattgagcacagacaatgttttgcttattgctcaatatttcccaaagatgaaagcatagggaagcaatatttgattgaactttggatggctaatggattcatttcatctgacgaaagattagatgtcgaagatgttggtgatagagtgtggaatgaattgtatcatagatcattttttcaggatattgagatagatgaatttggcaaagttacaagtttcaagatgcatgatcttgttcatgatcttgcactatctattgcacaagatgtatgttgcattacagaagacaatcgtgtaactaatttgtctggaagaattctccatctctcagatcataggtccatgcggaatgtacatgaggaatccattgatgcattgcagttgtatctagtcaaatctttgaggacctatatattgccagatcactatggtgaccaactttctccgcatcctgatgttttgaaatgtcattctttgcgggtgcttgattttgtaaaaagagaaaatttgtcatcttcaattggtcttttaaaacatctacgatacttaaatctttctgggggtggctttgaaactctgccaggatcactgtttaaattgtggaatttgcagatattgaaattagatcgttgcagacgtctcaaaatgttgccaaacagtttgatatgcttaaaagctctacaacaactatcttttaatggttgccaagagttatcaaggttgcctcctcaaatagggaagctgacttccctaaggattttaaccaagttctttgttggcaaagaaagagggttctgtttggaagaattgggatcgcagaagcttaaaggagatcttgacatcaagcatctaggaaatgtaaaaagtgtaatggatgccaaagaagccaatatgtcaagtaagcaattgaagaagttgcgattgtcgtgggacagaaatgaagactccgaattacaggaaaatgttgaggagattcttgaagtgcttcaacctgatacccaacaactttggagattagaagtggaggaatataaaggtttccatttcccacaatggatgtctagtcaatctctcaaatatttaactattttatattggatggatcgcaaaaattgtttaggacttccacttttggggaaactaccttctctaaagactataagaatacaaaacatgattcatgtagaatacttctatcaggagtcctatgatggggaggttgttttcagggctctagaagatctttcactccgtcaactaccaaacctaaaaatgttatcaaggcagtatggggaaaacatgtttccacgtttttccatacttgaaattgatggctgtcctaaatttttgggagaggaagttttgctgcatcggttgcactctctctcggtaattagttgtggcaagttcaatttgtcagcaggttttaaatgcctacagaaattgtggatttcagaatgcaaaggggtgaaaaatttgcaggctttgcaatatatgacttcccttaaggagataagattaaggaatcttcatgagctagaatccttacctgactgctttggcaacctttctttgcttcacacattgagtatctttcactgttccaagttgacgtgtcttccaatgagcctgagccttagcggtttgcaacaattgactatttttggttgccattctgagttagagaagcgatgtgagaaggaaactggaaaggactggccaaacattgctcacattcgtcatatttcagttggcagtacactttatgatcatatttccgattga

SEQ ID NO: 80743 - DNA, 1128 bp, Glycine max
  Peptide Sequence Number=SeqID_197521
atgcaggatgcatgctgcaaccatacacgtgtagcggatggagacagctgtccttcatcttacaatcccaagcactacaatgaactctacaatttccgagctagaggcttagttgcaagagcatctgctgatccaagggataatttggtgccatttgctcccctccaatttgagtcaccagttggtcagcttttggaacaaatctcaaatacccatccgcatctactaccagcagccattgatcaacaactagagaatcttcagactgctagagatgctcagaatgaatcttctgattcatctcttgattccctttacaagaggatagcggaagtcaaagagaaagaaaagcgaacaacattggaagagatattgtactgctcaattgtacataaatttttagagaacaatatttcaatgatcccaaaaatatcagcaacatcagatcccactggtcgagtggatttatggccaaatcaagagctgaaactagaaggggttcattctccagaggcatttgagatgattcagagtcacttatctctggtactgggagatcgccttgtgggccctctccagacagttgttcaaattagtaaaattaaactgggaaagttgtatgctgcttctataatgtatggatacttcctcaaacgaattgatgaacggtttcaacttgaaaggtcaatgggaaccctccccaaggattttggaaaagctaaaagttttgatgaaccatcaccaggcatcaagctttgggatcctgattccttaatcatagtacacgattatgacaatgacagtgatcacatggatactgatgaaggcagatctttcagactaagagcttatgtgatgcagttggacgcagagacacttcagagacttgctactgtacgatcgaaggaagctatatcattgattgaaaagcaaactcaggccctgtttggaaggccagatattcgtgtctccgaggatggttcaattgaaacatccaatgatgaattgctttcactcactttctcgggcttgactatgctagttttggaggcacttgcttttggatcattcctatgggacaaagaaaattatgttgaatccaagtacccttttcttgatatagactag

SEQ ID NO: 80744 - DNA, 231 bp, Glycine max
  Peptide Sequence Number=SeqID_197522
atggaggtagtagcaagaaaacaagggaagagttttgcaaaggcttatagagtagaaaaaacaacaaaaaatgttgaaaatctcggagcaaaggctacgaataattggggtggaattgataaagattacaatgcttacttttttctctacgtaaaatttgtgaattatgggccgaaattcaaggtgctacatattgcattaagagttttcatgtctgatacaactatgtaa

SEQ ID NO: 80745 - DNA, 576 bp, Glycine max
  Peptide Sequence Number=SeqID_197523
atgagtcatgtagaatacctttacgaggaatcctatgagggggaagtagttttcagggcactggaagagctgacactccgttggctgccaaatctaaaaaggttatcaagggaggatgtagaaaacatgttcccacgctgttccacacttgaaattgatgactgtccacaatttttggtagaggaagttttgctgcaagggttgcactctcttagttatgaatgccttgagaaattgtggctttccaattgtagagaagtggaaagtttgcaggctttacaagatatgacttccctgcaggagttaaaattaaagcatcttccaaagctagaatccttgcctgactgctttggatgccttccctcgcttcacacactaagtattttttactgttccaagttgacgtgtcttccaacgagcctaagccttagcaatgtgcaacaattgactattttttgttgccattctgagttagagaagcgatgtgagaaggaaacgggagaggactggccgaacatagctcacatccctcatatttcagtgggcagtaaacattatgatcatatttccaattga

SEQ ID NO: 80746 - DNA, 1047 bp, Glycine max
  Peptide Sequence Number=SeqID_197524
atggatattggtgaagttgagaggttcatcaaggtatggctcacaaccatctcatgtctatgctattgttattacataacttctagaatacccaaaggcttcttaaggcttctctcccttttccctattctctacctcttcctcatccttcccttgaacctctcttccttccacctagctggccccaccaccttcttccttgtttggcttggcactttcaaactcattcttttttctttcaaccaaggccctctcgccctatcacccccaaacattctccatttcatctccatagcttccctccccatcaaccccaaacaactcccaccaccaacaaataaaaaccacacaaacaacaccacccaaaagccaaaatggcttttcctcctaaaagtgcttatttttgcaatgatcatacgtgcttatgactatagagaaaatttacaccctcatttcatcttagtcctatattgttgccacatgtaccttggcatagaacttgtgttagcccttagtgctgccccggttcgaaccgttttagggtttgagattgaaccacaattcaacgaaccctacctttccacgtcccttcaagacttttggggtcgtaggtggaacctcatggttacccgtattctacgccccaccgtataccaccccgtataccgtattttcatacactttgtgggtccttcttgtgccaagtcaagtgccgtgttggccacgttccttgtgtccgggctcatgcatgagttaatatattattacctttcacgtgcgccacccacgtgggaagtcacgtgcttttttgtgcttcacggtgtgtgcacggcggcggaggtggtggcaaagaaggtgatgctccgtcatggatggcggctgcaccgcgttgtgtcggggccgctcgtggtggcgttcttggcggtcacggggaggtggttgttttttcctcagctgttgaggagtggcctggataggaaggccattggggagtatgcaattttggtggattttgttaagtctatggtgccattatatttgttttga

SEQ ID NO: 80747 - DNA, 309 bp, Glycine max
  Peptide Sequence Number=SeqID_197525
atggcgcttttgaacatagtgccgccccacctggatatgggagtaggatgccaggttttgcagctggttctcaccatgtgtcttcacgccagaattccgcagactgattcaatgggtagtttgaatgtccattttttcgttttcctcgtctactttagcataaaaatgttagttcactatttgaaaagagaggctttcactctttctcattattcaattggacaccttaacattctcttcaaatggagtaaggctttcactcagaagtgcattttgcactacttccacaattattctaaaagtatttga

SEQ ID NO: 80748 - DNA, 477 bp, Glycine max
  Peptide Sequence Number=SeqID_197526
atgaccttaatcttttctactaagagtaaggtctggacagttgaaattgcagctacacttgtcagagaggacgaaaggattacagatctgaacttcctgattggtcccaagctgtatgaggcaaattggttagatccagtaaaaggtggatttattgcaaatgtacagtgtaaagaagaggagatgtattactcaactaagaggcagcaatttttagttgatcagggttacagctttaaggtatttcagctagttgaattagagcacctagaagaagatgcagatgaaaaagcccttcatattgcccgtcgttctgaaggatccataagtacaatgtcgggtgcgaaagggatggcttatatggagtacaacactgggaataaaaaggccaagcacagatcaagagcaaaccaagagatccatcgaagagacacttcttgtttaaaagaagatatagaacaacctaaattgccttag

SEQ ID NO: 80749 - DNA, 606 bp, Glycine max
  Peptide Sequence Number=SeqID_197527
atggattggagtttaaaactactgctgctaatatcaagtgatgccatacttctttgcagaatggatgaagcactatgttcatatattgaaaaggatcgaccatttttgggcatttgtcttggacttcaactgctttttgaatccagcgaggagaatggaccaggttttcttataattaactctggtggaaatagtgctcaatgtacatcatcctcaatcaaaggtcttggcttaatacctggaactgttgggagatttgactcatcaaatggttttagagtaccccatattggctggaatgctttacaaatcacgaaggacttgggaattttggatgatgttggaaattatcatgtctattttgtgcactcttatcgtgccatgccttcagatgacaacaatgagtggatatcctctacctgtgactacggtgacaaatttatagcatctattagaagaggaaatgtgcatgcagttcaattccacccagagaagagtggaggcaagttttattttccattccaatcctttagttctctctctctcttatacagaatcctaataatggaggctgcaatctttgttgaaatttctattcttcattag

SEQ ID NO: 80750 - DNA, 231 bp, Glycine max
  Peptide Sequence Number=SeqID_197528
atgaggcgctcattgcagctcgtccagggacaagttgccaacagataccaaaccaaggaaatagtgctactcaagtactaccagattgccaaaactctcatcgataatttcaaatgcttgaaaatgtactacatacccagagagaacaacaccagaaaagacttactttctaagctagccatcaccaaaaaggcgaggcacctcaagactatcatccaggagatgctctaa

SEQ ID NO: 80751 - DNA, 348 bp, Glycine max
  Peptide Sequence Number=SeqID_197529
atggccaacaaagagttcgctaaaccttacgatcaagaacccagtgctcctattgccctaccaattacccatgccaaaccttttttgggtacggtaaaatcaagcttttcaatggctaaaacttccatatgcggcagaatgcatctacacaattttagacatcagggagttgcatctattgttacggatactgcgagacttatgatgtttgtgttagattggaaatataacaccaaggagggacaatgttcaaccatcaaatctgaatacactttaatgcagaaccaagggcacaatgcacaaaatgatctctttttgggttctttggcgtatacctgctcaatctaa

SEQ ID NO: 80752 - DNA, 2976 bp, Glycine max
  Peptide Sequence Number=SeqID_197530
atggctgagtttgtccttgaaactgtgcttaggaatttgaactcacttgttcaaaaggagttggcactatttctgggttttgatcaagacttggaaaggcttaccaccttgttcactacaatcaaggctacgcttgaagatgctgaggagaaacaattctcagacagagctatgaaaaattggctgggaaagctaaaagatgcagctctcatccttgatgacatcattgacgagtgtgcctatgaaggattggcgttcgagaaccaagggatcaagtctggtccatcagacaaggtacaaggctcttgcttatcctcttttcatccaaaacgtgttgttttccgttacaaaattgctaagaaaatgaaaacgataagtgagagattaactgaaattgctgaagaaaggaaaatgtttcatttgactgagatggttcgtaagagaagaagtggagtccttgagttgcgccaaacaggctcttccatcactgaaacacaagtctttggaagagaagaagacaagaataaaattttagactttttgattggtgatgctactcattcagaggagttatccgtctatccaatagctggtgtaggtggacttggaaaaacaacacttggccaactcatcttcaatcatgagagggtattcaaccactttgagttaagaatgtgggtatgtgtttcatattttagtttgaagagagtgacaaaagctatcattgaagcagctggaaatacctgtgaggatttggatctacagtcacaacaaagaagacttcatgacctacttcaaagaaaaagatatttgcttgttttggatgacgtgtgggatgataatcaagagaattggcaaaggctgaaatctgtactggcttgtggcgctaaaggtacttccattttggttactactcgcctatcaaaggttgcagcaatcatgggaacattgactcctcatgaattaccggtcctgtccgacaatgattgttgggaattgtttaaacaccaagcctttggactaaatgaggaagaacatgtagagcttgaggacaccgggaaggagatagtaaagaagtgccggggaatgcctcttgctgcaaaagcactaggaggtcttttacgcttcaagagaaacaaaaatgagtggctcaatgttaaggaaagcaaccttttggaattatcacacaatgaaaactccataattcctgtcctgagattgagttacttgaacttaccaattcagcacaaacagtgttttgcttattgtgcaatatttcccaaagatgaaagcataaggaagcaatatttaattgaactttggatggctaatggattcatttcatctgatgaaagattagatgtcgaagatgttggtgatggagtgtggaatgaattatatcatagatcattttttcaggatattgagatggatgaatttggcaaagttacaagtttcaagatgcatgaccttattcatgatcttgcacaatctattgcagaagatgcttgttgcgttacagaagacaatcgagtaactacttggtctgaaagaatacatcatctctcaaatcatagatccatgtggaatgtatatggggaatccataaattcagtgccattgcatctagtcaaatctttgaggacctatatattgccagatcactatggtgaccaactttctcctcttcctgatgtgttgaaatgcctttctttgcgggtgcttgattttgtaaagcgagaaacattgtcatcttcaataggtcttttaaaacatctaaggtacttgaacctttctgggggtggcttcgaaactctgccagaatctctatgtaaattatggaatttgcagatattgaaattagatcgttgcagtcgtctcaaaatgttgcctaacagtttgatatgcttaaaagctctacggcagctatcttttaatgattgccaagaactatcaagcttgcctcctcaaatagggatgttgacttccctaaggattttgaccaagttctttgttggcaaagaaagagggtttcgcttggaagaattgggacctctgaagcttaaaggggatcttgacatcaagcatctaggaaatgtaaaaagtgtaagggattctaaagaagccaatatgccaagtaagcaattgaataaattgcggttgtcatgggacaaaaatgaagactccgaattacaggaaaatgttgaggagattcttgaagtgcttcaacctgatacccaacagctttggagattagatgtggaagaatataaaggcacccatttcccaaaatggatgtctagtccttctcttaagtatttaatccttttaaatctgttgaattgtgaaaactgtttccaacttccaccactggggaaactaccttctctaaagattctaggaataataaacaataatcatgtagaatacctctatgaggaatcctgtgatggggaagtagttttcagggccctaaaagttctgaccattcgtcatctgccaaactttaaaaggttgtcaagggaggatggggaaaacatgttcccccgcctttccaatcttgaaattgatgaatgtcctaaatttttgggagacgaagaattgttgaaaggtttggagttttcaacgccattggaaattgtggatttccaattgcagagaggtgggagatttgcaggctttacaagatatgacttccctcaaggtgttaaggttaaggagtcttccagagagctagaatcgttacctgactgctttggaaaccttcccttgctttgcgaattaagtatttttttctgttccaagttggcgtgtcttccaaccagcctaagcctcatcagtctgcagcaattgactatttttggttgccatcttgacttagagaagcgatgtgagaaggaaaccggagaggactggtcaaaaatagctcatgttccctatatttcagtgggaagtaaacattatagtcccgattga

SEQ ID NO: 80753 - DNA, 2940 bp, Glycine max
  Peptide Sequence Number=SeqID_197531
atgacttcctttggagaacactctacccaatatccaaccccagagaggcctaaacacaaactttcacaacatgagaaaaaaccacttgctgcatacatctgtcatgatccaagaagccttggttcatcaaagcacaaggcagagaagggcacagcacaaagtgtgtcttcttctcaattcaaaaggggtggttcagcttcagaaagatcaaattctaagtcactgtcgtctgcagattcaagaagggtgggacacttgatggatgatgttgccattaaagcagtgattgctatcctcagtggctacataggaagatatgtgaaagatgataattttagggaaaaaatcagagagaagtctagttctttattggaaagaagaagaaggagaaaggattcaggtgatgaggtttttgtgaacatggaattgggtacgaagaagattgatagattggcagaaaatcaaggaacaatcgagcaggtgaggatgatcaaaagattaaggaattccattgagcttttaaccatagttgctagtttgaattctaaaacttccagggatgcttcaacctgtggtgtaccaaattcacatctctcagcttgtgctcaactatacttggcaattgcttacaagttgcagaaaaatgacagggtttcctctaagcatttgctgcaagtgttttgtgattctccaagtttggctagaacctacttgcttcctgacctttgggagcatttgtttcttccccatcttctacatgttaaaatttggtacaacactgagcttgagttcctttcaaatgaagctcatggtgagaaggaaaagaaaatgaaggttctgagcaaagtttacaatgagaaaatggatactgggactaacctgtttgctcagtactacaagcaatggcttaaagttggagctagtgagcctccccttcctaatgtctctttgccatcaaggccaagttacagatcatcaagaaggtcttcagattcctttgtttcaaattcctcaatcaacccaaacttatacaagacagtgtttggctccaaactagagcagcaacctactggtcttggtgaccaaaatggagtgttggcaattactacaggcttagagattgatgaaaagttatatctagatgaatacaaatgcagtccagttcagaaagatgatagggtatttgttggaagatcaagccaagttggcaagagtcaagctcaattatggcctgcgtcacagagattggactattttcagtgcctttcttgcaggttcataccaaaggaaagcttggaaaacagcaactatagatacaagaatgcttcaactctttcgagagactttgttggagccattacaactatatgttcatcagatgttctaagtgaatgtgaattcgctattcgtgtggttatcaaagcttggttgaactctcctggtgatcctctcattgaagaagcactaacacaacctaatgtagttgaagctatgcttgaggtgctattttcctcaactgaggatgagatccttgaattgattatatcaattttagcagaattaataggaaagaatgatgcaattagacaaattattctgaactctgatcctcaactagaaatatttgtgcggcttctaaaaagcactagtctgtttctaaaggctgcagttcttctttatctatcaaagccaaaggcaaagcagatgctatcttctgaatgggtgccattaatacttcgagtgttggaatttggggacaaattgcagaccctcttcacagtacaatgcagtcctcaagtgacagcattttatgttttggaccaacttcttactggttttgatgaagacaagaacttagaaaatgctaggcaagttctttcacttgggggattgacactgctaatgagaagaattgaaggagaggcccatgagagaaacaatgctgctatgataatttcatgttgcattcgcgctgaaggaacctgtagaagttttttagctgacaacataaataagacttccttactcgaacttattgttattgagagtaaacaaaattccagtggctatgccttgtctgtgctagctgagttgctctaccttgatagaagaaccaagactttaaatttcttgagaggacttaaagatggatggggtggatttaatgtgatgcacattttcttcatttaccttcagaagtctccacctgaagaacgccctatagttgcagttataatattgctgcttgatcttatggatgatcctttcaagggaagcttatatagatcagaagcaattgaggcacttgtagaagctttaaattgtcaaacatgtaatgatagagtgcaacagcaatcagccagagctctagtcctattaggaggtcacttttctgattcaggggattcattaatggaaaaatcgcttttacaaaaagcaggtttcagagaaatttgcttagaagattcatatccgggaaaggaaattgttgtttatgatccaattcacaagaacgtggaagaggaagaagcagaaatttggcaaaaaagagcagcttgtgtcttgttcaaaagtggaaagaagaatttactatcagcacttgcagattccatagccaatggcatcccatgtttagcacgagcaagcctcataactatttcatggatgagcagctacctcaacatagttgaagatagaaagttgccaccaatggttttctcaatcttaagaccacagttgctacgatcactgaattatgataaagatgttgaggaaagagtgctagcttcatattcactgctatatcttgtaaaatattcaggtatgagaacttataccatctcccaagctataccaaacttcaacttttgtcctgaaaggattaattgtctccatttttttctcaaactttatacttttcatgatggtgtctctcaatga

SEQ ID NO: 80754 - DNA, 208 bp, Glycine max
  Peptide Sequence Number=SeqID_197532
caaagaagagctgagaaaagttaaagagcaactgagacttgtgtttgttgagttctatcagaaactcctccatctcaaagattacagttttatgaacctctcaacattttccaagatcatgaagaagtacgaaaagcatacatcaagggcagcatctgcagcatacatgacagtagtggataaatcctatgtgggcagttctgatgag

SEQ ID NO: 80755 - DNA, 362 bp, Glycine max
  Peptide Sequence Number=SeqID_197533
atggaaaccggcgccggtggcggtggcaaaggacaacaaggcggtaaaaccggaataggaattccgcaaaaaccgccagaggaaccgaatctgcgaccagaatggcggcgcccaaccagaaccgagcaggatgtggttctgcaacctgaatggcggcgaccaaggcctagtgctcctctttcagaaccttccaatcgtgtcgtcgaagaggagttgctattccaaccggaatggagacgctcaaagccaagtgcgagtgctattgcgaatgccaatgcgagtgtttgggaacctgaacggaggcgatcgagaccaacggcaacggcgtttccgtggaaccagaattacggcgttcgggaaag

SEQ ID NO: 80756 - DNA, 1332 bp, Glycine max
  Peptide Sequence Number=SeqID_197534
atggaagtgttgtcaaagttcttggttggcccattgcattcaataactagcaaatgtatggttttgcttgttactgttttgatccttagagcactgttgtttccatccttccctggctttgatgggattgaatggggcaaccttgtatgtatccgcactccattgttgaattcggactttggaatccagcaagataagtttttggaggttcctcagctcgtttggggattaaacaatcagaagattgcatttgcaagggcttgccttactgctagaatgctgaatagaacattgttgatgccaagccttagtgcctcactgttttacaaagaaattgacctcctgcaaccaatttcctttgacaaggtattccaatttgagaagtttaatgccctttgccgtggttttgtccggttgggatgctattcagacgtcttgaatagaacagaagtgctgaaaatggagaaggggagtggcaggaggtggacagtggagagagatttggcacaattgaaggagcatagtaagggctcttttgatgattatgaggtaattcggattgtagggaagaaccctttcttgtggcatgatcattggcctgtgaaggactatgcaagggtttttgagtgcttggatttgacagaggagattgctaaggaagcagacaggattgtgtctaggattcgagctgtcggaagagaggtaacaggcaacactgaagcagtggaagtggagaacaatattatcacctctgatggatcttcatttcagcctcttccatttgttgctgtccacatgaggatagaaattgattggatgattcactgtaaaaacctagagcagagattgaacacgaatcaaatctgcagtggcaagaaagagatagtggaaagagttgggaatattgctggtttgaagactccagttgttgtttatcttgctgttgctgataaactccttaacaattcatcatccatactagatgattgggaagaagggtttcttccttttgagaagaagaggcttggtgttgatggaatttataagaagtatccctatttaattcagtctgcaattgactatgaagtgtgtttaagagctgacatctttgtgggaaacagtttctccacattttcaagtcttatagctcttgaaagaacacagaagatgatcagaataaatgtcaccaacatgtgtggagagaatgtaagatggccttcttatgcttataatataccaggagaatcaaatggcccaatgagatgggtgacaaatatgtcagaatcaagtcttcaagcaatcagctatggcaccaatcacatctcttgttga

SEQ ID NO: 80757 - DNA, 1293 bp, Glycine max
  Peptide Sequence Number=SeqID_197535
tcgagttccggcggcggcggcggggttgaaagacgcggagaccctaacgacctttggcgacgacctgctcctccggctacagattctgtagttcccaaactggaaaaattacagatatcgaaacagttacctgcctcaacttgtacccttgaaaaaaaggataaaatttcacctattcagagacctgacaatggtggcacgttagcaattctaacaagcagacttcgtgtcaatcatttcccagttaagtttgatccagagagtataataatgcattatagtgttggtgtcaaacctaaggtttcttcaaaatttggccagcctcagaaattatcaaattctgatctgtccatgatcagagagaaactgttttctgatgatcctgagaggttgcccttggagatgactgcacatgatggtgcaaaaaatatttatagtgctgtacaattaccagaagagacctttactgtggagatctctgaaggagagaatgaaaaggccatttcatatagtgttaccttaactcttgttaataaactcaggctttgcaagttaatggactatcttagtgggcataacctctccattcctagggacattttacaagggatggatgtggtggtgaaagagaatccagctagacgtgctgtttctgtaggacgacacttctatcccacaaatcctcctgtcataatgaaggatcttcaccacgggataattgctattggagggtttcagcatagtttgaagcctacatctcagggtctgtccttatgtgtagactactcagtattggcttttcgaaagcaaatgtcagtcttggatttcttgcatgagcgtattgataactttaaattggatgaattcgaaaaattcagaaaattcattgaggaggcacttattggattgaaagttaatgtgactcatcgtaaatgcaatcggaaatacattatttcaagattaacacctatgattactaggtatgtcacttttcccattgacaatactggtggatggaactcaaatgatgttagtcttattaccttttttaaagaaaaatatggcaaggatatcgtgtacaaagatattccttgtctagatttagggaaagacaggaagaagaactatgtacccatggaattctgtgttttggttgagggccaaagatatcccaaagagcgtctggatggtatttctgcgaatacattgaaagcaatgtcactagctcacccaaatgagagggagtgtgcaatacaaaagatggtgcaatctagtgatggaccttgcaggtaa

SEQ ID NO: 80758 - DNA, 367 bp, Glycine max
  Peptide Sequence Number=SeqID_197536
ttgttgtggagatgaagatgaagaagcgtggaaagagaccgaggaaattgtagtcgaagggttgaaggatgagcttgatgaattttcagtgaagatgttcttcaaggggttgtcaatggctggtgttgaaaattcaagttctgggttttctgggattggagtgttcatggaaaggtcttcaggttttcctgctataagggtgcagaaaaagcttgacttttatgcggaggaatcaatggttgactatttggcactcttggatgggttgctggaagctacccagaacaagatccgcagggtttttgctttcactgattctgagttgttgcacgaccaggttggcatttcagtgtttcatgctaagtaa

SEQ ID NO: 80759 - DNA, 285 bp, Glycine max
  Peptide Sequence Number=SeqID_197537
atggatgaactgaaggatttgatcaagcaagttgtgccttatgggatttccccttatggtattcatgaaacacaaacgaaactatggttgatccgtgcactgcctacgtcgagacctcacatacacaatgtggtcttttgtgacacccctggcaatcctggggcattgttccatgatctcatgggtctttgtgcctggcgtgactatccttgggttgagatgacgctccaacctttaagcgatcgcatgacaagtctcttgttaaatagaaaacaaacaaattag

SEQ ID NO: 80760 - DNA, 792 bp, Glycine max
  Peptide Sequence Number=SeqID_197538
atggcagttgaagctagttacatgaatctcttgccttctcagttactcactaacagagaaaccatcaaatccaatcaacaattacagcatcaattgaactctgattacatgtacaacactacccagatggattcttcttcagctttgcctctaccagcagcaacaatgcctgaatcactcttgtccttctatcaatccaacttttgtgatccaaacaaggcagatagtggtctcacctaccatattcctctccagagaaaacgttcaagagatttcaccaccgagttaacctctctcccagctcaccagaagaacaaaatctcctctgagtcttcctttctcaaccaagagattctctaccaatttcagaaccaacaatcagaaattgatcgagtccttgctcatcatactgagaaagtgagaatggagttggaggaacaaagaatgaggcaatcaaggatgttggtgagcgcaatccaagaggcaatggtgaataagctgaaggaaaaagacgaagagattcagcgtatggagaagctgaattgggcccttcaagaaagagtcaaaagcatgtgcatggagaaccaaatttggagggaattggcacaaacaaacgaagccacagccaactacctaagaagcaatttggaacaagtcttggcacatgtcggcgaggaacgcgccaccgcggccgaggtggccgatgatgctcaatctagctgtggcagcaatgatgcggcagacgccgggagacgacacggcggcatccacggtggcgaccggtcgtggtag

SEQ ID NO: 80761 - DNA, 342 bp, Glycine max
  Peptide Sequence Number=SeqID_197539
atgggtgagatgtcaatccatacgtctatggcaacttatgctcgatatgttaactgtgaaatactggttttaaacttcatgttttttgttgtttgtatttcaatgcctatgtccattggcagcaataaggttctagacaggggtgacaagatagagcttctggtggacaagactgagaaccttcataaccaggcacaagatttcagaacttctggaaccagaatccgtcgaaaaatgtggctgcaaaacatgaagattaagctgattgtattgggaatattgatagcacttatcctgataatagtcctatctgtatgtcgtgggttcaactgtggaaaataa

SEQ ID NO: 80762 - DNA, 1845 bp, Glycine max
  Peptide Sequence Number=SeqID_197540
atgagtgatacagaaggtaaatcacattcctcgggaatcacgaggaaactagatagccataaaacttatcacggtagagatcccaatcacggaaataacctttggaaagatggacttatttgtgcttttgaatacattaaaggacaaaacagatcggttaaatcgagctcctcatcaaagatcacagacagactacatgttaatggccaacattcaaagatgcatgtcccttcagatgacaaaaagaagctctcagatccttcatctgtaaatgtctcaagggacagtttgtttggtggctcagatgacgacaaggagggccaggcccataaggctgggcaatctaaaaagtatgagggaggtcattgggtaccaattggatgggcaagaatttcagaacttgtccaagcagttcaggttgatgctgactggtcttctcatcaattggaatttgaggattctgaagatgattttacagtagcagatttggcagctccttattgggagcatccggctgggcctatatggtggtgccatgtttttgcaggtcaccccactgttgaggcttggctcagcaatgctcaatggctacaccctgctgttagtttagccttgagagacgaaagtaggcttataagtgagcgaatgaaacaccttctctatgaggtcccagtcagagttgcaggagggctgttatttgagctcttgggacaatccgcaggtgatcctcttgttgaagaagatgacattccaattgttcttaggtcttggcaatctcaaaacttccttgtaactgtaatgcatataaaaggatcagtatcaaggataaatgttctgggtataacagaagttcaggagcttctttctgctggagggtataatatgccgagaacagtgcatgaagttatagcactacttgcttgtcgtctctcacggtgggatgataggttattccgtaaatctatatttggggcggcagatgagattgaattgaagtttatgaacaggagaaaccatgaagatttgaatcttttcatcttaatcttaaatcaagaaatcagaaagttatcaacacagaaatgtgattattttaactcagtaataggggttaaaatgagggttgaggttttcaaatggttggatgtttgcagtttacaggttgatctttccgttgcagagatgtgcatgtgcagctggtctaaagttatcaagcttcaaaaggctggaaatgaaccaaacaagcttgagagtagtgttatcagagtgaagtggtcactccatgcaagagatgagattgtctttgagcttctccagcatctaaaaggaaatggagcaagaaccttgttagagggaataaaaaagagcacaagagaaatgattgaggagcaagaagctgttcgtggccgcctgtttaccattcaagatgttatgcaaagcactgttcgagcttggttgcaggatagaagccttcgagtaacccataatttagctgtatttggtggtgttggcgttgtcctcaccatcattactgggttatttgggatcaacgttgatgggatacctggggcagaacagacaccttatgcatttggtgttttcacggccatcctcgtcgttctgggagtagtgctgatagcagttggcatggtttaccttgggctgaaaaaccccgttgttgaggaacaggttgaagtaaggaaacttgagctgcaagaattggtgaagatgtttcagcatgaagcagaaactcatgctcaaatgcggaaaaatatttctcccaagaacttacctcctactgctggtgatgctttccgtagtgatgcggattatcttgtaatacagtag

SEQ ID NO: 80763 - DNA, 2520 bp, Glycine max
  Peptide Sequence Number=SeqID_197541
atgagtgggaagggcggtggcagccacaacaatggcggcggcaaggcgctgtcggcgacgattccggcgtcatcgcggaagatggttcagagcttgaaggagattgtctccaatttccccgatcacgagatctacgccacgctcaaagactgtaacatggaccctaacgaagctgttagtcgtctcctctcacaagatccttttcatgaggtgaagagcaagcgagaaaagaaaaaagagattaaggaccctacagattccaggtctcgtgggagtgggacaaacaacacatctagtcgtggtggtggtagggctggcacagatcgttatggtggacgtggtggtgccaaccaattcggcagcagtgattatggtctgcaggggaagcctgtatacaagaaggaaaatggggcacccacttttggagggtccacatcttctgcacctagtgtgctgggaaataatacgaacacgagactgccatcctacagtgattctgtggttactgaaaaaacatatgcatttggcatcggtgatggaccatcttcatcatcacaacgtgctggactgcaatctgcatggacagggaatacaggtcaagtatcaatggccgacattgtcaagatgggtaggccacaggccaggccatccatgcataactcttccatccagagttgtaatcatcagaatgtcttcatgcctccagcagcttcagataacaatttgcattcattgcaaggttatgcttccaaagtttcagaaacaaatactaatcaaggccatgtcattagcgacaatgttccacagaatgatgaatggccttgtattgagaaccaacatgatgttatagtatatgcagatgtggatgcccatgcaaattctgagtactatgcaaactcatcaagctttgctgaagctgattggcagcagaaaactcacttggatgaacatgtagctgaagatggttctgttgagaatgcagacaatgttgaatctgcttctatatctgctaaaagtacgtcagaggataacacaggagctgaagatgatgtttcatcagtggctgcaaacatagagcagctaaatatacagagagatgatcaggggacagaacaagaacatgagaatccttctgtagtaattccaaatcacctactactccatactccagaatgcatgaatctgagctttggaagttttggatctggaaaccccctttctggatctgggtcatttacatctaggcctttgaaaagtagcttggaggatacatctggtgcaacagatgtttcaacaattgagaactcagacactagaaatcctgactattacggggatgagcatctttctactactgctactactacctcagatggaaatttagttcaaggaactggtgtaagtgctgggacctatgaacatacttccatttcacaacaagaggctttaaaaccggacccccctgaaattgctcaggaaaatcagtattcatttacatcccagtctcatggatttaattatgaaaatgcccaacaaccggaggtcacatttcctctttcacagaccagctcacagatgcagaatcttgctcccttctctggtgtaatggtgcatacaaattctttgcccagtgctctgttgtcattgccagttcaaacagcaagagaagatattccatacttacccttccctgcaacacaatcgatgcctacaaaatatagtaacattggtagttccaccataaccgtgtcagaggctctaagagctagtggcattactacacctcaacctaatgcacaaaccctgtctggtgcaggtgttgccactggacctgcacttcctcagcaccttgctgtgcatccctactcccaacctactcttcctctggggcattttgctaacatgattagctatccattcttgcctcagagctatacctatatgccatcagcttttcagcagacttttgctggaaataacacatatccccaatctctggcagcagtgcttccacagtataaaaataatgtttctgccagcagtttgcctcagtctgctgctattcctcctggatatggctttggcagttcaacaagcattcctggaggaaatttttctctgaatccacctgctgctcctactgggacaaccattggatatgaggatcttataaactcccagtttaaggacaataatcatatgatgtcactacagcagaacgagaattctcccatgtgggttcagggccctggctctcgaacaatgtctgcagttcctcccagcaactattataatttgcagggacagaatcaacaacaaccaggtggatttcggcaaaggcagcaacagcagcaacagccttcacagcattttggaccccttgggtaccctaatttctaccaatctcagactggcatttcgctggaacatcagccacaaaatcctcgggaagcatccttgggtggtccgcaaagccaaccatccaagcagtcccaacaaatatggcaaaacagctactaa

SEQ ID NO: 80764 - DNA, 804 bp, Glycine max
  Peptide Sequence Number=SeqID_197542
atgcccactatcgatgagctattggatgaattggccaacgcatcctacttctcgaaattggatctccgacaatggttccatcaaatccctgtggtcgtcgctgacatgcccaaaattgcttttcgcacccaccagggacattatgagtacaatgtaatgcgcttcatccgcaattacgcatccattgctaggccactacctaaactgttgaggaaggaccaatttcactggtctgatgacgctcaacaggcgttcctccaacttaaaaaaatgatgatgctggccctagttatggtacctcctaatttcactttgccatattcatcctcaaaatcgatgctttcgacacctcaatgggagttgtgctccaacaacaattccacccctatcgccttcttcaataagcatcctagtggttgtcctttctatcacttaaagagtggtcctacaacacgactatccattctgccaccgggtattgataacaataacaacctagacaacaacatgcccacaaaggatgcacaaagagaccaacatacctacatgactacgcttgacttcaccctctcagaagagacccttgcccgacaagcactatatgcatttcacttttctgtgttattagcaattctgttagccgacattctgttatcatcatcctttctgttagaggctataaacacttatcataccataaggcttagatttaacaacttcatgcggtttgataattttgatatggggttggaaaagtccagagacactgagaagcttattatggaagatggggttggaatctag

SEQ ID NO: 80765 - DNA, 1682 bp, Glycine max
  Peptide Sequence Number=SeqID_197543
tcaagcgagaaaactcacctagagaaatgacaagagttcagcttcctcttctacctggtcttcctgatgatcttgctgttacttgtttgattcgagtaccccggattgagcacaggaaactacatttagtttgcaagagatggcgccgccttctgtctgaagacttcttttattcactcaggaaaagtcttggaatggcagaagagtggttatatgtcatcaaagcagaccgtgctggaagaatttcagtgcatgcttttgatcccatctaccaactatggcaacctcttccccctgttcctggagattttcctgaagcaatgtggtttggtagtgcagttcttagtggtttccatttgtacttatttggcggagtagatctggaaggatctagatctattagatgtgttattttctacaatgcctgtacaaataaatggcatagggcacccgatatgctgcagaaacgtaatctgtttcgttcttgtgtgataaataattgtctttatgtgtctggtggggaacttgaaggaattcaaatgactcgatctgctgaagtttatgaccccagccaaaacaggtggaatttaatatcagagatgagcacatccatggtgcctttatttggtgttgttcacaatggaacatggtttttcaagggaaatgcaattgggagtggtaattccatgtgtgaagcctattcacctgaaactgatacttggaccgtagttactaatggaatggtcaatggatgggataaagattgtatctctctgaatggacaactctatgcattaggttgcccggatggatgcaagctcactgtatatgatagagcaacagattcatggagaaagtttattgatagcaagcttcatgtgggtaaatttccaactctagtagctgctgcacctgtttcccttaatggaaagctctgcattatccgccacaatatgaacatcagtttagttgacgtttcaagtcctaacaaccaagtggaaagcaatcctcgggacctttgggaaaatattgctggaaaaggtcatcacattcgcaggtgctacaagcctgagaagaaaatcccacctgataatattagttatgcagagacatgcccttctgtaaagaatgtccttcttttggattccgatgggaaacgtgttgcggtcaaatacttctctgaagactggccgacaaatagtgccaaggaaaattttgagaaagttgtattcaacaagactcagaaaaccaatgcccgcacggaagcagaaatagcaatgtttgagaataacattgttctttacaagtttgtccaagatcttcacttctttgttaccggtggtgattatgaaaatgagcttatcttagccacagttctgcaggcattttttgattctgtgggccttctgctcagaggcaatgtagacaagaaggaagcactagagaacttggatctcattctattgtgcattgatgaaattgttgatggcgggggtaattctgttccattgcccttatctgttgtgatcaatgagattatcatacttgaaactgatccaaatgttatagctgggaaagttgctagtaatagtatagattctggagctcctttgtccgaacagacactaagtcaagcattggccacagccagggaacatcttgcaaggtcccttcttaaatga

SEQ ID NO: 80766 - DNA, 921 bp, Glycine max
  Peptide Sequence Number=SeqID_197544
atgaattgcagctcaattgaattaagcttatttgcaacatgtttgcaacctgacgctagagctcagctttctaactatggggataacgatatggacgaatgtttacgggttgaaaggagatgtatgagaggtggtggtgtttcaggtgggattaagggtgaggtgagctggactgggtcaggtagtcaggccgatgcgggttggagaggcatgtctgctgttaattggagttggggggcagaccttatggcaaaggagagtgccgccatcgccaaccataacttggagtgggttgattgcgatggtgggcaaagcgaggaattatgccactcaagcttacacaaagttatgggcaggcccgataaagcattaaggctcagttgcggagtgtcgaagatcaagggagaaggcaaactagactcggggtctagtgagtttgacgtcgatggggggtcggagttgtcttccgcaatgagaagctcctccgatgagagtcatttcactgacaatttaggtggtggtggaacgctcgtggcagaaggggactgtgaaatagccgatggaagtggggataagaatcgaggaagacgccggcctgagatgaagcaacctaggagaaagggggcctataacattactagccacgatgttagaagtctattgcggctcatccattggtaccaacagagagctggaccttccatgcacgggacatccaacttcatatgtgggcaaggaaatggagaagagggtagtgatggaggtggcgaattctttgggggaaggaggtggaagggtgagggattgctagccttgggtaaggcggagcacaacctcttcgagtcgcttcatggtagcttgcctagtattgtgttcaggcatgatggaagcgacagggcaagttggaccaaattggtatga

SEQ ID NO: 80767 - DNA, 213 bp, Glycine max
  Peptide Sequence Number=SeqID_197545
atggaggccgcagaagctgttgccggtgacggtgaaggttgcaaggccttgtccagcaacaacgaatgtcgtagagccttctgcaaaacccacaaatcgctgcaattctctgcgatttgcccggctaatagtgccgtgacgagtgtcttaggagcgataaggggccactccgctccgctaccccgcgatcacagcgctatcatgtgcgattga

SEQ ID NO: 80768 - DNA, 2211 bp, Glycine max
  Peptide Sequence Number=SeqID_197546
atggataacagaactacagaaggaagagacgccgttggtagtgcagagaacagaacagcgtcacattcattgctactcgtctcatcgcttctctgcactagtgtgccatttagttcagctgaaccggtgactggttttgtttctaactatcacgttgttatagatgatggttctccaaacaatgaacaactacttgaggttgaggatgagggcaatgagcttgagaatgaatgtgggcaattgtttgagattgatggaagtgaacctgaaaacgggagggatgaaacaacaatagttgatagtcatagtggagaatctcaagggaaagactgccctccgccagttgtgagaatggagtttgatacctatgatgatgcctacaactattacaatacctatgccaaggatattggatttgctattcgggttaaatcttcgtggaccaaacgcaacagcaaagaaaagcgtggtgctgtgctgtgctgcaactgtgagggtttcaaaacaaccaaagaagcaaatagtcataggaaagaaacaagaacaggctgtctagcaatgattagattgagattagtggattctaacaggtggagagttgatgaagtcaagcttgatcacaaccattcctttgatcctgaaagagcacaaaactctaaatcacataagaggatggacagtagggccaaaagaaaagttgagccaactttagatgttgaagtaagaacaatcaaactatatcgaatgcctgttgtagatgcatcaggttatggaagctcaaattctactgaaggaggaactagcaacattagctgttccaggcgtttgaaacttaaaaaaggtgatccagaacttatttcaaattacttctgccgcattcaattgatgaatcctaactttttctatgtgatggatctgaatgatgatggacaactgaggaatgtattttggattgattctagatctagggctgcttatagttattttggtgatgtggttgcatttgactcaacatgtttgtcaaacaattatgagattccacttgttgcatttgttggtgttaatcaccacgggaaatctgttttgctaggatgcggtctgcttgcagatgagacatttgaaacatatatttggttatttagggcatggcttacatgtatgactggtcgccctccacaaactattatcacaaaccagtgtaaggccatgcaaagtgcaattgcagaggttttcccgagagctcaccatagaatttgtctatcacaaatcatgcagagcattcttgggtgttttgtgcagtttcaggagtatgaagcatttcagatggcactgactaaagtgatatatgactctaaaacagtagatgaatttgaaagggcttgggatgatttaacccagcattttggaataagaaatcacgaaaagctccaaaccttacatgaggaacgagagcattgggctccagtgtactccaaagacacattttttgctggaatatctgattatgaaaagggtgagtccgtgattcccttttttaagggtcatgtgcatcaacaaacttctttgaaagaattttttgagatttatgaattagtccagcaaaaaaagcataaaactgaagttcttgatgattttgagtcgcgcgatttgagctcattactgaagacaaggtgctactatgagttgcaactctctaaactgtacacaaatgcagtattcaggaagttccaagatgaggtggtaatgatgtcctcttgtttcagcatcacacagactcaaacaagtgggtccatagtgacatacatggtaaaagaacgcgaaggggaagagcctgcaagagatgctaggaattttgaagtcatgtacgataatgccggagcagaagtacgctgcatttgtagttgctttaacttcaaaggttacctgtgcagacatgccttgtatatccttaattacaattgtgtggaggaaattccatgtcaatacattttgtcaagatggaggagggattttaagcgtttgtatgtacctcatctcagtgctgacaatgttgatattagcaacccggttcagtgttttgatcatttgtacaaacgtgccatgcaagttgttgaagaagggatgatatcccaagatcattatatgctttcttggcaaacatttaaagagtctttgaataagattcgccttgtagcagacaagattgaataa

SEQ ID NO: 80769 - DNA, 1917 bp, Glycine max
  Peptide Sequence Number=SeqID_197547
atggaagagtcctctctctgctgcgaacaattgccggatggggaatgcattgaggttcagaaagacgaagaagacgatggactgattgaattggactgtcaaaatggttttcctgaaggaagaaaggaatttgttgcacctgctgttggaatggagtttgagtcatatgatgatgcttacaattattatatttgttatgccaaggaggtggggtttcgcgtgagggtgaagaattcgtggttcaagcggaatagccgagagaaatatggtgcggtgctttgctgtagcagccagggtttcaagagaataaaggacgttaatcatttgaggaaagagacgagaactggttgtcctgctatgataaggatgaggttggtggagtctcagagatggagggtgcttgaggttatgcttgaacataaccacatgttaggtgctaagatactcaggtcggttaagaagatgggaaatggaacaaagaggaagccattgcctagttctgatgctgagggtcagacgattaagttatatcgtgcacttgtgattgatgcgggaggtaatggaaattcaaactcttgtgcaagagaggacataactttctctgagttttctaataagtggaaccttagaaaaggtgatacacaggccatttataatttcctctgccggatgcagttgactaatccaaacttcttttacttgatggatttcaatgatgatgggcatttgaggaatgcattctgggttgatgctaggtccagggccgcttgtggttactttggcgatgttatttattttgacaacacaaatttgtcaaacaaatttgaaatccctcttgtgacctttgttggaataaatcaccatggtcaatcagtgttattagggtgtggcctgcttgcgagtgaaacaacagagtcttatctatggttgttaaggacatgggttaaatgtatgtcaggatgttctccccaaactattattactgataggtgcaaggctttgcagagtgcaattgtagagatttttcctagatctcatcattgttttggcttgtcattaattatgaaaaaagtaccagaaaaattgggagggttgcacaactatgatgcaatcaggaaagcactgattaaagcagtttatgatacattgaaagtgatcgagtttgaagcagcatggggatttatgattcaatgttttggagttagtgatcatgagtggcttcgttctctatatgaagatcgagttcgttgggctccagtatatttgaagggcacattttttgctggaatgtccgcagctcgccctggtgagagcattagccctttctttgatagatatgtgcataaacagactcctctgaaggagtttcttgataagtatgaattagctcttcacaggaagcacaaggaagaatctttttcagatattgaatcaaggagctcaagcccattgctgaaaaccagatgttcctttgaattgcagctctccagaatgtacacaagagaaatgttcatgaaattccagttagaagtggaagaagtgtattcttgttttggtacaacacaattgcatgtggatggccccatcataattttcttggtcaaggaacgtgttttgattgaaggaaacagacgggagattagggatttcgaagttttgtacagtagaacagcagagatacctcacaaatacattctttcacgatggaagaaagatttcaaacgtctttatgttcctgatcacagctctggtggtgttaatgatactgaccgcattcaatggtctaatcagttatttagaagtgctttacaagttgtagaggaggggatactttccctagaccattacaatgtagcgttacaatctttagaagaatcactgagtaaggttcatgatgtagaacagaggcaggagtaa

SEQ ID NO: 80770 - DNA, 897 bp, Glycine max
  Peptide Sequence Number=SeqID_197548
atggacaaggttgtggaggaggctgaaaaagtgaagaaggaatgggatgaaacatacaagaaaacgcaagagcacattgaggcaattgcagagtatggaaaaccaggaagagcaaaagaggagaaaaattctctcgccagattgaatgggattgctcaagatggcttggctctcctttcttccttcctcttcaccctcgatcttcttgctcctcaattgccctctgagccagaggtccaatccacacgtgccttgcttcaatcttggaaaacactaactcaaaaagagaactacttctgggtggcggagaagagtccacagttcgcagacgcaatttacagtatgacctttatgtctcatttggctgggacaaaagctggaatgacatctgctgcagagagcatcacggaaagccttcgtcgtactcgtcaattgatggttcaggaggttgaaagaaacacaagcacacttatgactcttggtaggctttctatgcaggtggttttgatgaggataataatttgctttttaatttcacaagatgagtcaactggggtgttaaaaaaggctgaaagtgaatataaagggcaccgctcgttgttgatgagaacacgaaatctcctctccacaatgcaacgtcaagatgtcatagacagggtaataatcggggttgggtttttgttgttctcccttgctgttctttatgttgtttacaagcgaatcggactacttacgttgcagagaaaggtaactgaggccataaaagccggtatggtgggacaggcagagctaagaccccaagctgttgcagatgacttgaatcttcatcaagtcagaggcgactgtgttcataatgcagaggctcctttagaacaaagaatacatgatgaactatga

SEQ ID NO: 80771 - DNA, 1314 bp, Glycine max
  Peptide Sequence Number=SeqID_197549
atgggaaatgaagcccatgaccaacaatactcaaacaaattgcaagcatatggtcacagccaaaagcacaagctgaagtctattttgctagtcatactcaccaaccttgtcaccatttacatcttcactggtccaatcagttttttgtaccactcctctacgagtcctcgtgactcgaattctatcttgatggaactcaactccaccaaagctcaacttgttgccactcactcactcttgtctgaactgcaccacagactcaactcctctaacttacttgtccaggcactgctcattgatctcacgcgccaacaagaaaagcaatccaacagtgctgatcagaatcaagtgagtttgaaggtagggagtgatgagctcagttttgcacttggccctcacaagctcccttttgggtactcaccgaggataggatcagatgagattcacctgcctgccggtgcatcatgcatgaggcttcatgaggagttaacccaatatatggcatatgagattggaggggagtgccctatggatgatgtgcttgcacaaaggctcatgctcaaagggtgtgagccgttccctcgtaggagatgccgccctaagtctcctacaaattatgtggagccaacacctttgcctgagagcctttggacaaccccaccagacactagcattgtttgggatgcttatgcttgcaaaagttaccagtgtctcattgacagaaagaacaagccaggctcttatgactgcaagaactgctttgatttgcaaggtgaagagaagagtaagtggatctttgatgatggtggacttgattttggaatagaccaagttcttgcaacaaaagccatggggacggttcgtgttggacttgacattggtggtgaaactggaacatttgctgcaaggatgagggaaaggaatgtgatcatcatcacaagcacactgaatttggatggccctttcaacaacatcattgcatcaaggggtttggtgccaatgcatattagtatctcccaaaggtttcctttctttgacaacacactggatattgtgcactctatggatgtcttgagtaattggataccagacaccatgcttgagtttgtactatatgatgtatacagggtgttgaggccaggtggtctgttctggcttgaccatttcttttgctttgggtcacaactcaacaaaacttacgtgccaatgttggatcgaattggattcaatagattgaggtggcatgttggaaccaaacttgatcgcaagaatgtgttgtacatttcagccctaatggagaaaccaatgacttaa

SEQ ID NO: 80772 - DNA, 2422 bp, Glycine max
  Peptide Sequence Number=SeqID_197550
ggatctgtcttacaataagaaattaactggaccacttcccagtaacattggaaacttgagaaaactgagaaacttacttcttattaattgtggcttcactggtcctatcccagttacaattggaaatttagaacggcttgttttcctatctttaaattctaatggcttcactgggacaattccagctgccattggtaatctctcaaatgtttattggctagacttagctgaaaatcagcttgaagggcccatccccatatctaatggaactactcctggtcttgatatgatgcaccatacaaagcacttgctttttgaatccaaccgatttactggcggcattccatctacacttggccttgtcaagactctggaggtggtgcgttttgataaaaactttttaagtgaacctttgcctctgaacatcaacaatctcacaagtgttagggaattgttcctgtccaacaaccgcctgtctggttccctcccaaaccttactggaatgaattccctcagttacctagatatgagcaataatagttttgatcaatcagactttccaccgtggttgccaactcttccagctctgacaacaatggtgctgaaaaagaaccagctaaatggcactttagatattggcacctccatcagcaaccaactggacctcctagatttgcagattaatttcattgaagattttgatccgcaaattgatgtctctaaagtggagataatacttgtgaataatccatattgccaagagtcaggagttccacagccttattgcaccattacaaaatccaatgactcgtattcaacaccaccagataactgtgtgcctgttccctgcagcttagatcagacattaagccccaagtgcaaatgtgcatacccatatacaggaaccttatttctcagagctccttccttctctgacttggaaaacgagacagtctttgtaactctggagtattctctgatggaatcttttcaacttcatatgaaacctgtgaattcagtttctttaagcaatccaaggaagaacatatatcagtaccttgaactgactttaaaaatatttccatttggccaaggtcgtttcaatcgaacaggggtttctggtataggctttcttctcagcaaccaaacatacaaacctcctgcaatgtttggaccttattattttatcgctgatgagtatgaacactatgtggataattcagtattagaaggtcttgtgccatccagtagtaaatcttcaaatacgggcatcatagctggagctgctggtggtggtgctgcactgttggtgttagtagtccttgcatgtgtgtatgctatcagccggaagaaaaagtcaaaaaaatcaactgggaatagcaatccttttgaacaatgggatccgcatgacagcaatagtagcatccctcagttgaaaggagcaaggcgcttcagctttgaagagatacagaactgcaccaaaaacttttcacaagtcaataatataggatctggcggttatgggaaggtttatcggggaactcttcccaacgggcaactgattgcagtaaagcgagctcaaaaggaatctatgcagggagggttggagttcaaaactgagattgaactactatcaagggtccaccataaaaatcttgttagcctggtcggtttctgctttgagcaaggagaacaaatgctgatatatgagtatgttgcaaatggtactttgaaggatactctttcagggaagtctggaattagattggattggattagaaggctaaaaatagcccttggtgctgcgagggggctggattatctgcatgaacttgccaatcctccaatcatacacagggacatcaaatccactaacattttactggatgagcgcttgaatgctaaagtatctgattttggtctgtccaagcctttgggtgaaggtgcaaaaggttatattaccacacaagtcaaaggaacaatgggctacttggacccagagtattatatgactcaacagttgactgagaaaagtgatgtttatagctttggagtgctaatgttggagctggtaactgcaagaaggccaatagaacgagggaaatatattgtgaaagtggttaaggatgctatcgacaagacgaaaggcttctatggtcttgaggaaattcttgatccaactattgaactggggacagcactgagcggttttgagaagttcgtggaccttgcaatgcagtgtgttgaagagtcaagttctgacagacctacaatgaattatgtggtgaaagaaattgaaaacatgttgcagttggctggttcaagccccattttatcagcatcagcatccacttcatctagttataataatgcaactaaggggagttccctgcatccttacaataatgaatactttgattga

SEQ ID NO: 80773 - DNA, 318 bp, Glycine max
  Peptide Sequence Number=SeqID_197551
atggcatgtgaatgtgaaaacactattgtaatcgaccttgggtcttttgactttttcattgatgatatgaacttctcgttgccaattcatcattcatgggtatattttgaagtaaaggctgccaaagtctctgagcaaaaacgaactacttgcaggttcccagaagaaacgcaacctggcctgacagcatgtaaagatgcagcaaagagactaatggacttgggtcttgtcctcacaccaattcaagatgctgtgagagaagcagtggagagcctcatagctaaaggcttcctgcaatgcacaccctcacagagttag

SEQ ID NO: 80774 - DNA, 348 bp, Glycine max
  Peptide Sequence Number=SeqID_197552
atgctatacctcttttggaaagaaacatcacactccttctcatatatcctgagttcaaccaaacagtgtggttacccacttaccctacgatcttgcctcggatcaaaaccaccaatatatgctggtaaccaccgtggaaaaagcaagctcaccctagcattgatgaatgatgatcgtgctcgccatctccgacaacatcgaacagtcaccgccaagcacatgtggaagtatgtttttttcgggaaggggagggtgtgtttttccaggaaggagtacgggagggagaaagatgaggggagtttagggggaaaaaaaatcaaaaataacggaaaaggagtgtataaataa

SEQ ID NO: 80775 - DNA, 516 bp, Glycine max
  Peptide Sequence Number=SeqID_197553
atgccatcccaacctgcaccacaaggatctgaacccacccaattaggcggtgtgttctgccattcattcactagtgccagcatagcagcagctgcatcagaaattaaaaagccaatcaaatacatattgaatcttcatacaaaaattgttacagaagaatatataatagaactagcacaggccattcttgaaggcaaaattcaattaggacagcttcaagaactctccaaagatgcaagcttatctaactataaacagcttgatgataagctgaagcaaattaggggatatgttccatttactcgtgccaatgtacttatgtgtttgggatattaccatgtcattccaacggattctgaaactgttactcacttaaagcagatgctgactacttgcttttcaagtttcattatgtctatggttcattcaagagatacaacctctaaaacaattcagagagatcttgaagagatttatggaaagtatgagccctatcagtttctggcgttctggtaa

SEQ ID NO: 80776 - DNA, 738 bp, Glycine max
  Peptide Sequence Number=SeqID_197554
atgtcttcgtttccgagctccgtagaacgaacggttgcatcgtctctgcttcttctcaacacaacatctctctcatctccctcgctttctaagtttcagtctggctataattccagcgttgtggttccagagaggagaagcggaagcaagaggttgagagagatatcggtttcgtacggttcttctaaatcttcgtcttcctcgctcaccaacgacgacgacgacgacgacggtgattcctcggagaaagagatcaaatcgcgcagcgtatcgttctctgctgtcacgcgttaccatcagatgaagctcgagattgcgaggaagattcggtcgaaggtcgcgtggaccacgtcgtgctccggcgaccggaagccgaacgccggggagttggcgaaggtgctgtctccggcatcgctatccggcgaggtgtcgtcgtgtttgtcgagcagctcgagcggcatctccagcgagcgaagcttgcgctacgctaagagatgcagaggcgcgattgtgagtgtggccggagtcaattgcgagacggcggcgccgtcgcgttgtcgcgccggttcgccgaaccttcgccggcgcggcgaagccatactgaagctgctctcttgttgcggtggctcctctgaagtgaagatccgtcaaatgctcggtgacagccctgacactagcaaagctctacgaatcgaaaacaacaagcgtgagctagcgctatatctgaaagtgaattaa

SEQ ID NO: 80777 - DNA, 1440 bp, Glycine max
  Peptide Sequence Number=SeqID_197555
atggcagaagaattgaaccagtctctggaatatacaccaacatggattgttgcggttgtttgctccatcattgttttcatctctctttgtgttgagcgtgcccttcacaaacttggaaagtacctaaagagcaaaggtcagactgcattgtatgaagccttgacaaaattggaagaagaattgatgcttttagggttcatttccctgctattaaccgtatttcaaggtctaataagcgatatttgtatctcaccaaatcttgcaacccaaatgcttccatgcaagagacctcataggtctccagaaggttcagagcattatcagatatactatgatgctataataaacagacggaggcttttttctactgatactggttcagatcattgtaggcaaaaggggaaggttccattgttatcattggaatctgtacatcaccttcacatttttatctttgtattggccgttgtacatgcaatattctgtgtcaccacaatgcttcttggaggtgcaaagcttttctcaaatgcagaaaaagattaccgtgagttcttcaaagtgcatgctgacggatattggagaagagcagctgttattagttggctgagatcattcttcaagcaatttcatggctctgttacaaaatctgactaccttgcactgcggtacggatttgtcaaggaacaccacccacaaaacccggaatataattttcatgattacatgctgcggacacttgaagtcgacttcaaaacagttgtaggcataagctggtacctgtggctctttgttgtgctgtttttgctgatggatcttgaaggatggcacacttatttctggttagcctttttaccattgattcttctacttctggtgggggcaaagttggagcacataatcgctcgtttggctcaggaatcaatagatatgatgggaaaggaagattcccgttcagtgaagccatcagatgaatacttttggtttacccgtccatccctagtccttcacttacttcacttcattttgtttcaaaactcttttgagattgcatttttgttctggatttggacaacatatggattggattcatgcattatggagaaaatagcctacgttatcccaagacttataatgggtgtaattgttcaagtgctttgcagttatagcaccttgcctttgtacacaattgtgactcagatgggtagcaaaagcaaggctgaaaaggcagaaccatcttccttgatagggactaaaggtggctcccccaataatacaaggcagtccaaccacatgatcaaagaatcaacccaaattgatgaacaagcaataatcatgatggaagatgcaacaacatctacaattgagcttccccacattgtccatgctccttttgagagacctaatgcatccaatagttattcttctacaaatattcactag

SEQ ID NO: 80778 - DNA, 1578 bp, Glycine max
  Peptide Sequence Number=SeqID_197556
tgccacttcccgcattcagtctttcgccacggatggtatcgacctggccgtacggcatggcaacggtttctgtgagggttgcgtgagtgagaagttgatcgacgacgactaccttgcagtctgcattcctgctgtggcgcagcagctgggggaaccgccggcacttgccgcactcggtcgcgtcacgttactgcatgatatgcaccgggaagactggcagcgctggctcgctgaagccggtgtcgggcatattgattccggtaaagggcccttgtatagcgatggcagcggggcgtggctggcgatgctagccggcatgggcgtagcgctgatgcgcaggcgatttgttcaggccaacctggcatccggtgaagtggtggcaccgtttccaaatacgctgaataccggacacgcgtactggcttattacgcctcacgaagcgctgctgcgttctgccgtggttcaggacatttcacctgcagaggatatcatggcgctttcacacgaattaatgctgatttacaccacttactttgtggcaacggccagccctggtccgagtaatatggcgattatgggaacggcgatgaataaagggcgcggtgccgccttagcgcttgcgggcggggtaattggcggctcaatgctgtgggcgctgctggcggcctgcggggtattaaccgttttggcgacatttgcccaattgctgctggtattaaaaatcggcggcgggttatatctgttgtggctgtcatacaaagccggtaaatctgcgttaacccgcaccgctgccgataaaaccgttatcagcgatcaccgtgttgcgtatggcgcgttatttcgtcagggaattttgatgcacgtcggtaatccgaaagccattttaacctgggtcgcgatcatgtccgtcgcgctcaaaccggacgctgcagcctcgacattaccgctgattattcccggctgtgcggcgatttgcgtcgcggtattttgcggctatgcgctgatattttccactgcagcaatgaacgcgttttaccgtcgtatccgccggggattagatgcgctattagcctgctgtttcgccattgccggactgaaactgcctgattgtcgcggcgcgacgcatcgcgccctgcttcaggccgtcactccggaaactatcgtccgtgagttcagtgaattatcgccagaactacagcgggctgccgaattctcactgcagaatgccaatcaactggtggtgcaatccatgcgcacctttgcgcagcaggccggagtgaaaccggcaacgctgctgcgcctggcgaaacggctgggctataacggctggagtgaactcaaagacgcattcatcgatgacatcggcctgcgcaatgatacctatgtctcgaaagcggaaaagctggtggccgccggcacgcaaccgcagctgtatgatgcgatgtttcaggcccatcagaccaacctggcctttacgcagaacgaaaaccgccaggcaatggaacaggcggtgaccttactcgatgcggctgacaatgtttacatctgcggcttccgcgccagctttccgatcgcctg

SEQ ID NO: 80779 - DNA, 171 bp, Glycine max
  Peptide Sequence Number=SeqID_197557
atggcgcttagatcaatcaaatcgagtttaggccacaagaaggtcagcttagccaccatgattggtgctcagctccatgaacctcagttctggcccggaatgaatcagcctaagatgcaagggttaagcactaagcgctcgagacttgcggctaagcgcatgagcaattag

SEQ ID NO: 80780 - DNA, 228 bp, Glycine max
  Peptide Sequence Number=SeqID_197558
atggagttaccaattccgaacacgacggaacaacaacacacttccgaggaaccccaaacggaacccgaattaggttttctcagagaaaaaattgcttcactcaccgaaccagaaaagttctcggaacctgaggaaagaccgagagagatgagtgaggacgcgctagcactggagagaggagtgagtacgcacagagagacgggtggtaccgatacggggagaaattga

SEQ ID NO: 80781 - DNA, 1068 bp, Glycine max
  Peptide Sequence Number=SeqID_197559
atggaattcaacttccgtggaattgtttcatcttgctttgaacctcacttaactgtgtatgtagaattggaagagaaaacactaatggaaagtctggagaaacttgttcaggaagagacatgggatattgaggatggaagccagagtaatgttttatccagtagcatgcagttgtttcttataatcaagagaagcttgaagagatgcagtgctttaacaaagaaccagacactgtacaatctgttgaaggttttcgaaagagttcttaaagcgtatgctacaaagctctttgctagactcccaaaggggggcactggaattgttgctgcagccacaggcatggatggacaaataaagacatctgatagggatgaaagagtgatctgttacattgtaaattcagctgaatattgccacaaaacggctggtgaattggctgaaagtgtttctaaaataattgaccctcaatattcagatagggtggatatgtctgaagtgcaggatgaattctcagccgttataacaaaatcattggtgaccttagtgcatggcctggaaacaaaatttgacatggaaatggctgcaatgacccgtgtcccttggggttcccttgagagtgttggtgatcaatcagagtatgttaatgccataaatttgatcctgaccactagcattcctgcacttggaagtcttctttcacctgtctactttcagttctttctggataagcttgcatcatctctgggtccacgcttttattctaacattttcaaatgcaagcaaatatcagaaactggagctcaacagatgctattagatacccaagctgtaaagacaatccttcttgaagttccttcccttggtagacagacatccggtgctgctagttataccaagtttgtcagccgtgagatgagcaaagccgaggcccttttgaaggttatactttctccggttgattctgtagcagatacttaccgtgcattgctacctgagggtacacccatggaatttcaacgaatcctggagcttaaggttataattagctatttctatcaaaatctctag

SEQ ID NO: 80782 - DNA, 242 bp, Glycine max
  Peptide Sequence Number=SeqID_197560
tgatgtttgagcttggtgggctttcgacggaagaagttgggccagaggggtttgcagcggcaggggtggttgttggggcttcggatccaacagcagtagcagcggcagcggcaacgcggcgtttgactcagacctggcccatgcacgtgaccttggaggaagaggcattgcttctgagaaaccttattagtgggggagggaacttgtctgtgcaacccgaactcgaaatgggtttggcttga

SEQ ID NO: 80783 - DNA, 1170 bp, Glycine max
  Peptide Sequence Number=SeqID_197561
atggacaagtcaagtgctctggagtacatcaaccagatgttccccaacgaggtgtctctttctggcgtggaaccgctgatgcagaaaatccagaacgagattcgcacagtcgatgccggaattctcgccgccgttcgccaacagagcaactcaggaactaaggcgaaggaggatctcgctgctgccacacgcgccgtcgaggaacttatgtataagatccgagagataaaaactaaagcggttcagagtgaaacaatggttcaagaaatatgccgtgacattaagaaacttgactttgccaagaagcatataactaccacaattactgcacttcaccggcttacaatgctggtctctgctgttgaacagcttcaagtcatggcttcaaaacgtcaatatagagaggcagctgcgcagctggaggcagtgaaccagttatgtagtcactttgaggcctatagggatattccgaagatcatagaactgagggagaagtttaagaatatcaagcaaatactcaagtcacatgtgttttctgatttttctagcttaggtactggaaaggagacagaagaaactaatttgctacagcagttgtctgatgcctgcctggttgttgatgcattagagccttctgtaagggaagaattggtaaataatttctgcaatagggagcttacatcgtatgagcaaatttttgaaggagctgaacttgcaaagttggataaaaccgaacgaagatatgcatggattaagcgccgaatgagatcaaatgaagaaatttggaaaatttttccttcttcatggcatgtttcatatcgtctctgtatcctattttgcaagaagacaaggaaacaactagaggacattcttgctaatctaaaggaaaagccagatgttgggaccttgttattggctttacaaagaactttagagtttgaggatgaattggctgagaaatttgggggaggcactcaaaacagagagattgggaatgagattgaagaaataggtaaagggaataattctagtagtagtgccttggatatccggaagaagtatgaaaaaaagcttgctgcacatcaaggaggtgacagtgaagaaaaggatggaagtaaagatttggcagtgcctggagctggggtatggtctcatttaactattttctaa

SEQ ID NO: 80784 - DNA, 285 bp, Glycine max
  Peptide Sequence Number=SeqID_197562
atgattcaatggaaatctgcagcagagggagttcttggaaaccatttgggtaatgagattttctcctttgttgccaatattgggtattgctcagtgttacaagcagaaatatgggcaatctatgttggagttaacattgcttggagttggggattgaagaagtttttggttgagtctgactcccaaactactattaatctgctgaaagttaccacccgtgttttagctttgtcaagaatatccagagtcgtttgttgcctcaggcgatgtcttggagtggactaa

SEQ ID NO: 80785 - DNA, 882 bp, Glycine max
  Peptide Sequence Number=SeqID_197563
atgcaggattggatattgacaagtaatactgattttatgaattttatggttctgtacagccttcagaacttggagagttgtctttttgtccttttcccatatttctcgtacatgcttgctgaaggccttggtctgtctggtattgtatcaatcctgttcacaggaatagtcatgaaacattatacatattccaatttatcacaaagttctcaacgatttgcctctgcttttttcgagttaatatcatctttagctgaaacatttgtggcagcaaatgtcttctcatgtgcttatttggtcaatctggtcaggcccactcatcgaaagataccttcaaaacatcagaaggcactttggtatagtggacttcgaggagcaatggcttttgcgcttgctctgcaatcaattcatgatcttccagaaggacatgggcagactatctttactgcaactactgcaatagttgttttgacggtattgctgattggtggttcaacaggtagcatgctggaagctctagatgttgtaggtggagataatgatagccctttggcttcagttggtaccatcacaaatttcgatggaaacaatggttatattgctcctcattacaacgaagaatcatcttctgggaacaaaatcaagatgaagctaaaagaattccacaagactgctgcatcttttacggcattagataaaaactacctgaccccattctttacaagtcaaaatggagatgaagatgatgaaggatacggctatgagcctatgaaacaacagaactactatttagaagtgtttccgagccttttacttccacaagatcgggatttcatggccagaaccactattcatcatgattcgttccagacaacatactga

SEQ ID NO: 80786 - DNA, 1155 bp, Glycine max
  Peptide Sequence Number=SeqID_197564
atggtgcaggtgcaggtccagatcatgccggaacacaattccgatcccgccgcccctccgcctcctcctccgccgccgcacaaccgccggccgagggtccgagaggtcagctcccggttcatgtccccatccgtgccgcgccgcccgcggacgacggagccggaccccgatgagaattccgaaaccccgttcccacttgggtgttctatttctcagagaaaacaaacacaaacaccacaacaacaacgttcgatgaagcttttcaaagagaacaacaacaacgagcatgttccaccgcaccctcacccttcaaagtcatgttctggaagaattggtacgccttgtgtttctaggcctggcactcccactccctcggtttacgtgtcttctaggtatagacaaacacaacaacaccatcatcatcataataataatcaccatcatcatagatttgttaatggcatggcctctgctgctgaaaaattaatgcaagccagtggattgaatcaggctaagtccagtgctgcttgctccagtgataattctggagtgaattgtagtattcagtcacttcctgaattgggggagagagagatgttgctgcaatccaatttgtctgcgggtgagaaaattgggagtggcaatggtggtggtggggacttgaagtttcgccacccttcgcctttgtcgcggtcggttactttgccttcttcggggggtgagaacaaacctccggcttctgtctccaagcagcatgggagtggtaatcagttggctaagtcaggggggcttagtttgccgccggtacctcctcagtgtggaaagccagcagtggatgtgaggaaagggaagaaaggatctagtcatcaggaagatgtgcattctcttagattgttgtataatcgatatttgcaatggagattcgccaatgcaaaagcgcactccgtgatgaaagctcagcaaacagaaagccagaaggttttaaattgtgtccgttgttaccttgcggttgttgtgactggatgcggttggatgctgccattgcaatggcagcaatcaaggtgtgatgtggctgtggctccaaagcttaggttgcactctgaatttaaaaccctgcccctggactttttgataggaagagtatttggaagttag

SEQ ID NO: 80787 - DNA, 995 bp, Glycine max
  Peptide Sequence Number=SeqID_197565
atggcaaaatcagtggagaagcccttctcgattattggccttcttgctattagtggtggtgacaagaagaaaacacttccaacaagcaagcccaaaccattcaacaaaggaagaagttctaccgtcgagacccattacaaatctactcacgacctccttccacctcacaagaggaaaatggttgttaatattgaagacaatgtagaaccagttggttctagcttggtcaactttagcaacttcggtggttctcttatatggatgtctttgagccaagagattgatcatgtcatcttgtcaaaagattgggagtccattcaaaagaagggtcttgccgacttagagtctactatgtcgatcttagctggacactatttgggtgatgtcaacccactgaaactggttgaagaggaaaatgttactttgaagaaggcacaagatcaagcagacgcattgtcagaagagtttaaccaattgaaagagatcacccgacttaaagaggagtcgagtcaaggagaggtcacccaacttaaagaggagtcgagtctgggagaggaagagaacttcaagaaggccactagaggctcttttaacaatgttttgaagcaagttgagtatctccaccccaaggagactaatgatttgggaactcttgatgatgtaatggttgatgggtttatcaaaacccaaaggttcattgaagcttccgatgttgatgctggccttgaaggacctcaaatgcctccatttccttccattagtcactctagccatattgatgcatatgtttgttgctttcaaaatgctagagtggttaacgcgacgttggagtgtttggaaatcatcataagagctctccttcgagcctactggaatggtttgaatgatatgaatgatgatgttggtagccttgttttggcttgctcccatttggaaagttcatgtgggctatgggatgctttaaggacaaattttcttctgaatgttatctcgag

SEQ ID NO: 80788 - DNA, 223 bp, Glycine max
  Peptide Sequence Number=SeqID_197566
ggttcctctcggtgtgggttttcaatggagaactatggcggtttgtggtggctactggtggttgtgggtggtgaagaagaagcttgggacgttggggagtggttttggaagaaagaaggagaaaggaatggaggacgcttttaccgagacagcttcaggtagctttcttgagaagctttctcgtgaggcttctttgagaaacttccttgagaggcttctttga

SEQ ID NO: 80789 - DNA, 336 bp, Glycine max
  Peptide Sequence Number=SeqID_197567
atgaaggtcttccaagattgcgtctgtcaccattggtatgtagttaatcaaattcacaacatggttgccttgatcaacaagactaacccgaggagtgacgagaatgattcaaatctcatggttcaatggttcccaccccatcaacacatagtcaaaatcaatgtctacaagagttctctaggctcaacattggaaattcatcaaggccatgatcgttacattaaggttgtgatcattcatcaaggccttgatggattgatcttggctcatgtagatttgcattcgaaaaaccatcatgaccctaatcaattcatcagggctatgatcaattcgtga

SEQ ID NO: 80790 - DNA, 318 bp, Glycine max
  Peptide Sequence Number=SeqID_197568
atggtgatggaggaacaccttgacatggacaagctggaatcctattttggtggaaaaaatacagttgggttcaactaccaagcttatgctcagaaaatgaaagatgacagaagcatttttttaagctccgaatttcatgaatcattgcagtcaggaaccaatgattctgtggatgaagcatctatcgatggagaagttttttcaagcttggaggaagacgatgatagtacacatgggaagatgccttgcgtccaacatgaatccaatatgattgatgaatcaaaaaagacacgaagagctgaatcagaagagaactaa

SEQ ID NO: 80791 - DNA, 303 bp, Glycine max
  Peptide Sequence Number=SeqID_197569
atgaatgtaatcgatagacaaacacacatcaaacacaacaacatagcaaagtccccagtggagtcgccaactatcacaacctgctcttcgacgggggtgcgaaaaggcctctcgtatgggccaagggtgcgtcttccattgaaggaaaacgcatggagtcgccaccaacgtttattcaaggaaaatgtcggaaaaaccaaaatggaaaaggtcgaaggtttgcgtattttgaaaatgagggttcgggagttgtttacgcacgggaaaggtattagcaccccatgcgcccgtcacaagagatga

SEQ ID NO: 80792 - DNA, 279 bp, Glycine max
  Peptide Sequence Number=SeqID_197570
atggccaacaaaaacatatcatccaatgaaacatacccccccacacttattcccaaaacaattccaaagctccaaaattccttaagggtaggaaaggggaacataggctcaaaggggctatcaaaggaaataattcaaggtaggctcatttggctagaggcttataagaacaaaatgcctaaatcatctcccaacatgcatgtgaagcaagaagtatcaacaagagtcaagccaaggctattgtgcaagcaatcaatagggcaaaacacaccgaattaa

SEQ ID NO: 80793 - DNA, 465 bp, Glycine max
  Peptide Sequence Number=SeqID_197571
tatggacaacacttgttgaagagcttccttggctttccttgctctagcccttgccattggtcctccaagtccttcaagtggatccttgcccttgctcttggtcatgtcctcatcacactgcctcctgagcctgaggttggtcctttagtttcttgtgtcaacacaaaagagagttgtgttgatccctcagggaacgacccagatacaggtgacttagagaaatgtggattgtacgttgaagaaaatcctccccgcctggttaccctaggaagactttatgaggggtcgaccaccgttcacaacatccctttgggcaataatcaagtcaagattggtgttgaggaagttcgagatgcagatgctcacattcttgtacccactcaacaccttcattgtttggccgacacatcttgtcaagcatttctcaaagcagagagttgtaagactgatgaaacctatagatag

SEQ ID NO: 80794 - DNA, 1077 bp, Glycine max
  Peptide Sequence Number=SeqID_197572
atggcaaaagcgttagtggtgtttttacatggcgtcggcagtaatggcgcggatttggcggtgctggggcaacactgcctgaccggcatcacgctggaaaaccgtccggcacgcgtacgggctgcgcgcgacgcctttgacgccacgctgcagcagctgatggcgcagcacgcgatggccggcgcgtggcaaaaggtgattctggtgggattctcgcagggctcgatcatggcgctggatgcgctggcctccggacgctatccgctggctggtgtggtggccttctccggtcgcctggcctttgacgaggcgctcacgccgccgccgcatgcctccgcgctgctgattcatggcaaagccgatgaggtcatcccgtttagcgaaaccgtctccgccgcgcagcgcctgcagagcgcgggcgtcgcggtcaccgcacagccagtagcgctgcagcgcctgccacgcctgacgcgcggccgcttccggcggctgtgctttgaggcgatcgttaaacacttcgatgcccaccggaccgcgatagcctgcacttttcagcttatcgacaaagcgttccacttcaatgatgccgtcgccgggcagcaagcgctgatggcgcgcatagtcgctcagcgcctgcttttcctgcggtggcatctgcgccatatcgcacagctgcacttcataaatgcggtcggccggaatgccgtcgagctgagaggcatcgccaccgcgtgcgcagatgtggaacagatcgaccaccagcccgatattgggctgatccagccgctgcaaacgctgccacgccagcggcagcgtattgtcgacgctgcaccacgccatcggttcatacatgatgcgcatgttatagcgcgcggcttccgaggccagccagcgcagatcttcatcaatgcgctccgcaacgcagtcttcgcgcgtggtcgccggcgcctgaatggtatcgcagcccagcgattgcgcgacgcgaatgaaatcacgcagttcggcgcgcttttgcagccgttcgctgtccggcgcgccggtaaagtcacgcagcacctgcagattggtaaagcccag

SEQ ID NO: 80795 - DNA, 1467 bp, Glycine max
  Peptide Sequence Number=SeqID_197573
atggatgtaagacagggatcagaacatggttcaacaaaccaaaacagcagcttaaatggcttaccctcaaatgggccttcatctttacagacaaatctcaggccgacaggtagcagtgtgtccatgttattcaagggacatgaatatgggagtgcactgatgaagttctcatatgtggtggcatgtcaaatatatgggcgccacaaggcagacaagaatccccgtgctgacgagatattatatttgatgcaacacaatgaggcccttcgagtggcgtatgttgatgaggtttctttagggagggaggggactgaatattactccgttcttgtgaagtatgatcagcagttgcagagtgaggttgagatttatcgaatccggttgcctggtcctttaaagcttggagaagggaaaccagaaaatcagaatcatgccataatctttacacggggtgatgcagttcagaccattgatatgaatcaagacaattattttgaggaggctctcaaaatgcggaatctgttggaggagttcaatatgtcctacggtattaagaaaccaaccattttgggggtccgagaaaatatcttcacgggatctgtttcctcacttgcatggttcatgtcagctcaagagacaagttttgtgacactgggtcagcgagttctggcaaaccctttgaaagtacgaatgcactatggtcatccggacgtgtttgacagattctggttcttgggtcggggtggagtcagcaaggcctctagagtgattaatatcagtgaagatatttttgctggtttcaattgtactctgcgaggtggcaatgtgacacatcatgaatatatacaggtaggcaaaggaagagatgttggtttgaatcagatatccatgtttgaggccaagattgctagtggcaatggtgagcaggtcctgagcagagatgtgtaccggcttggccatagattagacttctttcgcatgctttcagtgttctacacaaccataggattttactttaactccatggttattgtactgatggtttatgccttcctttggggccgcctttatatggctctcagtggtattgaacatggtataaaacatgcagccatgaataatgctaccaacaataaagcccttggtgcagtcctaaatcagcagtttgcaatccaagttggtatcttcactgctctcccaatggttgtcgaaaactctcttgagcacgggttccttccagctgtttgggacttcttgacaatgcagttgcagcttgcatcactattttatacattctctttgggaactcgcacacatttctttggtcggactatacttcacggtggtgctaagtatcgagcaactggtcgaggtttcgtggtggcgcacaagagttttgctgagaactatcgactatatgctcgaagccattttgtgaagggtattgaacttgggtttcatggataa

SEQ ID NO: 80796 - DNA, 384 bp, Glycine max
  Peptide Sequence Number=SeqID_197574
atgcaaaacgcaagctccattggcgacttcatgggcattggacacgtggaagcccaacccgccagtgctgctggcgacttcaggtggaagcgcgtcccgccagctctgctggcgacttcaacctgtgctaaaatcgcagctttgactggcgatttccaaggctaccaggctagggtgcagggtgcacagaagccatttccgagggagctgcagagcagggaatcaccaagcatccagcaggaaagaaaaaggaagctagaggaacgtgagtgttgttgctgttcgtgtgtcttagagcatccagcaggaaagaaaaaggaagctagaggaagttgttggttcttaagtttgagaagctttctcccaaaacaaattcagttgtag

SEQ ID NO: 80797 - DNA, 426 bp, Glycine max
  Peptide Sequence Number=SeqID_197575
atgtctccttattgggttgtctttggcaaggtatgtcatcttcctatagagatagagcacaaagcctactgggctataaagacctgcaacttctctattgatcaggctggagaggaaaggaagttgcaactaagtgagctagatgagatctgtttagaaacctatgagaattccaaattctacaaggagaagaccaagaagttccatgacagcctgatagctaagaaggacttcgtggttggacagaaagttttattgtataactctaggcttggactcatgagtgttgagatcaaaagtgagtccatagataagagcttcaaggtcaatggacaccggctgaaaccattcctcacaaatccctccatagtggatgtagtggtggaggagacctccttacttcaccctacttctcttccaccatga

SEQ ID NO: 80798 - DNA, 420 bp, Glycine max
  Peptide Sequence Number=SeqID_197576
atgagtctaagtcttaaagtgctaaaaggatcagtcgcgctaagcggaccctgctcagcgcacgactggtgccaagcccaaatccacttactcgcgctaagcgcgagggcgacgctaagtgcgacgtcacgatttcagagcctatttaagcctgaattgtcagaattagggtacgattttgagagaccagagctatatatttttgcacagacttcgagaatagtactctggaggcaacaaagaggagcagctgtgctgaagagcctagggttctacatttttagagtgattgtgaggtgccaagaagaggacgagggatcccccttcttgtgttaccaagaattattctgtactctctatctcatttatgttagggtttctgtgtatggctggctaaataccctagttgggaatttctaa

SEQ ID NO: 80799 - DNA, 785 bp, Glycine max
  Peptide Sequence Number=SeqID_197577
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcaccgccgggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccagaattcgatcacatttcagtcaaacaaagtgcacatgcttttaggcactgtttagcagtgcattcaaacaccggattgtggagcggcctgattgtgagcatagattccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 80800 - DNA, 240 bp, Glycine max
  Peptide Sequence Number=SeqID_197578
atggcacggagcgtgtttgctctatgcccctatttggaacctataggacaatatctagggctctctagtaactactcccaacgattcataactcacacgttgttttctagaggcctaacccacaaaaatagtccccagtggagtcgccaactgtcgcaatgtgcccttctacgggcgagcgaaggcgaggctcacgggtgcgctttccaaaggaggaaagatgcacggagtcgccactaa

SEQ ID NO: 80801 - DNA, 408 bp, Glycine max
  Peptide Sequence Number=SeqID_197579
atggtggaggatgcacgaaaagcgataggcaataaattcgtggggctccgaataagatttgatgatgaaggatgcacgaacagcgcttggcaatcaattcgtggggctccagactcaatggcaatcaattcatggggctccagacttaatggtggaggatgcatgaacgacaataaattcatggggcttcgaataacatttgatgatggaggatgcatgaacagcgcttggcaatcaaatcgtggggcttctaataaaatggtggaggatgcacgaaggcaagccctaggcaataagatggtggaggatgcacaaaaagcgctaggcaatcaaatcgtggggctccggactcaatggtggagaatgcatgaacgacaatcaatgcatggggctccgaataagatttga

SEQ ID NO: 80802 - DNA, 463 bp, Glycine max
  Peptide Sequence Number=SeqID_197580
gccacttgtccaacatgttgaaccccccaagtgtcgacaagtgttgtccggtgtcgagcgtggtggccccaacgagtttgagagttgtaggtcgatgtggcttgttaagcccccgagcctagacatgcgttgtccaggctgcttttgtcaagtcgtccatgatggacttgtcttttgtgtgtcaagtaaggtactctcttccactataatgtcttccttcttgtctaattccgccattgatctgggcagtagtgattctggggacattgagcaacccatcatggatcaagagatcatctcaatagacgatttgtcgtttaaggatactcaccgaggtgcttctcatggggagtcctcttcaagggagccagtctccattactgtgaccctccatccttctgctttcaggggtgtaggttggtggaggtggagacgtgaggtcgtctccccccgttcgacctag

SEQ ID NO: 80803 - DNA, 330 bp, Glycine max
  Peptide Sequence Number=SeqID_197581
atggagggtcagagtaagggtagttttaatgtgatggaagggagtgagggcaaaggaagggagtttgtggtggaaaagtctgcatcatcaatagtgggaacttgtgatttggttctaaggattttggcctttttactaacccttgtggctgctgtagttattgggacagataagcaaactgccattgttccaatcaagcttgtggattctatgccaactttgtacgttcctgttgcagctaagtggcattacttgtctgcctttgtgaaaacagacaaaaagaaacaagagatattaacgagaagtatatataaggaagttactgtgtaa

SEQ ID NO: 80804 - DNA, 789 bp, Glycine max
  Peptide Sequence Number=SeqID_197582
atggcttgctcctcctccttcctctttctttgtcaatatcaacaccaacagaatcttcccatttcaggaaactcttctctcagccttccttcccggcctttcttttccaaaactcatggaaggtgcaagcattatagaagaagatgcaggattagagcaccatgttgcaatgagctctacttttgccgccattgtcataacgaggcaacgagcatgctgagcaacccttttgatcggcacgaactcattcgccaggacgttcaacatgttgtttgtacagtttgtgacacagagcagccagttgctcaagtttgcacaaactgtggtgtcagaatgggagaatatttctgcagcatctgcaaattcttcgatgatgatcctgtgattgttaatcttactgttttctatttgatactgagcattggttacacattatgcagaccgggaaacaacagtttcattgtgatgattgtgggatttgtagggtcttgctattcaactagtctgcgtgataatcatatgtgtgtggagaattccatgaggcatcattgccccatttgttatgagtacctttttgactcattgaaagacactgctgttatgaaatgtggtcacacaatgcatagtgaatgttacctagagatgctaaagcgtgacaagtattgttgtcccatatgctcaaagtcggtgatggacatgtctagggcatggaagagaattgatgaagagattgaagcaactgtcatgcctgatgattatcggtacagaaaggtagagttttgctcttag

SEQ ID NO: 80805 - DNA, 333 bp, Glycine max
  Peptide Sequence Number=SeqID_197583
atggctccgagctcgttgagtgtcttcctatcgattaaggcaaagtatgatgtgtttgcgtcaaccagtaaatatttgatggatgttagtggaactgccctagttgagaagggccctggacaccatgaagtttgctatgatgatggagacaaccatgggtttgtcttggttgataggattgatgcccttgaagtttctattcgtaaaggattcaaaagaagggaaatttcaagtgctttggaggaaaattgttgcaaaaccttgaaaaagaagttgaagattggaacatctcacttagcatacaagacaggctcagcgcaacgcctcacttag

SEQ ID NO: 80806 - DNA, 801 bp, Glycine max
  Peptide Sequence Number=SeqID_197584
atggtctgtggcggctcctggcgggccgggcggcgcatggcgcgacgcgcaggaaaaggcccgcgcataagggggaaatgcgaatcggcttccgcaccggatcggcgggccgagcgccgcggcagggggcggtccaaacccgccccctccctgtgcggcgcgttacttgacgatcgtcaggcgcgggcgcttgggttcgtcgtcgccgccatcgtcgccgggcgcggtatcggcgtcggcttcgggagaggcggtgtcggacgcgcccggcgtgccgggcgccggcggttcgtagggctgcacttcgaagcccatgccggcgccggtttcgcgcgcatagatggcgctgacggcgcccaccggcacgtagacgttttcggtcacgccgctgaagcgggcctggaattcgatgaattcgttgcccagcaccagacggttggtggccagcgtgccgacgttcagggtgatctgtccgtcgcgcacgtgggcgacgggcaccatggtgtgctcgtcgacctgcacggtgatgtacggcgtgtagccgttatcggtgcaccattcgtgcagcgcgcggatcagatacggtttggtcgaagtttcacccatcacgcaacagccttagcgacgcatcactttttccgaaggcgtcagcgcttcgatgtaggccgggcgcgagaagatgcgttcggcgtacttctgcagcggagccgcgttcttgggcagctcgatgccgtagtggtccaggcgccacagcagcggagccacggccacgtcgagcatggagaattcctcgcccagcat

SEQ ID NO: 80807 - DNA, 312 bp, Glycine max
  Peptide Sequence Number=SeqID_197585
atggataagacgcggaattatgcttatatacacgcaatatcgcatcatgtgaaattgattagagacaaagttgtactggatgttggatgctgtaccggcatcctttctattctctgtgctttgactggtgcaaagcggatgtatgcagttgaagcagctcatgacattgcccatgcgacaaccaaagctgttgaagataaaaatctttcagatattatcacggtagtgcaaggacgaattgagatagggtactgtgaccaatatgttttactctttgaaaaagttcttataacttccaattttagattatga

SEQ ID NO: 80808 - DNA, 345 bp, Glycine max
  Peptide Sequence Number=SeqID_197586
atggctccattaacagcttcgcaagtacaagtgcaactgatattggggataacaacctcagcaacaggagcagccggaagaggggcatatattggtttaaagggcaactaccgtgtggattggattaaagtttgcaacgtctacgacaagttctgtaggcatcttgctggctccatagcagtggctttgttgtattgtgaccgtccttctcatcatagatatgcactcaactccagatttacattgttcacaaaatcagtcaatgtgtccgttaatgttcatatatcgacatggatagcttttgttgttgctgagtgtttcttcaaaggtgttgattatgtgtag

SEQ ID NO: 80809 - DNA, 681 bp, Glycine max
  Peptide Sequence Number=SeqID_197587
atgcagcagccgaaggaacgacaaggtatcgatggagaagagcaagtagtgccaatgcgagtgaccagtagcattgatcatgacgaggcgtatttcgaatcctatgctcgaattagcgttcacgaacagttgctcaaggataaggcacggactgatgcttatctgcatgcaataattcgtcacgaggaatttattagagacaaagttgttcttgatgttggatgcggtactggcatccttgctatactctgtgctcaggctggtgcaaagcgggtgtatgcagttgaagcaactcatgacattgcacatgcgggttacggttacagaaatgtgttcctcactatatttttgtgtgttttttggagctttacaagcaaagtagttgaagataacaatctttcaaatattatcacggtattgcaaggacgaattgaggatgttgaaatcaaggaacaagttgatgttataatttcagaatggatgggctatatgcttctacataagaacatgctggaaagtgttattactgccagagatcgctggctcaaaccaggaggtctaatgcttccttcaaaggcaacgttgtacatggctcctgttacaaataccaaaagatacgaggaaagcattaactactggaatagtgtttatggaattaatagtgagtacagtactacgtag

SEQ ID NO: 80810 - DNA, 255 bp, Glycine max
  Peptide Sequence Number=SeqID_197588
atggttaaatgtgtgaactgtgattctgttaccattcctgagctacgatcggtgacagaaagctttaagttcaactcaacggtgaaagcaccgctacgtggttttgcgttttggtttgatgttgagtttggaccatcagcaattccacgactcttcctagcttcatcttcatcttactctgttgacgatcatccggtggatagtcagacatggagagaccctaatctgctcctgtccactgcacctgataaataa

SEQ ID NO: 80811 - DNA, 697 bp, Glycine max
  Peptide Sequence Number=SeqID_197589
gctggctgcatcatgctggaatggtgaaggtgctttgctgtttacatcaagctctgctccttatgattgtaatgataatggattgtgtcacgaggatagtccagtggtgccaacagggaggagtcccaggactgatgtccttctaaaagctgaaaaaatagtgctggagtttggtggttctgttttaagactgtctggactttatatatccttttcaaaattcagtttactaggattccaactattcattcatctgggtgtgtctgcttccaaccttgacattttaaacaaagtagataaaggtgcacatgcttattggttagagaaggggatagtcgaatctcgtcctgatcacattctgaatcttatacactatgaggatgcagcttcactctctgtcgcaattttaaagaaacaatttcgtgggagaattttcttgggatgtgataatcatcccttatccaggcaagaagtgatggatctagtttacaaaagtgggaaatttagtaaaaagtttgagaaatttacaggatgctatcactgcgtaactcatcattgtaaaagcatgcctttgtatatttccttagcaggaaccgatgatcctctaggcaagagattgaacaactccagaacacgccaggaagtagggtgggagcccaagtactctagctttgctcatttccttgagaccatctga

SEQ ID NO: 80812 - DNA, 168 bp, Glycine max
  Peptide Sequence Number=SeqID_197590
atggccagcaatataatcagcaatagggacagtggagaactcaccctgagcaccgagtcagccatcaagaatctagaagtccaggtgggacaattgacaaagcaactggcataccaactgtcaagaagctttggagccaacacagagaagaatcctaaggaggagtga

SEQ ID NO: 80813 - DNA, 834 bp, Glycine max
  Peptide Sequence Number=SeqID_197591
atggcaatggattttcttacaggagctaaattagccattgaaagaaatgcaagaaacggtcagaaactggatattaaagtagttgattccggcccattctttaaatcgaatgtcattgatgttttggactttactaaaagccagaaaattccaattgtagcgccgtttgcaaattctccggaattgtataactacagtaatctggttattattgaaacgaatgatcaaacctatgcggataaaattgtagatgaagtaaaaactgtatactcggatcaaaaaatttatatagttgcagacagcaaaaaggaaaatgcaaattatattaaagcgggtctcgaaaaggcagtgaaaaatccaaatgtaacaattgtaagttctcctgcagaaattaaggcagaccagaatatgatgacgggacaatctgctcctgtaatagctattttagccagtgataacgatagtaccggcgaggctttttcaaatagagttattgccctgacaaaagaagtacagggaataaaagcttttagcatgtattatgctccaagttttgagaaaaaggtagacgaccttagtcaggcgagtctggtttacttaatggacagaaaaatcaatacggacggaagttttgaaaaagagattttggcagcctataaaggtaaatactgcaagactcctcccaaatatgcaattattggttttgatgttgtcaatgacatgttaaccagagagaataaaaaaggagaaatttttaaacaaatgaataaagttcaaactcagcttgcaaccaagtttgaatttgtaaagtccaaagctaatcctcttatgtga

SEQ ID NO: 80814 - DNA, 929 bp, Glycine max
  Peptide Sequence Number=SeqID_197592
atggtgatgaaaaaacaaaatcaaatgtgtggaatagcaggaattatcagcaataatgccagaaattatacagaagaaatccaaaaaatgactgatgcaattgcgcatcgtggcccggattcttcccattatgaattttatgatcatattgctttgggacatcgcagattatcaatcatcgatttatctgaaaatggaatacaacccatgtactccaacacaaaaaacgaatgcatcgttttgaatggtgaaatttacggttatcttgacatcaaaaaaaggtatgccgaatatccatatcatggaagttctgatacggaggtgattttagccatgtatcaaaggaagcaggaaaacctcattcatgatcttcccggaatgtttgcatttgctatttgggatgaacaaaagcaacagttgttttgtgcccgtgatcgttttggagaaaaacctttcttttatgctattggaaataacaatgaatttatttttgcctcagaaatcaaagcaatccttgcttccggacttatacaacctaaggtaaatcctgatgcattaggacactatctccagaatggatatgtaaacacatatcaaagtatatatgctaatatctttgcacttcctccagcccatcaactcatctggaaggatggaaaaattgaagtttcacgctattataatttacctgcgaaagacagagttataagcttatctgatgctaaagaagaatttttataccttttaaaaaatgcggttaaaaaacagctcatagcagatgtggaagtgggaagctttctaagtggaggactcgactcttcctctattgttgcattagttaatgaatttttacctaaacaaactactattagttttggctatgatcataaagatagcgagctgaaatacgcaaaagaaattgctgaaaa

SEQ ID NO: 80815 - DNA, 138 bp, Glycine max
  Peptide Sequence Number=SeqID_197593
atggaggctcaatcccttcatctctctgacctttgggaaccctatcagagcaatcagaggaaaaaattgaggaatctcataaactttttagagatgtcgcttgaaagacacgtgagcccgcttagagatgtgtattga

SEQ ID NO: 80816 - DNA, 141 bp, Glycine max
  Peptide Sequence Number=SeqID_197594
atggaaaagcaaatagagaagatttggccttccttggtaaatttttaccatgatgaggatcacattgcaacaggaggagtttcaaagaaaatcaagattttcgacctcaatgctatttcaagtgattctgttaacatctag

SEQ ID NO: 80817 - DNA, 409 bp, Glycine max
  misc_feature (41)..(41): n is a, c, g, or t
  Peptide Sequence Number=SeqID_197595
tggagtccttgtcgaggaccttgaaggcatcacggagttgncgatcgaagggttcgggtttcatgtctttggccattacatcaaggaatcgggggaagtcgaagggagccgtgaggttctcttttgccacgatggttgtagttatatgagtaaagaaaagaaagataacctgaagtttttttccactcatgctcctgctagtatcgcaaacagccttcctcttctccctttcacccgtggcaccatgatagggattcagctgaggttccacaaacccttttcagttgagtgctcgtggccagtctcgctcccactcacggccaaccttgctctaggtggccactctcgaaagaaatatagattattagagaaaggaacaatgctagtgtttacacgtatagggtgttag

SEQ ID NO: 80818 - DNA, 258 bp, Glycine max
  Peptide Sequence Number=SeqID_197596
atgaatccaaagccttattctgctgaactcatgccaaagtactttctcttgagccatttcattgaacaactgcaatgtgaccagcatggagtaaggatctcatgtcctttgaacaaggaaactcaacaacttaaggacaaccgtgcgaccatcccagacataatgcctgagaacgatcatctacagcccaaagatgggaacctcctcctaagagaagcccttcaggccattaatcacgctctgatcacagggtcttga

SEQ ID NO: 80819 - DNA, 255 bp, Glycine max
  Peptide Sequence Number=SeqID_197597
atggctctctctagctactctgaacactcatcagtgatcactgcaaggaaaagagaggaatgcacgtggaagtcagtgccatgcatgagagaacccccaaaacgtgggaaaaaggctaggcatgcactgtgtacgtgttggtgtggttcagagcagaagtcagggactcagaatgcacatcgctacacaacacaaccttttgctcgaaagcgcttggtatggaaaaatcgcgagtgtaaaattatcgtcaagtaa

SEQ ID NO: 80820 - DNA, 663 bp, Glycine max
  Peptide Sequence Number=SeqID_197598
atgttggaagttttgatacttagtggatatacacctaaaggtttaagaaaattgatcagttttcaacatttggagataaccacaaagctgcctgttttgccggaggatcagattgcaaacttgagttctcttcagactctcaggatcgaattttgcaaccatgtggaatcattgtttggagggattaaactccctactcttaaagtactgtgtattgccaattgcaagagtctgaagtttttgccacttgatattgaacattttcctgtattagagactttgttagttgacaactgcgatgcattggaattttcaaaggaacataagcaaagttccaacttgaggttgaagattgtaaatttcatttcattgctaaagttggtgacaatgcctcattggcttcaagggtctgtggacacattgcattacttgttaatttcaagctgcaacaatcttgtggggcttcctcaatggccatcagctatgaatagtctaaaaacgctgtgtgtcacaagttgtcctaatatgctgtctctccctaatgacatccatcacctcatcacccttgaacgattagaaattgatggttatcctgaattcttccaacacttaaccactgatgaaccagaagaagtggagaaagaggtagaagaattggagtaa

SEQ ID NO: 80821 - DNA, 978 bp, Glycine max
  Peptide Sequence Number=SeqID_197599
gttttggttattggtggaggagatggtggagtcctgcgggaagtacctcgtcatgcctcagtagagaagatagacatttgtgaaatagacaagatggttgtcgaagtctttaaacaatttttcccttatatagcagtaggttttgaggacccacgtgtaacacttactgttggtgatggagttgcattcttgaagaatgttccagaaggaacttacgatgcagttatagtggattcatccgaccctattgttgatcttccaagttcactacaagatggccttagtggccagttattagagattgaaggtacagacaagagtgattgggttcttagtctaattaagatattaccatacagcttaggggtcaagacatgccttaaatctggacagaatggggaaggttgcacactaactccaatgaaagaaaatgttcttccactcatgactgtaaatttccagcaaggacttggccagaagtttaaacagccagctggaactggtattgatttttcaacatttgaggagtctgagttattgaaagtaggggacatggatgtctatcctgttgcaattaaagcagatgcatcctccagcgaccatgatgaatcaaaatcaaatgaaactccatcatccggtacctcaaactctcagataactcaagcagtgtttgagaaggagaaaggacaatttgtttcttgcaaaactgaggtccttgatattgacatttcttcagctgttggtaagtcttctctctctctttttccattccttacatgggttttggaagaaatggtggataaaaagaatggtgatggggggagagtgtgtttatgtttgtttgtgttattctgtgtttgtgagtggtttgggaaattggtcggaaaaggggcagttttggctgggaatggtgttgaccctcttggcaagaaaaatatagctgttatggtaaaatacgatgaaacttctatggcttga

SEQ ID NO: 80822 - DNA, 582 bp, Glycine max
  Peptide Sequence Number=SeqID_197600
atgggtgaagtagacgcggtgcaagagtggataaaggccgacatagaggccctaaaagagcaaatggccacaatgatggaggccatgatgagcatgaagaagacaatggaggtcaatgtggctgcagttgctgctaccagcgccgttgttgaggtggacccaactcccccatctggcctcaaccaaataaatcatccaacctcggatatggtaggtcagggaggcaaggagtggggaagtacgggcgactcccattttgtgcaagttcaaaacaagcatgccttcccgccatatagcttgcctcccatctacacaccacccaatctggtgcacactctcgatgagaatgtcaataactccaatcccacactcatcgagagccaacaacctcaatctgatcatgcacatgtgatcggaatggagaaggaagagagagaggagatgccacttcaaggagaagatgagtctagaagaagctcaccacaagccaaggataagagcttggaggtaggagaagaagaatggagggagaaggagagagagaacacgaaatttgtgcctcaaaagagatctgaactttga

SEQ ID NO: 80823 - DNA, 114 bp, Glycine max
  Peptide Sequence Number=SeqID_197601
atggattggcctgctgaactcgcctcaaaatggtcgagtgggcccactccgcctaatctgccaacctggcgggccacaagtgggatgggacaggttgacccaccgtcccactaa

SEQ ID NO: 80824 - DNA, 207 bp, Glycine max
  Peptide Sequence Number=SeqID_197602
atggtgactagccttggaaaggttgcaagaaggctttcaatgtcacagatggtttgctttggagccaagaggatgccaactgcttacaaggcaatgttttggaaacaaaggggagggggaatcagtgatttattttctccaccacaggttacaatatgtcaagatcagtacctatttaatttacatttggtatcagagcttgtttga

SEQ ID NO: 80825 - DNA, 1176 bp, Glycine max
  Peptide Sequence Number=SeqID_197603
atgcttatgcaaatatcgaacaaatcttcacaacagtatgattcggatacttttcgcagaaattttggtcacagtggaagttttaaaagaggcgaccgccatggtggtggctgcggcagttgtggttgtgggggaggacgcttcacaaactttcaatgccaagagaatcatagaaaattcagcaactcagtccttttgaaggtccataccaaatctacattggtaatggacaagggagccaacgagatcttacttcaaggctcacttggatctgatggtttatatatctttacaaatcttcgactccaaggctcagctgctgctagttcagcttcttgttttgtttcaaattcagtaaataattccagttctgatataaataatttcaagtctgatgttcacatggattacttgcttaaaaataaatccgaaactttcaccgttttccaacagttgaagttaatggctgaacttcagtttaattccaaaataaaaagtgagcaaacagactggggaggggagttcagaccactaactaattttttagcaagccatggaataattcatagattgatttgtcctcacacacatcaccaaaatggtgtagtggagaggaaacacagacatgttgtagaattgggccttgctcttctcaaacaagcctccctacgtctcaaattctgggattttgctttcacagcagcagtttattttatcaataggttacgtaccacctccctgaactttaatgttccctacactgttctgttcaataaactaccagattatacttttgatgatagaaggtctacatcaggggctgctatttattttggtcctaatctcatatcttggtggtctaagaaacaacaaattgttgcaaggtcaagtactgaagctgagtatagaatcctagctcaagcagtattctgtgataatcaaagtgctgttgccatcactcacaatccagttcttcactctaggacaaaacacacggagattgatattttctttgttagggagaaggttttagctaagaagctgcaaatttatcacattcctgcaactgatcaatgggtaaatgctttaacaaagtctttgtctccaactggatttcttttcttaaggtccaaactcaatgccattgagcctccctcaaagactcaacaccattga

SEQ ID NO: 80826 - DNA, 2955 bp, Glycine max
  Peptide Sequence Number=SeqID_197604
atgccactgctccaattttcttcatctttcgaagtacaggttacaaatcctgcaattgatcctcttcgagaaggattggttatgtctcttgaagtgaatattgggaagagaaggaatatattggaaattgggccagagaatgcttcacagggcattgaaggttccttggagaaagcattaaataagctttgtgaagctgcagatgaagctgttagaaatggttcccagctgcttattctatcagaccgttcagaagcattggaaccaactcatcctgcaattccaatacttcttgctgttggtactgttcatcagcatctaatccagaatggcctgcgaatgtcagcttcaattatagcagatactgctcagtgctttagcactcaccactttgcctgtttaataggatatggtgcaagtgctgtgtgtccgtacttggcattggagacttgtcggcagtggcgtttgagcaataaaaccgtaaatctgatgaggaatggaaagatgcctactgtatcaattgaacaggcacagaagaactattgcaaggctgtaaaagcaggccttcttaaaattctttccaaaatgggcatctcgttgctatcaagttactgtggtgcacaaatatttgaagtctatggattagggaaggaagttgttgatcttgcattcagaggaagtgtgtcgaaaattggtggattaacttttgatgaggtggcaagagagactttgtctttctgggtgaaggcattctctgaagatacagctaaaaggttggaaaattttggatttatacagttcagaccaggaggggagtatcatgcaaataacccagaaatgtcaaagttgctccacaaagctgttcgtcagaaaagtcaaagtgccttttcagtttatcagcaatatttggctaatcgacctgtgaatgttctccgtgatcttcttgaattcaaaagtgatcgtgctccaatacctgtggggaaggttgaacctgcttcatctattgtgcaacggttttgcacagggggcatgtcacttggagctatttccagagaaacccatgaagcaattgcaattgccatgaacagaataggtggaaaatcaaattcaggggaaggtggggaggatcctattcgctggaaaccacttacagatgtcgtagatggttactctccaactcttccacaccttaaaggtcttcaaaatggggatactgcaactagtgccatcaagcaggttgcttctggaaggtttggtgtcaccccaacattcttggcaaatgctgatcagttagaaattaagattgcacaaggcgcaaaacctggtgaaggtggacaattgcctggaaaaaaagttagcatgtatattgctaggttgagaaattctaaaccaggagttcctcttatatctccacctcctcatcatgacatttattctattgaggaccttgctcagttgatctttgatctccatcaggtgaaccctaaggccaaggtgtcagtaaaactggtggctgaagctggaattggcactgttgcatctggggttgcaaagggcaatgctgacattatacagatttcaggacatgatgggggaacaggagcaagccctataagttccatcaagcatgctggaggtccttgggaacttgggcttacagaatctcaccagacactcattgaaaatggacttagagaaagggttattctcagagttgatggtgggtttagaagtggagtagatgtcatgatggcagcaataatgggtgctgatgaatatgggtttggttcagtggcaatgattgctactggatgtgttatggcccgcatttgccacaccaataattgcccagttggtgttgccagtcagagggaagagttgcgtgcacgctttcctggtgttcctggggatcttgtcaactactttgtgtatgtagctgaagaggtaagaggcatattggcacagctggggtatgagaagttggatgatgtgattggccggactgatttgttccaaccaagagacatatctctagcaaaaactcagcatctagatctgagttatatcctctctaatgttgggttacctaaatggagcagcacagaaattaggaatcaggagcctcataccaatggtcctgttctggatgatgttttgctagcagacccagagcctctttgcatatgcaaggctaaagctgcgtacaatagtcctcccccatactttcgcataacaaagagccttctggcactaggggatattaatgatattgtttttcagattgcctatgccattgaaaatgaaaaggtggttaataagaccataaaaatatacaacattgatcgtgctgcatgtggacgtatagctggtgtcattgcaaagaagtacggtgacactggttttgctggacagttgaatataacatttacaggaagtgctgggcagtcatttgcatgctttctgacacctggaatgaacattcgccttgttggagaggctaatgattatgttgggaagggcattgctggaggtgagttggttatcactccagttgacaagaccggttttgaacctgaggatgcagctattgtagggaacacttgcttgtatggtgcaactggtggacaggtcttcgttagagggagagcaggggaaagatttgctgtgagaaactcgcttgctgaagctgtggttgaaggtgcaggagatcattgttgtgagtacatgactggaggctgtgtggttgtcttgggaaaagtgggtagaaatgtagctgctggaatgactggaggattggcttactttcttgatgaggacaatactttcatacccaaggtaaatggagaaattgtaaaaattcaacgggtgtcagcccctgttgggcagatgcaactgaagagcctgattgaagctcatgttgaaaaaaccggtagtacaaaaggtgggctattctga

SEQ ID NO: 80827 - DNA, 3573 bp, Glycine max
  Peptide Sequence Number=SeqID_197605
atgactggcgacgccctcggttggtatcagtggatgcacaataaccatttgatttcaacatggaaggagtttacccgtgctatggaacttcgcttcggcccctttgcatatgaaaaccatcaacaggcccttttcaaactacagcaaacagcaaccgttcttgagtaccaacatgattttgagcgtctttgcaaccgtgtgactggcttgccgcatcactccatcctcgattgtttcatttctggtttacgtccagaaatccaaaatgaacttgccatactacaacctgtcacaatttcacaagcaattggcttggccaaattggttgaatccaaattgttagcatccaaacctagtttcacctacagccctcgccccactcaacctaaatccatactgcctctattgcccaatccaccaccacaacctcgcctaatccaacacccttcacagcctctcctagccttaccagcaccaccctcccccaaacccactaccccacaaattcgtttgttatccaaaactgaaatggatgaccatcgagccaaaggattatgttttaattgtgatgaacgataccataggggccaccgttgcaaaaacaaagggatgctactactactttccccatctgaccctcccgatcctcattctgatcacatcttagatgatgtacctcctctaaccaattcagaaacaacccctcccaccccctctgcattccttctccattctgaaaccccacctacttacaccaaccccgaacaatttcacctgtcactgcaagccgtttctggccagccctcacctagaacactacgcttttatgcgcgtataaatggtcattatgtctcagtcttggtggacaccggaagttcacacaacattattcagccaagagttgcaaccttattgcgtttacccactcaaaatctgccatcttttgttgttatggtgggtaatggggctcatttaaaatgtgatggtttgtgtacagatgttcctttgacagtagttgaacattgctttgtggtgtccctctatgttttacctattcaaggggctgacattgttctgggtgtccagtggttacaaactttgggaccatttgtttctgattatattataccatcaatgcaattttaccataatggagtcctagtaacacttcatggtacaacttccccttctctatccctggccaccttaccccaactaaatcgcatgatacacactgagtctgttgctaccattcacaccattaccatgctacctgctgactccttacccccaccttccacaccacaaacacactccttatctagagacgaacaacccacccttgactcattccaccctgacattacccaactactacatcgttactcacccattttttctattccccatggtctacccccaaaccgaccccatgaccaccatatccacctaaagccccactccaaccccatcaacattaaaccatatcgttaccctcattttcagaaggaagccatgacttccatgatagctgatatgctacaacaggggatcattcgaccaagtaccagcccctattcctccccgattttgttggttaaaaagaaagatgggtcatggcgcttttgtgttgactatagagcactaaatgcaatcactattcgggatcgttttcctatcccaacaattgatgaactgttggatgaattacagggtgcccaatttttctctaaaattgatttgcggtccggttatcatcaaattcggttggctcaagaggacatcccaaaaactggttttcgaacctttgatggccattatgagtttttagttatgccctttgggcttactattgcgccatcaacctttcaggcagccatgaatgatttacttaggcctttccttcacaaattcgtattggttttctttgatgatatcctaatttatagtcctacttggtctgcccatctaactcacttacagcaagttttgcagctactacttgataaccatttttatgctaaactttctaagtgtaattttggtgtttgttcagtggattatctaggtcacattatttcagggaatggagtacaagctgaccttacaaaggtgcaggacatcttggcatggccaactccaaagtccctcacagctctccgagccttcctcgcattatgcaactattgcaggccccttacagatttacttaaagctccaacattaatgtggacttctaaagcagaggaagcattcacaaaactcaagcatgctatgactaatctaccagttttggcattacttgattttaatcttccttttgaggtgactacagatgcttctggtgtggcagtaggtgttgtcctctcccaacaaggccacccaattgcctacttcagccgtaaaatgtgccctcggctatgttcttcttctgcttatactccggagcaacagaaatggttaactaagctcattggttacaattttgagatccatttcaaacctggcaaagagaatttcgtcgctgatgtcctgtcccgcatgccggaagcatccactggactttgtgctactcaattctatgcagcacatcctgctggaaaacaattgttaacaaaactctgtgaaagctcaaccatgcaacggaactttagttatagagccggtattctttactttcacgaaagaattttcataccacaggaagctgccatcattccatccttgctggaggaataccactcatcacctttggggggtcactcaggtattaaggctaccatatctcgcttatcagctgtattttactggcctggcatgtatgcagatgtgaagcacttcatcaatagctgttccatttgtcattacaacaaatatagcacccaacccccttatggcctcttgcaaccacttccagttccacaacaggtttgggaagatatctctatggacttcgtcaccaacttacatgtttcgtctaacaagacagtcatttgggtcgtggttgaccgcctaaccaatgaagaacctcaacaatggacccgtttcctttcgcttgcgaagttttggtacaacacatctcatcattcagccattggcatgactccgtttgaggctctctatggccgtgctccgccgtccctcacttcctatgttgcgggctcctccaaaattgcagccattgatgagaatttagccaagagaagtgacatattgcagctactcaaaaataatctacacagagcacaacatcgcatgattcagcaggtgaattcaaagagaagagacaaagaatttgcagaaggggattgggtttacctgaagcttcaaccctatcgtcaagtgtcagtgcaccgccgttcttctcaaaagcttgcaaagcggttttacagaccctttcgcatccttcaccgcatcggaccagtggcatacgagctggaattaccctctacagcgcgcatccaccctgtatttcatgtttcacttctgaaaccctgcatcaaaacaccagacacgcaaatccttcctcttcccgtgacagccgtcgtcgcaccttctcgaaccaaaccctaa

SEQ ID NO: 80828 - DNA, 354 bp, Glycine max
  Peptide Sequence Number=SeqID_197606
atgtcgattgatgttggaaatgcattggcatgtgcatgttgtgtatgttcgtggggggcactgtgcactgaccttccagggtctttggcactagcttttggcaacgttcatatgttggatgttgtgtatgatcgtggggggcactgtgcactgaccttccaggggggcttgtcacctggaagggattacctttgggctcccaggctgatcacctatgggaggggggtttttacgtgcacaaccgggtggtctcgacaaactcagcacaattccctaagtgagagtgtcgtgtggacacgcttaggctatttcctaaggtttggttgttgttggtacgtaccacattgcatctga

SEQ ID NO: 80829 - DNA, 258 bp, Glycine max
  Peptide Sequence Number=SeqID_197607
atgcaatggcggttccaaagtcagaaaagatgcaaagacaagatgaaactaacaagaaacaagcatagaaccatggttacctcgaaagaaaatgaaagggtttcaatggagaacaacgatgatttgtggtggctaatggtggctgtgggtgatggagaaagtgcttgggacgttagaaatggctttggaagaaagaaaggagaagaaatggcatttttcctaagctacacgaaagcaaaggctgaaatgcttaaataa

SEQ ID NO: 80830 - DNA, 881 bp, Glycine max
  Peptide Sequence Number=SeqID_197608
atgaagaattctcgtatgatcttggaggaagaacatttctcattcattggtttaaggatctatgaggaagagacaaaaggatgggcaatctttccttggccttttgaacgagtagcattcttgattctcttgtcaaacgataagtatcgtctggccgaggacaacagggaggcctgcatgagctcccccgacctctcctccctgtggctgtcaacgccgcaatccgccactccgggacccgacacgagcagagctccgccgcctccgccgccgcaatctcagtctcctctacaaaggcggttgcagacgctactagaaggagctagagaaagctggacctatgcaattttctgggagtcttctcacgacaacttctccggcgctacccttctccgttggggcgacggctattaccagggcgaggaagaggacaaagccaaaggcaaagctcccaaaacgacgacgtctgcagaacaggctcgccgcaagaaggttcttctcgagctcaactccttaatttcggggccctcggtctccgccgatgacgtggacgaagaggtcaccgacaccgtgtggttctttctgctgtccatgactcagtcttttgctaacggcaccaccctcccgggccaggcttttttcaactcgaccccggtctgggtcgccgggtccgaccggttatctgaattggcctgcgaacgggcccggcaggggcggatgtatgggcttcggactctggtttgcataccttccgcaaacggcgtcgttgaactcgcttccaccgaggtgattttccagaaccctgatctcatgaacaaagtgctcgatttgttcaacttcaacgcagtggacggccatcccactctaccaccacgacaacg

SEQ ID NO: 80831 - DNA, 1773 bp, Glycine max
  Peptide Sequence Number=SeqID_197609
atggattctcaaatactcaactcattagcccttatcttgccctttttcctcttcatgattgtggtgctgaaactagggagaaaactcaagaaaactgagccatctctgaacatacccccaggaccatggaaactgcctattgtaggaaacttacaccaacttgttacatcttcaccacataaaaaattcagagacttggccaaaatatatggacccatgatgcatcttcaacttggggagatcttcacaatcgttgtttcctcggcagagtatgctaaggagatactgaaaacccatgatgtcatctttgcatcaaggcctcactttctagtttcagaaataatgtcctatgaaagcacaaacattgctttttcaccttatggaaattattggaggcaggtacgtaaaatatgcaccttggagcttctctcccaaaaacgtgtcaactcattccagccaattagagaagaagagctcaccaatcttgttaaaatgattggttcacaagaagggtcttccatcaacctcacagaagcagtgcactcatcaatgtatcatatcattacaagagctgcgtttggcataaggtgcaaagaccaagatgaattcatatcagcgataaagcaagctgtgctagttgcagcaggtttcaacataggagatttgtttccttctgctaaatggcttcaacttgttactggtttgaggcctacccttgaggcgctttttcaacgaactgatcagatactagaagacatcatcaatgaacacagagaggcaaagtcaaaagccaaagaaggccatggtgaagcagaggaagaaggtttgttagatgttctcctaaaattcgaggatggtaatgatagtaaccagagcatttgcttaactattaacaatatcaaggcagtaatcgcggacatcttcggtggtggagtagagccaatagctactaccataaattgggcaatggcagagatgataaggaatccaagagtgatgaagacagcacaggttgaggtgagagaggtattcaatattaaaggaagggttgatgaaacttgcatcaatgaactcaaatatttgaaatctgttgtcaaagagaccctaaggttgcacccaccagctcctcttatacttcctagagaatgtcaagagacgtgtaagattaatgggtatgacataccagtaaaaaccaaggtattcattaatgcttgggcaattggaagagatccaaactactggagtgaaccagagaggttttatccagagagattcattgacagctctgttgattacaaagggggtaattttgagtacattccatttggtgctggaagaagaatatgtcccggcatcacctttggtttagtaaatgttgaactaactcttgcgtttttgttgtatcacttggattggaagcttcctaatggaatgaaaaatgaggactttgacatgactgagaaatttggagtgactgttgcaagaaaagatgacatatacttgatacctgctacttctcgtcctttcctggaaaggaattcccatcttgtgtgcgctcacggtcccaaaagattaatcaccactttcatgatatttatatttataaaagaaaaagctgtaccaatctgtgttcctactaaaaaactggaaatggtgcagaaagcatggaagcagtgcagtcaaagaaggttgagtaggattcagtgccaggatcaagaaatccctaaccttgatatctttgttgaaaaatgcccaagtgtttcagatttttaa

SEQ ID NO: 80832 - DNA, 1318 bp, Glycine max
  Peptide Sequence Number=SeqID_197610
tgttcatatcgtagcgacgaggtgggtcgttacacctgtcttcaagtgcaaatggcttaatggaaatgccggtgttagtaaagacaaaatgaggtttactttggttgaccttgaaaaggttggttacaaggatgagcctttgacaatggcagcacaagctagacaggtgttttatgtccaagatccgagtgacccaacatggtcacttgttctacaggggaaaacaagtggtatcccttatgatatgtgtgcttcaacacttgatgtgaaccacatacccaccttctccccacaaatgtcttccataaatgctgaaaatgaagaggacgatgtacatacaaatcataacgatcatgatgaaggacccatggcaacacccccaggaggttcccttccaccttcagatgctctatccgggactacgtcaaggaagactagacaaagtacccgactcaaaagattgactagcagaagcttggaccagccacggcctgttgtgaatatgaaccctgcaactgatgtctcggattcgctaaagaacctaatatgggatgacattaggcaatttaagtcgtccctcaccagtaaatatgtatatgctgacaatgatggtgaggataaagttcatccttctgttaagtatggcctggatgtggaatcttgggaaaaatttgcggagagtcgccaaacccctaattggcagagaaaacatcagcaaactgagtttatggaaaattcagcaatgctgaacgatcctccatccccgatggcgagacatgtcaagtggaagatgactcgtacaaagcgatatgggcagatgacatctacatcggcacaacaaggaagctttattcccgaaggtcatcaagacatattgaatactgcacttggccgaccagagcatcctggtcgtgtttgtgtagctggccatggcctccccaaactcaccctagtagaagcgccagaccctcaggtattaggtgcacgtgtcagcgccaaaggcagttatgctaaagttgttgcaaatgttttacctaaagatccttttgctgctcatatgacaaggatgggcttgtacatagttgttgaggatgatgatgtcccgagggtcactgttcttatagtttacgacgctgacgctcaggtaccattttcgacgtcagagattcaatatgtgaaggaaacgcatcttgtgaaacctatatctaatgattcacacaataatgtggtgaaatcggttggacgtgttgagaggtgcaacataggtgctgcagaggatccatttggagaattgatgaagattttgtatgacgtttag

SEQ ID NO: 80833 - DNA, 765 bp, Glycine max
  Peptide Sequence Number=SeqID_197611
atgcaatctcagggacttgcagtgcctcctgagcctctggttggtccctccgatcctcgagtgagcacaaaggggagttgtgttgatccctcaggaaacgatcctatgaccggtgactctgacaggtgtggcttgtacatagaagcagatcctgcccgcctggttgccatggggagagtttatgagggatccactgttgttcataacactcctttgttgcctggccaagtaaaggtgagtgtggaggaggttacagatgcagatgcttcagttcttgtacccactgatgaggtttccttagtggggcaggcacttcacaccttccttgcttggccgacacatctggtcaagtctttatcacagcaggtagttgtgtctccgccaaaaccacctccgaagcccgatccggaggtcgatgatccactttatctgatgacattgatcatcccagagcttttcttgaggccttatcaggttagatgggatgtcaccatgttcggggtcgttaatccagatttccccctgtacataaaacacgaagacctctccgaaatcgcacacggtggtcaatgtctcagcatattagtgttacagttgtggattttgcatctcactgaaacatgtatgcgagcggggaattctgatatctatggattcctcgaacctcagtccattcagaggtctgggaaatcgcagtttgaatctgaaagttccactgcagcggacattggcagatggtggtcatcctgcccaaggaacacttag

SEQ ID NO: 80834 - DNA, 159 bp, Glycine max
  Peptide Sequence Number=SeqID_197612
atggggcttagtgatgggtcacagagttctcttcgacagggcttagtgatgggtcacaaagttctctttcaacacttggtgaagaccaaaggggatgttggagttgtctttgaacacgaaatgagacgctggctcaacagtggaaagggacagttgtaa

SEQ ID NO: 80835 - DNA, 687 bp, Glycine max
  Peptide Sequence Number=SeqID_197613
atggtttttagtatggatgaatctacaaacaatgttgtactttacgctggggtgccagagaaaagaggtaaaggtaagttggatgcggtagattggctgagtaatgctttgaggcctctagaagggagatgtggtaaaggaaaatgtgggtcaagaatgcgaccaaatgttcatttgaatcggtggttccatcgcactgctcttagtttagaggtttccaacctaagggcggtgtatgtcggacagactaggatcatcttgggtgtttgtggtttgtcaggggtgttattccccctaagtgcactcatgcattttatgggcagagtgctcatcgccctaggggcgtctcacgcgagcctccaactagttgtggttagccttcaactttctaagcttcttctcgtgatgtcgctccatctccgcaatatgggtttggagttgttggagagtattggtggacgtggccgaaatgtgttccaggatctcacacattgggctgaaagttccctaaggataagaaggggaacctgcaaaacaaaggactatgatgctcaatttgggagccggctgctaaggctaatgcgtatgtgctcctgtaccaaggctgagttgacatatataatggggtacgacgtccactttgtagaccttggacaatacaggatccttaaacatatttttacctaa

SEQ ID NO: 80836 - DNA, 390 bp, Glycine max
  Peptide Sequence Number=SeqID_197614
atgattccggtagacgatgttggtgaagcatatccacgcattgaccattccccttggaatggatgtggaggaggcggtgtcagtgaagtcacagacgatcaagcacatggtcaaagacaaattcccgacaacgaaattcctctccccaatgttaccaacaagattctagggaaggttatcgagtattgtaagaagcacattgaggccaattgcgctgatgaaaagcccaatgaggatgaactcaggcttgggacgttgatttcatcaaggttgatcaggccactcttttcgatctcattctggggtttcaccaagtttagccgtgctgattatctcaagtacaagtcagagagcaagattgtgcctgttggtgtgaatgttaagatctga

SEQ ID NO: 80837 - DNA, 273 bp, Glycine max
  Peptide Sequence Number=SeqID_197615
atgtccatccaacgatatctacataaatgcccacaagatgaagatccatgcagagttaaggggcaccctaccacagtaccaccttaccttgcaagttatatgtcgcaacaacaaaacagggccaagtctacccaacatagcgtcgaggttcacagtgttgagtggtgcatggctaaggaggcggcgaggtcaatgatggttatgcaatggtctcgtgatttgggatggcttaaggaaagggaaggcgagagaatatggttgtgtcatggttag

SEQ ID NO: 80838 - DNA, 465 bp, Glycine max
  Peptide Sequence Number=SeqID_197616
atgaaggctgatatggaggccatgaaggaaaaaatgacaatgatgatggaagaaatgatgagcacgaggaagatgatggaggataacactactacaattgttgttgcgagtacaactactaagatggacccgattcacccaatcgcttctagtgagaatatcgacaattttgcacctgcactcattgagaatcaacaaccccaatctcatcatgcacatgtctctcaacccatgagagaaacacatgaagttccccaagaccacactctggttggattcggggtttatccaggatataacactgaagggaagaaattttctagcatccctgtgctgaatgctctcggaatatctcaatgttgcccgttatcacaacccttggattttgtaaggggagaggggccttccacagtacttgagaaagaaaggattgagccatatggaggagaggctacgcgccattga

SEQ ID NO: 80839 - DNA, 498 bp, Glycine max
  Peptide Sequence Number=SeqID_197617
atggaggaatgccaaaagctaggtcttacaaaatgcattggagtcagcaattttagttgcaacaaacttgaaaatttgctctcatttgctactattcctccttctatcaatcaagttgagatgaatcctacttggcaacaaaagaagttgaaagaatactgtcaggcaaaaggtataatcataactgcatattctcctttaggatcaacggggtgcatgtggggttccgataatgttgtggacaatgaattgctgaaggaaattgcaatggctcatggcaaatcttcagctcaggtatctcttagatggttgtatgagttaggagttactattgccgttaagagctacaacaaagaaagaatgaagcaaaatttggaaatatttgattggtcactcaacaaatatgacaatgaaaagattgatcaggtgaagcagcatcagttgagcaagatcggaccaacaaaatttattgttgacctttgggatggagaaaattaa

SEQ ID NO: 80840 - DNA, 156 bp, Glycine max
  Peptide Sequence Number=SeqID_197618
atggcggctcgtggtggtcaacaatggtcatggatggtggagaaggagatctcacttagcgagctcgtcttgctaagcgggagtccaatttttgtgcttagcgcgacaattcatgctgagagcaactccctgtgcactaattatcgcttagcgtaa

SEQ ID NO: 80841 - DNA, 266 bp, Glycine max
  Peptide Sequence Number=SeqID_197619
atgtcttcatcaaacatccctcatgtggtgctacaatcctcctccaaccatcacagaatgcctgtgattggatttggcactgcttcaatgtcacccccgagtaccaccagagtggcagtgttagaggctatcaaacttggttatagacacttcgatactgcttcaatatatggttcagagcaaccacttggagaagccatagctgaagcacttcaacttggcctcataggctccagagatgaactcttcatcacttccaaactctg

SEQ ID NO: 80842 - DNA, 216 bp, Glycine max
  Peptide Sequence Number=SeqID_197620
ggctatgatatcaacaactattctttctacccagagtcacaagatcacaaaagtactgtgcagaacagtgggatcactgttgatgctcattcagatcactttagcagtgtagtagataataatccagtacgagcttccatgccttattttggagtgattcaagaaatgtgggagcttgatgatggtcaatttagagtccctgttgtaacaccctga

SEQ ID NO: 80843 - DNA, 207 bp, Glycine max
  Peptide Sequence Number=SeqID_197621
atggagagtgagagtactgggagcgtaagcactgacctggtgagcacgaataaagcagaagatgcgaggaaaatggaggaaactactaaaagattgccatcacaaaaagtggctagctcaaattcaaggaaaagaaaggaaaatccagtggcaagctcaaattcaaacaaaagaaagggaatacctcgtagggcacctttttattag

SEQ ID NO: 80844 - DNA, 300 bp, Glycine max
  Peptide Sequence Number=SeqID_197622
tggctgccggatcagttgcgagtcgagaagggcttcagcccggatacgctgcgtctgctggaagcaaaaggtcagcatgtgaaagtgctgccggcgatgggcagcacgcagagcatcatgattggcccggacggcatgcgctacggcgcgtccgacccgcgctcggtggatgatttgagtgccggggtgagcattcatgcgcaccggcatcagatagtgcaaatcccctttaacatcagggaattcgcgcgcaacgtcaacggcaaaaaaatcgggaaagggctttacagacgcaaatga

SEQ ID NO: 80845 - DNA, 315 bp, Glycine max
  Peptide Sequence Number=SeqID_197623
atggttctttatcaggttctctctgttgttgggcttcttcaagatgaagttgatccaatggtctttgttatgaaggttgaaaaggcacctttggaatcatatgttgatattggtggtttagatgctcagatacaggaaattaaagaagcagtcaaacttcccctgacgcatcctgaactgtatgaagacattcgtatcaagcctcctaaaggagtcattttatatggagaacctggaactgggaagacgttgctagctaagttagatggtttcgattcaagaggtgatgttaaagagattcttgcaaccaattga

SEQ ID NO: 80846 - DNA, 393 bp, Glycine max
  Peptide Sequence Number=SeqID_197624
atgaggctagaacaaggttcccattcttgtattgaaagagccattgattcacatggagcatttgccattttgtacagtcgccactcaaagcattatattaagaaacccgaggaatttgagcatgtaaacaggttttactgggacgggcaactcaaagtgttcctgtggacattgacttgggcatcaatggagggcatgtcaatgcaatatctcgacgtcactcgcctgcgcttccgtgactgcaaccacattgtggagatcgtgtttgtggagatcgtctttggcacttatccattgagttcgtgtttgtcgcaaactgggctgcgcttccgtgactgcaaccacattgtcgagttcgcgtttgtggagttcgtgtctgcgcttccatcgaag

SEQ ID NO: 80847 - DNA, 633 bp, Glycine max
  Peptide Sequence Number=SeqID_197625
atgatgaggatagagactattgaaaagagacagaatttgtctatggttctgactatggttatatctatttcttatgccatgatggttacaaatgaaattggttccacatttaccagctttagtttgttctatcataatacacagaggtcacgatgctataactaccccgcaaggcaatttggcttggaaagcaacaaaggcattagaatacgatttttcacacaaagagtgaccaatgtagatcctgctccaacaatctatagtgctagcctaagatcacgaaaaggagtggatatcgcagtcaagcctactagactatataattttttaactaggaaatcaactggtatgagaaacatagaagctgtttatttctttttaaaaacttttgaactaggaaaccaaaatcatagaatcatatcatcaaccacacagggaatcaattgctacaagggtaaagcgagaaataataaacacctcacctaccttggacagcagagcagcctagggcatagcggggcgtgcacgacacaatgcaaaacaggcaaccacgacacaggcaaccacgatggggcaggctacgacatggtggtccgacgaggcaggcaacgacacaacgaatgtcaactttga

SEQ ID NO: 80848 - DNA, 249 bp, Glycine max
  Peptide Sequence Number=SeqID_197626
atggatgtgcttgatacatacatgattgaggggcagattcaatgctctgatcaaagaagattactctatgaagaatctggagatgaattagacagaaagaaagcatgttatttcagaaatccaggaatcatgtttctcattggcgagttgacttggatgaaaaaggggtattattttggtaatggcaggagtaggactttgaaaaatatgcattgtctggaattatggcttgccatccttaggacatag

SEQ ID NO: 80849 - DNA, 247 bp, Glycine max
  Peptide Sequence Number=SeqID_197627
atgaaggcattaaagatcaagattaaatgttggagtagggagacttttggtggcttggatgcgaaaattgaagagttggttagtgaaatggatgtgcttgatacaaacatgattgaggggcagatccaatgctctgataaaagaagattactctatgaagaatctggagatgaattagacaggaagaaagcatgttatttcagaaatccagggtcagatggattaaactgggagactctaatatcag

SEQ ID NO: 80850 - DNA, 145 bp, Glycine max
  Peptide Sequence Number=SeqID_197628
atggaatcaaccaatgtgaagaacaagtcaagtggaaaaagaaagatgtctagtgaggacacaagaagctacttcccacggaacttggaaatggagcgtgtgctagctgatgtgcttagagataaaaaaatattgggcaataaag

SEQ ID NO: 80851 - DNA, 252 bp, Glycine max
  Peptide Sequence Number=SeqID_197629
cttaattccggtaaggtgatagcggttggacctggatcacgtgacaaggcggggaacttgattccggtgtctgtgaaggaaggtgatcacgtgctcttgccggagtacggtggcacgcagatcaagctcgatgacaaagagtatggtttcgagatcgtgttttgttccatttgtttagggatgaggacattttgggtattctgcatgattgatgttgtgaatgtgatgcgtcctacaacatgcaaattgtga

SEQ ID NO: 80852 - DNA, 471 bp, Glycine max
  Peptide Sequence Number=SeqID_197630
atgtttttcggcagtcgcgcctcaaaatcgaatcttcgaattccggagagcgcgctgtacctcgggaaagtgagcgaagcgtctttttccgacttcattgatgccatttcgcgccacatggactgtttcgtcgacgccgcggcgagcgcgcgcgtcgggttgtgcggtgagcttctcgatgagcgcggcgctaccgaggaaagaacgctgctggatatgaatagaaagcgcgtgagggaagcgcgagcgaagatacatgaactgcacgagacggaggacgcgacgagagagcgtctacaaagagagtccacggacgtgagcagtcgcgttcgagacgccgtttcgtacgcggaaaggtacgagccgtccaacaaaaaggcgcgcgcgacacctccagcgaaaaattgggatgtcctttccctggggcagggtagcctctcgggggagagctcttcttcggatgaagaatga

SEQ ID NO: 80853 - DNA, 252 bp, Glycine max
  Peptide Sequence Number=SeqID_197631
atggataaagttgatatctttgtccctcatcctctcacaaacgcatgtttgcttattcaactttcaccggaatgtgggtgtaagccattggtctgtttgctcaagcaacctgcgctcctgagtgttgacttccaagaccgttcaatcagagattactcatcttgcacgttggtggggagaagtgagttatcaagaataggatgttggacatatggcctcagttatcttgagaagaagaggggattgaattaa

SEQ ID NO: 80854 - DNA, 127 bp, Glycine max
  Peptide Sequence Number=SeqID_197632
caattgcaagggatgtgttaactattccgatctccactatagcttctgaatcaacatttggtattggaggttctagagcaattgaagaatcaacttttaccgatgagattgaatcagatgatgaaag

SEQ ID NO: 80855 - DNA, 450 bp, Glycine max
  Peptide Sequence Number=SeqID_197633
atgaaccatccttgctcaacttctcatctctgcaaactatcgatctttccggtactagttattcccctgcctttgacttctcttgttgaacttgatttatcaaataatcaacttgaaggaaccattcgaacttctttgggaaatttgacttgtcttgttgaacttgatttatcagctaatcaacttgaaggaaccattccaacttctttgggaaatttgacttctcttgttaaacttcaattatcacgtaatcaacttgaaggaaccattccaacttctttgggaaatttgacttctctggttagacttgatttgtcatataatcaacttgaaggaacaattccaacttctttggctaatctctgcaacttaatggagattgatttctcatatctcaaactcaaccaacagcacttgcagttcagagttcacgactttcaggcaatctga

SEQ ID NO: 80856 - DNA, 288 bp, Glycine max
  Peptide Sequence Number=SeqID_197634
atggaagttatgcctctccaattaagccttaaactcgtccagctcagtgtggtatatttccaccttcctctcagctggcaagagcccgctaagcctaaaatcagccgcaaggatatgcacttagctactcataagctttgcttagcggcattaaacagagcaaaagtttcactaagttatgggagcttagcgaacagggtcgctcagcttagaaaatgccgcaacaaatttcgcttggcctatagaagctcggcttaccgcacgtctatcaacaaaattattgactaa

SEQ ID NO: 80857 - DNA, 774 bp, Glycine max
  Peptide Sequence Number=SeqID_197635
atgatgattgattttgccctcgatgctgagcgcgcgcatggcagccagccgtcacaggccatttaccaggcatccttgttacgctttaggccgattttgatgaccacactggccgccttgttgagtgccttgccactgatgttcagccacggcacggggtctgagttacgtcagccgctgggcattgtcatggtgggcggcttattgttcagccaggcgccgtcatgcgaatgccgccgcgctggaaccgtcatgaatgtgctgaccacttttatccggcggccggtcgccacctctttgctgacgctggccattgccttgcccggactcttggcatttaaatatctgccacgcgccgctttgccgcaagtcgattatccaaccattaatgtggctgccaatttgccgggtgccagcccggaaaccatggcggcaacggtggcgacgcctctggaacgcgcttttggcaggattgccggtattgaggagatgacctcgaccagcacgcagggatctacgcgcattaacttgcagttcgagctggaccgtaatattgatggggcggcgcgtgatgtgcaagccgccattaatgccgcgcgtgctttattgccgcgcaatattccgtccaatcccagctaccggcgtatcaatgcttcggctgcgcctatcctggcgatttcgctgacgtcgcccacgcataccaaagagcaattgtatgactatgcgttttctatcctgggacaaaaaatctcgcaggtacgtggtgtcggccag

SEQ ID NO: 80858 - DNA, 270 bp, Glycine max
  Peptide Sequence Number=SeqID_197636
atggcggtgaccgggtaccaggctggtacatgcgtggtgttcagatgccatagcaggatgcaggcacagccgttcaggcggggaggccgtaggtcacgcaccggtcttgcgccgcagcgcgcgctgcgcctgtcactgctggcagtgctggttgcctcgggtgtcgctcaggcggccgatacgcaaaacagtgaggccaccctgaccgttgatgccagcgccagcgcggaagcgcagcagacgcaggccgcagcggactacagcgtaccg

SEQ ID NO: 80859 - DNA, 307 bp, Glycine max
  Peptide Sequence Number=SeqID_197637
atgagcgatgcactcaaggcattgaacaatcttcgtacgctgcgtgctgaagcacgtaatattgaggttgcggtattaaacgaaatgctggagaagtttgccgtggtggtcgccgaacgccgcgaagagacggcggcagagagtgctgcacagcgcgaaaaagaagagaagctggcgttatataaagagatgctgcgcaaagacggcattacaattaatgaactggcgcaattaaaccagggtgaaacgaagagcaaagcaaaacgtgcaccgcgtccggcgaagtataaatttaccgacgaacagg

SEQ ID NO: 80860 - DNA, 1293 bp, Glycine max
  Peptide Sequence Number=SeqID_197638
atgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaagtaaaacaatctattccttgataagaaaaataaaaaacgtgaatggtgattggattgatgataaaatagaatcctgggtcttgaacagtaattcgattgatgataaagaaagagaattcttggttcagttttctaccttaacgacagaaaaaaggattgatcaaattctattgagtctgactcatagtcatcatttatcaaagaataactctggttatcaaatgattgaacaaccgggagcaatttacttacgatatttagttgacattcataaaaagtatctaatgatttatgaattcaatacatcctgtttagcagaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagtagatccggctctaatagctccgaataaattaaatacatgcattaagatacgaaggcttcttatttcacaacaacgaaaacactttttcactctttcatatactaggggatttcacttggaaaagaaaatgtcccatactaatggattcgggtccacaacgatgggttcaaatgtaagatcggttcaggatcatgggatccttttctatcagataggaagggctgtttcacaaaat

SEQ ID NO: 80861 - DNA, 1209 bp, Glycine max
  Peptide Sequence Number=SeqID_197639
atgggcaccggcggtgaagaggtgtcggcgcgctttgccgccgcggaaagcgcctataagcgctttatcgccgaaccgcgccggctggcggagatccgcaatctgctggccggattggaaacgctgccgcaggaggcgcagcgcgatgcgctgatccacggcctgcaaggttggctgcgtttcttcgactgcaacgccattgaagatccgcaggcgcaggcgctgttggatcggatcatccacgccgaatccgatctctactcgcgccgcaagggctaccaggtgacgcatctgaacgccgaaggccagcgggtggcggcctcgctcggcgagctgttgaccaaccaggcgaccaacccgaacgaagactaccgccgcagctcgcagcaggcgctgcgcgatctggagcaatggctgctgcataacggcctgccggaactgattggcttgcgcaaccgctttgcgcgccagatgggctatcgcaactatttcgactacaaggtgaacaaaaccgagcgcatgacgccggagcagctgttcgccattctggatcgcttcgagcgggaaacccgcgaggccaacgcgcgcagcctgcagcaactggcggccgacaagggcagccaggcgctggagccgtggaacgtgcgctttgccagcgccggcgacgtcacccgccaactggatccttacttcccgttttctcgttcgctggagcgctgggtcgacagcttcaaacgtctgcacatcggctttggcggcgccgagatgaacctcgatctgctggtgcgcaaaggcaagtatgagaacggctttatgcacggcccggtgccgccgtttgtgcgccagggggaatgggtgccggcgcgcatcaatttcaccagcctggcgcagccggggcaggtgggaagcggcgcttacgggctcaacacgctgttccacgagggcggccacgcggcgcatttcgccaacattcgccagaatgcgccgtgcttctcgcaggaattcccaccgacctcgatggcctatgccgaaacccagtcgatgttctgcgacagcctgctggacgacgccgactggttgaaacgctatgcgaaaaacgccgccggcgaagcggtgcccgatgcgctgatcgaagccggtatcgcggcgcgccagccgatgcgcgcgttcaacgaacgccatatcctgctggtacgtgggatcctctag

SEQ ID NO: 80862 - DNA, 246 bp, Glycine max
  Peptide Sequence Number=SeqID_197640
atgtcgtcttttgcacctatgtcatccagagacaacgagttcgatgacatatggagatactttatggttttactttcgtcatccagagacattcaagtccaacgacgtgcaagattcttctctgctaggcagggacaatggagttcgatagcatgtggaaacgtcatggttatctcgttttatcgctttcaaggcactgaagttttgctgacgctccgaatgatgttccactggttgggatactga

SEQ ID NO: 80863 - DNA, 1695 bp, Glycine max
  Peptide Sequence Number=SeqID_197641
atggctgctggcatgggcttccgcagtcacaaatctttgttaacaattcttttcggttttcttggattgttctcctttacagttgaagcagccacaaaaaaataccaatttgatattcaagtaaagaatgtgagtagattatgtcatgcaaaacccattgtaacagtaaatgggaggtttccagggccaacaatttatgttagagaaggagacagagtactagtcaacgtaaccaaccatgcaaaatataacatgacaattcactggcatggaattaaacaatatcgcaatggttgggcagatggaccagcttacattacacaatgtccaatccagactggtaatagctacacttatgacttcaacgtcacagggcaaagaggaactttgtggtggcatgctcatattttttggttgagagcaactgtgtatggtgcaattgttatcatgcctaaacctgggaccccatttccgttcccacagccagccagagaatttgaaattctgctaggagaatggtggcacaaagacgtggaagagattgaaacgcaagggaatcaaatggggttgccaccaaatatgtcagatgcacatacaatcaatgggaagccaggaccactctttccttgctcagagaaacatacatttgcaatggaggttgaacaagggaagacttacctacttagaatcatcaatgctgccctcgatgacgagcttttctttgccattggtggtcacaacttgacagtagtggaggttgatgcagtttacacaaaaccattcaccactcaaaccattctaattgcacctggtcaaaccacaaatgttctagtcaaggccaaccaagtagcaggaagatacttcatggctacaaggacctttatggatgcaccaataccagttgatagcaaagccgcaacagctatattccaatacaaaggcattccaaacactgtccttccttctcttccttctcttcctgctgccaatgacacacgttttgctttgagttacaacaagaaattaagaagcctaaacactcctcagtaccctgctaatgttccactcaaagttgatcgaaacctcttttacaccatcggtttggccaagaattcttgccccacatgcgtcaatggaactcggctacttgcttccttaaacaatgtctcttttgtgatgcctcaaaccgcgcttctccaagctcactacttcaatatcaagggggtttacagaactgattttcctgataagcctctaactgcttttaactatacaggtgcaccattaacggctaatcttggtacttcagttggcacaagaattagcaaggttccctttaattctacagtggagctagttttgcaagacaccaacctcctcactgttgagtcgcatcctttccatcttcatggctataacttctttgttgttggaactggaattggtaattttgatcctgcaaaagaccctgctaagtacaacttggtagatcctattgagaggaacactgttggggttcccaccggtggttggaccgccattcgtttcagggctgataatccaggtgtttggttcatgcattgtcatttggagctacacacaggttggggattgaaaacggcgtttcttgtggaagatggtccaggacaagatcaatctgttgtgcctccaccgaaggaccttccagcatgctag

SEQ ID NO: 80864 - DNA, 2043 bp, Glycine max
  Peptide Sequence Number=SeqID_197642
atgagggtcctcacagtcatgtcactcaataacaatgatgacacttgcaacttgtcatcactcatcactttgccccagatttgggtactgctctatggaggaatggaatatagaagatgggatacagtactctcaagatgcctaaaggcaacaagatcattagagaagagcttaatccaaattcaggatatggttcctgttatgttggctgtagaggtttctagaataattcatgatcttgagtgtacgagatttgttctggaccctaatgaagaagaggctgggaggtttgtgagagagttgcttactttaacctcagattcagttgatgattctgaagttaaagctctccagtttgcagcatctcgattgaatataacatccccaaaagccatcataatagaacaacgatctattaggaagttgctagaaaaacttggaccaaatgacctcaaaaagaagaatatactgagatatcttctgcatctactgaaaaggcatggaaagctcatggtgggagaacatgtggagaagctctattctcgttctgaggaacaagctgcaactgagaactcgagtcacggttctctacgaagcaaccatgttgaatcagactcaagcatgaactatggtcagtataaaactcacaccaatgagttaagtggagttgcaccccttgaggagtattataagtgcccaatatcctcaaggttgatgtatgatcctgttatcattgagtcaggagtaacatatgaaaggatctggataaaaaagtggtttgatgagggtaatgacatatgccccaaaacaagaaagaaactagtcaatatgggattaactccaaacatggccatgaaagacttgatatcagagtggtgcaaaaataatggagtctccattccagaccctagtaggcatgcagaagatattcgcacatgggaaacttcaaacacttccattaacagtttagcaagctatttcaatgatttcaccgcaccggtggatcttagtaacatgtcaattgggtcattggatactagttttagttcagatgcctcacattgtaagaccacaagtggctcaaatttgatgcagaccaagagccgtgacaattctcacaaacatcaggctcatacagagatacatgatactgatttgatgctcttgcctcaactctctgatcttcaatgggattctcaatgcaaggtcattcaagatctgaaagatcatttgaaaagcaatagccaagcttttgtttctgtatcagcagagaatttcatagaaccactcgtgaggtttctgagcaatgcatatgatctgcgtgatgttcaagtgctgagagccggaagtcagcttctgttggaaaatggtaagactaatttgagtgaagatactttcattatgttggcaagttttctcgattcagaagtgataggagaaactcttgccataatggaagaactgtcaggatatgggtttggtaaaactaaaattgcagcatctagtgctctcagttctattctaaacatgcttgattccgaaaacaaaggtttccaacagcaagctattagaataatgtacaacttgtccttcagtggtgaagtttgtcaccgcatgctatctctcaggaaatctgtttctgaaacaaagggatgcatatcttctgttgctgaaatacttgagacaggcaataacgaggaacaagaacatgcgttggctgttctagtttctctatgttctcaacatgtggattattgtaagttgataatgcgtgagcatgaggaaatcatgggctctcttttctatatctcacagaatggaaatgacaaaggaaaggaaagtgcgttggaattgttctatcttttgaaagatgttgacattgctgtgaataaaaattgtcctgagccaaatatcaacaactcttgtcgagattctaacagtcacgaccgtgaagaaaaaaagccattaaaaagatccacgtttctgaagaaactatcacagttctcaaagtccagttctcatgcaacaaaatccaaaagatga

SEQ ID NO: 80865 - DNA, 1194 bp, Glycine max
  Peptide Sequence Number=SeqID_197643
atgtcgttgaaaagcatagtaagggaactaaaggagatgagggatgggattggtagcatgtcaaggcgaggtgtcgagagcaggcgttggaacggtcggacaaagtcacatgttgctcctgatgtcattctaacttcacttgaacctattcagcaagggcagtgggcaaatttaccgcctgaattgcttctggacataataaggagggtggaagatagtgagactacttggcctgcacgtgctgttgttgtttactgtggttcggtttgtaaatcatggagggctgttacgaaagagattgttaagactcctgaacaatgtggaaggctcacatttcctatttcgttgaagcagcctggtcctcgtgattctccaatacagtgctttatcaggaggaacagagaaacttcaacatatctattgtacattggcctggtaccatcggagaatgagactgataagttgttattagctgccaaaaagttcactatttatgacagccaacccccacaaggagctgcaattcaaccagataatagatctagtaggagatttcattctaagcaggtatctcctagagttccagcatgtaactatgttgtaagcaccattgcctatgagttgaatgttctccgtgcaagagggccaaggagaatgcactgcaccatgaactccatatctgtctcagctgttcaggaagggggcaatgctccaactcctacatcttttcctcaaatcattgacgagcctttttctccctcaccagcactgaaaggaaaaggtccaattagagatctagacaatgcaagcctcccagagctactaccagtacagagccaagactcagctgagcctcttgtacttaaaaataaggctcctagatggcatgagcaactgcaatgctggtgcctaaacttcaacggtcgtgttacagtggcttctgttaaaaactttcaacttgtggctgctgttgatccatctcataatgtttctgctgcagaacaagaaaagcctgtgaatgagaccgatggcactggatcatctgctggagcagcattgataccaaaccagcctgtgaatgagaccaatgacactggatcgtctgctggtgactctatatacacgcgttcggccagagctaaatatcatttttattacttcttcaaccggtatttccttggtagttatagctaa

SEQ ID NO: 80866 - DNA, 1299 bp, Glycine max
  Peptide Sequence Number=SeqID_197644
atgttggtgaggaagctgaaactgaaagcggttagtggggtccacttgagatggatgagcaccgtgatgtgtttcggagatggcagccagggtgccgttggatccccagtaggtgtgggactagacgcatacgaacccacacctgttaccgctcttccttccgacatcgttagcgtccacgccggacactaccattccctcgccctcacttcccacggccacctctgggcctggggcagaaacaacgaggcccaacttggccgcggcccatcctctagagaatcatggcatgagccagaaagagtgaagggattgttagagaatgtgaacgtgtgtggtgcttttgcgtcgggcgttgtttccgctgcccttggggatgatggttccgtgtgggtctgggggaagtccaaacgcggtcaacttggtcttggtcaacatatcaccgaggctgttgtgcctactaaacttgaagcactttctcgggaaaacgtagccaaggtggtcgcgtttggatgggggcatgctctagctcgtacttcggatggcaagttgtttggatggggctattcagcggacggtagaatagggaaaatggggaataatcacttccagacatctccgttggaatctgagtctccaaataactcacaactctcgacttcagacctggaagctgctgaaaagagagtcttgcaaggaattgaacaggagaataacatgccgatagtatgggaaccccgcttggtcgaagagttacgcggtgttcatgttttagacattgcatgtggccttgatcattctctggttctttgccgtgatggtgtgctcttgagctgtgggagcaacgtgtatggtcagttggggcgagctaaaatagatttgggagttttccccgttgaaatgagcttcagtcccgtttttatagcagcagggcttgggcattcattggcaatatgccagttcggtgaatcagatgttagtgtggggactacaaacattgcttcatggggatggaacctgagttctcagcttgggaggcccggggatggaaaactaccctctttgattgatgcattggatggggaaaaccctgtctcggtttcggcagggcgtgcacattcccttgctctcacgtccaaaggggaattgtgggtctggggctctggtaaaagtggaagacttgggttaggaagttctgttaaccaagtggagccatcttgcattgattccttggaggcttttcaaattttacaggccgtgtctgggtttgatcataatctggttctggttgcgggctga

SEQ ID NO: 80867 - DNA, 384 bp, Glycine max
  Peptide Sequence Number=SeqID_197645
atgagaaaggaaagttctagaagccggatccataaaacgacgagaagaaccgaatcagagaaagcgagagagagatcacgtcgttttgaacgctacgacgaagaagaaggtgagggagatggaggaggcgtgggaaggtatattccggagcggagtctccgccacccgcaccgccgcgaaaaagctatctccgggaccggaatgaaagcgaagcgtcatttattggagcgaatccagtgcctccacccacactgctccctatttcttatatctggacacgtggcactcgtctttcttgtgatcttagttataacgaaatcgttgatccaagactttaattcgggttaccctatcaacgttgctgtgttatctcgttggaaataa

SEQ ID NO: 80868 - DNA, 1686 bp, Glycine max
  Peptide Sequence Number=SeqID_197646
atggcaagcttggggggttccatgtttgtctcaacgtttctctttgtctttgttggcttaatgtcttcttcatctgaagctgccataaagaaataccagtttgatattcaagtgacgaatgtgagtagactatgccatgcaaagcctattgtaacagtgaatgggaggttcccggggccaactatatatgttagggaaggagatagagtgctgatcaatgtcaccaatcatgtactatacaacatgtcaattcattggcatggccttaaacaatttcgtaatggttgggtggatggaccagcttatatcacacagtgtccaatacagacgggaagcagctatacttatgatttcaatgttactgggcagagaggaacactatggtggcatgcacacattctatggctgagggccactgtatatggtgcaatagtaattatgcctaaacctggaacaccatttcctttcccacagccagccagagaatttgaaattctcctaggtgaatggtggaacaatgacgtggaagagattgaaaatcaagggaacaaaatggggttgccaccaaatatgtcagatgcacattcgatcaatgggaagccaggaccactatttccatgttctgagaaacacacatttgcaatggaggtagaacaagggaagacttacctcttgagaatcatcaatgctgccctgaatgacgagcttttctttgccattgccggtcatagtttgacagtagtggaggttgatgctgtttatacaaaaccattcaccactccggctatactaattgcacctggtcaaaccacaaacgttcttgtccaagccaaccaagttgctggtagatacttcatggccaccaaggcttttatggatgctccaatcccagttgacaacaaaactgccacagctatactccaatacaaaggcatcccaaacactgtcctccctgttcttccacagttgccggctagcaatgacacacgttttgctttgagttacaacaagaaattaaggagcctaaactctgctcagtaccctgctaatgttcctctcaaagtagatagaaacctcttctacactattggtttaggccagaattcttgccccacatgcctcaatggaacccagctcgttgcttcattaaacaatgtatcttttgtgatgccccaaactgcgcttctccaagctcactacttcaatatcaagggggttttcaggactgattttcctgaccgccctccaacccctttcaactttactggtgcaccgctaaccgccaatcttgccacttcaactggcacgagagttagcaagattgctttcaattccacagtggagctagttttgcaggacaccaatctgctcagtgtagagtcacatccattccatcttcatggctataactttttcgttgttggaaccggggttggtaactttgatcctgctaaagaccctgctaagtacaacttggtagatcctattgagaggaacacggttggggttcctaccggtggttggacagcaattcgttttcgggcagataacccaggtgtttggtttatgcattgtcatttggaggtgcatactggttgggggttgaaaacggcttttgttgtggaaaatggacctggacaagatcaatctgttctgcctccaccaaaggaccttccaacttgctag

SEQ ID NO: 80869 - DNA, 222 bp, Glycine max
  Peptide Sequence Number=SeqID_197647
atgccactagtccttggaaacattggttatggaagcacgagtcaggtcaggaagtggaacatgaatagcacaaggcccaatccaataggggcgctaagcgcgcatctggcgctaagcgagcaactaactgcaggcgctgagcgtggcgttaagcacgaagcgcacgatctgaacgcgctaagcgcgaggtgtggcgctgagcgcgactacgaaggcccataa

SEQ ID NO: 80870 - DNA, 1551 bp, Glycine max
  Peptide Sequence Number=SeqID_197648
atggctgtgctgctccttccgccaaacacggagcagacccaggccttactggagagatgttcaaatatgaaagaactgatgcagattcatggccaattgttgaaaaaaggcaccatcaggaaccaattaacagtaagcacgctcttggtttcatacgccagaatagagttggttaacttagcctatactcgtgtggtttttgacagcataagctcacctaatactgtcatatggaacaccatgctcagagcatactcaaatagtaatgacccagaagcagcgcttcttttgtaccatcaaatgcttcacaactcagtacctcacaattcttacactttccctttccttctcaaagcatgttctgctctctcagcctttgaagaaacccagcaaatccacgctcacattatcaaaaggggttttggtttggaggtttatgccacaaactctcttcttcgtgtttatgcaatttcaggcaacatccaatctgcacatgtcctattcaatcagcttcccacgcgagatattgtttcttggaacataatgattgatgggtacataaaatttggaaatctagacatggcctacaagatttttcaagcaatgccggagaagaatgtcatctcttggacaaccatgattgttgggtttgttaggataggcatgcacaaagaagccttgtctcttctacagcaaatgctagttgcaggcatcaaacctgatagtataaccttgagttgctctctttcagcatgtgcaggccttggtgcattggagcaaggcaagtggattcacacctatattgaaaaaaacgaaataaaaatagatccagttttgggttgtgttcttacagacatgtatgttaaatgtggtgaaatggagaaagccctactagtgttcagtaagttggagaagaaatgtgtctgtgcttggacggcaataatcggtggcttagcaatccatggaaagggtagagaagctctagattggtttacccaaatgcagaaagcaggaattaacccaaactcgatcacttttacagcaattctgactgcatgtagtcatgccggactaactgaagaaggaaagtccctgtttgagagcatgagttctgtttataatattaaaccttctatggagcattatggatgcatggtggatcttatgggtcgtgcagggttgttgaaagaagcaagggagttcatagagtccatgcccgtcaagccaaatgcagcaatatggggagcactgctcaatgcttgtcaactgcacaaacattttgagcttggtaaagagattggaaaaattttgatagaattagaccctgatcatagtggccggtatattcatttggcaagcatttatgctgctgctggagaatggaaccaagtggtcagagtgagaagccagatcaaacataggggactgctaaatcatccaggatgcagtagcatcaccctgaatggggttgtccacgagttctttgctggggatggatcccacccacatatccaagagatatatggcatgcctaatcttcttgcaaattga

SEQ ID NO: 80871 - DNA, 858 bp, Glycine max
  Peptide Sequence Number=SeqID_197649
atgaatgatttgatgacaaagtcgttcctaagttatgtggaactaaagaaacaggctcgcaaggaccttgaagacgacgatcttgaccttgaagcagggaaactcaaccccacggaagaccgcaacctctctcagttcttccaagaagttgaagcaatcaaggttgaaatggaagagatctccaatctcttatttgatcttcagcaactaaatgaagaggcaaagtgcacccacggtgccaaagttctccgtggcctaagggaccggatggagtccgacatggttgccgtgcttcgcaaggcacggaccatcaaggcaatgcttgaggttcttgaccaatccaacatagccaatcgtagtttgtcagaatcctacaaagaggggagccccattgacaggaccagaatgtctgtcacaaatggtttgagggtcaagcttagggacatgatgaatgactttctgtccttgagggacaagattctatctgatcacaaggaagatttgaagagaaggtactataccgcgactggtgaggttcctactgaggaggtcatggagaagatggtttctgggagtctcaaagttgagtttctggctgggaaaacggatgctgatttgggcactcaggttaggcatgaggcagtgatggatatccagaggagtttgaataagcttcaccaagtttttcttgatatggctattctggttgagacacaaggagaaaagttggataacattgaggataatgtggttaatgctgatgaagaagaagaacagaaaatggttgtgttgggtttttgctgtggggctgattatactactcgtatgcatcattgcaatgttgtcttcttgacttga

SEQ ID NO: 80872 - DNA, 285 bp, Glycine max
  Peptide Sequence Number=SeqID_197650
atggcagttcacggtgacgatgaccctgaggagatggtggttcccaacctctccccgcccaacacctacgaagctgtcgtcaacggtggcaccttcgaccgattgcacaatggccaccgcctcttcctcactgcttcagcggagttggctaggcgccggattgtaattggagtttgtgacggacctatgctggcaaaaaaacagtttgctgaactgatacagcccattgaggaaaggataaataatgtcaaaactttcataaagaacatgagggacggattgtag

SEQ ID NO: 80873 - DNA, 201 bp, Glycine max
  Peptide Sequence Number=SeqID_197651
atggctttcgcactaagcaggaagtggtggcatggtgcttgtgttggtgcatctaaccgtttgctttacagttctgtggggaagcaacttttcagcgggaaacaactgttagctggatccctctctacaccggaatgtcacagcatcaaaattgagaatgtttcagttgaatttaccagaaggatgcacaacacttattaa

SEQ ID NO: 80874 - DNA, 234 bp, Glycine max
  Peptide Sequence Number=SeqID_197652
atggcggttcacggtgacgatgacaccatggtgatggtggttcccaaactctctccgcccaacacctacgaagccgtcgtcaatggtggcaccttcgaccgattgcacgacggccaccgcctcttcctcaccataatgccaaagcttgaaacttgtgtgcaggcttcagcggagttggcaaggcgccggattgtaattggagtttgcgatggacctatgctggcaaaaaaacag

SEQ ID NO: 80875 - DNA, 1074 bp, Glycine max
  Peptide Sequence Number=SeqID_197653
atggaagcccaactgaaagtgttgtcgttaagcccctctactttgggtcgccactttctctgcaaaactacctcacacccttcccttcccttcccacgcgccaccctcacgcgccctcccattccttcgaattggaatccccgcaggttcctcttctcctctctcacttcttccccatccctcaacccctttctctctcactcccaaactgctggtggcgccttcccttggaacccggcttccgaaacccgaaacgccgcgttttgcggaggcaaagaccgcgtggccacggtggtgctgttggggtggctgggagcgagaaccaagcacctcaagaggtacgtcgagtggtacaattcgcgtggcattaacgcacttaccttcgtcgtcgacgtcaaggagcttcttcgattcgacctcggccacgtgctcgagacccgaatctctctcctcgccgaccacctcgtttcttgggtgtctcgcgaggaacacgatgggagggaacgctgtctggtttttcacactttcagcaacacgggttgttatggttacattcttgcccgaatgctgggtagtgaggaactcatggagaagattaagggatgcattgttgattcgggaggaggagaacctttcaatcctaaggtatgggctgctggtttttctgcagctatattaaagaagcgcaactctttaggacccgtagttgaggtagaaggcaagcttaaatcagagactgaagttagcttgtcaaaggttcaacaaaacgaaccttccacaatcgaaacagtggtcttgtcactattagagaagttcttctcatttgttttgcagttgccagatgtgaatcagaggttaacaaggattgtcaatgtgctcatgaaacaccagccttgccctcagctttacctgtatagtactgctgacaaagtagttccatgtcaatccatagaaacgttaattgaggagcagaggaagatgggaaagagggtgatccatttccataaaatgattatatccactaatccacctagagttaaaacgatttcttttttctttgtacatggtttttga

SEQ ID NO: 80876 - DNA, 309 bp, Glycine max
  Peptide Sequence Number=SeqID_197654
atggaactaccattcaaaatgacaccttacttccccaaattagatttgaagtttaaacctttcgctgagaacctgaagtctgaactgctaggtggcataattgctctttttgtccttggccttacttatctttactatcgcatgaaaacccccaaagatctgaacacttgcaccatctccgtcatgtacgccaccgtttcagaggaggggaaggtcgaggtggagttcatctacgagcctctgaaaccggcgagtaagcccttgcgccttgcggctgacgatgatgagttgaaggatttcagtgtggat

SEQ ID NO: 80877 - DNA, 198 bp, Glycine max
  Peptide Sequence Number=SeqID_197655
atggcagcgaagagcaaaatcctagtccttggaggaacaggatacattggaaaattcatagttaaggcaagcgcagaagcaggacaccccacttttgccttagttagagagaccaccctttctcatcctgaaaagtctaaacttattgagagcttcaagagctctggagttactcttctttatgtggacagcagatag

SEQ ID NO: 80878 - DNA, 219 bp, Glycine max
  Peptide Sequence Number=SeqID_197656
atgacagcgaagagcaaaatcctagtccttggaggaacaggatacattggaaaagcttattcgacaaaaaaagtgaaaatcagaagggcaattgaagctgaaggaatcccatacacttacatcagttcaaatgcctttgctggatacttcttacctaacctgttacaccaaaatgtcacagctcctccccgtgataaggttgtcattcctggagattaa

SEQ ID NO: 80879 - DNA, 1059 bp, Glycine max
  Peptide Sequence Number=SeqID_197657
atggcagcaaagagcaaaatcctagtcattggaggaacaggatacattggaaaattcatagttaaggcaagcgcagaaacaggacaccccacatttgtcttggttagagacaacaccctttctcatcctgaaaagtctaaacttgttgagagcttcaagagctttggagttactctgctttatggtgatcttactgatcatgacagccttgttaaggcaatcaagcaagttgatgttgtaatctccgcattaggtggacaacagatagatgatcaagtgaagatcatagcagcaataaaagaagctggaaacatcaagatattagtgcacaaggtattaaaaattgctcctaaacaccatcatcatcatcggcaagaaaatgataccgatatagacagaaatctcagcatggttgcaaatagcagtaagtcagtaaacaactgcaatggaacgaggttcctcccgtctgaatttgggcttgacgtggaccatcacaatgcagttgaaccagtaagtagctttttcgagaaaaaagtgaaaatccggagggctattgaagctgaaagaattccatacacttacatcacttcaaatttatttgctggacacttcttacccaacctgctacaacaaaatgtcacaactcctccccgggataaggttgtcattctaggagatggaaacgtcaaaggagtttatgttatcgaggaagatgttgccacttataccataaaagcagtggaagacccaagaaccttgaacaaaactgtgtacgtgagaccccctgccaatattttgaccttcaacgagctcgtgtccttgtgggagtacaagattaacagcacccttgacaaaatctacattcccgatgatcaacttcttaagagcatccaggagtctcctttccctgacaatttcatgttagcattacgccactcatttctggtaaagggagattgtaactatgagattgacccttctttcggtgtggaagcttctaaactttattctgaggtgaaatacactactgtcgacaactatttgaatgcgtttgtctga

SEQ ID NO: 80880 - DNA, 558 bp, Glycine max
  Peptide Sequence Number=SeqID_197658
atgtgggaacccttgcttacttttcattacatccgggcggcaataagggcaattgaagctgaaggaatcccttacacttacgtttgctcatatgcctttgctggttacttcttgcctacattgggacaagaaaatgtcacagcccctccccgtgataaggttgtcattctaggaaatggaaacgtcaaaggagtttatgtcacggaggaagatgttgggacttataccataaaagcagtggaagacccaagaaccttgaacaaaactctgcaccagaaaccccctgccaatgttttgaccttcaacgaactcgtgtccttgtgggagaacaagattaagaccaccctccacaaaatctacgttccagaagagcaaattcttaagaaaatccaggagtcttctttccctgccaatttcttaatagcattaggtcacgcaatgctggttgaggaagcttttaacaatgaggttgacccttctgtcagtgtggaagcttctgaactttatcctgaggtgaaatacactaccgtcgacaactatttgaatgcgtttgtctga

SEQ ID NO: 80881 - DNA, 147 bp, Glycine max
  Peptide Sequence Number=SeqID_197659
atggaagatgatgctgaacaccttcccctcagcccctcacacctatttatagcaaaacaaggggagcaggttgcaacacagctcgcccaggagagctcagctcgcccaggcgagctggtgggcccaggggctgaagaatgccgctaa

SEQ ID NO: 80882 - DNA, 516 bp, Glycine max
  Peptide Sequence Number=SeqID_197660
atgaccaccttagctcagacatggagtgttctttccttctctaacttgattcccacctcccactcttctgatgtcactctagacagggccagactcatttatggcattattatgaagatggatatgaatgtagggaaggctagagggaagagatctgaggccccttccatagcaccattagaggcaccaacaccttcttcttctacacttccttcttcttcctccacagatatcccaatgattcctcctacacccacacagataccactaccagctcctctttctacaggagaccagccttcttcctctggagggggtggggcctccacatcccaggagcctgtgactaaggaggccacagcaccagcaccatcaccagcagcagtagaggaggagaccactccagctcagacccctcaaccatctccaccatctgcacctgctccagaggagactcagctatcatcagcactggatcttaatgaagaccagccacaagaggagcaggacgtttaa

SEQ ID NO: 80883 - DNA, 540 bp, Glycine max
  Peptide Sequence Number=SeqID_197661
gagattcctcatggactaccaccttcaagaggcatagaacatcaagttgatctcctccccggagcttcattgcctaacaggccaacttacaaaagcaatccccaagagactcaacgtaaggatgcacatgtcaaagttgagtatgtgaaaagattgtatgaccaagtgaaggtgcaaattgcaaagaagaatggaagttatactaagcaagccaacaagaaaaggaaggaagtggtacttgaacccggtgatgatcctggacaaggaggacaaatgttttccaagaaggagggaatgatgagaatcatgaaacaggccaaatacagtctaaaggcccaagtggagaaggacgaaggcccaagtggagaaggacaaagcccccgagtggagaaggatgaaggcccaagtaatccttgtggcgtctaccctgacttatcttccttcattggaagtggcgtctaccctgacttatcttccttcaccggaagtggcgtcatccaaacctccgtagcctgtatcaaacgatccactcctactcag

SEQ ID NO: 80884 - DNA, 930 bp, Glycine max
  Peptide Sequence Number=SeqID_197662
atggaattcttttctgctgaaacttttgattgcattcaagcctttcagaacctaggtcttatacctttcatgtcattacaattgcctgtttatcctgaactgattaaagtcttttattgtaatcttgaaattcaggacatcactttaatttctaaggtttttgggataaaaatggtcattgaccaatcccttttccatgacttaacccaattgtccagtgacggtgtaccatttgaaggtacactgaatgacgattggaagtttgatttttctgcacatgatgcccgccagttagtttgcaccaacaatgcggatatgaccagacgccttcttgccggttcattggcttttgaaagtcgcatcctacattatctgattgtgcggattttgcttccacgatcttccaatcttgcccaagtttctgaggaagatcttgttatcatgtgggcctttcataccggccatcaacttgactgggcacatcttgtaagatatcgcatgcataaggcattgcgattaaatgcacttttgccatatccacatcttgtcacactctttttccgccattttcaaattcctcttgattctgaaccttatgttccaatcaagagatcttttttaattggtgctgttgtgattgcttcttttggttaccgcaaagaccatgatggctcttgggtcaaaaagggcgctcaacccgctgatgaagaaggcaacctaccagttgaagataattccactcttcttcgaaggcttatggacaagtttgatggacttcaaacttttgttggtgacaagtttgatgccatggaattgcaagtcgacatgcggttcgatgccatggaatcaaggatcaccaaagttgaagaagatgtctccttcatccgtacttgctttgatccaccaccaccacctccatcatcgtcttag

SEQ ID NO: 80885 - DNA, 201 bp, Glycine max
  Peptide Sequence Number=SeqID_197663
atgggcccgaaatctaccctaaggctcatgagaaccctagggccttctcttgtatctttggcccaatcttcttggagatttctatccaatgcccttggaggaacggttggacatgatatatgtcaaggtgtgggtttggccagtggttcagggataaaagggatgtcccacattatttccatgacagacatgcaacaatga

SEQ ID NO: 80886 - DNA, 243 bp, Glycine max
  Peptide Sequence Number=SeqID_197664
atgagaagtgccaagaaggctgaaccccttctccctttcactcctccccctatttatagcaaaataggggaggagcttgccacccagctcgcccaggcgagcaaggttgcttcctccagaagcaacagccttctggaggaagaatctggaaggcccagctttcgaagaagttacgaaaactcacggattgcgaaaaatacctcttttcgatttccgtcacatcacggaattttcacggatcgc

SEQ ID NO: 80887 - DNA, 576 bp, Glycine max
  Peptide Sequence Number=SeqID_197665
ggaccagctagaggagtcaatcacagaaaaagtgactcggtagctgatgttatccttcagccagatgcaatcccagtttcagtcacagatgcaatcacatggacttgcactaaggttggtccctcagctgcttgtgtcagcacaaaggaaagttgtgtttatccctcagggaacgatccagacataggtgactcaaacaaatgtaggttgtacatcgaagaaaatcctccccgcctagttgccctaggaagagtttatgagggatccacaatcgttcacaacatccctttattgcatgatcaagtgaaggtcggtgttgaggaggttaaagatgcagatgctcccgttcctgtacccactgacgaggttaacttagtggggcagacacttaacacctttcttgcttggccgacacatctcgtaaagcgtttatcagaacaggttatgtgggatgctaccgtgttcggggtgtttaataaagacttccccttgtacataaagcatgaagatctatctgaaatagcacacggtggtcaatgtctcagcatctttgttatacagttgtggattctgtaa

SEQ ID NO: 80888 - DNA, 238 bp, Glycine max
  Peptide Sequence Number=SeqID_197666
taccctgccacggtacagacccgggttcgattcccggctggtgcaaataaaaagagctatgatgataactgtgtcaactgtgatagatgggtctgtcacaacgttcttggacgaaagaacatgtttggtgctggaacagatacatcatcagcagttatagaatgggccatgtcagagatgatggaaaaccctagagtaatgaccaaagctcaagacgaagttactataaactttgcaa

SEQ ID NO: 80889 - DNA, 268 bp, Glycine max
  Peptide Sequence Number=SeqID_197667
atgatctctccgaccagcaggtccgaggttgccggagagttccgaggtttattgtcgaggcttgttgtcgagaaacctcgtcagtgggacccacctccttcttgtgtaataatagctgatgggttgatgtcaacggtttctatggacgttgctaaagagttcggggttccgctgatcgcttttagaacctacagtgccacggccacgtgggtctcaattcacgttagcaaaattgttcaggagggagtcatggatctgcaaaatccgg

SEQ ID NO: 80890 - DNA, 416 bp, Glycine max
  Peptide Sequence Number=SeqID_197668
gtatggcgcctactaggcaccctctggacccagagaagtccaatagggccctggggtttccggctctgatcacaggcctctgccagtcctacggagttcctgtcacccccagcaagtactacacacccaggcaggcgcagggtgatgcacatcaggccacgggcgcaccgccaccacctcaacaggccgatctggctgggtccctgggcgtggagcggtatctacagcatttggttcgccagcaggaggccaaccaccgtggacagtttggggctggggtcgcatggcctagagactggcccgatgcccaggcaggggagcagcctacaggatcccccggtgaggcggatgaacccaatatggataaggatatgactgacctgctcggtttcttgggagggagcggagccacatga

SEQ ID NO: 80891 - DNA, 846 bp, Glycine max
  Peptide Sequence Number=SeqID_197669
atgttgtttgtgggacacaaggttgctcctaaatctgatgcacttaattttcagttcatattgttaggtgctgttccatttcctattgatgttccccgcttaaaggagcttggtgtccgtggggtcatcacattgaatgaatcatatgagactttggttccaacgacattatattatgctcatggaattgatcatctggtgattcctactagagattactgttttgctccttcattgaatgacattttccgtgctgtggatttcatacatgaaaatgcattgtctggacgaactacatatgtccattgcaaagctggacgtggtcgtagcacgactattgttatttgttatctggtgcaccacaaaatgatgacacctgatgctgcatattcttatgtgaaatcaattcgaccaagggtgcttctagcttcctctcagtggcaagctgtccaagaatactactaccatcttatggtgaggaggaccgttggatgtgctcctacagccaatctatttgtaaaaacttctcaggtggcagcaggttcacgagatcttgtgatgtttgatgacaattctgtagtcatggtaacagagtcagatctagaaggttacaacccaagtagtcaatcaggagccatggcaagtgaaatatgggcagatttaagtgttgtataccgtgtacgagttgctggacaggcagcactggcgagaatatcatgcctttggctgcgatatggtactaccgaccagaagatttctacggagaaactgagcagcagggaaagcagttgctcaatcagggctaatcacttgggagaaattagtgttgatatccacgtgtactga

SEQ ID NO: 80892 - DNA, 114 bp, Glycine max
  Peptide Sequence Number=SeqID_197670
atggcggtagtagatccttggcctggggattctttgcgacgtgtcctatggatggagtggtggaataagtatctagagcatgtgggctctaatgaccaccatgaaaaacactag

SEQ ID NO: 80893 - DNA, 165 bp, Glycine max
  Peptide Sequence Number=SeqID_197671
atgatgtttatagcagcaggactggaggctatcagattcggattattatgtgtgagcaaagtttcggggaaggctactgttattgctgcaataggtgtcagacataactttttcggcactgatattgttaggtggcaatgcatgggagtaattgaaaagttttag

SEQ ID NO: 80894 - DNA, 321 bp, Glycine max
  Peptide Sequence Number=SeqID_197672
atgaaaaggaggctgaaacataattcacaaggtctgatatatgacaaccctcaacagacaaacagagaggatgacagcaaacagaaagcctttagcaatgatactgtgttgtcagtgacactaggagagataagcttctttgtttttttatcagcaaagataaatatattcatatatatgaaaagagtaccagagcttttcaagcctgacaagcctttcgcattcagtacatctaataataagaatctagcatgcgaggagatagaattacgtggagaatggatcatcacgagaacagcccttgatactggttcgccttga

SEQ ID NO: 80895 - DNA, 303 bp, Glycine max
  Peptide Sequence Number=SeqID_197673
atgtggttcttgaatattccttttctaaaacaagcttcgtatattcggattctcggtagtgaaaatgttccatgcgctattctattccaagtgaaaatcgcggttgaagttaacaaacgcaagaaaaggagcgcggtgcggagatttttcaagaaagacatggccgaccttcttgggagttcccttgattacaatgcatatggaagggaaccagttgccgatattttgggagcccattattatgggttcttcaatgcaaaagtgaaggctttgttaagcatggcatcagatgtggcagtaaag

SEQ ID NO: 80896 - DNA, 288 bp, Glycine max
  Peptide Sequence Number=SeqID_197674
atgtgcctcagggttcttcttggaaatgtccttggctttgtgtataatggtgttgctagtgtggtagccacggatgaagagcatgaagcagttgaccatcgacttgagtctgaggagcttggagaggtagtggtcggggtcgagaacaatgccgaagtaggaagttttgcgtattatgaattaagtggttgggtggcggtgcagtggtgggtttggtgtggtgtggaggcattgagtgcgacaatggtgacttttgggtggaggtggagtgcggtggtaatggactaa

SEQ ID NO: 80897 - DNA, 363 bp, Glycine max
  Peptide Sequence Number=SeqID_197675
gacgatgacacagaaatcgaggaccaagacgttgaaggaggaagaaccgttgctaagaacaatgacagtggaaagagtccacctgttattggtggagaaagttcaaaaacagatggtgatgaaggaccagatgtggataagaaggctgatgagttcattgctaagtttagagagcaaataaggcttcagagaattgagtcaatcaagaggagtacacgcagtgcaagaaacgcttcaagttgttttgaatgggaaattgtgattagatcacggttttggccatttgttgttgaaaaatgtcaaacggaattcccatatactaatatacacctagaaagagaaagaaagaatagagaaaagtaa

SEQ ID NO: 80898 - DNA, 384 bp, Glycine max
  Peptide Sequence Number=SeqID_197676
atggaggttgatggtatgatccctcgtattcaccaacaaattgattctcaagataatttcatgcttttggcaccttttgagagaagctttaagaatgttatttttcagatcctaacttcaatccaacttttgggatttctaggagatgaaattcttaattttagcattgattggttggagcaaaaggatcccggtgtcttcgaccaacctttcttcatgccttatgatagactcaaaatcctcatcccaagttatgaaaaggctaagtttattcatatcattctcaatcccttcaatgtcagggaacaagaacatcttgcagtgccttcaatcattggcatggagaacactactattttcaactatttcaaggataggatttga

SEQ ID NO: 80899 - DNA, 177 bp, Glycine max
  Peptide Sequence Number=SeqID_197677
atggttagagaaaaagttgtaatgggtggtgccaaagagagtgaaaagcatggtgtttcagtcactcgagcaatggctagcgctgttttggggaaaagcaacctacaatgtagagctggacaaatggaccatggcccgtggactacccatgaaactcacaacccatacgaaatataa

SEQ ID NO: 80900 - DNA, 339 bp, Glycine max
  Peptide Sequence Number=SeqID_197678
atgcgtctaccggggaaggagagtctgctgatgaaatctcccataaccataaatgagatttttgatgttagcatttcgtttctaaatgaccatttagaggaaacaccgggttcgacaaaaatagaagaaatccactcaaagtgtatcaatctcgcacaggtttgtagaatggctagacatgatacatgtcggggtttggtttggctcaaggataaaaggggtgccccacattatttccatgacacaaatgcaaaaatgatgatttggaaactttatgcaaaactggtcatgcatgcacctatgcggacactcaagtgtcaaatttttatggtcatgtga

SEQ ID NO: 80901 - DNA, 270 bp, Glycine max
  Peptide Sequence Number=SeqID_197679
atggatacctcagtgccctacactggggcaataagaggcaccgtgcataagcctcaagcgaacctaggggcagatcagaagttctcacttgcaaaaggagcagagcctaacccaagagttgaaaggaataaaggtacaagcaacacttttgagcttcttactcaatataaccttaaacactctttgaggctctctaatcctttctttcataaccctcttacccctaaccacgttacaagcccaataaagcctatgtggatcacggaatga

SEQ ID NO: 80902 - DNA, 243 bp, Glycine max
  Peptide Sequence Number=SeqID_197680
atgaggagttatgatatgtccagataccaagtccagctctccctcgaccgcgcccgcaccgtcgccgcgcagtccgatcccaacaacagccgccattacctgttcgactacaagaaagccaatgaagacctcaacaccatacgtgctggcatcgaccgctacacgcagccttcgcgtgcgcagccgctggattacggcaaggtcagcggtgattacacgcgaggccgtccgctatggcgatga

SEQ ID NO: 80903 - DNA, 204 bp, Glycine max
  Peptide Sequence Number=SeqID_197681
atgtcattgcctagtgctgttcatgtgtctccattatcaagtgcgaagcttctagtgactgggaagcacattgttctgttgttttccagatcggttccttcgccaaaagaaaaaagaaggagtggagacgagagtcgtcatcacagaaagggcaggacggacgaaatcagtgtcctatctttgctttcctcttatctccgatga

SEQ ID NO: 80904 - DNA, 357 bp, Glycine max
  Peptide Sequence Number=SeqID_197682
atgagggggcatcctaggctggcaaagatgtgtcgtcctgtgctggagtgggctagggccagggatcccaggcgtgacctcgggactttcttccggtgtcgcctccggctcttgggttgtaggagcctcacctctccttgcaggaaaaggctagacccctggccaggccccctagaccatgaaatcctctatgctaaggatggaccaatgctgagcctggctctacagcatcgacacaagaatgtttgtgctctgagcaaaggggctggagggcgttgtagttactggaggggccggagaggagctggtgctagtgctagtgctgaggtagaagtagaggcatcagaaggtccctga

SEQ ID NO: 80905 - DNA, 525 bp, Glycine max
  Peptide Sequence Number=SeqID_197683
atggcctccagaaagagaaaaacatctacctccagacctcaagaaccatatgacacgacgagattcgtatcagaggagctcgagaggcaaagatggcataaggccttgactaggcagcttgataactgcatagatgtggccctggtcatggagttttatccaaatttgtatgatctagaggataagtcccctcgacagtgcagagtgaggggcaaattgattaagtttgatgctgagacgcttaacacctttctggagacccccgtggttttggagccaggggagaggtactcagcttactccagggctaggttagtgtacgagttggtgatgaagatggacatggacttgggctccatcatctcaggccaaatctcacagatggaccagtccaactcctctcggctaggattccgtgcacttattatagcactatgcatcgccagaggagtggtccctgactcacttactttcgagtctttaagccctgccattaatttggcgtatatccagaagaactgctag

SEQ ID NO: 80906 - DNA, 171 bp, Glycine max
  Peptide Sequence Number=SeqID_197684
atggatgagattgagaatgagatagctcagattgcaagagctaagaggggttggccaaaagcttttctgaagcattggatgaggaaagaacttagaaaatttttcagtcatccactcgctcagtgcatcctatgtgctaagcgagacataccccatgcgctgagcgagtag

SEQ ID NO: 80907 - DNA, 297 bp, Glycine max
  Peptide Sequence Number=SeqID_197685
atgtgtttcatggtaggctttttctttcaaagtgctcctcacccatcaagattgcatatcttcggtcaaagctcttggaaatcgattgggtcatggtctagggtccctcttggaaagggatattatgagcttgtcttctcctctgccgaagacctcaacattatcaaattgatgtattacattggccttcacataggctttttgcgcttgctagcatggactccagatttcaacccgaatctcatcaagcagacccatgctcaatgttggttttatcatttgggactacttgactaa

SEQ ID NO: 80908 - DNA, 201 bp, Glycine max
  Peptide Sequence Number=SeqID_197686
atgcagatgcatgcaacctttgtcgtgaaatttggtaaatgcggacttcatatgaaacaatgcaatgtgagggcgtgtagccctctcaaggcgaggacgtgtagtcctctgaaggtgagggcgtgcaaccctctgatggcgaggacgggtagtcctctcactgcgaggacgtgtagtcctctcaacggtgagggtaactag

SEQ ID NO: 80909 - DNA, 327 bp, Glycine max
  Peptide Sequence Number=SeqID_197687
atggctccgaaaaagctttccgcgaagagatctaggagggacaccgcggctaaagggaccagtgccgcccccgagtttgatagccaccgtatcagcagtgctttgaggccatcaaaggatggtcgttccacagagagagacgcgtccagctcaggaacaatgaatgccctcagccagttcctgggcgacccgctagtgttagaagaaggccaggagtgcgagtttagtcagaggaggaacagggctgacgggttcgacgaagaggccattgcccagctaatatgtacatcggggcaggattttgcccagaccgctgccgggaggcag

SEQ ID NO: 80910 - DNA, 234 bp, Glycine max
  Peptide Sequence Number=SeqID_197688
atggtgtcgtttttttacgtagaagacatgcaactcgcaggagccattggcgagtttggccaagctttgacacgtatcatgggtgtcgccagtgcagttggcgaattgagtgtaggttgcaagaagcgttgcaggaagcgtggcagctttaagcagttgaaaacgccagtgctactggcgatttgcgctacagttggagttgccagtagcactggcgagttgagcttcaaatag

SEQ ID NO: 80911 - DNA, 269 bp, Glycine max
  Peptide Sequence Number=SeqID_197689
atgaaaccgcattgccgaaaattttcgatgagaacgtcgtcgtttcggagatgcagcaccggtgagtttgatttgcaggaaaattttgatgcctcgtcgccggtgaccggaggacacgcatatggtgctatgttgccggtgttcctcaacgagctgaggagtaatcatcacaaggaacttgtggagatcacgctggagcttgaaaacgacgccgttgtgctatgcaacgtggcgccggcgccatcttcggctccgaacgcttcgccgtc

SEQ ID NO: 80912 - DNA, 240 bp, Glycine max
  Peptide Sequence Number=SeqID_197690
atggtggaaagggagaaatttgatcatatacaggaaaggttgagggctattgaaggaggcagagattatgcctttgctgacgtggcagaactgtgcctagtccctgacgtcattatccctccaaagttcaaggtgccggattttgataagtacaaggggactacttgccctaagaatcacctgaatatgtacaataggaaaatgggggcaaactcgaaaaatgttgccttcattaggtag

SEQ ID NO: 80913 - DNA, 270 bp, Glycine max
  Peptide Sequence Number=SeqID_197691
atggacgccggcgaagccctctccgacgatccgaatcggcccaattccgccgccgacgcagctccggcccccgcgggagcaaggtacaagctcctgtcgccggctaagctcccgatctcccgctccccgtgcgtcacgatttcgccggggctcagtccgacgtcgtttctcgagtcgccggtgctgctctccaacatgaagggtttctcatttttggggctgggttcaaggttcgggtttgatccgttaaattgctccgaaaaagaataa

SEQ ID NO: 80914 - DNA, 1878 bp, Glycine max
  Peptide Sequence Number=SeqID_197692
atggctacactgaagacgatctcagcagcactgaaccttgtcgattccaagaaagagaatctgaagaaagccttcgacaatctgcattcccttctctcccccctccctctctcatggctcgacctcgattcccacttcaccaccctccaccactccctcacccaccgcttcaacctcctccaatcccattcccaaaccctaaccccaattcccgacccaccaccccacaccccccaagatgtgaacttttcgtcaaaccctaccgacccatcatcgaatcacgacgaatcatcacctggggtgtccctccagaacgacgtcgttccgggcccggtcacgcccaggaacgaattggtcgctttatgcgagaaaatggacggtgtagggttgatgaattacgtcaatgacaactttcaggatagaaccagggttcaggcggagcttcccggcgcgtttcggcacgcgccggacgccggtacgatggttctgggagcgttggaggtgtttcacggagaaggtagtgaattgaaggaatgggaattaaggaggattaggaaggcttgcattgtgctgttgaagcagttcagggttgctgctctgagtgtgagtgctgaggcaagtgtgagagctagagagttggctttggaatggaaagagaggttggtgggtgatgaggacaatatgtttggagctttggggcttttgcatttgatttgtgcctttggttttgtctctgaattcagcttggatgagcttgttgacttttcggtcgctgccccgactaacgaggaggacttcccggagctgtgccggacgatcgggttgacggagagagttcccgggttattagaattgttggtattgatgaataaggataagaaagagagaagggaagaaatgaatggtaatgagagttatgcacttgctttgtatgtgcaacctaaagatattacttttattgtgtgcaaagtgaagttcgtaaaagggcttcttgtcttggaagagatttgcatcctccaagttttaaaaaaggacaaaaatttcattcttttagctggaaacaacacaagtttcacagatattgttcaaaaacttatagataaggacaaacatattccggctgtcaagtatattcttgagtttaatcttgctgacaggatttcacctgttcctattttgaaagcttgtgtagaagaagctaagaaacttggtaaaagacttttccaggaaggaaagtcattgaatgagagtacatctagagaaattaatacactgagaatggtgatcaagactattgagagttataagcttgaatctgagtacccacttgctagcctggagcagcatatagagcaattaaagaggcagaagacaaataataaacatgctgcaccgacttctgctgcaaagcctcctcagcataaacagcaacagcaacaacagcagcaaaagagaaatatgcagaagcagccgcagcaaactgggatcaagcgtcctcgagcatcagcaccagttggatctgcagctgtcctcaagaatgtcaataatgtcaattcaactatacaccactaccagcaacatcttgtccatccatcaggtttgtttacagagcatccaaatccatacatgagcttgccagccatgccatttggcatggtgtctcctaccccaaatgttcctccttatgcaggtccttcagctgggccttatggtcatgatggtgtcccaatgggtcccagcggcaaccccagtcttggtggttctcatcttagctcgtcagagccacatgtgcaagctgttggttattatgatagagcctctacttatggtgggattggtctgcaacattattaccaagcatcttattatcctcaatag

SEQ ID NO: 80915 - DNA, 192 bp, Glycine max
  Peptide Sequence Number=SeqID_197693
atggatttgaagttgttggtgagaacggtggtgagtacatgccttgaagctctactttgtttctttgagttgcgtacaaggtatttgatgggaggctttcatggagggtgcaatagggttcagatctttggccttgatagtcttaagtttaagaaggaattatggggatttgggtgggattgtgaattgtga

SEQ ID NO: 80916 - DNA, 234 bp, Glycine max
  Peptide Sequence Number=SeqID_197694
atgaatgcaaaaagaagagaaaatatggttggtgtgcttccaaagaaaagaatattaatgtggcaaggggagtcacagggaaaccaggacacaacaacgtacatcaccatacccaaccacaacattcaatcaatgacgcaaggcatggcccaggccctctgtgtcagcgagcacttccatcacgtgatagttctatgtgtcccactacccccaaacccgatcaacgctcagtga

SEQ ID NO: 80917 - DNA, 732 bp, Glycine max
  Peptide Sequence Number=SeqID_197695
gggaaatggggtttccattgataggggagaccatggaattcttcaatgctcaaaggagaaaccaattgtttgaagagtttgttcatcctcgcattctgaagcatgggaagattttcagaacaaggatcatggggtctccaactgtggttgtgaatggagctgaggccaataaattcttgttgtctaatgagttcaagttggtgaaaagctcttggccttcttcctcagttgagctcatgggaagggactctatcatggagaaagatggggaaaggcaccgattcctccgtggtgttattggcacaagccttggttatgctggacttgagctgctagttctaaaactgtgcaattctgttcagtttcacttagctacaaactggaagggccaacataagattagtctttaccgttcaacaaaagtcctcagttttagcgtagtgtttgagtgtttattaggaatcaaagtggagccaggccagggtggagatagaaaagatgttggtcaaagtggtgagagagaagagaagggaaatggaaggaagcatgggaagagaaccagatggaatgctgctgtccaaattggtatacgggatgatccaaggggagaaaaagaggtcatagacaatgtggtactactagtttttgcagctcatgatactacttttgctgttgctatgacattcaagatgttggctaagcatcctgattgctttggaaaacttcttcaag

SEQ ID NO: 80918 - DNA, 315 bp, Glycine max
  Peptide Sequence Number=SeqID_197696
atgggatgtgtacctaggagcctacctgaaaggataattaacaggtcagacaactacctgaaaggaataaataacagtgctttgaaaggacttgacgatactccacaaagtaaatccaagattgctcctagacaaaaaggaagcactgaatgtgggtattacgtcatgcactggatgtcatttataatcttagaaagtttcaacaataattgggaaacatttttcaatgatgctagaccattggaaccagagagattgaaggcgcttcacatccagtgggcaaagtattatttgaaagttaaaaatgaaatctag

SEQ ID NO: 80919 - DNA, 819 bp, Glycine max
  Peptide Sequence Number=SeqID_197697
atgggaagcaaaaagaaaaccagtgtcgctgttgatgtcgaagtgaatacaccgcttaaaaataaagagtatgaaaaagagctccgccgcctgcacgttgaactggttaagctccagcaatgggtcgtcgccaagggattaaaagtgtgtatcgtttttgaaggtcgcgacggcgccggtaaaggcggcaccattaaagccatcaccgagcgcgtcagtcctcgcgtatttcgcgtagttgccctcccagccccgacggaaaaagaaaaaagccagctctacttccagcgctatgtgccccacctgccttcggcaggcgagatcgtgattttcgatcgcagctggtacaaccgtgcgggcgtggagcgggtaatgggattctgcacggaggaacaggttgagaaatttttggacggcgcgccggtcatggaaaaagcaatggtcgatgccggcattatcctgctgaaatactggctggaggtgacgccgaaggagcaggagcgccgcctgcgcgaccggattaacgatggtcgtaagatctggaagctttcgccgatggacattaagtcctttaacctgtgggacgagtacactctcgcacgcgacgccatgtttgaagccaccgataccgcctgggcgccatggtttgtggcacgttcagaagataaaaaacgcgtgcgcctgaatattatttcgcacctgctttcgcagatcccgtataaagaactgcacgttgaaaaggtcgatttaccgaaacgtaaaattggtaaagtgaagccaacgaaatatccgttccggtatgtggaagagcggttttga

SEQ ID NO: 80920 - DNA, 390 bp, Glycine max
  Peptide Sequence Number=SeqID_197698
atgagtcatcattcatctagtgttaatggcaagggtactagtcataaggaccctttatctagaatcttagatgagttgagttccctcaagttatggatagaaaaactagaaagaaaagaaaaaggaaacgagagggctttactactaagttatgagaaagtaaagaacagaaacaataacttagacaaaagtaaagcggaaataaaaggtgcacagcggaaaagtaaagagcgtcgggaagaagaaagcaaacacaagttttatactggttcgacaatgacccgtgcctacatccaatcctcaagcaacctcttgagatttcctttccttttaaaaatcctttacaagcaaagagccacaaaggatgtaccttcccttgttctcttttaa

SEQ ID NO: 80921 - DNA, 174 bp, Glycine max
  Peptide Sequence Number=SeqID_197699
atggaagtggtagtggagacagagcttttttgtgtgggaggaggaaatgctcaaatctttgtagcttttcaagataagatcccctctaaacaaaatttgatggtgagaggtgtgctgagtaatgatgagttggattatggctcatgtgggggcatggtagagaccttgaagtga

SEQ ID NO: 80922 - DNA, 147 bp, Glycine max
  Peptide Sequence Number=SeqID_197700
atggatagaattgcaaatggaccaagagggtttgcttttcttcgttatgcaactgaagaagagtctcagaaggctattgagggaatgcatcgaaaggagagtaatttggagagcccgaggtttttgcaacttcctttggcttgctaa

SEQ ID NO: 80923 - DNA, 1491 bp, Glycine max
  Peptide Sequence Number=SeqID_197701
atggagatgcagggggattatgaagcatggctacatgatttggtaattgggtatttgttaaaagaacaatggatacttgacatggatatgactctaattaatgaccaaatagaaagcacaagatcaaccatatttggctcagctagtaacatccattccaatgctgaaaagcaggccgaaaatgttgctcccaaggtgaggaaaccatataccattactaaacaaagggagaagtggacagaggaagagcatcaaaagttccttgaagctttgaaattgtatggtcgtggctggcgccaaattgaagagcatataggtaccaaaactgctgttcagattcgaagccatgctcaaaagtttttctctaaggttgtgagggaatctgaggtcagtgatgagggttctatacaaccaattaacatacctcctcctcggcctaagaggaaacccctgcatccatatccccgtaaatcagttaattctttcagaggacccaccataccaaatgaaacagaaatatctccatctacaaacctgttggttgcagagaaagacaccccatctccaacctcggtgctatctacagttggttcggaagcatttgggtctcaattttcagagcagactaacagatgcctttcaccaaactcttgcaccactgatattcactcagtcagcttatcacctgttgaaaaggaaaatgattgcatgacatccaaagaatctgaggaggaagagaaagcatcaccagcttcacgtcctttatccactgtttctaacccaaaaatgtgcatgaaacctgagtttagttccaaggagatagaagatgctactgatatgccacaaaccactagtattaagctttttggaagaacagtctctatggtaggtaatcagaagtcactgaagatagatgatgatggtaagccgataactgtgaagtccgatgaagtagatgatgttgagaatgagaagcttggccaatcaggagaatccaagcaagtagatacacaattatcactcggcgtggttagtggtaactggcctataacacccgatgctgatggagctaatgtgaccagcatagagcccccaaaggagaacctatgcttcagtgaatctgcacctgatgcattttttccgcagtggagtttgtcccaaggccttccacctttctacctgaggccatgcaatcaggtcctaaatcccttgcctcttaggccctcctctttgaaagtaagaacaagagaggaggaaagttgttgcactggttccaacactgaatcagtctgtgacatggaaaaccaaggcaagaactcagatgctgttgattctaagtttcaaaaatatcacgaggaaggagctgcaccccagaagaagcctgcaaggggatttgtaccatataaaagatgtttagctgaaagagatggacattcttttattgttgccatggaagagagggaggggcaacgagcacgtgtgtgctcatag

SEQ ID NO: 80924 - DNA, 351 bp, Glycine max
  Peptide Sequence Number=SeqID_197702
atggctaacaacgttgtttttgttgttcctaaggtagctcctggttctctaccttcattacccataacaaacaatgctctctaccttcatctgaatttctgccaaaccaaaaacagaacagcctcattcccttcttcctcatcaatcctcagaagcaaagctagttgttctgtgttagcgtgtctccctcctgcttcttctgaatcctcaacctcatcttccactgctaaaccctcttttccttctcctccaactaagctttatgtcagtgaagaagttaatgtaatggtgggaactgagaagaagatggccagtgtctctagcttactaacatcatattatctcttttaa

SEQ ID NO: 80925 - DNA, 390 bp, Glycine max
  Peptide Sequence Number=SeqID_197703
atgtttggattctcgctagccgaactgcgttgttcgacaccagttaccacacaagacgaaagatcattctatattatgatcaagaatgcaaaaggtaccaaaaggaggggcaaaagggtctttttattgagtttcctggaccctagcttgcctaggctagcctctggctcatctgggcccccaaattacttcagcctgaaggaaccagctcgcctgtgcgagccatgtacttcaggagtaagcctccaactcgcctgggcgagttaccatggtcccaagtgcccttttttttctataaataggaatgaaggggagttgaggaaggggttccaaggctcagaagtggagagaattgagagaagagagaaaaaagaagaagaaagaagatga

SEQ ID NO: 80926 - DNA, 237 bp, Glycine max
  Peptide Sequence Number=SeqID_197704
atgaacagtgttgagtggaatcctaaatacaatttacttgcatatgctggtgatgacaaaaacaagcatcaggctgatgaagaacaaggggcagcattcacggacatgaatagtaacataatagttcttttactttttacaccgctctcccatcagaatggtttggtaattgatgacattaaaggacaacagcacaaatggtattttggaatgctgagtttgaaatgttcgcgctaa

SEQ ID NO: 80927 - DNA, 699 bp, Glycine max
  Peptide Sequence Number=SeqID_197705
atgggtgaaacaaaagacacccacatagtagaaatcccagtagaccaagagcataatcatcacaagaacgtgttgtgttccatgacaagcaacatgattgaggccatagaggaccaccctctaaccgaaatctccgagagccccgggcacctcttgctcctgaagctatggcaaagagaggaagagctcttctccaaacgcattgctcacaaggagacaagaatggataccatcaaagctgaactctttcaactctcctcattcttcttcatcttccatgccttcttcctaaccctccttttcacgtcttgggccaaagcccaacaacaagcccaccatagtgtttgtcacaagtggtggcttccctccatggtgtccctttgcacctcctttgtgtttgtggttcttgtgcagatgaaggtgcataggtattggaaggtgtgggggcacttgcaaagagagaggaatgatgggagggctgtgacaaggtgcattcaggagttgaggatgaaaggggcaagctttgatctttctaaggagcctaatagtagtagtagtgggaagaggatgaagagctcaagtgttgagatcaagtggaggccactcacttggtgttcaaagaacttgctcaccatttcccttgtttgcttttcaggtttggtgtttcctgcttccaagcttgtcctctgtggcctgtga

SEQ ID NO: 80928 - DNA, 285 bp, Glycine max
  Peptide Sequence Number=SeqID_197706
atggaccaagctcaacatcaagccttccgcaaggcatatggaaaaatctgggatttggccatgatagaagtgtttgttgaagccatcgcatccctcactcaatattatgaccagttgctaaggtgcttcaggaggaaggaagccgtatctgttttccagattctacccttccatggcaagagtagcaaaagtggtcaagatctcggcacaagagttagactgagtgaaacaaaacaggaatggggtggtagggataccaaggcagagcttggaggaaagggttga

SEQ ID NO: 80929 - DNA, 828 bp, Glycine max
  Peptide Sequence Number=SeqID_197707
atgaagaagtcttcgggaagcgcagctgacaaaaagagggtgcgacgctcatccgcaccagatcccacctccgacgctcctcctaggaaacaagttgtcaagaaagatgtgttccaggtttttgctgagaaggttagagatcataaggaattggtttcaaggtgggctgttctacaggagacgcgtgttgagtattttagagggaaggattttgtgagcttcttgaaaaaccatccggagctcaaagacgtcctagaatcagataggaatttggaaacagaggagattgccaacattctactcgcaaaaaatcttttagtgcgctgtgatcgtgttgtgaaaactgttcgtcctgggaagaaaaagctgtctacctggcctgcacatttagaaattttccctcgaatctggtttttccctaacatccttgccgaggaagcaacactgcgggagttgttcagattttggcctaagaaagatgaagaggaaaagcccaagtggacaacaagacttttctatgctggggtagctgtgctgttcatattattgctgaggcatcatgcacccgatgaagctgccagagcaaggcaaaagagggtatctaacatcattgatgatgttcttgaatggtctccgactctagccttgtctgggatgatggataagcaacaaaatgtggctaatgccacagggtccgccgatgcgagcaaaaatggaccggaggatgcagctccagccgatggtgacgatgcaaaagatttcatggaacaggataataatactgaagaagtcataaacgatgtggatgatgataaacatcatgattaa

SEQ ID NO: 80930 - DNA, 480 bp, Glycine max
  Peptide Sequence Number=SeqID_197708
atggctgacctgattagcttccttctcatattcagtgtccttcttaacgttttgggatcctctattgggctatatgctgacatctggtgtacacagccatatcttcatgaatctaggcatcagcatgctatgagaagggcaaggggtaccggaggacgatttgcaaagaaaactgacggtgagggctcaaaccacttaggcaaggaaaaggataatggtactgattctgtccaatcaattagttcatctggttctgaacctttgcattctgactctgccgaaacctggaattctcctaacatgcaacaagatgcaagagcatcaaaagtgcacaacagcaggttcgaagcacccagttaccaaaatggcagtggctcctaccataaccataatggattgcaatcttcagtgtaccattcatcctcaggtgaaagagtggaggaaagggactgttcaggtcagcagctgaaccacaattga

SEQ ID NO: 80931 - DNA, 204 bp, Glycine max
  Peptide Sequence Number=SeqID_197709
cacaaaggagaatctggcagagcatcaacatcaaagccgcgtgctaatcgcgagatcactgcgctaagcacagcagcttttgcacaccttttaggacagcgtgcagaatggccagggcacagaattccagagcagccacaggcctatttagggaaaagagccctagaagcagaaaagaggagcagcttgtgcattgaagcctag

SEQ ID NO: 80932 - DNA, 356 bp, Glycine max
  Peptide Sequence Number=SeqID_197710
ctgtctgctgacgcgaaagccattggcgacaatgccaaatggctgctggatcaggctgagtgcatcgtgaccctgtggaacggccagcctatcgcagtgactccacctaactttgttgagctggaaatcgttgaaaccgatccaggactgaaaggtgacaccgcaggtaccggcggtaaaccagcaacgctgtctaccggcgctgtggttaaggttcctctgtttgtacagactggcgaagtgatcaaagcagggatgatgaaacgtaccgttaaaattctgcttctgttagcgctctccgctgatatttctgaaggtggtagcgcaatctctggtgcggcaacaaaagctcagca

SEQ ID NO: 80933 - DNA, 348 bp, Glycine max
  Peptide Sequence Number=SeqID_197711
atggcccctgccacacaggagatgccagtgcgctggataccgtttatcgctttctttctctatgtttacattgagatttccattttcatccaggtcgcccatgtgctgggcgtcctgctgaccctgattctggtgattttcacctccgtcatcggcatgtcgctggtgccagaagatggccgcaggcgaaagcccggctgcggagatgatcaaaagcgtatcgctgattattgctggtctgctgctgatcctgccggggttcttcaccgacttcctcggccttctgctgctactgccgccggtgcaaaagcacctgaccatgaagctgctgccgcatctgcgctttag

SEQ ID NO: 80934 - DNA, 904 bp, Glycine max
  Peptide Sequence Number=SeqID_197712
gcatgacgagcaactgctgctggccgaactggggacgctggctatcgtctggtgggtgggttcgcgcggagccaagtccagcgccaacctgcagacactggttgcggtgctgattgtcgcgctcgttgccgctatctggtgggcgggcgatatcaccgtaaaagagattcccttcccggccgtgacggacgtcaatcactcacagctttttgccgcgctctccgtcatgttctggtgctttgtcggtctggaagcctttgcccatctggcgtcggaatttaagcagcctgaacgtgattttccccgcgcgctgatgataggcctgctgctggcaggcacggtctactgggcttgtaccgtgctggtgttgcactttaacgctttcggagcggatctcgccgccgcggcatcactgccgggtatcgtggttgaactgtttggcgtgaaggcgctttggatcgcctgcgttattggctatctggcctgttttgccagcctgaatatttacatccagagctttgcccgtctggtgtggtcacaggcgcgagagaaaccccggagccgccttgcgcgtctgtctaaacgtcagcttcccttgaatgccctgaatgccgtgctgggctgctgcgtggtgagtacgctgtgcatttacgcactgaagatcaatctggacgcgctcatcgtctacgccaacggtattttcatcatgatctatctgctgtgcatgctggcgggttgccgtctgctgagcggtcgctataaagccctggccgcggtgggaggcccggtaagcgaagcgccaccgggcaacaaaatcaacgatcgtctttgtgatctaaacggtcgtgttgttcatccttacgctgatactccccttcaaaggtatcccctggcccggtactaa

SEQ ID NO: 80935 - DNA, 99 bp, Glycine max
  Peptide Sequence Number=SeqID_197713
atgaaagttagagttgacgaagcaacatgcattggttgtggagtttgtgaaaacctttgtccagatgttttcaaactcggcgatgatatgaaagcaaag

SEQ ID NO: 80936 - DNA, 567 bp, Glycine max
  Peptide Sequence Number=SeqID_197714
atgcagattggaggtgaagatgtgcttagaagaccagaaaaggaacagttggttcaagaacttaccagcgagtttcaaaattcatcacttgttcttttcacagactttaaaggtttgaccgttgcacaaatgacaaatttaagaagagctttaagagaaaaacttggtagtggtgcaaggttaaccgttgtaaaaaacacacttttaaagatggctttgaagaactctggttacgatgttgattctcatgaaagttcattctttggtcccacagcggttttgtatgtaacagagggagatccagtagaagctatcaaagtcttctacaactttgttaaagaaaacaagggtacaccagtatgtaaaggtttattccttgaaagaaagttctttgccggggaacaactcgaagacctttcgaaacttccatccagagaccaacttatcgcaatggttgttggaggaattcaggctccgatacgcggtcttgtcaactctcttgcaggtgtgcttagaagcgtactttatgcgcttaatgctattaaagagcaaaaagaaaagcagtga

SEQ ID NO: 80937 - DNA, 1056 bp, Glycine max
  Peptide Sequence Number=SeqID_197715
atggcaaatcaagaagattgggtcccgtttatggatgtgttagcattgctaatctttggggtcgtcctctttccaaacgtagatggtttggtggacctagccgccatcgacgctttccttgcataccaccatagcaaggaaagcccggtggtagctgtcttggcagatttatttgacacatttgaccgaagccatcgctcgtgtgctgaaaagagaggaatagattgggaccagctcttgaccgggataggaggtagaacaatcagttggttcccccgatggaaggaaggaagggagggagtccttttctcatgtggagggtacccaaacattccgttgataggaacgaggggttgtattaactacaatcctgcactcgctataagacagttaaggtaccctatgaggggagcatcgattgaagagagcctctctcctttccttgaaagcccgttaaggaaagataaagaaattaggggcattcgtaatggcatcatcggtggttatcatgaatggctgaaagttcgtacacgagggttagattggctctccaagttaaagattatcgacaaagaaagcttcgaagctctagaagaggatgaagaagtccgagctctaaaaacagaactaggaaaagcaagacttgccaaagaaaaattcaagttggtcgctacagacgtccgaaaagagtgtgtcgggttacaagaagaaaatacagctaacgcaaaagcccttcaacaagaaaccaagagggctcgcaaggaagagcatggccgtgacaaatttcgtggagctttatggggcagcaacagtgagctcaagcttcgaagggaagagagagaccaatcacgagcacataacatggtcttgaaagaggagtcagctgcttgctcaaggtccaaaagaagcttgtctcagcgtttatgcgagacagagaccaacatgttagccatcatcagcaagtaccaagaagagctaaatctagccacggcccacgagcataaagtggcggacgagtatgcccaagtgtacgcggaaaaggaggctagaggaagg

SEQ ID NO: 80938 - DNA, 180 bp, Glycine max
  Peptide Sequence Number=SeqID_197716
ataaaatgggcaagattggtgaagtgcagaatttatgaactcgctgagccacgccacacgctgggcgagccatccgctaagcgcacagaagaatctggaagaaggatgagttgtacaaaggcgttaagcgagtgtcaactcgctaagcgcaccgcctttaaccctttggctaagcaataa

SEQ ID NO: 80939 - DNA, 462 bp, Glycine max
  Peptide Sequence Number=SeqID_197717
atgaagaataataaatcacccttctccgccgccaccttcactctcttcaacgccaccctgttaatcctctcttcactatcaccaactcatgccctcggttctgccgccaccctcgctgccacctcctccgccgtatgcggcgtggtggcatcggagccgacgcggcgcattgcgtgctaccgccacggcgaagtcgtcgccgtcgcccccaacgtttcgttctcggcgatctccggcggccggagctacttctgcggccttcgctccggcaactacagcctcctctgctgggacaccctctccggcttccaaagcaagaggctttacaacaatggcactgttctattggagaaactcgccctcggagactcgcaggatactcctcctaggcttattagattaactgaaaagatcgtcacacgcacacttctcgaacttcaggacacaaaactcaataactga

SEQ ID NO: 80940 - DNA, 249 bp, Glycine max
  Peptide Sequence Number=SeqID_197718
atgaggaggaagacgagaatgagtacatatgagagaatgaagctccctgtctgtgttggagggtttcatgttgtaatgcaatatgcaacgagggttgccaatttgagtggtaatgtgtggtatatatggccaacgttcgtaattaggcgtatttgcatgaacgaagggaggcttaatttcacactattcacatacgccatacttgaccagctagcaaggaagccagagttttcattagccaggaaataa

SEQ ID NO: 80941 - DNA, 258 bp, Glycine max
  Peptide Sequence Number=SeqID_197719
atgcaattttggtcattctatgatgcaatcctccctaggaagggaccagtcactagagtcatgagcaagaggctccaagaggattgggctagagctgctgaagaaagtcctaggcaccacaatggaaacccgcattcacactacaatgacgttcacatcggcaagcttagtaccaaggttgacaaaatcgacataatcacaattaataagattcatgagttcgtggttcagggaagaggcttagttgttaagctttga

SEQ ID NO: 80942 - DNA, 824 bp, Glycine max
  Peptide Sequence Number=SeqID_197720
atgattgctatagcaaaagctggctactgggctattgcctttgatttcagaggctatggactttctcagcatcctgcggagccacaaaaagcaaacttacttgaccttgttgatgatgtcgtgggtttgttggcttcactaagcattaccaagggacatcattttgaaatccgatcacgccaatgtgaccgaggttcagtgaagggttcctctcggtgtggggttccaacggagaaaaatggcaatttgtggtggctactggtggctgtgggtgatggagaagaagcttggcacattggaaatggttttggaagaaagaaggagaaggaaatggcgtttttccaaagctacttgaactacaaggctcaaaaagcacaagtgactaatgctctcagaaacggaaatgttgtgcacactgcagacgtcttctcaaagatcccaatggactttggtgcctttccaggatatattgttacctctctccatccagacaaagtagattcagtcataatgttaggtgttccattcatgcttccaggtccctctgctattgaaaacctcccaaaaggctcctacgttattaagtggcaggctgggagggcaaaaacagattttgttcgctttgatgttaagtcagttataaggaacatctacacactcttctctggaagtgagataccaatagcaggtgataatcaggaaatcatggatttgtatgacccaactactcccctaccaccatggttctccgaggaagacctgacaacctatgcatcactatacgaaaaatctggcttcagatttgcattgcaggttccatacag

SEQ ID NO: 80943 - DNA, 246 bp, Glycine max
  Peptide Sequence Number=SeqID_197721
atggacattgagagggacaaacaaacgcagagcacaaaacaacctcaacacatggaaattaacaaaaatctaaaaaatgaggtacctgaagaggtggatttgatggaatcaagattggagattgcgattggagactatagtgaaacgaaggtggctcgggaaggcacaaagacgaagaagaagatgcaaacatggattgaaccattatcacacaaaggagaagaagaagaagcaaagcagccatga

SEQ ID NO: 80944 - DNA, 2151 bp, Glycine max
  Peptide Sequence Number=SeqID_197722
atgatgttccattctcagggtgtgtcaagacattgtagtctccttgctgtcctgagtggtaaatcacgtgacattaagcaaaagcagaagcagggtaatgcttctgaggatcaatttccttatccctttccagaactttcttcctctggtcgtcttgaggtcaaggtattgatcgaacctacggctgatgaactcggtctagctcttgaacaactgcagccggattttgtttacctgcaaggtcagcagctagaagataggggagaaattgggcctcttggatgggaagattttgacttgtctgtcccagaagcattgtgtggattgttttcttccaaattacctaatactgtttatttggaaactccaaagggagaaaaattggcagaggcacttcgtaaacatactgcaaacttaaacagcatacctaccaactatgtatactcccacttatcaatagtttgtaaggtcatgtaccgtgtacctataccagcaccaccagagagtattgcgaacctgggagttccatacactatctattggaaaaacgatttttcaaagtatgcagcttcacattttcgacattctttattctctgtggcacagagtacatccagccatacatgggatgctttccagctagctctggcatcttttagactatactgtatacacaacaatgtcttaccttctaactgccataagggtgctggaaagctcgggccacaaattcttggggttcctcccaacattgatgtcagtccatgtgtagcagacatgaaggaagaggaagaagattcaccggagacaatttctgctgtaaagatatatgacgatgatgtgaacatgagatttcttatttgtggagttccctgcacattggatgcttgcttgttggggtcattagaggatggactcaatgctcttctatttgcagaaatacgcggatgcaaacttcacaacaggacaagtgcaacaccgccacctctccaggcaggaacattctcacgtggtgtagtgactatgcgttgtgatatatcaacatgtagttctgctcatatatcacttttggtgtctggtagtgcagacacttgttttaatgatcaggcatggcttttggagaatcatattaaaaaagagctgattgagaagagtcaacttgtccaagcatttcctaatcatgaacaaagtaaagcaccttcctctgagcctcgaagatcagcctcagtagcctgtggatctagtgtgtttgaagtttgtatgcaagttcctgcatgggcttcacaggttctgagacagcttgcacccaatttgtcataccgcagccttgttatgttgggaattgctagtattcagggattgccagttgcatcgtttaataaagatgatgccgaacgccttcttttcttttgtactaggcaggagaaagaaaactgtcccaacgatcatgttttctctggtattccaagttggctgaagcctccatcaaccagtcgaaaaagatctgaaccatgctctagttcaaagtctattaatgatagtggccggggagttgaagccattggcagtcatagacagaaatttaatcttgcttctatgaggccaatccctcactctaatagacacaagattctccccttttctggattgtctgagggtacaagatatgatggagatcatggaaaatcaaatctaccacttgctcctattaagcataatgtttcaggccctacttcagttacaaataggaaatctgtgtcgaactcatttcaagctcaccagattatttctttgaatccactacctatgaaaaagcatggttgtgacagagctccaatacgagcttgctctgaggaggaattcttgagggatgtaatgcagtttttgatacttcgggggcataatcgtctaattccgcctggtggacttgctgagttcccagatgccattttgaatgcgaaacgccttgacctgttcaacttgtatagggaggtaggagatttgtatacatactgcatactgcatagtagtgtaaaaagaatgaatagtaatcctttccttatcaggcatcttgcactttttgttgagatggatgctcctaatgtagtacattttgctcatatgaagcattcagttgtttatcttagttga

SEQ ID NO: 80945 - DNA, 281 bp, Glycine max
  Peptide Sequence Number=SeqID_197723
gaagactttataaggggtccacaaccgttcacaacatccctttgcgccatgatcaagttaaggttggtgttgaggaagttacaaatgcagatgcccatattcatgtacccactaaagaagttaagttagtggaacaggcacttaacaccttccttgcttggccgacacatcttgtcaagcatttatcagaacagggagctgtaggaccggtgaaacctatagataggccagatcatgatgtcgatgatcccttatatctgatgacattgaccatcccatag

SEQ ID NO: 80946 - DNA, 1326 bp, Glycine max
  Peptide Sequence Number=SeqID_197724
atgttgaaccccgaaccgccgccgccgccgccgccgatgatggttccgccggcgacgccgatgaaccgcgaaacgacgtcgctaaggaagaagaacagactccgaactcgaactcgaattccacctttcgacgtggactcctccttcttcaccacgccgatctccttgcaaggcaccacaaaatcaaacgcgatctccgtggagcaatacgacggcgtttccgcttccgcttccagccccgtccacgtcatcaacctctctgataccgaggacgacgacgaagtccgaatcctcaacttcactcccataaacacgtccttcggaaaacgcagcaagaaatcatcatccaaaggagagtgctccaactccgcatcgttcgtctgcgaaatctgcaccgaaacgaaaaccgccagagactccttctcgatcatcggatgccaccacgtgtactgcaactcctgcgtggcgcagtacgtcgaatcgaagctcgaagagaacatcgttagcatcccctgccccgtgccgggatgcaggggactactggaggctgatgattgccgtgaaattctcgcgcctcgcgtcttcgatcggtggggaaaagccttatgcgaggctgtgattgctgctgaagaaaaattctattgtccctttgcggattgttctgttatgttgattagagggatcgaggaaaacaatatcagagaagctgagtgtcctaactgtaggaggcttttctgtgcgcagtgtagggtgccctggcacgataatatgccctgcgaggactttcagaagctgaacgcggacgagagggataaggaggatatcatgctgatgaacctcgccaatcaaatgcagtggaagaggtgcccccggtgtaggttctacgtcgccaaatcggatggatgcatgtacatgaaatgcaggactattcatctgctttcgatgactaatctccgttccaaaacctgcctagggaaagacgcagaagcagctgcttttgctgatccactatcgaaaggtagccagtgtttactaaatacccactggagtatgcggttgatgcagccgcaaatgcagacgcagttgcaacgcgtcaaaaaacctttacaacgtgggcacacttgtgtttgtggaccacaatttaaaaccatgctcaacagctcaagacttcaatgccttttggctttgcaatcttccatggcacattccagctcgtataatagtcatcatccacataatcttccaaagtgtggaaacgccttctgttacaactgtggagctcccaacttaaccagctcccatagttgcagctattgttttcgttaa

SEQ ID NO: 80947 - DNA, 2058 bp, Glycine max
  Peptide Sequence Number=SeqID_197725
atgacgatgaaaacggcacacaaaatctggaattttttgaaggaagagtatgaaggcagtgagaaaatcaaaggaatgcaagctttgaatctgattcgagaacttgagatgcagagggtgaaagattcggagacaatcaaagattatgcggacaagcttctcggcattgcaaacaaaatacgtcttcttggcactgaaattcctgactctcgaattgttcaaaaaatacttgtaacaattccagaaaaatatgaagccacattgacttccttggagaactcaaaagatctttctactatcaccttggcagagcttttgaccgcacttcaggctccggaacaaagaagactcatgagacaagaaggtactactgaaggggctttggtagctaaatcactggacaaaaaaaagaagggcaagtcaggaagtttcaaccacaaaaatggtagcaaatcctctcatgattttccatcatgtccttttgggcatgtggagaaaatttgcaaatcatcacaaaaacaagagaatgtacaagctgctgttgaagaggtggatgaagaagaactttttgttgtttcttgctttgttaccgcaagatcaacagaaagttggctaattgacagtgggtgcacgaaccacatgacttacgatcaagaattattcaaagatcttgatgcaacctacaacacaaatatcagaattggaaacggagaaaaaatagcagtgaaaggcaaaggaaccatcgtgatcgagggttgcacaggtctaaaattaattcctgatgttctatacattcctgaaattaaccaaaacttgttgagtgtcggccaacttctagagaaaggctataaagttctatttgaagataaaagttgcatgattaaagattcagataataaagaattattcagagttcaaatgaaaggcaaaagctttgccttgaatttgattgatgaagagcagcttgttgtgcacaaggttgaagacaacacgctggtttggcataaaaggatgggtcattttcatcatggcgctttgctctatttgaggaagaatgatcttgtacaagggctgcctgaattggaagacaaatcacccatatgtgctgcttgtcaatatggaaaacaaacgaggttgtcttttccaaaaggcaaatcttggagagcaacaagcaagctacagttagtacatacggatgtcgaaggacctcagaaaaccccatctctgaatggcaaatatacttctgataagttcagcaagttttgtgaagatgcaaggataaagcatcaattgacaacaccgtataccccacagcaaaatggggttgtggagcgcaaaaacagaacgatcttggaaatggcaagatgtttacttcatgacaaagatcttccaaaaaaattctgggcaaaggctgcaagcacttctatttttttgctgaacagattgccaacaaaagctctttcaaaatcgaccccatttgaagcttggtatggtttcaaaccaaaattgatgaacttgaaagtctttggctgcttgtgtttctcttatattccacaggttaagagagacaaacttgataaaaaggcggaagcggaaatctttgtaggctatagctcaacatcaaaagcctatagaatattcttgccacaaagtaataaagttattgttaacaaagatgtgctattctttgaagaagaaaaatggagcaaggaaagtgagaagcttcaagttcaggaggagagcgaagaagatgtggatgaccagccagttagaggaactagatctctctctgatatttatcaaagatgtaatgttgctataatggagcctgtagactacaatgaagctgcaatttcaatttctaagaaccctgtgtttcatgggaaaacaaaacattttaagataaagttgtatttcctaagggaggtgcaaaagcaaggtgacgtgcaactgctatattgcaaaactgaaaatcaacttgctgattttttaacaaaatcacttcctcaagcaagatttgagtatcttcgacaaaaacttggagtatgctgtcattga

SEQ ID NO: 80948 - DNA, 696 bp, Glycine max
  Peptide Sequence Number=SeqID_197726
atgcctggcacaccgcaacaaaatggtgtggctgaaaggtggaatcatactttaatggatatggttagatctatgttgaattatagtattgtacctttatctttatggatgcacacattaaagtatgctgcatatgtgcttaataaggatcctgtaaaggtgtttaattcacataaaaagaaacttgatgcaagaaccattagtggcttcttcattgggtatcctgaaaagcccaaaggttatatattctattgtcttaaccatagtatgagaataattgagtctggcaatacttggtacattgagaatggtcagttcaatgagagtgagaaatcacagaaggtggatattataaagactcatgatccaatctcttttaagcaagccatgaaaagtgacatttctgaaaagtggctcaatccaatgaaagaagagttgaaatcaatggatgataataaagttttggatctagttgaattgcccgaaggttcaaaacaagttggctgtaaatgggtatttaagacccaatgtgactcgaaggacaatattgaaagatacaaagctagacttgttgccaaaggtttcactaaaaaagatggcattgactacaaagaaaccttctctccagtttttaacaaggactctttgaggattgtgttggctttggtggctcattatgacttagagcttcactaa

SEQ ID NO: 80949 - DNA, 450 bp, Glycine max
  Peptide Sequence Number=SeqID_197727
atgaagcatatccgttgtgcattagtggttgggagcttgatcaatccaggaacagaacactggaaagctgcaaagaaagttcttaggaatttacaaggcacaaaagattacatactcacatatagaaggtcagatcaccttgaagtgattgactactcagatttagactacgcttttgcctggagaagcggtatcatggaaagtgcaaaacaatctatgattgctacttctaccatggaggttgagtttgtggcatgttttgtggccacaattcaagcattatggttacaaaactttactttagggtttggtattgtcgacaatatagtcagaccgctgaggatttattatgttaatttcacagttgtcttcttctccaagaatgacaaatactcaaaaggagctaagcacatggatttgaagtatttgtctgttaaggaagaagtatag

SEQ ID NO: 80950 - DNA, 1131 bp, Glycine max
  Peptide Sequence Number=SeqID_197728
atgaccgcttccaataagaaaaaccccaaagagaaaccaattcgccgcaaggaagaaaaaccggaagaaccggaagtgccgaaatacagagatcgagctaaagagcgtagagaggatcagaatcctgattatgaacaaactgagcttggatttcatgcagttgcaccacctggtactgtggatattcggtcatctgatgcgcacaagttatctattgagaagagcaagtaccttggaggtgatgtggaacatacacatttggtcaaaggtttggattatgcattgctgaacaaagtaagaagtgagatagataagaagccagaggctggggatgacgttgaggggaaatccaggtctgctatggaagaccaacaagtgtcgattcgcacagcaactgcaaagtcagtttatcagtggatcgtcaagcctcagaccattagtaagacaaatgagatgtttctccctggtcgaatgacatttatttataacatgggaactgagttcttcagtccaccttatagattagctatagagggtggataccatcatgatattccaacaaccttgcaccgtagtaaagctgactgtccagtgccagaggaaatggttacagttaatgttgatggatctgttctagatcgaattgctaaaataatgtcatatcttcgtcttggttcttctgggaagatcctaaagaagaagagaaaggaaaaggatgcaaaagggaagattttggctgttggtaatggatttgacaaagaggataagccatcaaaggttgaaggtggggcaaaaaatcaaactgaaaaagaaattattctgcctcctccacctcccataaagaaaaatcctcttcattcaatagagaaacaaggcccagctgttgctagagcagaagatgatgacatttttgttggtgaaggggttgactatgatatacctggtaaagacttgagccaaagtcctgtctctgaggacatggaagagtctcctaggaacaaagaaaaaccttcatatttcacagaacctacttatggtcctgtccaaccttcaatggttcctcaagggtggcaagaaacagtgaatatgattagaaaaagattccttactcctgtttcatccttaagttaa

SEQ ID NO: 80951 - DNA, 183 bp, Glycine max
  Peptide Sequence Number=SeqID_197729
atggttgtgaatgtcattgaccgtgaaagtgggtttaatgtcgttggtggcggagcccggcggttcggcgtgggcggagctgttttcgggcccaggtttcttgctgaggaggcatcatcggagaaggagatgaagagaggtggaggagtggaaaaaggaaatcacatgagagggaaggggtga

SEQ ID NO: 80952 - DNA, 354 bp, Glycine max
  Peptide Sequence Number=SeqID_197730
atggcaacaaacgacaacgatgccaactccgtcaaccaaggaaaaggtccacacgagcatgaatccaccatgtcgaggatgcttgccatgggtgcctctgaaatgaggaacccaacaaacgttgcaagtccttcacgtcagaaggttgatgatcactcaatcatcattgccctgcaaagagagatggataccttgaaggaaaaaaacgcccaagagatgaatgaaattctgatacagaggtcagatgtcgtaccagatattaaccaagtaaataacacaagagaattgttaacccagttcggtgcaacgtcacctacatctgggggctaccaagccagggaggaaatccactaa

SEQ ID NO: 80953 - DNA, 183 bp, Glycine max
  Peptide Sequence Number=SeqID_197731
atgtttgtattcaatagtgctttgaaaggacttgacaatactcaacaaagtaaatccaagtctcctgctaggtggattgttgttaaatatttcactgatcctagaccattggaaccagaaagattgaagacgcttcgcaaccagtgggcaaagtactacttgaaagtgaaaaataaaacttag

SEQ ID NO: 80954 - DNA, 186 bp, Glycine max
  Peptide Sequence Number=SeqID_197732
atggcctgcaacctttgcctgaccgtttcgaggtacttcacacccattgttaggcccacttgggccttccggggtgttccaacagaaggcggtgccttctggtggaagcaacagctcgccagggcaagcttggcggcaaccacctcccttttttcccctataaatagggtattaagggcagagtaa

SEQ ID NO: 80955 - DNA, 219 bp, Glycine max
  Peptide Sequence Number=SeqID_197733
atgcacgaaacacaatgtggaccactacgggtacatagaatgaatcgaaaagcttggttcgagcaaaataggggaggtggttgccgcccagctcgcccaggcgagctcagctcgcccaggcgagccaggttgcttcctccagaagcaaccgccttctggaggaatattctggagggcccaagtgggcctgggtgctatttgcacccccatttttactaa

SEQ ID NO: 80956 - DNA, 651 bp, Glycine max
  Peptide Sequence Number=SeqID_197734
atggataacatattcatcaaccaactagggagaaatctagaagtctatgttgatgacatggtgctcaaaagcacgaacaccacctctcaagcaaaagacttggcagagatctttccagagataagaaagcacaatatgagactaaatcctaagaaatgcgcattcgatgttcaaggaggaaaattccttggattcatgcttacccatagaggaattaaggccaacccagagaagtgtgtgatcataattgagacgagaattccaaacactctaaaaaaagtacaaagacttgctgaccgatcagtagtgccctccaaatttttgccaagagaagctaacacgacgaagcctatcttcaaactattggagaagcaagggggaacaaagtggaatgaggattgtgaggctaactttcagaagctcaaagagttccttgcttcaccccttatcctcactaggccactaaggccatatttcacgagtcaccaaatagtggttcaaactgatcactctatccgaaaattgtacctagatggatcaccaaacacaaaaggaattagggctggagtcattttagaaagcccaaatggaataattctagtcgaagcaacaaataaccaagctgagtatgagaccctcttagctggctag

SEQ ID NO: 80957 - DNA, 450 bp, Glycine max
  Peptide Sequence Number=SeqID_197735
atgcgaggtatctatgtcccttatgacgttgatgccattgatgcatatctacaagctgtcgttcaacccgaggaagataaagatgaggaaacccataatggtgtggagatccctcaccttatcattcaatcacatttgaggagtctcccgagggtttggatgacattttacttcaccaacattagcccaaccctccatgtatccgatcttcatttagacaatgcctacaccatcttttctattcttgacgaagtccctatcaatgtagatccatacttcataccaccctataagtccatctgttcgcctatcagttggaactacattgttaccaactatggagtagatattcataacactgaccctaatatggaggaagtggcaagggaaaaagaagaaatgaaacaacaacaacaggcacaacaagccccaatgagctatgaagcatag

SEQ ID NO: 80958 - DNA, 195 bp, Glycine max
  Peptide Sequence Number=SeqID_197736
atgaccatgactgaggactctaccaaacctctccaagaagaggttgaatgccttaataaggagtctactctctttaagccaaatgcgacgaaggttgaggagaaattaaagagtgatctcgacgagattgaggccgagatccttaagactcatgaagttgaccaaatagctaagttatctatggtctatacttag

SEQ ID NO: 80959 - DNA, 291 bp, Glycine max
  Peptide Sequence Number=SeqID_197737
atggcacctccagactctattccttcagtagagcagtttaatgagacggtacctcaacatgtggaggatgagtcatctgaggccaccatccatgagccatttgatataggagaagaggcagaggagacacaggtgagacaggtagctgttgccactcctgagcgatccattgaggctacttcagagccttctccaccaatggtaaacctaccctcacctcagcctgcagcaaacccctccactcctcttctacaaattccagaggacccgactacaccagtcctagcttag

SEQ ID NO: 80960 - DNA, 240 bp, Glycine max
  Peptide Sequence Number=SeqID_197738
gataaacaagtaactgagggaccgacgaaacctgtagctatgctgaatcctgacatcgatcccctctacttgatgacattgaccattccacagattttcctcaagccattaccggtgtcgtgggatgctagcgtgttttgggtgtataatgataatttctcattgtacataaagcatgaagatctttctgaaatagttcatggtggtcaatttcaaagcatctttgttatacaattgtag

SEQ ID NO: 80961 - DNA, 207 bp, Glycine max
  Peptide Sequence Number=SeqID_197739
atggagctaaatatcagattgagcagttttgaaattgccaagaaacttcaagataaactaagagagagggatgctcggattgaggaaattggtaaaagtctatcagaaaagcaggattctgtttcatccctagagaaagatctttcaaactgccgattggagcttgcagagagagagaagagaattaatgacattctgcataatgag

SEQ ID NO: 80962 - DNA, 216 bp, Glycine max
  Peptide Sequence Number=SeqID_197740
atggcctggagattggcccgaggcctaggcaggagaggcaccagtaggggcaccagcagaggctcccgacgagtaaaaagaaagaaagaccacaaagatcgacatgttgtagttaagaagtatgaatcattcgtaaagagcaaacgcatcttctggaaacaagggactgatgctaagagtttattttccggaatgaaccgagataaggatggatga

SEQ ID NO: 80963 - DNA, 207 bp, Glycine max
  Peptide Sequence Number=SeqID_197741
gggcaggatcatcttgagctaccttctggggtagagacaaagctagaacagcagaaaccaatcaagggacggatgcaagtagggctagggtcacgaccaactgatcgttgccccttcccggcgctaaacaagcagaggacgtcgctgcaagacagcccagtatcctttgcgtttgcagtttcttttactattgtttgttttaaataa

SEQ ID NO: 80964 - DNA, 213 bp, Glycine max
  Peptide Sequence Number=SeqID_197742
atgggggtgcaaatagcacccaggcccatttgggccctccagaagattcctccagaaggcggttgcttctggaggaagcaaccctgctcgcctggaaaatctaagcccgaggcgcttccgaaacgtttccgtaacgttttccgtgaggaatttcgcaaaggtttcaaccgttcttcgacgttcttcattcgttcttccatcttcaacgggtaa

SEQ ID NO: 80965 - DNA, 643 bp, Glycine max
  Peptide Sequence Number=SeqID_197743
gccgtgcgcgccatgctgcagcaggccggcgggctgctggtcgccggttcttcgctgatggccgtggcccagggcaagccggtggccgccatcaaccagggccgcatgcgctccgaggatttgctggccctcaagatcgagcaggactgcggcccgttgctgcagcagctggcccaggacctggagcaatgaaaaagccccgcaggagcggggcacgcggactccacctgctggttgtcgtgcaccgagatcacgaagcacaggtccgtggtgctcatggcggcctcgtcggccatgtccacgcgcaggatgtccacctcggcgccggccagctcggctgccacgcgggcgagcacgcccttgccgttgttgacggtgacgacgatgcgggcctcgaaaaggcgcgcggcatcgatgtcatctgcccattccacgacgatgaagcggtcgctgtccttttcctgcaggcgctgtgcgatcttgcactgcgcgtggtgcacgatcaggccttcgccgctgcccagatagcccacgatggcgtcgcccggcacgggccggcagcactgcgcgtagtggatggagccttggttggagccgtccagcagcacggcgccctggaagggccggttgctggcattgaagc

SEQ ID NO: 80966 - DNA, 720 bp, Glycine max
  Peptide Sequence Number=SeqID_197744
atgaccagcgagcagccaccggccgcagatgcgcttgattctatgccggagatgcttgcgccgggcgaagtgtggcaacacgatcggcagcagccagccgaggttcggacgctgattggttactgccagttttccgcacccgacgcgggattgattgtttcgttgttgccacagtttattcatgtgcatggcgcatcgcgtctgaccacgagggtgcagctggtcagggatgagtgccatgcacagcgtccggcacggcagatggtgatggaacgtttgctggaattactgctgatcgaggcgttgcgcgcaatgccagcggcgaatgcatcgcctggcgtgatgcggggactggccgatgagcggctggccggggcgattcgcgccatccacgccaggccagcccatggctggacggtgccccagctggcgaaacacgcggcgctatcgcgctcggcgtttttcgtgcgttttcgcgatgcagtgggcatggcaccgatggcgtatctgctgacgtggcgcatggcgctggcgaaaaatctgctgcgcagcagccgcctgtcagtggccgacgtggctgaacgggtgggttaccgctctgccagcgccttcagcatcgctttcacccgcttcaccggccagacgccgaccggcttcgctggcgcggaaaggcgcagcggcaccgcagaagctgagccagcaatcgcccagttaagttaa

SEQ ID NO: 80967 - DNA, 363 bp, Glycine max
  Peptide Sequence Number=SeqID_197745
atgacattgctacttagcaacattctgcccagcgaccgcaacgccaatctcccccctgcaaaagtatcagttggtctgtgtcgtcccgacatggggatcgcacccacaagacacccagtggacccggaaaagtccaacagggccctggggtttccagctctggttacgggcctctatcagtcctacagggtgcccgtacccccccggcaaggttatgtcatcatagggatcgcacctgcaagacacccagtggacccgaagaagcccaacagggtcttggagttgtcaagctctaattacgggtctctgtcagttctacagagtacctgtaacctccagcaagggcatcaggccccctactga

SEQ ID NO: 80968 - DNA, 279 bp, Glycine max
  Peptide Sequence Number=SeqID_197746
atgaagcaattggctcgcctaggcgagccagaggctagactgggggagctagggtccaggaaactcaatgaaaagaactttttgccccctccttttggtatcttttgcattcctgatctaaacattgaactatacttcattttatgcggtaactggtgtcgaacaacacagtttagccagcaagaatcaatgaatgacagtcccttgacgaaattagggtataacacttcagatgaacatttctctcctatttatgagagttatgggcaaaaggcttaa

SEQ ID NO: 80969 - DNA, 982 bp, Glycine max
  Peptide Sequence Number=SeqID_197747
atgagcgaggtgcgggcgaccgcgacgtcgctatccgtcgccttgagcgagatgatgcagggcaatcagcagctcgacgcgcacgcgggcacgcaggccgaatcgctggcgcgtaccgccgcgtcgatgcgcgacctggcggccaatgtccatgacaacgccgcgcgcgcgcagcaggcgcggcaactgaccgaccaggcgcgccagaccgtcgacgcgggcagcgccgtcgtggcgggcgtggcgaccatgatgggcgaaatccagcaggagtcgaaaaagatctcggaaatcatcggcctgatcgacagcattgcgttccagaccaatatcctggcgctgaacgcggcggtggaggcagcgcgcgccggcgaacagggcccgaggttttgcggtagtggccgcgcccagtcggcgaaagagatcaaaggattgatcgaagcctcgcagaaccgggtgcaggaaggcgagcagatggtggagtcggcggcgcagaccatgagcggcattaccggcgaagtgggccgggtgacggcgctgatgcgtgagatctcggcggcgacgcgcgaacaaagcagcggtggcgcagcagaatgcggcactggtggaagagtcggcggcggcgacgcgctcgctggaagatcaggctcagctgctggcgcagagcatggcggcgttcaagctaacgcgttactcgtccgggttttcggcgatgaagcgttccgcgtcttctaccatcgacttggtgccgacgaagaatggcgcgcgctggtgcagtttcaccggcgtgatgtccagaatgcggtttttgccgtcgctggccttaccgccggcctgttcggccaggaacgccatcgggttgcattcgtacagcaggcgcagcttgccttgcgggtggctggcggtgcttgggtagatgtagatgccgcctttcagcaggttgcggtggaagtccgccaccagagaaccgatgtagcgcgag

SEQ ID NO: 80970 - DNA, 869 bp, Glycine max
  Peptide Sequence Number=SeqID_197748
atgggagatcgcttggaggatatgattcgtgaccttggacaagagtcttttcagcaagcacatgcccctatgtatgatacattgcaaactgattcaaagaagcctttgtatccggggtgcaataattccttgacgttattgtcggtggtgttaagtctggttaatatgaaggccaaatatgggtggagtgacaaaatttttagttcgttgcttcaagtagtgcacggtatgcttccagagaaaaacacattacctaaaagtcactatcaagccaataagatactgtgtccgatgggtatggagtatcagaagattcatgcttgcccgaatgattgcatactgtacatacgtgaatttcaagaaatgcctaaatgccctaggtgtggtgtatcacactacaaagtgaaggatgatgacgagtttagtagtgacgaaaactcaaagaaggtcccccaacaaaggtgttgtggtatcttcttatcattcaagtggaagaagattgatcgtttgtatccagattttagcaaagaggcaagaaatcttaggcttgggcttgccactgatggaatgaatccatatggcagtttaagcactaaacatagttcgtggctagttttgctagtaatttacaacttgccttcttggttgtgcatgaagcaaaaatacatgatgttgtctatgatgataccgggcccaagacagccaggaaatgacatcgatgtttatctcagtccattgattgaagacttgacaaagttgtgggatgagggggtttcagtgtttgatgggtttcgaaatgagacttttgatttgtgtgcaatgcttttttgtaccattaatgactttccagcacatgggaatttgagcag

SEQ ID NO: 80971 - DNA, 549 bp, Glycine max
  Peptide Sequence Number=SeqID_197749
atgccgacattacctccttttatttcacccatttccccgacgaagctaatgaagagttgctatggaggcacttcaaaaactggggtgacgtacgtgaagtatacatcgctaaaaggctcaacaaggatggcaggagatacgggttcatgcggttcaagggagtctcggatgcaaaaggattggagggggggggggtgccaaggagacaaaagggcagacgaggcacaaacaccaactattctgatcaacccagatgaaggtggggaatattggtgtaacgaaacctgggtgggcatgctaaagaaggtgatggaggtggaaaccttagaggatcgtatcacttgggagttaggatataacgtccgcactaagttcctcggagacgacatggttcttctccctgggatgtccgatgacaaagctcaactcctcattcaatcagagacggaaagcgatgattctctcttttactcactggagaagtggacgccgaaatgtagacccaataacagggttgtttggctccagctgtggggatttctgatacag

SEQ ID NO: 80972 - DNA, 258 bp, Glycine max
  Peptide Sequence Number=SeqID_197750
atgggaagcagatggagaaaattgaagctagctcttggtttggattcttgtgttcacattcctagagcctgtgatgattcctccaccgccacaacaaggtttcccggcgacgtctcacccaccgttgtttcgccagccggcgacacctctggctaccgtccttttactcccacaccatcgtctttcggcctctggttacccaaatcccctaaggaggttatgataaagaagaaaaatcagctagagtatatgatttga

SEQ ID NO: 80973 - DNA, 854 bp, Glycine max
  Peptide Sequence Number=SeqID_197751
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgcttccaccatcagcgccaatatcagtggccagggcagcgtgattaaaagcggtgacgggcggctgacgctgagcggtgacgtcagcaaccagcaaggcgtggaggtgcagcagggcgagctggaagtgagcggcaagctgcacacgccgctgaacatggccgccggcacgctgctctccggcggcggcgtcatcaatcatgccagcctcgccgataacgtcacgctggcaccggactggaacaatgcgccggacagctggtcgaccatgcgccttggcgatctgcaccacgggcgcgacacggcgctggtgctgaactccgcgttccgccacgacgccagcgatcgcctgctaatcgatggcgatctgcaacagccggacgatgcgccgctgtggctgacggtaaaaccccaggccagctggatcgatagcgatcgcaaccacaacggcgcagcggataacaatgaaggtgtgtcgctggtgcaggtcggcggccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactat

SEQ ID NO: 80974 - DNA, 297 bp, Glycine max
  Peptide Sequence Number=SeqID_197752
atgaagaagactcaaggcctacaagctccacatggagctacgtcacgccacaatcacaaaggaattgataagccaaggatcaagatcaccacaaggattatagtccttgataagattagaggtgaggttgcgttgaggaagtggatgatggatagagatacactagggtatagtgggcagagaggttcgaagaacctaggggaattagcgagtggagcagaggactcacccttgcaaccaccaattttaggggaagatcctggagcattagtggaggatgctcatatggatcagtag

SEQ ID NO: 80975 - DNA, 210 bp, Glycine max
  Peptide Sequence Number=SeqID_197753
atgaaactaagaaacttcttacggtaccaaaagaaaacatttgtcaactccttcaagtatctttgtgaaagaaacaaagtcaaagtatgtctcagctgtggaattttccaagtcagtgcattggtgccatcaaaactgggaatgtctaagttcatacaaggaggggaaggtctgggtgagtgggaaggggaagaggcttcgagtgcttga

SEQ ID NO: 80976 - DNA, 636 bp, Glycine max
  Peptide Sequence Number=SeqID_197754
atggctgggatgaatcagtctaacctcgagcatggtggtgacttgcttctcaagttcaactttctggaaataggggtaactgggttcgtggaagatgtccgagaattgaatgaggatgaagatgatttacggggtgtatgctggtcgaaggggtgtagtggagaggatgagtgggagggtgcgaatcatacatcgacatggaagaagtatcgcaatctagcgtgctatcattacctagcatcgcctagagcgcggtcgtcgataagatggcaagttgaggaacatggccatgtgggtcttaataaagttgtgcgtgcttccactgtcgaccagtatcatgacctggtggtgtcagatagagccaaaaaggtgaaaggtctcaggtgccggtgtggcttccatagcgttgtggttgatatgaggaatcagcgtggggatgtgaagtcgaggcttgcaacggtggtcgggaatccatttatcctcacagtggtcccacggggtgagaaggtggtggcgggggtagggaagaaagtgactgtgatcttagccaattctactgcctggggcaaagacaatggtcaaagtgctggacttcgcgatggagctctggattcaggccagacacaaagcccttga

SEQ ID NO: 80977 - DNA, 832 bp, Glycine max
  Peptide Sequence Number=SeqID_197755
atggatacctacatgacaactgcagtaaccgtacagaacatcaccttcaaggaaggcgaaaccttaatttgcgtaccgctgatcggaaaaacgctggatgaactgctgactaatgctcagggcctggttgacgcgggcgctgatattatcgaatggcgcgttgaccattttactcacgtccgggaaatcccccaggtactggccgcactggcggaaatccgtcatcccctgaaagcactcccgctgctgttcaccttccgcagtaagaaagaaggcggcgaaacggaaatcagcgacgaagcgtattttgaacttaaccgccaggcggcgctaagcggattagtcgatgttatcgacatcgagttgtttaacgatgaagcgcaaattcgcgcgctggtgaacgacgcccatcaggccggcgtaaaagtgatcatgagcaatcatgatttccataaaacaccgacgcaggaagatatcatctatcgactgcgtcgaatgcaggatctgggtgccgatctgccgaagatcgcggtgatgccgcagacgcctcaggacgttctcactctgctttccgccacgctgaccatgaaagagaagtatgcgacgcgcccgctgataaccatgtcgatgggcaaatccggcggcattagccgggctgcccggagccagtctccgggcgcttgctcagttgattctctggctatcgttaatgatgacaatgcgcacgttataatttgccagagcggagatcctcggcataatcgcaatgccatagtcgatgctaaccagccccgccatcgcagtatcttcatcgacgtagcagcgatatccg

SEQ ID NO: 80978 - DNA, 684 bp, Glycine max
  Peptide Sequence Number=SeqID_197756
atgcacgagaatgccgggttcacccggttttgccctctgtccctcagcggtgacgatgaagatttcgcattcgggaatggccttgccgatggaggtcgggcggcggtcgatttcatcgggcggcaggaaggtggagcggaaggcctcggtgaggccatacatcaggtagattttcgtgtccggcagcttctcgcgcagtgcttttacggtttcctgcggcacgcgtccgccggaattggtgatgtagcgcagatgcgggagcggcgtctttgtgagcgacggggccgctttcgtcaggatcgcccagatcgtcggcacgccggccagacccgtgatggcgtggtcgcgcagatcgcggacgatctcatcgcccagccggaaggtggagataacagtggccgcgccctgttccaccgccgtcagcagttggttcaggccataatcgaagctgaagggcaggagggaaagaatgcggtccctgccggtgatgtccagataggtgcgcacgatgcgcgcgccggccagaagattgcggtgcgacagcatcacgcccttcggcgagccagtggagccggaggtataaagaattgcggccaggtcttcgccgatcgccgccgaaggccgggcgggtgcgccggtgcggttcccaatctcctccgccagcaggaccgtgacgtcgggaag

SEQ ID NO: 80979 - DNA, 339 bp, Glycine max
  Peptide Sequence Number=SeqID_197757
atgttggacttgaaatgtcatccaattccagaagctagtaatgaggatgatttagatgatgtacctgttgctggccatgaggaagatgttaatggtggagagaaaggtattaacgtggacgttggtgaagaaagagatgttggtggtggcgatgaggaaaaggttggtaatcctgacgatgaagatgacaatgatgaggatgagtggtttactgacttctcttgtatgaggaaggaagttgaagttgaatatgaaatagatggttatcattcaaaggagctcaaaaatcccattagtagtgatgatgaagatgaggatgttcacaaagtttatccttaa

SEQ ID NO: 80980 - DNA, 387 bp, Glycine max
  Peptide Sequence Number=SeqID_197758
atgaaggagaatgtgaatgggtggcaagacttgaatggaggccaccatctctccgatgctgccatcatcggccatgatggctctgtttgggctcaaagctcttcttttcctcagattaaatctcaagaaatcactgatatcatgaaagatttcgatgaaccgggttatcttgctcctacaggtttgcaccttgcaggaaccaaatacatggtcatccaaggagagtcaggagctgtcattcgtggaaagaagggatctggaggcatcaccataaagaaaactggtcaagctttagtttttggtatttatgaggaacctgtgactcctggacaatgcaacatggttgttgagaggttgggagattacctcattgaacaaggtctttag

SEQ ID NO: 80981 - DNA, 234 bp, Glycine max
  Peptide Sequence Number=SeqID_197759
atgaaaaaggaagaagagaatgaactccaaaatccacatcaaacaataaacaacaacagcaacatatcacagttgaaaaacaagaaagttcgtggagggcattgtggagcacagcagaggtggagtgtggtggtgccgcacgctgcagaggaggagattggtggcgctgtgtgccgtgcagaggtggaggttgagggagggaaagggaagggcggagagaaaatggattcttga

SEQ ID NO: 80982 - DNA, 1542 bp, Glycine max
  Peptide Sequence Number=SeqID_197760
atgcccactggcttctctctcatctttgcggcatcacttttccttttgcttctcgattgttgctctgggagttttgttggggtctgctatggaagaagtgctgatgacctccctacacctgacaaggtggcacagttggttcaacttcataaaatcaaatatgtcaggatttatgattctaatatacaggttctgaaggcctttgcaaacactggaattgagcttatgattggggttccaaattcggacttgctttcattctctcagttccaatctaatgcagactcttggctgaaaaacagcgtgcttccttactatccggctacaaagatcgcatacatcactgtcggcgccgaagtcactgagagtcctaacaatgcatcttcatttgtagtgcctgccatgaccaatgtgcttacagcactcaagaaacttgggctgcacaaaaagattaaagtttccagcacccattcccttggggttttgtcgcgatccttcccgccttctgctggggctttcaatagcagccatgcacatttcctgaagccaatgctagaatttcttgctgaaaatcagtcaccttttatgattgatatatatccttattatgcctaccgtgattcccggagtaaagtgtctttagactatgccctgtttgatgcatcctctgaagtaattgatccaaacacaggcttgctgtacacaaacatgtttgatgcccagattgatgctatttactttgcactgatggccttgaacttcagaacaattaaggtcatggtcactgagacaggttggccttccaaagggtctcctaaggagactgctgcaactcctgataatgcacaaacatataatactaatctgataaggcatgttatcaacaacactggtactcctgcaaagcctggagaggagctagatgtttatattttctcgttgttcaatgaaaataggaagcctggtttggaatctgagagaaactggggattattttatcccgaccagacaagtgtttatagcctagatttcactggacggggtgcagttgatatgaccactgaggcaaatataaccaagtcaaatggaaccacatggtgcattgcttcgagtaaggcctcacaaattgacttgcagaatgccatagattgggcctgtggtcctggcaacgtggactgtacagctatccagcctagccagccttgttttgagccagataacctagcttcacatgcatcttttgcgtttaatagctattaccagcaaaatggggcttctgatgttgcgtgcagttttggaggaacaggtgtaaaagttgataaggatccaagctatgacaagtgcatctacatgagagctggaagtaataaaactgtgacaagcaatacaacagcaatgtccacttcatcctcttcactgaatggaaattcttcgtcaatttttacttttcttcttcatgattttgctttgttgacaagtatgctgcgtttgaaatgcatggggaaggatggctcaccctattctaccttaacctacgtgtag

SEQ ID NO: 80983 - DNA, 507 bp, Glycine max
  Peptide Sequence Number=SeqID_197761
cataaaattcaaggactatatctgggtcaaacttagccatgggagtgaccagcgacgtccaacgccggcgagctatctcttcctgaaagtcggtgtactcatcgtccctgagctggacgcgtctctctcagtggaacgaccatcctttgatggcctcgaaacgctgctgatgttcggtgctcctgaaatggtggctatcaaactcgggagcagcgctggtcccttcagccgcggcgtccctcctagatctcttcatagaaagttttttcggagccatttcctgcgagggcaaacatttggaaagcatgaatatcaagaaaatgggggcaatgtggcatgccccattacttcagaatgcaccctaggcctaaggtcatcccttacaacccctcaattcaacaaaaacaagcaacaattcaaggataaatccctcacgtttttgagcaaatacatgcaacttagagcaccaaaatacatcaatggaaagctagagagcccaagaatgag

SEQ ID NO: 80984 - DNA, 411 bp, Glycine max
  Peptide Sequence Number=SeqID_197762
atgggatttggagaacccttagtgaatagttcgaaggagatgaaaagattaatgagaagaagatttgttccttctcattatcatcgagacgttcacaacaaggttcaaaggctcacacaaggaaacaaaagtgtagatgaatattataaagagatggaggtttccttgattagaaccaatcttaatgaagatcgagaagctactatgacacaattcttacataggttgaatagtgatataagagatgttgtgaagttgcagcattatgtggagattagtagtgagtctttttcagattctactccacctagtgatgaagagaagtatgcagaggaaaaaggagtagaaggagcttcgttcattgtgcaaaggttgttaggtagccaagcaaaggacttggatgaaagctaa

SEQ ID NO: 80985 - DNA, 279 bp, Glycine max
  Peptide Sequence Number=SeqID_197763
atggtgttagtgaaagagtttttttttagcttaacctatcatcctcagagcttgttgccaaatggggtagtgtcagacttagggaaaaatattctccaaattgttgatgctctcttagcatgggctatatactgtgatcttcaggcgaggccgtccaacagatgtgccataagtttggaaataccggagaccatagagttcgatatccttaaggatgttcatgaaggcgtgttggtgtctattaatgacattcttaagaagactcctttggaaagttga

SEQ ID NO: 80986 - DNA, 522 bp, Glycine max
  Peptide Sequence Number=SeqID_197764
atgaaggtgatgttcaagccatttccttcttcatacaagaatttcaaagttagattctttaaagtgattattcttcccaatttgggcgataaccacttctttgatgttaacaagaagcctttgttcccattttactggcaacgagtgttgaggaggtatgatgattatcctgaggactacctgaccgatcaagaacaccacaacttgacccttatgaataagttgtcgaggagattgtcgaccaaaccccttgtgtctattttcaaggaattgaaatgtgccttttccttctctttatcattgtttgtttacctttcaaatgtcattaacttagcttgttttatagccatacttaaatttgttggcatggatgctctcaactttgccaacatgtgtagagaagttggtgttactgtttggaatgcctctatgacatggccttttgatccacttccccctcctcggccttcccctagggatgttgtccctctagcagacaaaaaagaagaagaaaaagagtag

SEQ ID NO: 80987 - DNA, 204 bp, Glycine max
  Peptide Sequence Number=SeqID_197765
atgggtggaatttgtaaatttgaggaatcaatggatggctacaacaagttggagacatacaaaggtatgcttcttgacccaacaaggaatctgagaaaccgtgtaggagttggtggtttaactactgaagatagaatgttaatgtatctcattacctacattatggcaccaaggtcaagcaatcatgctcaagttactaaatga

SEQ ID NO: 80988 - DNA, 339 bp, Glycine max
  Peptide Sequence Number=SeqID_197766
atgccgccgatgtattcatacccatatgatttacaaccagggtacagtatggcaggcatatttgggtcctctcctccttcaaggggaactccttcatttacccaaagtgatgaactatcgaccccaaatgccccacttggtggtccgtggaatgtacctggaaatatacccgacatggatgacttattaggggtcgatttacgtcatgatttctctgctgaggctgaccaagtggatgaaagggcgaatcgtagaagaagaaatcctgatagggcagctaggaattgggaccggccatgtgggacttcgtcgcgacatcacagacatagtgatgattga

SEQ ID NO: 80989 - DNA, 162 bp, Glycine max
  Peptide Sequence Number=SeqID_197767
ggtgaaatcgtcgaaacaatgcattttatggtgtcgcctctctggagaagggtttgtacttttgacaatttactgccatgtattgaaaagatcactcttttgtctgacgaagaggataggatacttgaggcacatgaagatgctccccgttctcagccataa

SEQ ID NO: 80990 - DNA, 846 bp, Glycine max
  Peptide Sequence Number=SeqID_197768
atggaggccatgaaagagaaaatggccacaatgatggaggccatgatgagcatgaagaagataatggaggtcaatgcggctacagttgccactaccagcactattgttgaggtggacccgattcccccatctagcctcaatcaaatacgtcatcccatctcgaatatggtaggtcaaggaggcaaaaagttgggaagtatgagtggcccccattttgtgcaaattcagaacaagcatgccttccccccatatggcttacctcccaattacacactgcccaatgttgcacacactcacgaggagaatggcgatgaatttgttcccatacccattgggagccaaaaacctcaatttgatcatgcacatgtctctcaacccatgggggagacacatgaagtaccccaccacaatctagccgacttcgagcctcgcctcggatatgccactaaggggcaagcagttggtggggtacccctgccaaacactttggagggccctcgattccctccacaacctcaacccttgcatttcgtggtggggagagtccctcctactgtggtggaaagaggaaaacttgatcatatagaggaaaggctaaaggctattgaaggaggcagagattatgtctttgctaacatggaagatttatgcctagtacccgacatgatcattcctccgaagttcaaggtgttggacttcgataaatacaaggggactacttgccccaagaatcacctgaaggggtactgtaggaaaatgggagcatatgcaaaaaatgaaaaattattgatgcatttcttccaggaaagtcttattggggcagccatcaccttgtggcctcaataa

SEQ ID NO: 80991 - DNA, 474 bp, Glycine max
  Peptide Sequence Number=SeqID_197769
atggagaggcaaaggaataaggactaccccgtagatacttgggagaagaggcaaccaagatgtggagaagatttgcaccttcatagtaccatagggagttgcacaacaaactacaaaggcttacccaaggaagtaagagtatggatgagtacttcaaagagatggaggtgggtagggttctttgatgcctatgaacctatctatccaaggctagtcagagccttttttgctgctattatggtggacagtagcaaattcaccttgaaggctactttgaagaacattgagattcttatcttagaagagttgttggccaccattctaagtgtgactgttgacaacaagaggctttatgatgagtggtttgacatcatggacctcaagaagagcaagctcaaaagtaagttcttggaagaaaaggatgatgagttcaaatccaaatccctaacatcattttggaggattctacactag

SEQ ID NO: 80992 - DNA, 300 bp, Glycine max
  Peptide Sequence Number=SeqID_197770
atgtctaagggtactaatgctactggaaccaaaaagatttgggtaccaaaatctcatattgttcctattatagatatccttgtggttgctcctcgacacatgaaaggggaaaggtctatattccttaacctaaatacaattgaaggaggaattgatgcctttgatggcatagggaaaggaaagatcaccgatatggggcactccatagtgcttgaagaccagggtcatcaacatctcataaggcacagtggaagtagacttgatgagcttggtggccttcataatatgattgatgattag

SEQ ID NO: 80993 - DNA, 246 bp, Glycine max
  Peptide Sequence Number=SeqID_197771
atggagcatccaatgggggcaaaagcagtaaaaaggaaggcaaaagaaaaagaaaaatcttctaatgttgttgatctcacagaaaactattacttagcggtgttgctaacgatgcactctagcaagtcatctctcgaagatgaagtcattgatgatttgctaaatgatgagtacaaagaacattacatgatgttggtgatggaaagattgtcagagatcgtgaagaagggcatccacgaaaagtag

SEQ ID NO: 80994 - DNA, 441 bp, Glycine max
  Peptide Sequence Number=SeqID_197772
atggctcaccaacaatcattcttgaagtcatggagtcacaagacttatggagttggcaagcatatttttgagttacaggcgacacttatgaagactatcccaaggccacaaggtcataaaacaaaattgtttgctcaacatcaagaagcaataagaaaggatgtggatcacacatttggagtgcttcaatcttggttcatgattgtacatggccttgcatatggttggagcatactgttaatcgcgtctgctaagtgcaacactcatgggctaagcacgaggaagactctggaagaagatgagctgtacaaggggagtttggattgggattcagagctttgcatgtctagagtttctagagagagaaagagaccagggcttgaagtaggagccgatttgagagcttgggatgagtttgtgagtgattgtgagatcctagag

SEQ ID NO: 80995 - DNA, 429 bp, Glycine max
  Peptide Sequence Number=SeqID_197773
atgacttcatcatcagtcactgcaattgtatactacaatggcaccatcacaaaaactcaacatgggccaacattggctagtagtgaaccaatgatagttcaacttaacaacatgtcacttgatgccttgaagcaagttattgaaaacaagattagtctaccatatggtaaagtgaatcctttgctttgtgtcagtgcatcaaggaatccaatgtttttcgtcagtatgttaaggaatcaaatactttacgtcagtgcatcagggaatccaatgcttggtgtcatggtgttagggaattcgatgctttatgtcaatgtgtcaggaaatcctttgctttgcgtcagggtgttagggaatccgatgctttatgtcaatgtgtttggaaatcctttgttttacgtcaatgtgttaggaaatttgatgctttga

SEQ ID NO: 80996 - DNA, 309 bp, Glycine max
  Peptide Sequence Number=SeqID_197774
atggcatccaggaagaagaaaagcactgcttctagacctcaagctcagtatgataccaggcgattccattctttggacgcttggaatagatacaccgataacattctcggccggaatatccttctggagagaaatgtgcagatttatcatactgagtttgacgagtttaaagtggaattggagaggcataatctacacaaacgcctcgccaatctccaagatggaagcatagatgtagctgtggtaaaggagttttatgctaatttatacaccacagaggagcaatcacccaagcaagctagagtatga

SEQ ID NO: 80997 - DNA, 381 bp, Glycine max
  Peptide Sequence Number=SeqID_197775
atgtcagtagaagcacccgtgaactctctctctgtcattgattctctgattcagcttcactttccagtcccacctataaacaatgcaacacaatgccataccaagggaattcggcctaagccagggaatggtttatccaccaacatgaccagagtcgaattttcagaacaacagttcatgaaatgggtgaaatttgtaggtggcctcaaacattctgtctttaggacagcaaagaataagctttttccttctcacactttgcacgtttctaagaagcatggtaagggaggtttttcgtcaattcaagcagccattgattcccttccattcatcaatgtagtgagagtggtaattaaggtgcatgcaggggtttacacgtaa

SEQ ID NO: 80998 - DNA, 1311 bp, Glycine max
  Peptide Sequence Number=SeqID_197776
atgggtagagccatcaggtggttgaaggggttgtttgggataaggacagacagagagcgcaaagaaaattcaaatcactcagacagagattcccgaggtctatgtcataatccaaccaccattccacccaatatttcacctgcagaggccgcttggcttcaatccttctactcagaaactgagaaggagcagaataagcatgctattgcagttgctgcagccactgcagcagccgcagatgccgcagtggctgcagcacaggccgccgtggcagtggttagactaaccagccacggcaacagcagagacaccacgtttggtggtgctggacaagaaaggttggctgttgtcaagattcaaaccgtgtttagaggatatttggcaaggaaggcattgagagccttaaaaggattggtcaagttacaagcacttgtgagagggtacttagtgcggaagcaggcagcagcaaccctgcatagtatgcaggctctaattagagctcaagcaacagtaaggtctaagaaatctcgcaatgaagctcataggtttcaaacacaagcgcgaagatccatggagagatttgatgacataaagagtgtgtacatagctcccatccaaagcagaaggctatcatcttcttttgatgccacaatgaacaatgcaaacagtgttgatgggagccccaaaatagtggaagtggacactggcaggccaaagtcaaggtctcgcaggagcaacacctcaatgtcagattttggtgatgacccatcatcattccaggcacttccttctcctctcccatttgctcatttgtccataccaaacctcaggaattaccacaactcagagtggggcttaacaggagaagagtgcagattctccacagcacaaagcactccacgcttcaccaccaactcttgtagttgtggaggatctgttgttgttgctgcacctacgaatatgagtatgagtatgacacctaaaagtgtttgcaccgagaacaacttcttctatgggcagtatcatgacaattttccaaactacatggccagcactcagtctttcaaggccaaactgaggtctcatagtgctccaaagcaacgccccgatccagctgggccaaagaagaggcttaccctcaacgagatgatggagtctaggtgtagtttaagtgggactagaatgcaaaggtcttgctctcagattcaagaagctatcagttttaagaatgctgtcatgagtaagcttcagaagtctgcagaaattggaagggacacagaattgaacttttccaaccaaaggaggtggtga

SEQ ID NO: 80999 - DNA, 120 bp, Glycine max
  Peptide Sequence Number=SeqID_197777
atgactcttgatcagagttggtttaaagggaacatgctgcatctttcttggggaacgagcaagttacgctgtggcaaggaacagccgcatatcatggaaacacttgacattatcaattga

SEQ ID NO: 81000 - DNA, 1417 bp, Glycine max
  Peptide Sequence Number=SeqID_197778
atggagggagcagtagaaaaagaggggcagcactgttggagcataaggagagaagtgaaagcggtgggggagctggcgtttccgatagccttaacggcgctgatattctacgcgcgttccatggtatcgatgctgttcctgggacacctaggagagctagaactggcagcagggtccctaggaatggcgttcgcgaacatcacaggctattcggtgctgtcgggtctagcactcgggatggaaccgctatgctcccaagcattcggcgcaaaacgcgtgaatgtgttgtcgttgaccctccaccgctgcgtcatgttcctgttactctgctccatcccaatatcactcctctggctcaacatgtccaacatcctcgttgatctcttgcaccaggaccccaacatcaccctaatggcccacacctacctcctcttctccctccccgacctcctcacccactccttcctccacccaatccgcatttaccttcgcgcccagggcgtcacccaccctgtcaccttagcttccctcgccggaaccctcctccacctccccttcaactacctcctcgtcacgcgcctccgcctcggcctcgccggtgtcgccgctgcctccgccgcttccaacctctccatcctcctcttcctcggtgccgccgtcttcttttccggcttgcactgctccgcgccgagccgagaatgtctcagcggctggaagccgctccttcggctcgctgcgcctagctgcgtctccgtttgcttggagtggtggtggtatgagatcatgatcattctttgcgggcttctcgtggaccccaccgctaccgttgcttccatggggatactcattcaaatcacttcactcatctatgtttttccctcctcgcttggtttcgcggtttcgactcgcgtcgggaacgcgctgggagccaatcgtccctctcgggccaaactatccgcggtggtttctgtttttctcgcagcgattatgggattctcggcgatgtttttcgccgtcgggatgcggcggcggtgggggacgatgttcaccgccgacgaggacatattaaggatcacgtcgatggcgctgccgatcctcggaatttgcgaactcgggaactgtccgcagacggtggggtgcggcgtcgttagagggacggcgcggccgaacacggcggcgaatgtgaacctgggcgcgttctatttggtcgggatgcccgtggcagttggacttgggttctggtttgacgttggattctgtgggctatggctgggcctgctctcggcccaggtgtgttgcgcgggtcttatgttgtatgtgattgggaccaccgattgggagtttgaagcccatcgggcccagttgctgacgttggtcgaagatggagtgatggacggacagaaacagccgttgacgg

SEQ ID NO: 81001 - DNA, 126 bp, Glycine max
  Peptide Sequence Number=SeqID_197779
atgtcccaaaaggcacgagtgcaggagatctacaagggaatgtctaagcagcagggtttacagagccagctccttgctacacactcacagctcatctacggactcaagaaaaagaatatctcataa

SEQ ID NO: 81002 - DNA, 1686 bp, Glycine max
  Peptide Sequence Number=SeqID_197780
atggggaaattagcaaatccccacgggttgatgctacaaattgctaggagatattgtagtgcaagaagtactgaaaagcaacttccttggttagaagtcgctaatgaggttaaggaagaaggtaaggtgatgcagaaagcaaaaacgactaggataagtggttcttttcccgagggctctgcaaagaagatgagtagtaagtcctcttgggaacaatccattgaaaggttagataaaagtcataaaacagaagttcctgaatctaagctgagatcagcagcagcaaaattttctatgaaaggtggtgtttcagctactgctagtaaggaaaggaagggtggattggttgagaaggtgggacagctcagaagtgattatggtaaaaggtatgtgaagtttgatgataatgatgaagaaggagttgatgatgaaatggaggaggagatggatgatccaaggtggtataacataaagaataagttcaaggggatggtgggggcaaaagttggaatggagagacctgaggttcgaagatggaataagcaggataactggggtagaaagacattgaaagaggccagtgaatccactgtgcctaagattgttggtgagggaatctatggggttggtccagttttggctgcattgtcagctgatcgaagggaattctatgcattgtatgttcaagaaggattggatttgagtggcaacaataggaagaagaaggacaagaaagggtttgagagagttctgaagattgctgaaaagcttggtttgagtgtaaaagaagcatcaaaacatgatctgaatatggtggctgataaccgtccccatcagggtttggttttagacgcttcacagctagagatggtgaaagtaaatgaactggatcctgtttctattgatgaagggaagggttccctttgggtagccttggatgaggttactgatcctcagaatttgggggcaataattaggtctgcatatttttttggagcttctggggtggtgttatgtgccaagaattcagccccattgagtggtgttgtgagcaaagcaagtgcgggatcacttgaattaatggaacttagatattgcaagaatatgatgcaattcttagtgtcttcagctgaaaatggttggcgagttcttgggggctctgtctcctccaaagctattgctttggatgaggttgtgcctggtccaccgaccattcttgttttaggtagcgagggcactggtttaagaccattggtggagagatcatgtactcagttagttaggattcctgggaacattcattttgactcaagtactagtgaattggatggtgaaagtagtggtttaaattcccagagctctggtaaagagttcctctcatttttggccgtggaaagcttaaatgttagtgttgcagcaggtgtgcttattcaccacttaattgggaaaaagttggtagattcatttccagaggagcataaacagattgacatgtctgaaagactcggccctaacagccacctagagttcctcactgtttcttgtggttacttagctcaatcacctggtatcagagtcatgtggcttcaagatcttgtttggcgtctgttgggacttaggactgtgggaaaggggttcctaacagtctcattggtgaatggtgaggtatctgaatatggtggttga

SEQ ID NO: 81003 - DNA, 1476 bp, Glycine max
  Peptide Sequence Number=SeqID_197781
atgaaggattgtatgaagaatggcaatagcttttctttcctttgtcatgacattaacgaacttgagcactcctatcaggtcgatcttccaagagtaacagtgattatgcccctaaaagggtttggagaacataatctccataactggaggagtcagataacatctctatatggtggccctatagaatttctttttgtggtagaaagtacagaggatcccgcttaccatgctgtatcacgattaatagcagaatttgaggatcatgttgaagctaaggttgttgtagctggtttgtcaacaacttgtagtcaaaaaattcacaatcaattgattgtctttgctagaggcattttaccaattacactagtattaacaccttggcaggttggagtggagacaatgcataaagatagcaaatatgtattgtttttggatgatgatgttaggctacatcctggatcaatcggagcactcactcgtgagatggaaaagacccctgagatatttattcaaactggataccctctcgatctgccatctggaagcctgggaagttactgcatctatgaataccatatgccttgttcaatgggctttgctactggtggaaaaacattctttctatggggagggtgcatgatggcaatttttcttcagatgcatgctgatgactttaggcaagatcgatatggtgtagtctccggacttaaagatggtggatattcggatgatatgactcttgcagccatatccggtgctcacaaaaggctcattacctctcctcccgttgccgtctttccccacccccttgcaagtgatcttaattttggaagatattggaattacttgaggaaacaaacattcgttttggagtcatatttaacaaatgttaactgggtgatgaaccgtgcattgtttactacccactgctatttgtcatggggatttgttgcaccatattttatggcgatgatccatgttgctgcagcattaagattttactataaagggttctcacctgaagaaatagcctatacttctggtgggttatcattggtgaccttcctagccatatgcactcttgttgagcttctttcaatgtggaacttgacacggatagaagtccaactgtgcaacatgttgtctccagaggcaccacaactctctctcgcttcttataattggtgtcttgtgttcatcgcaatgctggtggataactttctttatcccgtatcggcattccgctctcatttttctcaatctatcaactggtctggtattcggtactatttgaaagatggaaaaattagtaagattgaaagaactccaagaagcaaggatatgggtccagtattcacagatttgggaggaaaacatttatacggaaagaaagggttaccgactagaggctcatttctcagttctttgtccagaagtttggcacagtggcatcaacccaagaaatttgataactag

SEQ ID NO: 81004 - DNA, 372 bp, Glycine max
  Peptide Sequence Number=SeqID_197782
atggataacgacaacgtcaaccttacaatttcagagagcaacaatattgcgcagtcaacaatgtccaacaatttcatagatttggatgttttcgatctagacgaggctcttgcggtggcggtggtggacggagaaccacggcgtctattcgcaacgtggaagaccttcgtgtcgaacttgcctacggttaacgacgtgacgagggatgatgtttgctctgtttgcatggaagggtttattacccagcgcaacacggatggggaaaacaaacgagtcccgtgcggccacgtgtaccactcaaactgcatcaccctctggttggagcactgcaactcttgcccgctttgccgctgccatatcccccttttctag

SEQ ID NO: 81005 - DNA, 315 bp, Glycine max
  Peptide Sequence Number=SeqID_197783
atgggtcatcgtaagattgaaattgcgatagtgaaggatcctaacatgaggcaagtcacgttttctaagcgtcgaacgggaccattcaaaaaggctaatgaactatccatcttgtgtgacgtagaaattgctattgttgtgttctccattggaaataagccttactcttttgggcacccatgtgttgatgttgttgcgaccaagtttcttcaacttcaacaagcggctaattcaagcaatgccaaacaaattgatgcccaaggccgaaacaacccatctaatgaacttggtggcatggataggctgaatcaataa

SEQ ID NO: 81006 - DNA, 795 bp, Glycine max
  Peptide Sequence Number=SeqID_197784
atggtcatttatgcaactgtcaacaaatgcttgtatcgtttatttgtatttgtagtctatgtgcaacagaatttcaaggtggctaagttttgtgcgaagcggatgcacgatgttatagcagaggaatgggaccgagaaataggaggtgccgctgaatggcagagaagatgggaagctgtatttgctaacagttttgagaggactgataatgaaatcctctcagacgcagttgcaccagaaatggtaggatctactgcctctgtggtggttctatctggttgccaaattattacatccaactgcggcgactcaagggtagttctttgccgcaggacacaaactatccccttgacagtggatcagaagccggatagacaagatgaactcttgagaattgaaggaggaggaggaaaagtcataaactggaatggagctagggtatttggtgttcttgccatgtccagggccataggtgatcggtacttgagaccgtggattattccggtgccagagataactttcacagcaagaaccgatgaggatgagtgcttagttttggcaagtgatggactctgggatgtaatgaccaatgaagaggttggagaagtagcacgccgcattcttagaaggcgtcgcagatccttgtcaatggaggaaacatctcctgcacaagttgttgccgaaagcttgactgaaattgcatatggtcgaaatagtaaagataacatttcaatcatagttgttgatctgaaatcaaagagaaaacgtcagcaaaggcctcctttaatttcctaa

SEQ ID NO: 81007 - DNA, 1068 bp, Glycine max
  Peptide Sequence Number=SeqID_197785
atggctgctttaagtgttggagaatactcaggactcaaacaagaagttctcatgcaaataccagcttgtaaagttcatctgatggatgaaggagaagctcttgaactgtctcaagggcacttcatgatcatcaaaacctttgaagagaatgtgtctctggctacaatcataaaagtaggagatgatcttcagtggcctttgacaaaagatatgccagtagtgaagttagattctctccattacctgttttccttgcttgtgaaaaatggtgagcctctcagctatggtgtgaccttttcagaggctagtttgggaagcttgagtttgctggactcgttcctgaaggaccactcttgcttttctggcttgaatttgagcaagaagaacaatctagattggagggagtttgctccaaaggttgatgattacaatcattttctggccaaggcaatcgcaggagggactggtcagattgtgaagggcatcttcatatgcagcaatgcttacagcaataaggtccagaaaggaggggaaacgatcctaaatagttctacacgtgagaaaaatggtgttgtagccagggaaagtatgagctacaagactgccagtgcctcaaagaagaacaagattaataaaaacctcaaacgtgtgaggaagctgtccaagatgacagaaaagttaagcaaatctgtgcttaatggtgttggtatagttagtggatcagtgatggctcctgtggttaaatcccaatcaggaaaggcattcctaaggatgcttcctggggaggttctgttggcttccctagatgcagtcaacaaggttttagatgcagctgaagctgctgagaaacaaactctttctgccacctccaaagctgcatccagagtggtctctaacaggtttggggagagcgcaggggaagctactgagcatgtatttgcaactgcgggacatgctgctaacactgcttggaatgtctttaagatacgaaaggcattcactccagcttcttcagcaaccaatggagtactcaaacatgctgccaagatttcaagttttaaacattaa

SEQ ID NO: 81008 - DNA, 363 bp, Glycine max
  Peptide Sequence Number=SeqID_197786
atggttggtgctaaggttccggcaatgatcgcgttcggggactcgtcggttgatgctgggaacaacaattacatagcaacggttgctcggagcaatttccagccatatgggcgtgactttgtgggtgggaagccaactgggagattcagcaatggccgaatagcaacagatttcttatcccaagcctttggaatcaaaccatacgtgcccccgtacttggatcctaatcacaatatttcacacttcgccactggggtctcctttgcttctgctgctactggctatgacaatgctacttcagatgtgcttttggtagttgatttgtctaatccaagaaagattagtctagtggctaagaaataa

SEQ ID NO: 81009 - DNA, 183 bp, Glycine max
  Peptide Sequence Number=SeqID_197787
atggaggtttttgagggtggagcattcgatttaggagacatgggacctgatgcggaagatggcaacgaaagaaagagaaaaggtcgtcggaaatatctttttatgttggcaggagggatccaagagaaggggaagggaagaaagagaatagggaaacaaagaatgaaacgtcctcgccgttaa

SEQ ID NO: 81010 - DNA, 618 bp, Glycine max
  Peptide Sequence Number=SeqID_197788
atgtccggtttgcatagcatgaatatccaaagcaagtctgtgataccattatggaagcagttggagtactataaagggtaccaaaagaaactgagtgtgtatcttggagaaagtagggcaaacgagaccgttgccaaagcattgcacataataagtttgggaacaaatgacttcctagagaattattttgcaatccctggcagggcatctcaatatacaccaagagagtatcaaaattttttggctgggatagctgagaatttcatctacaaactttatggtcttggtgctaggaaaatatccttagggggtttacctcccatggggtgcttgccactggagagaaccacaaattttgttggtggtaatgaatgtgtgtccaattacaataacattgcattggagttcaatgataatctcaggtttcaggttacctcaatggcatgttgtgctactggaatgtttgagatgggatacgcatgcagcagggcaagttctttcagttgcatagatgcttccagatatgtattttgggactcattccatccaacggagaaaactaatggtataattgcaaagtacctggtgaagaacgctttagctcaatttttgcattaa

SEQ ID NO: 81011 - DNA, 243 bp, Glycine max
  Peptide Sequence Number=SeqID_197789
atggttgaggttgtagctgtgcctatgcttgtgcctttggttatgactctacctatgattgatgtcgtcaagtcaactctccatcaccacgtgttgatgcagtcacacattgcctttgtgcctccggatctaagacaaagacagcgagaaggagaaagagttggagagaaaaagaatgagaaggagagtgggagagggaaggggaaaggttgggtggttttggcagggggaagagagagttga

SEQ ID NO: 81012 - DNA, 909 bp, Glycine max
  Peptide Sequence Number=SeqID_197790
atgatgcccatcacatgtgaaagctcaattgtttcccctcttctcctgtcacgagtatgtcaggctaagacggacccaacaagagcccttctgttagggaataaattctcaacaatggcagtaactgccttgccgaagacaagttgtatccaatgcacgattgtccgatccaaatttagccacaaaagtggtggtcccatggagaaaaaagggaagaagacaacaggaaagaaagagcaccacttgtggaaaagtagagattctgctcagtctggccaaaaggcacttgctcttgttagaactgtttataaactccctaatgagaaagaggctgtttatggggcgttagacaaatggacagcttgggaaacagagttccctgtgattgcagtgtctaaggctttaaaaatcttaaggaaaaggggtcactgggttcgtgtaattcaagtagctaagtggatgttaagcaaaggtcaaggagcaacgatgggaacatatgacacccttcttctggcatttgatatggacaagagggtagacgaggcagaatcgttgtggaatatgatcatacatgcccacatgcgctctgtctcaaaaagattgttttctaggatgatctcgttatatgatcatcataatatgccggataagattattgatgtatttgcagacatggaggagttgcggctaaaacctgatgaagatacggtcaggagagtggcaagagcttttagagaactaggtgacgaagagaagcggaaactggttataaaacaatatgggcttaaatggaagtacattcacttcaatggtgaacggcgatttatcttgttgcgttctccttctggtgcattagtggctcaccaatttgattcattgtcgtgcatcccggtccaacatagctactga

SEQ ID NO: 81013 - DNA, 329 bp, Glycine max
  Peptide Sequence Number=SeqID_197791
atggctgaggagttcgtcgaatccgaggttgtctttcccgaccaccgcgccgcccacgactgggtagtggagctggcgcccccgccgcggagggagagggagaattgtcgacggagggcggcgaattcgatgccggtgagtataccggagaggacgggccggcggcactggggctccgccgaggaggaggcggaagaggaggagatgacgccgccgcacgagatcgtgaagaggagggtggctgcaaaaatggcgttttcggtgtgcacggggaatgggaggacattgaagggacgtgatttgagtcaggtcaggaattcgattctcag

SEQ ID NO: 81014 - DNA, 987 bp, Glycine max
  Peptide Sequence Number=SeqID_197792
ggtcgatcaattactccactccatatgggaaacaacttctacccgttggttctagcaagagatgttgaacatccaggcttacctagtaacaattctgggttttgcccggactacccttcaacccaacaaggtatgggggaagatagttctctgcatgagagggcaaggagaaagattgaaaaaaggcttagaagttcaaagggctggtgggccaccggtgtgtcctatgagaatgccttaaaacttattcaatatgttcattctactctaaacccaatggctcaaattctaccaggaacaacagtgttagaagccaaaccagcaccctcgatggcctccttctctagcaggggtccaaatatagttgaccccaatattctgaagcctgacattacatccccaggagtagacatattggcaacatggacagctgaagaaggccccacaggaatgacatttaacgacacgagtgctgttcttctcaaagccattcaccctacttggagcactgcagctataaggtctgctctcatgactacagacaacactgacaatccattaactgatgaaactggaaatcctgcaacgcctttcgcaatggggtctggccacttaaaccccaaaagagcagcagatgctggactggtttttgatgcctcctacatggactaccttctttacacttccaaccttggagtaactcaaaactttaacattacatataactgtccaaagaatgtttacaagtttagtgcagtgtcacctaaggaatactccatcacagccattccaaacattctgaaatttaatcatgttgagcagaaaatgaacctcaccatcacagtgacagcaaattggagccagatactaaccaagcatggcccagataagtactattttggatggtatgcatggactcaccaacatcacgttgagactgataggatacagattattagagtggttgtggtaggaccatatgcttaa

SEQ ID NO: 81015 - DNA, 844 bp, Glycine max
  Peptide Sequence Number=SeqID_197793
ggaaggaggtggtgagaagaacgggggaagagggaaggagaagggagtcataacaatggttgtggaagatgcccaaaaatcagccatcacggaggaccaaaaccctagcagggtcgccaacgacaacaacgacgacgaagatctcgaagagggggagatccccgacgacggtgacgacggcgcctccgccacatcaaagcctccgtccgccctcgtccgcaacccccaccctctcgagaattcctggaccttctggttcgacaacccttccgccaagtccaaacaagctgcatggggcagctccatccgacccatctacactttcgccaccgtcgaagagttttggagcatttacaataacattcaccacccgagcaagttgggtgtgggggcggactttcattgcttcaagcacaagattgagcccaagtgggaggatcctatctgcgctaatgggggaaagtggactatgaccttccaaaggggaaaatctgataccagttggttatatacgttgttggcaatgattggagaacagtttgatcacggagatgaaatatgcggagctgttgtgaatgtcagaagtaggcaggaaaaaattgctatttggactaagaacgcttcaaatgaagctgctcaggtgggagggagtgagggagatttatctagcctcttcaataatgttgtgagaaatattgaggaatgtgtactaggcataccccatctagtgagcattggaaagcagtggaaggagtttcttgattacaatgacacaattggctttatatttcatgaggatgcaaagaagcttgacagaggtgctaaaaataaatacgttgtatga

SEQ ID NO: 81016 - DNA, 324 bp, Glycine max
  Peptide Sequence Number=SeqID_197794
atgaaaccaccatcttcaccacaagttgccaccactgctaatcacactctttcaccgcaatcacctggcaacaacaacacaatctctgcgaacaacaaaccctccactacaaaactacaacaaactagacaaataataaccattcttggtgaagagtgtgattccaatggcgacgaagtacatggggatggtggcgatgtcgaggaaggagagggattagagaaccgtgacgatgaaccagtccttggtcttcgagtgtctttctcttctccaattccaacgctcttctcttcagtgtttccgacgagcaaaatggcgggatag

SEQ ID NO: 81017 - DNA, 456 bp, Glycine max
  Peptide Sequence Number=SeqID_197795
gtggttgctaactgtaaagctcttgctcagcagttaattgagcacggatataaactagtttctggtggtagtgacaatcacctggttcttgttgatctaaggccatctggtcttgatggtgctcgggtggagaaaattcttgacatggcctccataaccctcaacaaaaattcagtgcctgatgataagagtgccctagttccgggaggcattcgaattgggacaccggcaatgacaacaagaggacttggtgagaaagagttttcactaattgcagatttccttcatgagggtgtgcaaatatgtcttgaagccaaaagtttggtctcaggaacgaagctccaagattttttgaagtttgtatcatcttctgaatttcctttgggagagaagatatcagagttgcgtaggaaagttgaagctcttactactcaatatccaatacccggagtctaa

SEQ ID NO: 81018 - DNA, 774 bp, Glycine max
  Peptide Sequence Number=SeqID_197796
atggcgtgcttgcacgaccacagttgcgaagaccatgactgttcctctaactggcctctctacaagcacatcgacctctccaagacaaagatgcaggcttgtacaatgatgagttctttgcaacaacaacctatttggaccaaagggttgaatttccctgcaaaagggtatggcagcaataacggctttgtaactcagttgaggttctgcaatattaagccatccaaagcttctcatgttgaagcaagtttggtcgctgggaagccatcatctgtgtctttctctgtgcctgaaattggaggtgatggaagtagcttcctggactatggcttgagtgaagctgatcctgaggttcgtgcaattattgacaaggaaaaggatcggcaatttaaaagtcttgagcttattgcttctgagaattttacatccagagcagtgatggaagcagttggttcgtgtctcacaaacaagtactcagaaggattgccgggtagaaggtactatggtggcaatgagtacattgatgagcttgaaaccctatgtcaacaaagggctttggctgcatttcatgtagatggaaacaagtggggtgttaatgttcaaactttatctggttccccagctaattttgcagtattcactgctgttcttaaaccacatgaccgaataatgggtttggacttgcctcacggaggacatttgtctcatggattcatgacacctaaaaaacgtgtatcggccacatcaatttattttgaacctatgccttattga

SEQ ID NO: 81019 - DNA, 462 bp, Glycine max
  Peptide Sequence Number=SeqID_197797
atggttcgtcgtaagattgagattacggagttgaaggactccaacaccaagcaagttacattttccaagcgtcgaacagctgaagttgctgttgttgtgttctctcctgggaataacccttattcttttgggcatccaagcgttgatgttgttgcagacaagtttcttaaacaagagccgaaatcaaatgatgtccagggaacatctactgaggttgctgatatggataggctcaatcaacaactatccgatgttcaaaatgaaatacttgaggaacaaaagaaggctgcagaactcaatgagagaatgaaacaaaaaggagtcacacaactttttcaacctaaagaattgcaaggttcaaatttagagatccaaaagatgaaggactgttatgatgcaatcgaggtgtcagaatatatgttgctccttgcaaaagaaccagtagttggaatacccaaacag

SEQ ID NO: 81020 - DNA, 216 bp, Glycine max
  Peptide Sequence Number=SeqID_197798
atggaggagtttgaggcacaggtggcctggccaggagaccagccttcttcttacggagggtctcaggaggaggagactactccagagcaaattctagagccatctccagcccctgtgcatgcacctgatgatgccacaccagtggtggagcctgagcagactattcaggaatctttagcagctccagcactggatcttaatgaagaacagccatag

SEQ ID NO: 81021 - DNA, 631 bp, Glycine max
  misc_feature (178)..(178): n is a, c, g, or t
  Peptide Sequence Number=SeqID_197799
ggagctttccagggggaaacgcctggtatcttgatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctntcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatggaagcttcgatgtcgctcctccaccgctccaactccggcaagagcagaaggcttctctccccggaaacgtccttgtgccgaaccctacagcgccatatcctgttcaccgtgtcgagataggcaggattgccgtcgcggtggagcataacagttgcgacttgtggggacaggaatggagagtggtgacacgctcatgctccaccgcgacggcacaattgacggcggagaccggagcgccgtcacggtggtggagctcctcaaggatcgagggtttggagaatggattcggggaaggagacg

SEQ ID NO: 81022 - DNA, 177 bp, Glycine max
  Peptide Sequence Number=SeqID_197800
atggcgacagcgacgaagtctatttcattgaagcccttaggaagagacgggaccgtgaggcgccatttggcggaggagattccgattgtggtgcctaggtacgccatcaagcctctagcgacaatggcattggaaaaaggcggagtggagggcgcaaaagccggcaatggcaattaa

SEQ ID NO: 81023 - DNA, 495 bp, Glycine max
  Peptide Sequence Number=SeqID_197801
ctgtagctatgagtgcgacagaaggtctaatgagaggaatggaagtgattgacacaggagctgccctaagtgttccagtaggtggagcaactctaggacgaattttcaacgtgcttggagagcccattgataatttaggaataaaagtagtagatcttttagctccttatcgtcgtggaggaaaaataggacttttcggtggagctggagtgggtgaacgtactcgtgagggaaatgatctttatatggaaatgaaagaatctggagtaattaatgaacaaaatattgcagaatcaaaagtagctctagtatatggtcaaatgaatgaaccgcccggagctcgtatgagagttggtttccccgccctgactatggcggaatattttcgagatgtcaatgaacaagatgtacttctatttatcgacaatatctttcgcttcgtccaagcaggatctgaagtatctgccttattgggtcgaatgccttctgctgtgg

SEQ ID NO: 81024 - DNA, 132 bp, Glycine max
  Peptide Sequence Number=SeqID_197802
atgttcaaccctcctgaaaatccaagtcgaggcgcttccgtaacgcttccgagacgtttccgtgggcgatttcgcgaagattttccaccgttcttcatcgttcttcgtcgttcttcggtcttcaaccggtaa

SEQ ID NO: 81025 - DNA, 928 bp, Glycine max
  Peptide Sequence Number=SeqID_197803
atggcagcagcttgcgttgagcctgctcctacagccccgcaagccacgccaggccagactgggactcccaaatcaagaaggagctccaatgaattccaacagccttcagcgccgcacagccttggccctcgtgatgtccgcagcactgttgggtgcatgcgcccagacccagccggcgcccaatgcgcccgtcactgcagtcatgggaacggtcgacctgagggagcccgctccgcttgcgcccgatgccgtgctggtcgtcgaattgcaggacacctcgcgcgccgatgctcccgccccggtgatatcccagcagtccatgcggctcgaaggcctcaagccgccctacagcttcaagctgcccgtcgagcccagccgcctgaatcctgcctcgcagtacacggccgacatgatgctggtgcgcgtcgccccctgaccccagtccttcaacaaccaaagcccgcaggaaacctggcgggctttgtcacgcagggcgccagaccgccatcaaggcatgccgttggcgccatgcaggcgaaagcccggccgctcgcaaagccgttcgtagtaggcgcggactgcaggcaattccgggcgctccatgggcgccgacatccagcggtgcgtggacaggcccagcacgatatcggccaggctcaattgcgcgccagcagcaaaggcgccggtgcgcgacaactggtcctccagaatgcgcatgtggcgatgccagttcgccatgctgccagccagttgcgcggggtcctgatgctcagggctgtttctcaccaatcccatgaaggcatagcgccaggcattgttcagctcggttgcctgccaatccatccactgctcgacaagcgcgcgttcggcgggtgctgccggcagcaggtcctgccggtcatggcgggccgccaggtagcggcagatg

SEQ ID NO: 81026 - DNA, 612 bp, Glycine max
  Peptide Sequence Number=SeqID_197804
atgtttgggtttggctatgatccgtcaagtgacaaatacaaggttgtagcaattgcattgactatgctctcacttgacgtatctgaaaagactgagatgaaagtttatggcgctggtgacagtagttggagaaaccttaaaggttttcctattctttgcactttacctaaagttggtggagtgtatctgagtggaacccttaattgggttgttattaagggaaaagaaaccattcattcagaaatcgtaattatttctattgacctggagaaggagacttgcagatcactatttcttcccgacgatttttgctttgttgatacaaatattggagtttttagagactcgctgtgcgtttggcaagatagcaacacccatcttggcttgtggcagatgaggaagtttggagatgacaagtcttggattcaattaataaattttagttatttacatcttaatattcgtccttatgaagaaaaatccatgattttaccattgtgcatgtctaacaacggagacttcttcatgctgaaattcactagaattgctgatgatgaataccaaataattctgtataaccagtgggatggtaaggggagaagggagatatga

SEQ ID NO: 81027 - DNA, 492 bp, Glycine max
  Peptide Sequence Number=SeqID_197805
atgttatgcttatggcttatctcaggtcgtggtagtgtgcgagacttcacaaagcctgctgtaggttgcttgaggggtagtgtgaatctaaggagactacaaccattgtatggtcctttgagttttgggtgttctacttttgatgctaataggaggatccgggattcgagtttgctgcatggatcatggctcaagaatttctcagcctcttcttctgcttgctactcagccggggctgcacatgctgtctcatttgatggaagccctcctgatgaacagcttgcaaattcctctttttcgcctgacccgcttttcgtcttacagacagcaaaaaagaatgtttatacggataaccactcgggtatttccgcccgtcagcgtgactcaaatgtcagtatgacaaatcttgtgagcgcgaaagatgacgtaaatctctgcgtaacaacgggcttgtcggccgcgattgacgaagggtgcagaagacgacgttag

SEQ ID NO: 81028 - DNA, 1081 bp, Glycine max
  Peptide Sequence Number=SeqID_197806
caaaaggatcagtgtctgatatgagtgttgggccaggaatggatttgccgatcatgcatgacagtgatcgctatgagtttgtgcgtgacattggttctgggaatttcggtgtggccaggcttatgagggacaaacatactgaggaacttgttgctgttaagtatattgagagaggtgaaaagatagatgaaaatgtacaaagggaaattataaatcacagatcactgaggcatcccaatattgtcaggttcaaggaggttatattgacaccaacacatttggcaattgtgatggaatatgcttctggaggagagctatttgagagaatatgcaatgcagggaggttcagtgaggatgaggcgcgcttcttcttccaacaacttatatcaggagttagctactgtcatgcaatgcaagtatgccatcgcgacttgaagttggaaaacacattgttggatggtagtcctgctcctcgtttgaagatttgtgattttggctattcaaagtcttcagtgctacattcacaaccaaaatctacagttggtacccctgcatatatcgctccagaagttttgcttaagaaggaatatgatggcaagatagcagatgtgtggtcttgtggggtgaccttatatgtcatgttggttggtgcatatccttttgaggatccagaggaacctaaaaatttccgcaagacaatacataggattttgaatgttcagtactcaattcctgactatgttcatatatcttccgagtgccgtcatctgatatcaaggatttttgttgctgatcctgcaaagagaatctctattcctgagatcagaaaccatgagtggtttttgaagaaccttcaaagtgatctcatggatgggaatactaacaacaaccagtttgaggagcctgatcaaccaatgcaaagcatagaagaaatcatgcagataattaaggaggctacaattcctgcagctggatctcagtctctcaaccatgatcttactggtagcttggatattgatgatgacatggattcggatcctgaccttgacttagatagcagtggagaaattgtgtatgctat

SEQ ID NO: 81029 - DNA, 7494 bp, Glycine max
  Peptide Sequence Number=SeqID_197807
gaaatgattttcagattggctggtcttccaatggtagagaactgcctttcagggtataatagctgcatgtttgcatacggacagactggaagcgggaaaacatatacaatgcttggtgacattgaagatttagatgtgatgcctagtcctcatcgtggaatgacaccgcgtatatttgagtttttgtttgcccggatccaagctgaagaggaaagccgaagagatgagagcttaaaatacaactgcaagtgttccttcttggagatttacaatgaacaaattacagatctacttgatccctcctctactaatttgctactgcgtgaggatgtcaagaagggtgtttacgttgaaaatttatctgagttcgaggttcaaagtgtgagtgacattataaggcttctaattcagggttctgctaatagaaaagttgcagcaacaaatatgaatagagagagcagtaggtcccatagtgtttttacatgtgtaattgagagcacatgggaaaaggattctacaactaattatcgttttgcaaggttaaacctggttgatctggctggctcagaaagtcatgttattatgatactagtggatgtggcaaatgggaagcagaggcatatcccttacagagactctagactaacttttcttcttcaggactctcttggcggaaactcgaaaacaatgatcattgccaatgtcagcccttctatctgctgcgctgctgaaacattgaatacacttaaatttgctcagagagcaaaacttattcaaaataatgctgtggtgaacgaagattctactggggatgtaattgctttacaacatcaaattcgacttttgaaggtggaagagctttctatcctcaaacgacgtcagaatgtctctaggtctttgtcattttctttgtcatcgatcagagatataaaacaatcactagaactagaagactgttgcctagaaaatgcaactgacatggttgaccaacatgaagataacatgccggattatgaatccaagggcatcagaatgtcccacaaacagttgcattcattggagacaactcttgcgggtgctttgagaagggaacaaatggcagaaatttctattaagcaactagaagctgaaattgaacaattaaatcgtttggttcgtcaaagagaggaggacactaggagttgcaaaatgatgcttaggtttcgcgaagacaaaattcatagattggagtcccaacttgctggttcgattcctacggacacatttttgcaggaagagaataaagcactttctgatgagattcaaatacttcagagcagacttgaccgaaatcctgaagtcactcggtttgctgtagagaatatcaggcttctagaccaacttagaagatatcaagagttttatgaagaaggggagagagagattttattgactgaagtgtcttctttgagggatcagttgcttcaatatcatggaagaaactccatgcagggtaattcaaatcatgatattcaacctcagaaagctcagtgctgcaataaagaaaataaccttgttgatctagagctaagaaacaccctcgatgagttacaggaatgcaggcgcaatttaaattattgcttagaggagaatgcaaaactcaatagggaagtagactctcttcactcaatgttaagcagcacaaatagtacaaaggtttctaccaaaggaccatttattgaagctcaggcagttccaaggatgggggtcaagcatgaaactcatctgtcacaacacacagatgatattttaaatctgcagttggaattagatataataaatgtcattctgaaggaagagaggtctttccgtggcatattggaagagcaaaaaatatgcttaaataaggattttatgatggcaaaagacaagcttgagcaaacaagcaaacaattagaagatgcaaaggacgagcttggagaggcaaaatctgtcattgaagccttagaattgcagcaaatattatctatcaaagagatagaagagatgaggaacaagaacagccattttatggagcttatggggaaacaagagcatgaaatcatgaccttgaagaaccaacttgcatctaaagagttcagagataatttgctttcaaataatccagagtttgaaaacaagtcccccttacaggtaaaactcagaaggatgcatgattctcttgaaaaagcgaagcaactgaacatgtcgtaccaaagtgatcatgcattccagatatccaatgaggaagagagggatgaaatccgtcggcaggccgaggctgaaactgttgaggtaattgtctgtatgcaagaagaacttgcccagctccagcatcaagtaaatgatagtcatttgaaggaaacagaaatggaagagagtatgctgcatctggaaactgaattgaaggagttgcagaaaaaaatgcttactactattgatgataatagaagtttaaaggaggagcttggccaaaaagatatagaactcacatcactggcagaagaatgggaactgttaacctctgagattgaagaggttcttcttgatggatgtgaggcaatagttgatgcctctgaagaacttgggaatataaggaattcatttccacagaaaaggatctggatttctgaacaagttggcatgatagttagaaaaatttctgagaatgaattattaattgatgaacttagaagatgtttggaagatgcaagcaataaaagaagtgatatggagtgtatgctgaagtccttaagaagtgcagcgttagtcattactgaatcccaccagaaggagtgtgctgaaaatgaaaaagaaattctcctattgacctcacaattgagtgaaaaaacatctactgtggcacaactgaaggagcatttggtaatggcagaagatcatatcagaaaagcatcaaattgttcaacagtggcttttgtagttgtgaatagattgtcagaagtgaatcttggttacctggatgatctaaagcataaggatattctgcttagtgaattagcagaaactaataataggaaggatgtccttctcagtgaccaatccacttcatttgttcaagcagagagacagataacagagttgcaggaaagatgtaatgatttatggcagaagctgtctgaggagcaagagcattctcgtgctttggaacaaaagcttgaagatattgaaaagaatgccatttcaaagacaagggagcagctagtgacattacaagatggtgtctcttcaatcagatcatgcatggcctcttttgcagaccatccaggaagtcttgataatagaaattcattggatgcatgcacatcagactatgatgatattggtgaacaaaggcatacaagttcggaaacacatcaaaacagtgattcagatccgctttctgttgaagaacatatagttgacctgactgacttacagttggtcaaaagtggatatgatacgaaagacctgaaatcaagaaaagttggcaagaatgtgcttgaaagagatgctactattaggcttttgagaaaagaaatcgaatgtgctcttgaaagcttaaaagaagtgcaatatgagatggccagattacatgaagaaaaaaaagagatgtccgtgtctgaaaagaagagtcggcaaagcatagagtgcctcacaaatcagatacttttcctgcaagaagctatgtatcactttgaggagaaatctaaagtcaagattgatgtactcagtcacaaacttagaggcctggagaaacctctgaaagaagccagctcccattggtaccaaaggaaagagacacttgaacttgaagttggagaggcaaagatcattcaagctcagaaagcccaagaggcatcttgtattcttgctaaatttgaagaagcacaagatacaatgagagaagcagatattatgatcaatggattggtgatagctaatgagtcaatgaagatagatatagaaagactgaaagacagagaaatgactttactcaatgagaagggtacattagtcagcaatattgaaagcttacaaactgttgttgatttgaagcatcaggagatagagaaccttgttgaatcaagtctagtagaaacaagggatctaattgttacgttggatgatgtcattaaagacgtccaattgacgatggcagaaaatttcaagtctttagcttgtgatttagagtgcttgaagtctcaatgtttatattccactaaattgatacagccatggcttgagaagatatggtctgagatagtttttaaagattgtgctatgtctgtgctacatctctgtcacatgggtattttactggaaacagtaacagggatgcatgcagaaaatggtttgctttcacacggcttgtgtgaatcgaactctgtcataagtgatttgaaggaacataattataggacaaagcaagagcttgatatgtgcagaatcttgaaagggaaactgctggctgacatcaagaacagttttgatcgtattaataagaaagaagttgaagctggagaaatcaccatcaagctaaataattttgctaaaagcatatcagacctacaacttcaggaggagatgatgctgcaaaggtcgaatgaaatgggatcccaacttgctaaactgatgagggaattggatgtgagtaatacagatattgtgacatcccttttagatcaagagaaactactgaaacagaaagtagtggccattgaatgtgaggccgaattttttatggcagattggtatgccaaagactttgaatcacttatccatgcatctgaattgaaaaatatgtcatgtaatatagctaatatggaggagcattttgtcaagtactccatattaattgagcaactgaagaaagaaacaatcttttcccaagtagaaactgagtttgcaaaacaaattttgatggataaggaagttgaagtttccctattagaaagagaagttcagcagggaaaagtggaaaggaaggacctagtaacagaattaaaccggaatgtcttaaggattacagagatgggtgaagtaaacaaggtccttgaacaaaatattgagtttctaaaggatgttacttgttctaatcatgcattgaagggtgaacttgttgaagctaacaaggcaaagaaaagactgctggataggattcttgatctagaagctgattatgataaagtaattggtgatgtcattgggaaggatgtggcttctgaattttctttccaacaggtttattttcttgaacatcaaaacacagagttaaagaaagtaaactatatgttggaaaattcatcttgcagactaaagaatgagctgaacctaaaggattcggacttaaccagaatgcagaacttactggaggttgagttatccagaaaggatgatgtagtaaaaggactgttgtatgatctgagcttactacaggaatctgcctcaaacaataaagaccaaaaagatgaagttgaaaaaattgtggctacaatggaggcattagaagtggagctagctgttaaatcaggtgaacttgctgatgttgttgcaaactgtcaattgcttgaagctcagttgcaggacaaatcagacataattagagctcttgagttggatctctcaaaagaacgtgaggctctagtgttgcaagtcagtgaaaatcaagaacttagaactcatattgaaggcgccttgacagcgagaaaactggctgacaatgagctaacagaaagaatgaagataacagagagcttagaagatgaaatcctggaaatgaacagtgtttttagccaaatgaatgattcatttaaaaatctgagtagtgatctggatgatgtcactaatgagagggatcagcttcagggtcaagtaatttgcctcaaaaacaggcttgaaaaagctgaagcacaagctgaagctaatgaagcaattgttcaagaagctcagaaggtggcagaatcgagaaaaatttatgctgaagacagggaagaagaggtgaaacttctagcgagatcagttgaagagctggaaagtactgtaaatgtactagaaaaccaagttgacatccttaaaggagaagcagaacgacagaggctacaacgagaagatctagagttggagctacatgcattaaaagatcagatgcaaaatgtcagaaatgtcgatggtgacatgagaagatttttggatgaaaaagagaaaagcctcaatgaagccctaaatcacatacaggttcttaagagggagttagcaggaaaggatgcagagattcgacaaataaaagctcatatttcagagctaaatttgcatgctgaagcacaggccatggagtacaagcagaaattcaaagcattggaagccatggctgagcaagtcaaaccggagggcctttctagtcattccaccagtgctaattcccacaatgcattgtcaaacaagtctgagaagaatgccaccaagtctcgaggttctagttctcctttcaaatgcattgggttgggcttggcacaacaggtaaaatatgagaaggttgaagagctgtctgctgcaagactgcgcattgaagaactagaagcccaggcagcatgtcgacagagagagatatttgcactgaatgccaaattagcatctgctgagagcatgacacatgatgtaattcgagacttacttggagtgaagttggatatgacctcttatgcgtcactaattgatgatgaacaagcggagaagattacagagaaagttaaatttcttactctggagtctcaagacaaggaggttattaagctaaagaagcagctgaatgaattcattgaagagagacaaggatggctacaagaaatggataggaaacaatcagagttggtagctgtccaaattgcattggaaaaccttcggcagcgagatcagttactaaaaacagaaaatgaaatgctgaagattgaaaatgcaagtaagaagaataaagtagtggaactggaggaagaaattaaaaagttgtctggtcagcaaaaccttcagcagcgtattcatcaccatgctaaaattaaggaggaaaataacaagttaaagatacagaacgaagaactcagtgcaaagctccggaagtcagacatcttccattcgcgtgtcaaagaagaccttgcacgtcttcgtgcttctactggcgcaaaaaaaagcattaatttggatgaggaacaacgtctgatgataaagctgaaggagatcgaggaagagaaagtacaactagcccagcaattactgagattgtccactaatgttctaaaggtggctggaatagcaagaccaacatcagatgtaaatccttctatggctgaggaagccctacaggacctcaagaataggataactaccctggaaatggaacaagaagatttgaagtttaagagagttaagcccaaggtgtggaaagtttatgagaggaaaaatagaaggcagaaagggagtgagtga

SEQ ID NO: 81030 - DNA, 360 bp, Glycine max
  Peptide Sequence Number=SeqID_197808
atgccgatctccccctgtgaaagtatcggttggtctgtgccgtcccgacataaggatcgtgcccacaagacacccagtggacctggagaagtccaacaaggccctggggtctccagctttggttacgggcctctatcagtcctacagggtgcccgttccccccaacaagggatcgcgcctgcaagacacccagtggaccctgagaagtccaacagggagtatctgtcacccccaacaaggtcattaggccccgcattaaccgggttttcatcaagaagtactgcgcccccaggcaggcgcaaggcgagacactacagcagcattgggatggccggtagcgggcaccgccaccacctctag

SEQ ID NO: 81031 - DNA, 312 bp, Glycine max
  Peptide Sequence Number=SeqID_197809
atgaaagagatgagaaggagacaaggaaggactagaaaaggggaaaaatcaaagaactatcaatgtggttgtttgaggagtaaaaaaacgcgtcggcaagtcgacgaagcggaggtcctgatcggaggtgtcgcagaaaatcgagagggacgacaacgggaggcacgaggcaagctcgaagtggatggtgttggagaggttgatacctcggtggtcgggggacgccaccgcggcggcgctgtaggtggtagagaaactcatgtatttggtcacgggaagagcatgaaagcacgaagaaatggtgaaatctga

SEQ ID NO: 81032 - DNA, 378 bp, Glycine max
  Peptide Sequence Number=SeqID_197810
atgccactagtccttggaaacattggttctggaagcacgagtcaggtcaggaagtggaacatgaatagcacaagaaaaaccatgatttttgtgagccaagcccaatacaagccaataaagtccttagtgatccacctgaaggttgttagaaaattgcagacactaaaccatacacttgtgagcagaggaaaacaccagccttgtgaggaaaatattgacagatgcggaaaggaccactggaagaaggaggaactaaggccattgacagtgttgaaacactcagaacttgcttggaaattatttctattcttgatacgaaaaagaaggctgcatttagcaaaagtggcacagaaaggaagaaaaaagaagaaattctga

SEQ ID NO: 81033 - DNA, 813 bp, Glycine max
  Peptide Sequence Number=SeqID_197811
atgaagaaaaagcaattcagagatgcacgtgtgagagattggcttcttaaggccaaagatgtcgtgtttgaagcagaggatctctgggaagatatggacaatgaacttcaaagcgatcatctaggtttgaaaaaggctagtggtgttgtggttggatcaggatcgggtagtaaagtgtcagagaaattgtcatcaacatctttgttaagtgaaagtattatttatggaagagatgatgacaaagaaattatctttaactggctcatatctgacattgacaacaagctatctatactttctattgtgggcatgggcaggttgggtatgaccatggttgcccaacacgtatacaatgacccaaggatggatgataaatttgatattaaagcttgggtctgtgtttcagaagattttgatgtcttcaatgtatcaagagcaattcttgacacaattagtggttcaactgatcgtagtagagagctagaaatggttcagacaagactgaaagaaaaattgactataataaggttgctttaccatgcggtcagaagagctccacctggaggaattacaagaagattattgctggcattgttcgcaaaacatgcattccaaagttctaatcctcaggcaaatatagacttcaaggagattgatatgaagatagttgaaaaatgtaaaggacttcctctagccttgaaaacaatgggaagcctattacacaataaatcatctgttagggaatgggaaaacatattcaaaagtgagatatgggaattttcagaaatgatagcgatattctccctgctttaa

SEQ ID NO: 81034 - DNA, 934 bp, Glycine max
  Peptide Sequence Number=SeqID_197812
ggatatcagatcaccaaagcgaaatgttaatggaaagaaatctttcacttcaccagtgaaagatcgccttcttcccttcaacagccttaagtcaaaactacccccacctcctttgcagtcagcatttgccagccccacaaagccaaatccaggaggtggaggggaaacatgtgcagaaactgggatcaacatcttttttggcaagatcattaagttgggagcagtcagaataagtggcatggttgaaaggctacaattatctcagcagattagggagaatatttcacaactgaacctaacttttaaggagattgtatacaactacagaaagcaaccacattgcaaaacacaagtttttcgtagtgtatttgttgattggtcattggcccgccgaaatgggagaacaggacaggatcatgttgacatcattaccttttacaatgaaatattcattccttctgtaaagccactgctggttgaacttggccctgctggaccaaccccgaaaagtgatcgcatacctgaagttaataataaaaatgaaggccatttagctcaatgtccaggatctcctaaaatatcacctttcccaacccttcctgatatgtctccaaaaaaagtgtcagccacacacaatgtatatgtctctccattacgatcatccaagatggaagccctaatatcacacagctcaaaaagctattatgcatgtgttggggaaagcactcatgcatatcagagcccttcaaaagacctgacagccatcaataaccgtttaaatggcaaccggaaggtgagaggtcccctcaactttgatgatgttgatgtggggttggtgagtgattctatggttgcaaacagcctctatctgcagaatggaagctgtgcatcatcatcaggtgcaccattgaaatcagagcagcctgactcctag

SEQ ID NO: 81035 - DNA, 126 bp, Glycine max
  Peptide Sequence Number=SeqID_197813
atgtgtttcttgcctcatgcagttccagttagtcataaagaactcgtcgccattgccacccttcccattcccaagcgagaattgaagtcagtctgtggcattaagacaatgctactagacatgtga

SEQ ID NO: 81036 - DNA, 243 bp, Glycine max
  Peptide Sequence Number=SeqID_197814
atgggtagtagtttaggattgatgctttacatgccaaggcatggcaaaattggggatgaatttaccttgaaaaaacttaaaattggtagccaccaaaaagaaaacaagagaggaattaaagttgaaggatgcattagcagagtttggtctcaatggcctaaagctcaatacagtttgaaagcaaacaaatgcaaactagtagggaatgggtggcatcacggtcgtggcaatttccactgttag

SEQ ID NO: 81037 - DNA, 741 bp, Glycine max
  Peptide Sequence Number=SeqID_197815
atggcttctgcattgactccaccttcggtttctctttcttcctccccaccaccacaaccatctttgtctgcgaatgcttcttcgaagtccttggcgcattccgtctctcagaagttgcatgcgaagaattatcttctttggattcaacaggttgaaccagttattcatagtcatcatcttgaaggctatatcgttaatccacaaattccacaaaaatatgcttcaattgaatatcaggatgcaaatcaagtcaccaacgagtatggtgtttgtctaccatttctggtgacattcttccgcttgtcattggttgttgttcgtcgtggcaactctgggatcacattcaatcacattttcagtatcttacgcgagcgaagaggaggttatgtccgtacccttcctccaccaacttcatttgccactactcaatctacttcagttcaaactaattcagctcaaagtggtcagacttctcagcaagtccaattcgctcaaccaattcagcatgtcttttgcccaacctcagtcttctcagcaagtgccaatcctcagcagtcactgatcatgtcttttgctcaacttttagtttctaaacttgttctgcttaaaggatttgtgggaagagatggcctttatcagttccctcaacttcttgcttttatgcccaagtgcaatctttcttcaaatgtttgcaaatctgacaggttttgtacaaagtcctgttgtaagtacagtcactag

SEQ ID NO: 81038 - DNA, 465 bp, Glycine max
  Peptide Sequence Number=SeqID_197816
atggggcattacttctgctttgagtgtggtttatcatcaactacaagatcaacttcaaggtattgtgttttcattgaaggttacataatctcattgagaagtcctaaacagaacatattgctattgcaaaggtcgagtagcttaggcagtaataaccaacttaaggaattgcttcagccttcagcattggacattgatattgatattgactaccattttttactccgagctgccttggacattgatattgactaccattttttcagggaaaaaaaaaggttcttgcacctgagatcactattggttcggtcaactccaacaataacttacatatttactaaatctcttaggcttagaggggctcaggttgactttatttgtagaaaggttgtcacatatatgctccaacttagaggtatagtgttagaattaaatgttagatttaagcatatgtatcatgagtag

SEQ ID NO: 81039 - DNA, 871 bp, Glycine max
  Peptide Sequence Number=SeqID_197817
atgggtagactggggtcgagccagttggggtactctgttgttgatctaaggttgacaacagtgattgcagcaattggaaggtggtggcagctagaggttggcacccctgagagtggcggaagaagtgccatagtatggacatatggtgcggttattgcttctaatgcaattttgcatcccttcatcttcagcgtcaactgtgtgcatgggtgtgttaggcaagaaagtcaaccacaatctgagccaaggggccatttccttgtgagaaaggagagtgctcctttgtatagtgctgtggacagaggtgttacattgagtgaggctctacttaggcatgacaaatggcttgagaagaagggaataaagaattccaactttgctgtggttacatggtccaactgggattgtcgggtgatgcttgaatctgagtgccgattcaagaagatacggaagcctccttacttcaaccggattcctttccgtgaggtatttggtgctgtgaggtgcaatctaaaggaagctgttgagatagccggcttggcctggcagggacgtgcacattgcggccttgatgatgccaaaaatactgctcacctattggcacttctcatgcaccggggttttaaattttccattaccaattccataatgtggcagacagctgatcgaccactgatgtggaaacagtcaccagaacaaccaattgttttcccgcattccccctataaagcaaaggatatcactatccccgtggttcagtatcaccctttctgcttttgtggggtgaaaagcagcaggggcatggtgaggaagccgtgtcccaagcaagggagtctcttctttggatgtggaaattggactgcgactagag

SEQ ID NO: 81040 - DNA, 291 bp, Glycine max
  Peptide Sequence Number=SeqID_197818
atgattatagacagaggtagacaggatgaggatgatgtagttgatgttcctcagaggtgtaggcctattgcatcagcccgtaggcaacgggttcatcagatgattaaggatgttcctcacatgattgaggatgtccctcatatggctgaggatgcacctgagatgactgcggacgtacaggcgacagttgcaaaggacttaggtcgtgatggtgctgaggggtcacatgctgatgatgctgagggattcccagaacgtcctgagttgaagttggtgtcgcacgggaggaag

SEQ ID NO: 81041 - DNA, 334 bp, Glycine max
  Peptide Sequence Number=SeqID_197819
atgcctactgacatcagggaaattgaggctgctctgtgcatacccggcagagggtttattttaaatgctgaaggtcaccctgggaagatcctcaaaaaagatctaaccactcttgctcaggtctggagtgttctctcatactccaacctggctccgacttcccacaccttggatttgactatggatagagctaggggggctagaagaccaagggcaaggccagttgaggctccttctacattagcaactcctcatccagcttctacatcagcagctcctcctccagctcatatgacaccagctccttctaccctacctcctgcagattttcaag

SEQ ID NO: 81042 - DNA, 303 bp, Glycine max
  Peptide Sequence Number=SeqID_197820
atggttccccgcatgtcatcgagcccgtcgcctttggatgacaaaggtgcagatgaccataatttgtctctgcgtgtcaacgggctcgcttgcctctggttgaaaaaagaggttgtctgcgcggaagatgacgtaaatctccgcgtgtcaatgggcttgttggtcgcgattgacaaaagagatagcaaaagaaagtttgcgggttaccgtcaggtgtctccgcatgccatcggactcttgggtcacggtaacaaaggtggggtagtcgacaaaagcagggcttttgctcctacgtatccttaa

SEQ ID NO: 81043 - DNA, 567 bp, Glycine max
  Peptide Sequence Number=SeqID_197821
atgagtgaaatagaggaggtacaagagcggatgaaggctgacatggaggccatgaaagagcaaatggccacaatgatgaaggccatgatgagcatggaaaagagaatggaagtcaatgtagctgcagttgctgctaccagcatcgcttctgaggtggacccgactcctccgtctggccttaacccaataaatcatccaacctcgaatatggtaggcaaagaattgggaagtatgggcattccccattttgtgcaagttcaaaataagcattccttcccaccatatggcttgaaacacgactatgcgccacccaatgtggtgcacactcccgatgagaatgtcaataactccactcccatactcattgagagccaacaaactcagtttgatcatgcacatgtcactcaacccatgggggagacacatgaaataccccaccacaatctagccaactttgagccttgcctcggatatgcccctgaggggaagcagttggtggtgtacctttgccaaacactttggagggccctcagtttctcccacaaccacaaccctttcattttgtag

SEQ ID NO: 81044 - DNA, 1041 bp, Glycine max
  Peptide Sequence Number=SeqID_197822
atggaagaagagaatgccatagagcttctccagagataccggagggaccggagagtgcttcttgattttatactctcagggagcttaatcaagaaagttgtaatgccacctggtgcagttacactggatgatgtggatctagatcaagtcagtgttgattatgtcctcaactgtgccaaaaagagcacattgcttgagctttcagaagcaattagagattatcatgatcatactggattgccccaaatgagtgatacaggttcagtcggtgaattttatttggtcactgatcctgagtcttcaggttcacctcccaggaggccaccaccaactgttcctattcctgcagtgcctcctgtcgctgtttccactcctcctcctgtttttccaccatccccaattgtttctaatgtatcgagatcggagtcttttgactctactcaagaaaaggagctaacagtggatgacattgaagactttgaggatgatgatgatgttgcggtggttgaaggcttcagagctaaaaggactcttaatgatgcttctgatcttgcagtgaaattgccttctttctccacaggcatctcagatgatgatcttcgtgaaacagcatatgagatcatcttgggttgtgctggagctacagggggtctgattgtcccatcaaaagaaaaaaagaaggataaaaaatccagcttgatcaggaagcttgggcgcagcaaaagtggaagtgttgtatcccagtctcagaatgctcctggattagttggcttgttagaaaccatgcgtgttcaaatggagatatctgagtcaatggatatcagaacaagacaaggcttgctaaatgctctggtgggaaaggtggggaaaaggatggatactctattgattcctttggagttgctttgctgtatttcacgttcagaattttctgataagaaggcttttatacgttggcaaaagaggcagttaaaagttttagaggaggggcttgttaatcaccctgccgttggatttggtgaatctggacgcaagacaaat

SEQ ID NO: 81045 - DNA, 174 bp, Glycine max
  Peptide Sequence Number=SeqID_197823
atggaacaaagaggccaacaagagaggttgcacttgaaaagcttgcgttccaagatattcttagaatgtgggtttgggtctaactcaaccccaaaagctagctcatggggtaagggttgcctcccactatatatacttcattttggcactatctctggccgatgtgagacttga

SEQ ID NO: 81046 - DNA, 609 bp, Glycine max
  Peptide Sequence Number=SeqID_197824
atggctgtagcctccccaggcctggttgggcagactaaaatccaccttctagcttctggtcattgtgctggtgtcctaaataaagctctctctcccactagttttgttgctctgagcaagttcagctgtgtgattcttctgcatcacatccctcaagcttggggggaacttagccaactttgtgatattgttgtggagcctctcagggatcgcatagtgacaagtcttcttcaggcatcattggatggcttactccgtgttatcttagatgggggtccatcaagagttttctttcccggtgatgtaaaattattagaggaagatctggaggtcttaaaggaattctttatatctggaggtgacggcctccctcggggtgttgtcgaaaatcaggttgcacgtgttcggaatgtgatcaacttgcatggctatgagacccgagagttgattgaagacttgaaatctgctagtggcatggaaatgcaaggtggcaaaagcaaactgggaactgattccaaaactctattaagaatattatgccacaggagcgactcagaagcctctcaatttctgaagaaacaatacaaaatacccagttcttctgcttag

SEQ ID NO: 81047 - DNA, 423 bp, Glycine max
  Peptide Sequence Number=SeqID_197825
atggcattagaatgcgttggtggtgctattctttcttctttcctcggggctctatttcagaagctggcttctcctcaatttggaaatgtgctagtgagagactggcttattaagctcaaagttgccatgcttgacgtagaagatgtcttggatgaaatacaacactccaaactccaagttcaacctcaatctgaatctcaaactggttcaggctgtacttgcaaggtacccaaattcttccaatcttcctcttttagttccattaacaaggaaattaattccagcatgaaaaaaatccttgatgacctagatgatcttgcaagccggatggataatctaggtttgaaaaaggctagtgatcttgtagctagatcaggatcaggtggtaaagtgccacaatcaacattgttggtagttgattag

SEQ ID NO: 81048 - DNA, 3504 bp, Glycine max
  Peptide Sequence Number=SeqID_197826
atggcattattagaatgcgttggtggtgcttttctttcttctttcctcgggactgtatttcagaagctggcttctcctcaagttctggatttctttcgtggaacaaagatcgatcagaagctgcggaaggacttagaaaacaagctcttctccatccaagctgtgcttgatgatgctgaacaaaaacagtttggaaatatgcaagtgagagactggcttattaagctcaaagtggccatgcttgacgttgaagatgtcttggatgaaatacaacactccagacttcaagttcaacctcaatctgaatctcaaacctgtacttgcaaggtacctaatttctttaaatcttcccctgttagttcctttaacaaggaaattaattccagcatgaaaaacgtgcttgatgacctagatgatcttgcaagccggatggataatctaggtttgaaaaaggctagtggtcttgtagcaggatcaggatcaggatcaggatctggtggtaaagtgccacaatcaacatcttcagtggttgaagtgatatttgtggcagagatggtgataaagaaatcatcattaactggctcacttctgacactgataacaagctgtcaatactttctatcgtgggcatgggcgggttgggaatttgatgttttcaacgtatcaagagcaattcttgacacgattactgattcgactgatcatggtagagagctagaaatagttcagagaagacttaaagaaaaattggcagataaaaaatttctcctcgttttggatgacgtttggaacgaaagcaggtctaaatgggaagctgtgcagaatgctcttgtttgtggagctcagggaagtaggatccttgtcacaacacgcagtgggaaagtttcttctaccatggggtcaaaagaacacaagctgaggctattacaagaagattattgctggaaattgttcgcaaaacacgcattcagagatgataatcttccacgagatccaggatgcccagagattggtatgaagattgttaaaaaatgtaaagggcttcctctggccttgaagtcaatgggaagtctattacacagcaaaccatttgcctgggaatgggaaggcgtgttgcaaagcgaaatatgggaattaaaggacagtgatattgttcctgctttagcattgagctatcaccaacttcctccccatctcaagacatgttttgcttactgtgctttatttcccaaggattatatgtttgacagggagtgtttaattcagttgtggatggctgaaaatttcctaaaccaccatcaatgcaataagagtccagaagaagttggccaacagtacttcaatgatctactatcaaggttacgtacatttatgccaacaagcaggatcatgaatggatattactatcattggcattgcaatatgttgatacatgaattgttctccaagtttaagttcttacgtgtcttatctctgtcttgttgttctgacattaaagagctgcctgactctgtttgcaattttaaacatctccgttcattagacctctccaaaactggcattgaaaaactacctgaatccacatgttcactctacaacttgcaaatactgaagctggtcaattgtagacatttgaaggagctgccctcaaatttacataaactcgccaatttgtgcgttttatctttgtctcagtgttctgggcttacagaagtgcccaactctataggtgatcttaaacatcttcgttcattagacctttcccatactcgcataaaaaaactacctgattcaacatgttcactctccaacttgcaaatactgaagctgaactattgtagatatttgaaggagcttccctcaaatttgcatcaactcaccaattttcatcgccttgaatttgtagatactgaactgataaaggtgccaccacatttgggaaagctgaagaatcttcaagtattgatgagtttgtttgatgttggcaaaagtagcgagttcactattctgcaactaggagagctgaatcttcatggaagcctatcatttagggagctgcagaacattaagagcccctcagatgcattagctgcagatttgaaaaataaaacacgccttgtggaactaaagttagaatggaatttggactggaaccctgatgattctggcaaagaaagggatgtagttgtgattgagaatctacaaccttccaaacacctggagaagttgtcaatcatcaactatggtggtaaacaattcccaaattggttatccggtaattctttatcaaatgtggtgtccttagagttggacaactgtcaatcttgccaacatttgccttcccttggactttttccatttctcaagaaccttgagatttcaagtcttgatgggatagtgagcattggtgctgattttcatggggatagcacttcttcatttccatcgttggaaacattgaagttctcctctatggcagcatgggaaaaatgggaatgtgaagctgtgacagatgcttttccgtgtcttcaatatctttctattaagaaatgtccaaagctgaaaggtcacctcccagagcaacttcttcctttaaagaaacttgaaattagtgagtgcaacaaacttgaggcttcagctcccagggctctagaactaagcctaaaagactttggaaagctgcaacttgactgggctactttgaaaaagctcagaatgggtggacacagcatgaaagcatcgttgctggaaaagtctgatactttgaaagaactggaaatttattgttgcccgaaatatgaaatgttttgcgattgtgaaatgagtgatgatggctgtgactctctaaagacttttccgctagatttcttcccagcactcaggacccttgatctcagtggctttcgtaatctacagatgattacacaggatcacacccataatcatcttgaagttctggaattcggtaagtgccctcagttagaatcattgcctggaaagatgcatatactgcttccatctctgaaggagctacgaatatatgattgtccaagagttgagtcgttccctgaaggaggtttgccatcaaatctaaaacagatgcggctctataaatgctcctctggacttgtggcctctctgaaaggggctttgggagaaaatccctctctggaatggttgttgattagtaacctagatgaggaatcttttcctgatgaaggtttgcttccactctctcttacttatctatggatccatgattttccaaatctagaaaaactggaatacaaggggctctgtcagctctcctctctcaagggattgaatcttgatgactgccccaacctccaacagttaccagaggagggtcttcccaaatccatttcacatcttaaaatttctggcaattgtccgttgctgaagcagcgttgccagaactcaggaggccaagactggtcaaagattgttcacattcaaaccgtggatattattaatacatggtag

SEQ ID NO: 81049 - DNA, 2874 bp, Glycine max
  misc_feature (2386)..(2386): n is a, c, g, or t
  Peptide Sequence Number=SeqID_197827
atgatcattaactggctcacttctgacactgataacatgctatcaatactttctattgtgggcatgggtgggctgggtaagaccacgcttgctcaacttgtatacaacgacccaaggatagagggcaaatttattgttaaagcttgggtctgtgtctcagaggaatttgatgttttgaacgtatcaagagcaattcttgacacatttactaaatcaactgaaaatagtgattggctagaaattgttcatacaaaactgaaagacaaattgagaggaaacagatttcttctcgttttggatgacgtttggaacgaaagcaggcctaaatgggaagttgtgcagaatgctcttgtttgtggagctcagggaagtaggatccttgtcacaacacgcagtcagaaagttgcttctaccatgcggtcagaacaacaccacctgcagcaattacaagaagattattgctggaagctgtttgccaaacatgcatttcatgatgataatcctcaaccaaatccagggtacaacgagattggtatgaagatagttgaaaaatgtggaggacttcctctagccttaaagtcaataggaagtctattacagaacaaatcatttgtttcagattgggaaaacatattgaaaagtgagatatgggaaatagaggacagtgatattgttcctgctttagcagtgagctatcaccaccttcctccccatctcaagacatgctttgcttactacactttattccccaaggattatgagtttgacaaggagtgtttaattcagttgtggatggctgaaaatttcctacactgccatcaaggcagtaagagtccagaagaagttggccagcagtacttcaatgatttactatcaaggtccttctttcaacaatcaagcgaaaataaagaagtatttgtcatgcatgacgttctaaatgatttgggaaaatatgtttgtggggacatctatttcaggttggaagttgatcaagcaaaatgtacacagaagacagcccgctatttttcagttgcaatgaataacaaacaacattttgatgagtttggaactttatgtgatactaaaaggctacgtacatttatgccaacaattaggatcatgaatgaatattacaatagttggcattgcaataatatgtcgatacctgaattgttctccaagtttaagttcttacgtgtcttatctctatctcattgctctgacattaatgagctgcctgactctgtttgcaatcttaaacatcttcgttcgttagacctttcacatactagcataaaaaaactacctgattcaacatgttcactctccaacttgcaaatactgaagctgaactattgtagatatttgaaggagcaaccctcgaatttgcatgaactcaccaatttgcatcgccttgaatttgtaaatactaaaattataaaggtgccaccacatctgggaaagctgaagaatcttcaagtatccatgagttcatttgatgttggtaaaactagcgagttcactattcagcaattaggagagctcaatcttcatggaagactatcattttgggagctgcagaatattgagaacccctcagatgcattagctgcagatttgaaaaataaaacacgccttgtggaactagagttagaatggaattggaaccggaaccctgatgattctgccaaagaaagggatgcaatcgtaatcgagaatctacaaccttccaaacacttggagaagttgtcaatcaggaactatggtggtaaacaattccctaattggttatccaataattctctatcaaatgtggtgttcttaaagttgcacaactgtcaatcttgccaacatttgccttcccttggactttttccatttctcaagaacctagagatttcaagtcttgatgggatagtgagcattggtgctgattttcatgggaatggcacttcttcatttccatcgttggaaacattgaagttctcctctatgaaagcatgggaaaaatgggaatgtgaagctgtgataggtgcttttccatgtgttcaatatctttctataagcaaatgtcccaagctgaaaggtgacctcccagagcaacttcttcctttaaagaagctacaaattagtgagtgcaaacaactagaggcttcagctcccagggctctagaactagacctgaaggactttggaaagctgcaacttgactgggcttctttgaaaaagctcagaatgggcggacacagcgcggaaacgtcgttgctggaaaagtctgatactttgaaagaactgtatatttattgttgcctgaaatatggaatattatgcaattgtgaaatgagtgataatggctttgactctcaaaagacttttccgctagatntcttccctgcactcaggacccttcatctcagaggctttcataatctacagatgattacacaggatcacacccataatcatcttgaatttctgaaaatcagagagtgccctcaattagaatcattgcctggaagcatgcatatgctgcttccatctctgaaggagctagtaatagatgattgtccaagagttgagtcgttccctgaaggaggtttgccatcaaatctaaaagagatgggactctataaatgctcctccggactcatggcctcactgaaaggggctttgggaggcaatccctctctggaaagcttggggatagtagagctggatgcagaatcttttcctgatgaaggtttgctgccactctctcttacttgtctacgcatccgtgattttcgaaatctaaaaaaactggactacaaggggctctgtcagctctcctctctcaagaaattgattcttggaaactgccccaacctccaatag

SEQ ID NO: 81050 - DNA, 885 bp, Glycine max
  Peptide Sequence Number=SeqID_197828
atgcaacttgactgggcttattcgaaaaatctcatcatgggcggacagagcatggaagcatcgtctctggaaaagtctgatactttgaaagaactgtatatttattgttgccaggaatatggaatatattgcaattgtgaaatgagtgataatggctttgactctcaaaagacttttccgctagatttcttcccagcactcaggacccttcgtctcattgactttcgtaatctacagatgattacacaggatcactcccataagcatcttgaagttctggcattcagtaactgccctcagttagaaccattgcctggaagcatgcatatgcagcttccatctctcaaggagctaacgatatctaattgtccaagagttgagtcgttccctgaaggaggtttgccatcaaatctaaaagagatggaactctataaatgctcgtccggactcatggcctcactgaaagggactttgggagacaatccctccctggaaagcttggggataggaaagctggatgcggaatcttttcctgatgaaggtttgctgcctctctctcttacttgtctatgcatccgtcattgtctaaatctaaaaaaactggactacaaggggcggctctgtcagctctcctctctcaaggaattgtttcttgatgactgccccaacctccaacagctaccagaggagggtcttcccaaatccatttcatatcttgaaattcaaggctgcaccgacctcaagcagcgttgccagaacccaggaggcaaagactggccaaagattgctcacattacaacgtgcattgttcgtatgatatttatgattatttttgatctgaattatcatgaaccttctacaccatttgtgcttcaagcaaattaa

SEQ ID NO: 81051 - DNA, 192 bp, Glycine max
  Peptide Sequence Number=SeqID_197829
atgatacctgaacaccggtgcaagcaatcatatgtgcggaaaaagatcatgttggtggagctaggtgaattggtgagcgaaaatatgatctttggagaagaatccaagatacaagtgaaaggaagtttatctttccacccacctctaatgaggcctcaccatgagaaccctgaggttcaagctggagtgtaa

SEQ ID NO: 81052 - DNA, 180 bp, Glycine max
  Peptide Sequence Number=SeqID_197830
atggcaaggcaaaagaatatgattcatgcccagagattcgagtctctgacgaaaagctcaacacatggaagatatgtcctaattgtcagcgttatgggcaagaaagttccatcagaggtaccatggcaatgggggatcactatatccttgtacgtagggatagacccagaagtatattaa

SEQ ID NO: 81053 - DNA, 359 bp, Glycine max
  Peptide Sequence Number=SeqID_197831
ggttttataggcgttttatcaaggacttgagcaaagtggctcttccactatccaatctgctgcaaaaggaggtggagtttgattttgaagaccggtgcaaagaggcttttgattgcctcatgcgtgcgttgactaccacccttatcattcaggcacctgattggatagccccatttgagctgatgtgtgatgcatcctgtcataccctaatttcgtccggggaccattgtttgatggcatgcaacctttgcttgaccgcttcgaggtacttggcacccattgttgcacaatacgtgaagttccataacgtgccagaagtcaaaagagagcattgttgcaccatccgtgaagtttcgtaa

SEQ ID NO: 81054 - DNA, 192 bp, Glycine max
  Peptide Sequence Number=SeqID_197832
atgaactctgtctcagaaattgtggaggaagtgaatgctgtagaggcacaacagacaaagttggaggagaacataatattgcagacattggacatggctttggttttgataactacaaagttagttggttcttcctttgccagtgcatctcttgatcgcaccataaaggtatacatgtgttcttcttgctag

SEQ ID NO: 81055 - DNA, 267 bp, Glycine max
  Peptide Sequence Number=SeqID_197833
atgatgatgttgttggacactcatgaaaaccaaaaccaatattgtggaatagagcagcacacttatgatagtgttttaaaagatcatagtatggaattattatgcatgaaagctccagctgatgtctctacaattttggagccagagaaagaagagatatctttcaaaactaaatctttctgggatgtggtagtgccctcctattcagaaattcagctcatggaaggcgagagcaaacatgatggcagaagcgagactccaagttaa

SEQ ID NO: 81056 - DNA, 2829 bp, Glycine max
  Peptide Sequence Number=SeqID_197834
atgacatctaatcaaatatcattgtcatcgaaccgatcttcgtctccgaattcctgcaatgggtcaatgaacaatgagaatgagaattgtccttatgttcttgaggctatcacagatttagtagaacttgggtctactgcaaaggacatcatttcattgattgcccagggtaatcaactttttgttgatccaacaattgcaaatgatttgtccttggcacaaaaggacaaaggtgctggcctcgaacccagctttctgcttaacaattttggtgctctcgttgagagtcgaactcaagtgcgaaatagaatcatgcttcagaaaggtctcatacaacccagcacgagccttttctcttctctgatactattggtgaagaagagcggcgggtcatggcggttctttgtagactaccgcgccttgaatgccatcaccgtctgggatcggtttcccatccccaccattgatgagcttctggacgagctcgaaggcgccagatgcttctccaagttggatcttctacaagggtaccaccaaatacgcatgcacccagaggatgtgcccaaaaccgcatttcgcacccaccatgggcattatgaattctgtgtaatgccatttaggctatgcaatgccccctcatcctttcaagcaacaatgaacaatcttttctgcccatatctctggcaattcattattgtattcttcgatgatatcttaatctacagcgcgtgcctggatgaccacctgcgccaccttgaattgaccttccaggtattatcagacaatcaatttgctttgaaaataactaagtgcttttttgctcaaaaccaggttgagtatctgggccatctagtttcgcataaaggagtggagcctctcgcttctaaggttgaagccattcagcaatggccaacactgagaacggcgcctgtccttgccctgccggattatgagcatcccttcattgttgaaacagatgcttcggagattggtatgggtgcagtgctctcccaacgcaaccaaccaatcaccttcttcagtaagccttttccaccgaagttcctcaatgcctcagtttatgttcgtgagttgttcgtgattacaacagtagtgaaaaaatggagacagtatttactgggtcgttgcttcacaatcatcacttatcacatgagcttgaaagagctattaactcaggtaattcagacgcccaagcagcatatgtacctggcacgcctgatgggctacgagtatcaaatccaatatcgcacaggaattcataatcaagccatagatgaactttctagatgctttgattcagaggcaattcagtccagtccaaccacacatcctgagtacaccttgactcacaacctgatcctgcgaaaaggtcgtctatggctcccaaaaggattagccatgattcctacactattagtggaatatcacaccacccccaccggcgggcacatgggcgtgacaaaaataaaaaccaatcgcttgctcgaaaatttcgattgcccagggctccgacaggatgtgatagattttgtatcaaaatgccttgattgtcagcatgttaagtatgaaactaagcgaaccgttggcttgctatgtcccttacccatcccttatcgaccttgggaagatttgtccttggattttatcacaggactacccccgtttcgtggcaatacaatcatattggtagtggtggatagattctctaaagggattcaccttggtatgcttccgacagcacacacagcccattccgtcgccgccccgttcatggacatagtagggaaaattcacgggataccttgcagcttggtctctgatcgagacccattgttcttgagtaagttctggcaagaactgtttcgtcggagtggcacacagctgcgaatgagctctgcgtatcatccacagagtgacggccaaatagaggtgttgaacagagtcatagagtgcttatgcgccttcgtccatggtcgaccaaaggagtgggaatatatcaagggagcttcaaccttggatgttgtggatgaaatgctcactaatagggaggaaacatttcaggtgattcgaaagaaactccttcgtgctcaggagcgaatgaagctggtttccgataccaaacgaagagaggtacactaccagccaggggactgggttatgctcaagctgcgtccatatcgacaggtatcagaaaagggcacccacgccattagtggcaagctagcaaagaggttctatggcccttttcaggttttggagcgcataggacccgtggcctatcgcttgaagctgccggaggaagctcgtatccactttgttttccattgttcaatgttgaaacccttcaagggatctccacatgaggcgccaagagtagaattacccaccaaaatcattcaacaccaacccctcatttccctcttagctttgctggattaccgcagaacctcagagcacgcactattggaagtgttggtgcaatgggagggtctccctcctgatgatacttcatgggaactttgggagcaattgtgtgaagacttccaccttgaggacaaggtgaatctccatgggccaatggatgatacgaagcaaggagaagcagaaggtagaagcacacatgcaggggcacagaacacacaatcagggggaggagctaacctaagtggccatattgcatccgttttgccttttgtctttttgccaattcgttgtaatggttgggtacgtgggggacagggtaatcagctttttgttgatccaaaaattgcaaatgatttgtccttggcacaaaaggacaaaggccgttag

SEQ ID NO: 81057 - DNA, 159 bp, Glycine max
  Peptide Sequence Number=SeqID_197835
atgcttaatatatatgtgaggggtagagggtgtcacatggaggattatgatagcgagataaacaccaacgaggccaccatgcagcccaatgagacacccatgcagcccattaatgccccaggaaccaaggaagcacgtggaacttctcgaatccactag

SEQ ID NO: 81058 - DNA, 573 bp, Glycine max
  Peptide Sequence Number=SeqID_197836
atgaggtttaacaactacactcatgttgttgagagtgagtcatattcatcacatggtcttcatgaactcgaattgcttctttcatttttgaacgatagttctattgaagatttcttttgtaaaccatgcagccaaggagatgttgttggtattcttttatttagtggcttgatagattcttttgcatatctgaattctaaagaaccaatttcacaagccgtcactgatataaagggagatatcattacgagtctgcaaagtagattgtatataatctgtgatgaggtagatgtcgactctggtaacaaatatgatgttcaaagccaagtaagcaatgaaatatcggctgaaaagcctgttccccaactagtgttgcacttattgagaaaaggatgcagccttccatttcctagaagagtctttgcaccttggttagcagggatgtatctatgtgattatttgcagccttctgaaacttttgagaattacattcatttctacatcggtggctacgacaggaccgatgtagtaaattgcgctctctacatcgttttggtggaggcaccgatgtag

SEQ ID NO: 81059 - DNA, 2289 bp, Glycine max
  Peptide Sequence Number=SeqID_197837
atggcagaaaataaaaagcctcataccgatggtaccaagaaaacaccttctccttatgatctaaactcaaacgacaaccctgggaacttgatcacacaagtgcagctgcggggtgagaattatgaagaatgggcccgagcaatgaaaatctcgttgcgtgcccggagaaagtggggcttcatcgatggaacctatgaacagcctgacgatggctcaccagaaatggaagattggtggactgttcaatccatgcttgtgtcgtggatattgaatgccattaaacctaccctgcgttcaaccgtgacatatgcggaaaacgcaaaagatttgtgggaggacattcaagatcgtttttcagttgtaaatggtccgagaatccagcagctgaaagcgaaattagctgattgcaagcaacaagggttgaccatggtttcctactatggcaaattaaagacgctttgggatgagctcgcgaattatgagcagatccctcggtgttcatgtggaggatgcaaatgtgatattgcatccaaactcgaaaaacgaagagaggaagagcgggttcatcagttcttgatgggcttggatgatgcgagttatggtactgtgcggtctaacatattagctgccgatcctctaccttcattaaatcgagtatacacaattctagtgcaagaagaaagggtgagaacaatcagcagaacaaaggaagagagaggagtagtcatgggtcttgcagtacaagcagaacataaaagtaagtggagaggagaaatcaaagacaaatcgatggtgtgttctatttgtaggaaagcaggacatgatgataagaactgcttccaagtcgtcggatatcctgactggtggggtgatcgcccacgaagtgaaggcggatctagtggcgaaaatcagcaacgaaatgggacttcagctggacgtggcagaggaggcattgcccgagctaacgcaacacacgttgagaaatctgagctgcctggtttaagcaatgaacagtggcaaactcttgttgagatgctgaacaacggtaagacagatgagattgagaaaatgactgacactggtgcttctaaccatatgacagggtatttgaagaatttatgtcaacaaagaacaatacgaggatgtccggtgcctgatggagaaaaagtaattgccaccaaagaaaggacggtgattcttgatgggggtctcaagcttgaaaatgaccgcactctgaagacgctgattggagcgggtgagcgaaaagatggactttatctgtatcatggtgttcgaaattccaagggttatcatatcagtacaaaatatgaccttgatatcttgcacaaatgcatggggcatccatcctttaaggttgttaaattgatccctaatgtaactagtagtgatgattattcccgttctgtttggatatatttgttgagtgaaaagagggaagtgtctcaaacaatgataaatttctttgctctaattgaacgacaatttgataaacacgttaaagtgattagaagtgataatggaactgaattcacttgtttgaaacaatactttcttgaacatggcattctccatcaaaaatcatgtactggcactcagcaacagaacggaagagttgagcggaaacatagacatattttaaatgtagcaagggctctaagatttcaagggagacttccaatttgcttttggggtgagtgcattttaaccgcaggttacttgattaatttgacaccatcgcccatccttgatggaaaaactccatatgaactcgtccatggaacctctccttcctatgaccacttgcgcgtgtttggtttgctttgctatgcacacaatcaagatagaaagggagacaaatttgatagtagaagccgtaagtgcatttttgttggctatccatatggtcaaaggggatggaaattatatgatttagagagagaggtcttctttgtctcacgagatgtaaaatttgttgaaacagaattcccatttgaagaatcaatcaataatccttccccaacatcactggtgccccttattaatccatgtatggatgaggaatgtatgattgaaaatagccatgataatgacacaaatgcagacgtcagggtgggtgctagtgaagcaagcaatgaaccccaaagctttgcaccaccactagaaaaacagaattgcatagatgctgtacaatgtagtagtgaaggaccggaaacaagaagcaacattcctcccacctctccacttggaaaaggtcatcggatcaagtga

SEQ ID NO: 81060 - DNA, 447 bp, Glycine max
  Peptide Sequence Number=SeqID_197838
atggccagagaagatcagaaatttggcataggaatcgacctaggagatgatatagtgatcccattcaaaagaagatgctgtgtccatctcaatgttatgaggataatcaatgaacctactgctgcagctatttcatatgaccttgacaagagaactaattgtgctggagagggaaacattttcatttttgatcttggtggtggtacttttgatgtttttgatgtgtctctccttaaagttgaggataagatatggcagtggatcttccaagttaaggcgactgccggaaacactcaccttggtggacgggactttgacaacaaaatggtgaactactttgtagaggagttcaaaaacaagaatagagtagacattagtgggaatccaaaagccataaggaagttgagaactgcatgtgagagggcaaaaaggagtcctctcttatga

SEQ ID NO: 81061 - DNA, 423 bp, Glycine max
  Peptide Sequence Number=SeqID_197839
atggtgggccaaagaagagtgagacggagaggaaggggggccacaaaggtgaagggtaggcacggaggtcgtgcaacaaggctaagagtagagtggggtggagaggcctggaggagggtgaggcaggtaaagatggggaagccaaggaaggagaagagaggggaagtcaagaaggaggatagacgacaacgaaggtccaacatagaaggatggtctcgatttgggttttcgtgtaggaattgggaattgggaattggggaaaaaaataaggaaatggaaatgcagggaattagtcggggtgtcaatttggacccgcaaacgaggatcctcgcagggactgcccctgtgtggggtcccgtagacgaggatttttttccctcggggatggggacaaggataaatattcccccgtgggcatggtag

SEQ ID NO: 81062 - DNA, 1566 bp, Glycine max
  Peptide Sequence Number=SeqID_197840
actgttattactcagtattcaaacaaatttgctagactatttggaaagtctagtggtgccacaggaaagcttaaagtaatattccatgattttccaggaggtgctgaaggctttgagcttatgttgaaattctgttacaacaatggaacagctgatataaacccttccaatttgtttcttgcacgttgtgctgctgagtacatggaaatgaaggaacccatggctgatgtttctaacttgttggagcaaactgaaaagtcactccaagagattagctattggacttggtcagatattttgattggtctgaaacagtgccagagtttactagttccagattcttctgtgatggtagagagatgcttggatactattgtggggagacttgttttggccagtgaagcaagtccttgtccatcaactagttccacagacagttcttgggttcggtattcgtgcgactctaagagcaccgagagtgtaaaaacaagtttctctcgtttaacatggtggtttgaagatctcctgtttttgagtcccttgttggttgcaatgttggttaagtcaatgctttcgcgaaagatggaccatcttgtgatcagcaagtttcttctctactatcagaaggccaaattttctactgctactacacatgagaagtgcaagatcatagaaatggtcatagatatgcattatgatatggatctaagttgtgttccttgcaaaactttgtttgggattttgagggttactttgggattgaacataagcaaatgtagcaggaataagttggagactatgattggttcccagttggatcaagcaaccttggacaatttgcttgttccatctcctcatggaataagctatttatatgatgtgaaccttattttgagatttttgaaggcattcttgcggcgaggaaatagtctagtcactcccattcagatgaggaaagttgctagcttgatagatttgtatatagcagaaatagctcctgatccttgtttaaaaacttcaaagttcttggctcttgccacagcaattcccgattctgcaagagattcttatgatgagctctaccatgcaatggacatgtatcttgaggtgcatactcaattgtcccaggaagaaagattgaagatatgctgtggtttaaattttgagaagctttcacctcaagcttgcctacacctttctcagaacaaaaaatttccttcaaaatcgactgttcaagctcttatctctcaacaatctaagctaaaaaatttactccatgtcattcccagtacatcttcatacaatgattcaccttgcagctccagtggtgctgctgctcaaaagggaaagaaagacaaaaccagtgaacaagttgtgttgtattctggcaattttgatctttctacagacaatgagaaactcaaagcacatttacaaggaatgcagtggagggtcatggagttagagaaattctgtaggaaaatgcaaatccaaatggcaaagatcacaaaatcaaaagcatcaggccatagttatgcaaaatctttgcccaagctatgctcttga

SEQ ID NO: 81063 - DNA, 2625 bp, Glycine max
  Peptide Sequence Number=SeqID_197841
atgacgtttggaacgaaagcaggcctaaatgggaagctgtgcagaatgctcttgtttgtggagctcagggaagtaagatccttgtcacaacacgcagtgaggaagttgcttctaccatgcggtcaaaagaacacaggctggggcaattacaagaagattattgctggcaattgtttgcaaaacatgcattcagagatgataatcttccacgagatccaggatgcccagagattgtcaatgggaagtctattacacaacaaaccattttccggggaatgggaaagcttgttgcaaagcgaaatatgggaattaaaggacagtgatattgttcctgctttagcattgagctatcaccaccttcctccccatctcaagacatgctttgcttactgtgctttattccccaaggattatgtgtttgacaaggagtgtttaattcagttgtggatggctgaaaatttcctaaactgccatcaatgcagtaagagtccagaagaagttggccagctgtacttcaatgatctactatcaaggtccttctttcaacaatcaagcaaatataaagaaggatttgtcatgcatgaccttctaaatgatttggcaaaatatgtttgtggggacatctatttcaggttgggagttgatcaagcaaaaagtacacagaaaacaacccgtcatttttcaggttcaatcattaccaaaccatattttgatcagtttgtaacttcatgtaatgctaaaaagttgcgtacatttatggcaacaaggtggagaatgaatgaatatcactatagttggaattgcaatatgtgcatacatgaattgttctccaagtttaagttcttacgtgtcttatccctgtctcattgctctgacatttatgaggtgcctgactctgtttgcaatcttaaacatcttcgttcattagacctttcccatacttgcatatttaaactacctgactcaacatgttcactctccaacttgcaaatactgaagctgaatggttgtagatatttgaaggagctgccctcgaatttgcatgaactcaccaatttgcatcgccttgaatttgtaaatactgaaattataaaggtgccaccgcatctgggaaagttgaagaatcttcaagtatccatgagttcgtttgatgttggtgaaagtagcaagttcactattaaacaattaggagaactcaaccttcgtggaagcctatcattttggaatctgcagaatattaagaatccctcagatgcattagctgcagatttgaaaaataaaacacaccttgtggaactaaagtttgtatggaatccgcacagggatgattctgccaaagaaagggatgtaattgtaattgagaatctacaaccttccaaacacctagagaagttgtcaatcatcaactatggtggtaaacaattcccaaattggttatccgataattctttatcaaatgtggtgtccttggagttggacaactgtcaatcttgccaacatttgccttcccttggactttttccatttcttaagaaccttgagatttcaagtctcgatgggatagtgagcattggtgcggattttcacgggaataacacttcttcatttccatcgttggaaacattgaagttctcctccatgaaaacatgggaaaaatgggaatgtgaagctgtgataggtgcttttccatgtctccaatatctttctataaagaaatgtccaaagctgaaaggtgacctcccagagcaacttcttcctttaaagaagctagaaattagtgactgcaaacaacttgaggcttcagctcccagggctatagaactaaacctacaagactttggaaagctgcaacttgactgggcttctttgaaaaagctcagcatgggcggacacagcatggaagcattgttgctggaaaagtctgatactttgaaagaactggaaatttattgttgcccgaaacataaaatgttatgcaattgtgaaatgagtgatgatggctatgactctctaaagactcttccggtagatttctttccagcactcaggactcttcatctcagaggcttgtataatcatcttgaagttctggcattccgtaattgccctcagttagaatcattgcctggaaacatgcatatactgcttccatctctgaagaatctactaatagatagttgtccaagagttgagtcattccctgaaggaggtttgccatcaaatctaaaagtgatgtatctctataaaggctcctcccgactcatggcctcactgaaaggggcttggggagacaatccctctctggaaaccttgcggataggaaagctggatgcggaatcttttcctgatgaaggtttgctgccactctctcttacttatctatggatctgtgattttccaaatctaaaaaaactggactacaaggggctctgtcagctctcctctctcaagggattgattcttctaaactgccccaacctccaacagctaccagaagagggtcttcccaaatccatttcacatctttttattgatcactgccccaacctcaagcagcgttgccaggacccaggaggcgaagactggccaaagattgctcacatttcaaccgtggatattaggtag

SEQ ID NO: 81064 - DNA, 1669 bp, Glycine max
  Peptide Sequence Number=SeqID_197842
catcaagcaggtagggttcttcaccaaggaccttgaattgggtctctttgaccctttcaaggatgtgaagaatggtgttctgcttgacgaggaggaaattgttgcagagaatgaggctgttgataaggggcagggtgttacggatcaaggcaatgatgcatgtcgtcatgatgatgagtgtggaatctttgacagcacaggaagcaagaccttgtcgatgttaaggcaggtctatggtggtcttgtaaaaatggatgacataaaatcatctcagatggaacttatcaatagaaaaggctcaccaacggtgaaccttgggtttgtcgagccttggactggtgaggactcaccaagggtggaccttagcttttgcgagccctttggaggatcgactagggaattgtccgacctgggttttgggtgccatgctcttgcatacatgtcacttatcatggatggcatgttgaaaggctcgtggttgaacctttgtgctgtatctcctcactactcggagtttggcagcttcttccctgatccttgccatttctgggacctctatgctagagagctccttgacaccgttagacttgttgagtatagtacacaaggccctaaggatgactctgttagctgcctctgcctaaccgttggtctgaggatgttcgacagagatgaggtatttgattgctcctggggcctttggcaatggtcccaatatgtccgtaccccacatggcgaagggccaagtggagctcaaactttggagattgtcaggaggagtatgtggcacatctgtaaactcttggcattgtttgcatctcttggtaaagtcgagggcgtctgccctgagtgttggccagtagtagtcggctcgcaccactttggtggcaagggagcatcctccagtgtggagaccgcaaatcccttcatgaagttatcttatgacatacgtttcttggttgatagtcttgaggtgtccggccttcttggtgctagccagcttggagagcaggtctgctatggtattgctttccttggggatggtgatattgtcagggtctttgaggatgatccctgtctcactttcttttacgttggatgcactgtcaacgtaaaggttccaccagtctggggtggttcgtactggatgtcaaactctaaaagttctacaaaccaggtcaccaaccttcctgcgagttcagcgcttctcagcgttctagagtatgcggttggtgaaataaacagggagttagtgcttcctttcctcatgagtagaggtactcctggactgggtcgacttaaaactgacggtgtggctatggtcttcttgaaagccaggaaagcttgttcgcaagtctcgaagaacctggacagggatgctggcctaccatttaacttctggacttcttggacattggcacaccctgttaagatcagtgtagtcgatgcacattcgtcatttgccgctggccttttttaccatgacaccctttacaccattcttctcccatcctcattttcttctgtgatattggtttggcctggggacaaatggcaacatgtcagtgatgctctgatgcttatggctggtgaggtccctactaagctgcatacattgcctgggattaggtccaagctgcaccttgacaagctcttcgatgggttttag

SEQ ID NO: 81065 - DNA, 927 bp, Glycine max
  Peptide Sequence Number=SeqID_197843
atggttagcactcaatctagcctcagacacgagacccctctcgaagactcccatcctcatccagcagctatgacagacatagatactttacaacaactccaaaaccacattgtagagacggagcgacgtcatgaggaggagctgagaaagctaaaggctgaccatgataatctagaggcttgtatcaggcacccaaggatgcatcatccaacagggcaaactacttgtcggcatccctttgtcgaccgtattgtggaggatgacatacccttgggatggaagccattaaccttgaatgatgagcaccgggatgccttcctgactcatacgaacctatacactaataacgacgcgattctacgttgtgtcttcccaacatccctcaagggggcgacattgacctggtatgatggacttccacctaggtccatagacaaattcaacaccctcatcgaacgcttcagtgcaaagtacacaaccaatagatctcatcgcatgaccttagtcgccttggccagtctgcgacaagtagacaacaagtctcttagaaaactcatggacagatttgggcgcatagtcgtccaaatccaaaatattaaccccggggtagcgttgcattccatgctcctcgccctacgctttgacaagttcatgaataatctatgcaaacccccctcccccccagtagcatggtcgagttgtgcaagaagtaccaagaccgacttacacaagtcgaacaagaggcataagctagacaagcacaagtctttcccaaaagggctcaagtatgagcgttacacatccctagcggtcaattgcactacaattctggaggaagctttcaacttggagaccgaacaaccaccaagcaggagcaagacccaaatgacaccaagagaagaaccttatgaaccacaaagcaaatag

SEQ ID NO: 81066 - DNA, 333 bp, Glycine max
  Peptide Sequence Number=SeqID_197844
atgcctcgtgctatatgtgagaaacttgaccaaatctcttggaattttttatggggagatacttttgagctcaagaaagtccattgggtgtcttgggaggtgatttgcaagcctaaagatattggtggcttaggggtgttggctacaatggttattcaggatctaaatgaagatgatgtgatgaagaaggtgagagacgtgtttgttgatggagttggttggtgtactgtccagggtccacaaaatacacatgacaccctacatggcactctgagacacgagtcaaccttccacatcagctttgcaaaaggagcacggatactcggcccttag

SEQ ID NO: 81067 - DNA, 193 bp, Glycine max
  Peptide Sequence Number=SeqID_197845
tgagaatgctcggaattgggttgtgaacatgatactcaaatttaacgatgatccaacggggtatgagtctgagatcgtcatttttatgaggcaggtttggtgggttacagaaaaaagaaagggttctggggaggaggagagggaaaacgaaattgaagtgataagcagtcgtaaaagttactgtctaacctaa

SEQ ID NO: 81068 - DNA, 1224 bp, Glycine max
  Peptide Sequence Number=SeqID_197846
atgaagagggagtttgggcaattctcgaagcttctgcatgaagcttcccagatacaaagagctattaatgttgctttggtgaaggaattttatgctaatctctacagctctgagggtccttcaccaaagcaacccagagttaaaggccacctggtgaagatagacgtagacagcctcaacacatttctagagattcttatagtcctagaggagggggagacattacccatctactctaggtactgtaggttacccacagaccacagagagattgaggttgctctctgcatacctgggagggggttcattttgaatgctgaaggccatctgaggaggattctcaagaaggatctgactaccttggcccaggtgtggagtgttctctcttactccaacctggcccctacatctcatacattagaccttacgatggacaaagctaggttgatctttggcctggtctctcatatggatatgaacatcggcgctctcatattaggacagatgacttccattgcccagtctaactcttttagacttggcctcacatttgagtgcctgagcccggtcattaacttggtctacatcaggaagaactgttggaacattgatgatctaacagttgctttccggggggctaggagggtgaggccagctgatattccatcttcttctacagctccaacacctactccagcatctacttctgcagctccttcagttccagctcatgttgacttgcagcgttttgaagctatgcttcaaagtatccatcagggtcagattatattactgcaaagtctacaggtggtagctcctccaggatccatcctatcaatggagcagttcttagagagggtagcctggcttggggcccaaccttctcttgatagggaaggtgaaggtcctacagtccaggtaccccaacaggtacaggatgcttcctctgagaccaccattccagagccattcactcttcatcctgaggtaggggaagaacaggcgagactagagactgctactactcctgagagatcccttgagggcacatcagagcctcctactccagtggcagacctctcctcatcacagcctgcatctgacccttccactcctgtacttgacatactagaggaccaaaccacaccagtcctggcactgaacacctctcctccagctactccagtacttcacttgacagataaggaggatgctcagacttag

SEQ ID NO: 81069 - DNA, 228 bp, Glycine max
  Peptide Sequence Number=SeqID_197847
atgtttaggaacccaaagacttcctaccaagcagttgttagtttgcattttgtaccaccttggcagtgcttagtcttcttgtctatctatggtcaacaagatccacttaaactgctacaagaacacagtaaaggattagacgaaacatacctaggtgaggtggtgaaggagaagaagcacagagttgtcacgatgctcgagtgcgacgaacatgatgctcgagcttag

SEQ ID NO: 81070 - DNA, 252 bp, Glycine max
  Peptide Sequence Number=SeqID_197848
atgggtggagctgaatataactttaaagggtgttatgggggttctgtggattggcatatttgctttgttgaagttacttaccaaatatggagacttcattttttgggtaatacagattgtaagggggtaatggatacaattagtgactccaaagctaatgtttctgagcttgggtctattgtttctgagtgcagattcctacaattagccaagttcaatgcatacaaactacacaattctttattggcataa

SEQ ID NO: 81071 - DNA, 501 bp, Glycine max
  Peptide Sequence Number=SeqID_197849
atgaagagggttaattggaattcttcttccgatttgactccttgcaattggactggtatgcttcatggaccccttctgacccctatttggaaaattacaacacttagaaagctttacttgtgtgaaaattacatgtttgatgaagtgccagaggagcttgggaatttagtatcacttgaggagttggtcacttatagcaataacttaaccagaagaattccatcatcaataggaaacttgaagcagcttagagttataagggcaggtttgaatgcactctcagggacaatacctgctgaaatcagtgagtgtgagagcttggagatattggggttggcacaaaatcagctagaaggttcaattccaagggagctacaaaagcttcagaacctcaccaatatagttctgtggcaaaacactttctctgggaagattcctctagagattggaaacattagtagcttggaactacttgctttgcacccactaatttatatataa

SEQ ID NO: 81072 - DNA, 174 bp, Glycine max
  Peptide Sequence Number=SeqID_197850
atggcagcgagactcaacttttcaatggcagtgacaatgggtctcacagctagacaaaatgacacgaacctgtcacgaaagtcttcagatgttaatggagaagaagagagcaccggagaatacacagagaagaagagggtgccagagaatacaccaggaagaagagagcgttag

SEQ ID NO: 81073 - DNA, 267 bp, Glycine max
  Peptide Sequence Number=SeqID_197851
atggcctcaacaaatttcttattcccagaaggaaattccatggtagctgccattatagaatctaaaaatctatcttctatgtctcttgccacattatttgaaaagttgcaggaacatgagatggaattgcaaagactcaatcaaaatgaagaaaacgacaaaagaaaaaggggaatagcactcaaagtctcatcctccatccaagaaggtagcgacaacgaggacttggatgatgaagaagatgattctcaagaaatcaaagactaa

SEQ ID NO: 81074 - DNA, 219 bp, Glycine max
  Peptide Sequence Number=SeqID_197852
atgcacgaaacacaatgtggaccactacgggtacatagaatgaatcgaaaagcttggttcgagcaaaataggggaggtggttgccgcccagctcgcccaggcgagctcagctcgcccaggcgagctaggttgcttcctccagaagcaaccgccttctggaggaatattctggagggcccaagtgggcctgggtgctatttgcacccctatttttactaa

SEQ ID NO: 81075 - DNA, 528 bp, Glycine max
  Peptide Sequence Number=SeqID_197853
atgaggagaatgcctgtaagactaaaagattaccacatgttccctgatggtgcaaacatagatgagggtgagtttgtgatgaatatagccttgatggctgctatagaaccagtaaagtttcaggatgccattaaagagaaagtgcggtcaaatgccatgaatgaagaaataagagccatagaaaggaataaaacctgggagttagtgactttaccaattgggaagactcctatagtggatgaagaagtttgtattcagcaacctcctagatatgaagtcataggcaatgaagacaaggcaactaaggatggtggagtcctgctaatatgcctctatatggatgatttgctgattacagggagtaatgcaattgagatagaaaagttgaaggacaatctcaaatttgaattcgagatgtcagatttaggcttatcatacttccttggtattgagtttgatgaaactaaggatggaatagtgatgcaccagaagaagtacattaaagaagtattgaagaggtttaggtag

SEQ ID NO: 81076 - DNA, 1098 bp, Glycine max
  Peptide Sequence Number=SeqID_197854
atggatatcagcaagcccattcttggacatggaaatgtctcaatgaaaactttgtatggagctacaacaaacaatccttgtgtaacaaaaggacattgttatggtggcaataacagaggagaccataattcattgtttatgacttcaagttattcttttacaagaaccaacaatgcatccttggtagcgtcacttccaaataaggagaccaatccttttttaacgaatggaaattgttatggtggtaatagccaaggagaccataattcattgttcatgccacctaattattcttttacaagtagcaacaatgcatccttggtagcgccaattccaactaaggggatttcttgtgtaacaaaagggaattgttatggtggtaatagccaaggagaccataattcattgttcatacctccaaattattcttttacaagaaccaacaatgaatccttggtagcaacaattccaaataaatggaccattcctttttctcagtatgtgaaccatccaatttatatgggttcttctaataatcatattggtcacgcaccaagtgtaagttctggtataagtcatcaatttgatgctagcaattcacaattttttattgatgatttttccataccttttagaagcaaatttcaaaatatcaaacctaatggtatccatctttcatatccaatctttgttagaaatccttctttaccaggttatcacatgactgaacgtggtttatccatattccctgactctcttaagcctttttttgttgatacccaaacacattctgttagcttaaacaatattcaccaaatttgtgagagagtgaaaaaacacaatagagataaagtccaagaaaaaagttcaatgatgaatccacccaaaaggcccaatatcaactatggtccacttgtctatcatgaaagagagatgttgcaaaagaatgaaacacttttttctaccaaagatgcaaagcttaaagatatagatgcaattgtcttcaatgatgaaggaaagattggttctaattcaaggagcaaaaataaagtaaaagagcaagaagatgatgatttggatctttcccttcatttatag

SEQ ID NO: 81077 - DNA, 796 bp, Glycine max
  Peptide Sequence Number=SeqID_197855
atgagctcggataagaaacagtcccttggcgcagtcactctggcggcgatcggcgtggtgtatggcgatatcggcaccagcccgctctataccctgcgcgagtgtctctctggtcagttcggctttggcgtggaacgcgaggcggtgtttggctttctgtcgctgatcttctggctgctgattctggtggtttcacttaaatacatcagctacgtgatgcgtgccgacaacgccggggaaggcgggattctgacgctgatgtcgctggcggggcgcaataccggcgcacgcgccacggcgattctggtgatcatggggctgattggcggcagcttcttctacggggaagtggtgatcacgccggcggtatccgtgctttcggccatcgaagggctggagatcgccgcgccgagccttgatagctacattgtgccgctggcgattgcggtactgacgctgctgtttgtgattcagaaacacggcaccggcattgtcgtttccgattcgcctggcatggtttgtggtggtgctgccgtcgctggtgctcaactatttcggccagggcgcgctgctgctggagcatccggaggccatcaaaaacccgttcttcctgctggcgccggactgggcgctgattccgatgctgattctcgctacgctggccacggtgatcgcctcgcaggcggtgatctccggcgtattctcgctgacgcgccaggcggtgcgtcttggctatctgccgccgatgcgcatcgtgcacacgtccgaagaggaatccggccagatttatattccg

SEQ ID NO: 81078 - DNA, 188 bp, Glycine max
  Peptide Sequence Number=SeqID_197856
agcaatgtgagaaggataaggagcgtgttctggttcattgcatgtcaggaaagagtaggtctccagctattgtgattgcatacttgatgaagtccaaaggatggagacttgtacacagttatcagtgggtaaaggaacggagaccttctgttgaattaactcaaggtcacaggctcacagctcactaa

SEQ ID NO: 81079 - DNA, 2115 bp, Glycine max
  Peptide Sequence Number=SeqID_197857
atggagagtaagtttgatgacaaagcttggatctgtgtctcagaggaatttaatgttttgaacatatcaagagcaattcttgactcacttactgattcaactgaaactagtgatcagctagaaattgttcatacaaaactgatagacaaattgagaggaaacaagttttttctcgttttggatgacgtttggaacgaaagccagtctaaatggaaagctgtgcaaaatgtaggatccttgtctcgacacgcagtgagaaagttgcttctgcgatgtggtcagaacaacaccgcttgcattgcagcaattacaagaagattattgcaggaagttgttcgcgaaacatgcatttcaaggtgccatgagctatcactaccttcctccccatctcaagacatgctttgcttactgtgctttattcccaaggattatgtgtttgacagggagtgtttaattcagttgtggatgactgaaaatttcctacactgccatcaaggcagtaagagtccagaagaagttggccagctgtacttcaatgatctactatcaaggtccttctttcaacaatcaagcgaaaataaagaggacctgccctcgaatttgcatgaactcaccaatttgcatcaccttgaagttgtagatactgaaattataaaggtgccaccgcatctgggaaagttgaagaatcttcaagtatccatgagttcttttgatgttggcaaaactagcgagttcactattcagcaattaggagagctcaatcttcatggaagattatcatttagggagctgccgaatattgagaattcctcagatgcattagctgcagatttgaaaaataaaacacgctttgtggaactaaagttaaaatggaatttggactggaaccctgatgattctgccaaagaaagggatgcaattgtaatagagaatctacaaccttcgaaacacctggagaagttgtcaatcatcaactatggtgttaatcaattcccaaattggttatccaataattctttatcaaatatggtgtccttagagttgggcaactgtcaatcttgccaacgtttgccttcccttggactttttccagttctcaagaaccttgagatttcaagtattgatgggatagtgagcattggtgctgattttcttgggaatagctcttcttcatttccatcattggaaacattgaagttctcatctatgaaagcatgggaaaaattggaatgtgaagctgtgacaggtgcttttccatatcttcaatatctttctataagaaaatgtcccaagctgaaaggccacctcccagagcaacttcttcctttaaagaagctagaaattagtgagtgcaaacaacttgatgcttcagctcccagggctctagaacttgacctaaaagactttggaaatctgcaacttgactgggtttctttgaaaaagctcagaatggacggacacggcatggaagcatcgtttcttgaaaagtctcatactagtctcgaaggcctgaaaatttattgttgcccgaaatatgaaatgttttgcgattctgagatcagtgatggctgtgactctctaaagacttttccgttagatttcttcccagcactcaggatccttcatctcaatggctttcgtaatctacacatgattacacaggatcacacccataatcatcttgaacatctggagttcggtatgtgccctcaattagaatcattgcctggaagcatgaatatgctgcttccatctctcacgttgctactaatagatagttgtccacgagttgagtcgttccctgaaggaggaaacctagatgcggaatcttttcctgatgaaggtttgctgtcactctctcttacttatctacgcatccatgattttcgaaatctgaaaaaactggactacaaggggctctgtcagctctcttctctcgatgaattgattcttgtaaactgccccaaccttcaacagttgccagagaagggtcttcctaaatccatttcacctctttcaattgttggctgccccaacctcaataagcattgccagaaccctggaggcgaagactggtcaaagattgcccacattcaaaacctggatatactatag

SEQ ID NO: 81080 - DNA, 462 bp, Glycine max
  Peptide Sequence Number=SeqID_197858
atggaaaatgtattcgctcttgtgtattgcaatggtgacgtgattccatcatatgaagggatagtgtttgaatgccctggtgatcctaaattcatcacaataagtgaggacatgtcgcttactgccttaaggaaaagaatttttgagtccaacggaggttgcataattttaatacatcctttttaccatcaaccaatctacgtaggtgatagttgtgttgaatacgattgtatggagctcaaaggcgacgatgatgtgggaaaaatatttttcatctattcagaaattagtaccaaagacttaattgagttgaatgcaacttttgggcgttctccaaatgaaattcttgtcctggtgcacaaaccaaagaaaccaagaacgcttgatgagatcagtgatctaatgcgtgatgaatctgagttgtcattgcacaaactacttattgatacttttttagaataa

SEQ ID NO: 81081 - DNA, 402 bp, Glycine max
  Peptide Sequence Number=SeqID_197859
atggtttggaaaggtggggacatggaagtctgggttttcagtgatgggggcattagccatgaagctatgccaagtcatcacttaactgatggcaggaactcgatacaaaatgagcatgctgaaaagtatggctatggtgtagtggagcgttttgttgggcatggtgtgggaacagtgttccattctgaaccaattattatgcacaatcgcaatgagaaggcaggtcgcatgattgaaggtcaaacatttacaattgagccgattctttcgatgggaagcattgattccattacatggcctgacaactggacaacaataacagctgatggtagtccggctgcacagtttgagcataccattttgataactaagactggagccgaaattttgactaaatgttga

SEQ ID NO: 81082 - DNA, 222 bp, Glycine max
  Peptide Sequence Number=SeqID_197860
atgagatcattggttgttggtgaggttaccgcaacactggaagaggccatagatggagtggaaggagacggggatggtgaagttggcaaaggcggcagagttgatgagggaggtgaggagcgagttgacggtgcaaaggggtccaagctaggtgaccgcatgcgacgcacaacaagagcaaggttgttggcgaggttgccgcaacattgtaagaggccatag

SEQ ID NO: 81083 - DNA, 984 bp, Glycine max
  Peptide Sequence Number=SeqID_197861
atggcgtcgtcggagacgtcgagcatggcggacctgctagtggtgctggggcttgagcgaaatggcgttgtcagagacgtcgagcgtgacaacgcagaagaggagtacccacacgtgcttggcattgttgtcgtggttgtggagctgcttgtggtgttggagtgtggtgaagcgcgttttggaagatggtgtggaattggggtggaattggaaggagagaagggagaaagggctcctttaaggaggcattcatcaatcatcaccatcaatggcttccatgggctctctgaagatgatttcgtccctcaaactctcccgttcaagttgttctatctctccccttcaaacccaaaagcaactacccctcaagtatctacatccagaagaagtaccaacaagaccactaccactgcattcttcttcaataaccaaaagcagcatcaagattcctcacagccagccaaagttcaagaactctttgtctacgagatcaacgaacgcgaccgaggaagtcctgcataccttaggctaagccagaagccagttaactctctaggagacttagtgccattcagcaacaagatatactctggagacttgcaaaagagactagggataactgcaggcttgtgtgtgctcatccagcatgagcctgagaaaaagggtgatagatatgaggccatttacagcttctactttggaaactatggccacatatcagtgcaaggagcctatctcacattccaagacacatatctggcagttacaggaggctctggaatctttgaaggtgcttctggacaagtgaagcttcaccaacttgtgttccctttcaagctgttctacaccttctatttgaagggtgttcctgatttgcctcctgaactgcttgggaaacctgttgaaccttcaccaagtgttgagccttctcctgctgctatggctaccgagcctcatgcctgtttgccaaacttcaccaactga

SEQ ID NO: 81084 - DNA, 1020 bp, Glycine max
  Peptide Sequence Number=SeqID_197862
atgacttcatcattagtcaatgcaattatgtattacaatggcgtcatcacaacaactaaacatggttcaacatttgtaagcgtttcaccaaagattgttcaacttgacaacaaaatgtctcttgatgccttgaaacaagctattggaaacaagatcagtctaccaaatggtaaagtgtactactatacgtttgagaaactcaaggaaaagttcgaggaagatcagatgattcatataagccaagaagtcaacgacaaagccgatgagttggcttggcaagaaacttcacctaaacctgggcaactaaaaatgttcatacttcatttggttcttgaacctagtgtctcaggaaaagaacgtttgcgagtagaagaaaacccttcaggatggaagaaagagatagttgaatgcttgagtcatgagacactcccaacagacaagggaaaagccaaaaagctaagaacacagactaccaggctaactatgtgctccaagagctacatgagggcgtctgagctttgtgaagaaatgactccaatgccaaagggatgggaatttaatacatcagctggccaaagaactgcatcctatggtctccccttggtcgttcattgtttggggaatggatattctcggacccttccccacagctccaaagcaaaggaaattcctgttagtgaccaaaagcttaatgagtttttgggtggccttagtgtcaagcatagggtgacatcaatggaacatcctcagaccaatggacaagccaaagcaactaacaaggagacacctttctggctaacctataggatgaacgccatgtttccggttgaggtaggagaagtatctctccgaaggtgctacttcattgaagctaaaaacaatgaagcattgtggatagagttggacctcatcaaacaagcactagaagacgcagtcatcatgactgaagcctgcaagcagcgcatgacccaatgcttcaactctaaacttgcttcttgtcagtttgaagaaggggaccta

SEQ ID NO: 81085 - DNA, 198 bp, Glycine max
  Peptide Sequence Number=SeqID_197863
atggaaaaagttgcccggcaacggtgccaaaattacttgttcgaccagaatacttgtttactccctcttccaaattggtattacttgtttttatatgggagtggtcttaccagaaagtgcactaggttgccaaatgttcttgtgttctacgctgaggacaaaaataccaaacaccgattcctccagagtttggactaa

SEQ ID NO: 81086 - DNA, 324 bp, Glycine max
  Peptide Sequence Number=SeqID_197864
atggcttactccgtgtcaatcttagatggggtccatcaagagttttctttcccggaattctttatatctggaggtgacggcctccctcagggtgttgtcgaaaatcaggttgcacgtgttcggcatgtgatcaacttgcatggctatgagacccgagagttgattgaagacttgaaatctgctagtggcatggaaatgcaaggtggcaaaagcaaactgggaactgattccaaaactctattaagaatattatgccacaggagcgactcagaagcctctcaatttctgaagaaacaatacaaaatacccagttcttcttcttag

SEQ ID NO: 81087 - DNA, 396 bp, Glycine max
  Peptide Sequence Number=SeqID_197865
atggttaagactagaggattaggccatgcgttaggtagggttgttgctagaggtctggggaaaggggatgatgatgattctgacgatgctccccagcgacgagtacctgtcattgttgacgatgttgtgcctgcagtacctgcggactcgcctgcggtaccagaggcacatgctactgtagttggggatgagccaatggatattggtgcacaggatgctacagatgagcctgagggatttcctggtggacccagggacccatcagtgcttacggaatatcttgaccatgttgcagccagtgtatggtctggacaggaatgtcctaagttgaagttatcctcccatgggaggaaggtgcataacttgggcaggcctgttcctgcaattgaggacatg

SEQ ID NO: 81088 - DNA, 502 bp, Glycine max
  Peptide Sequence Number=SeqID_197866
gccacaaggtccaacaatattggttaaagacaaggccaagaaggagtatataagtgagggtcaaccctcaccctttgagctcgcttttagggtcgaaaagcgagctttaggttcgattaatctcacttctggcacctcttctgaggaaaattctattaatccctatttgactactcaaccctcttctggtgacaattccactaatgtttatagtggagatcgattttcaaaggttgtcgtggttggaacattggccaaagtaatcgtggtggttgcacctcaagccatgggggatatgcccaacctgttcagtgtacagtgtcaaatttgctataaatttgaacatggtgcaccgttctgctatcacaagttggaagagaactatgtccctactcttcctccacctgttttacttgcacctgctcagacccaaactgctacagctcaaactgttcagtggacaccttcggttttggccttacagcaagtacaagaagtttag

SEQ ID NO: 81089 - DNA, 1248 bp, Glycine max
  Peptide Sequence Number=SeqID_197867
atgttgcatctaccaggcggtcagaacaacaccacctgcagcaattacaagaagattattgctggaagctgtttgccaaacatgcatttcatgatgataatcctcaaccaaatccaggattgggaaaacatattgaaaagtgagatatgggaaatagaggacagtgatattgttcctgctttagcagtgagctatcaccaccttcctccccatctcaagacatgctttgcttactacactttattccccaaggattatgagtttgacaaggagtgtttaattcagttgtggatggctgaaaatttcctacactgccatcaaggcagtaagagtccagaagaagttggccagcagtacttcaatgatttactatcaagatatttgaaggagcaaccctcgaatttgcatgaactcaccaatttgcatcgccttgaatttgtaaatactaaaattataaaggtgccaccacatctgggaaagctgaagaatcttcaagtatccatgagttcatttgatgttggtaaaactagcgagttcactattcagcaattaggagagctcaatcttcatggaagactatcattttgggagctgcagaatattgagaacccctcagatgcattagctgcagatttgaaaaataaaacacgccttgtggaactagaattagaatggaattggaaccggaaccctgatgattctgccaaagaaagggatgcaatcgtaatcgagaatctacaaccttccaaacacttggagaagttgtcaatcaggaactatggtgttgcacaactgtcaatcttgccaacatttgccttcccttggactttttccatttctcaagaacctagagatttcaagtcatctcttgatgggatagtgagcattggtgctgattttcatggtaatggcacttcttcatttccatcgttggaaacattgaagttctcctctatgaaagcatgggaaaaatgggaatgtgaagctgtgataggtgcttttccatgtcttcaatatctttctataagcaaacgtcccaagctgaaaggtgacctcccagagcaacttcttcctttaaagaagctacaaattagtgagtgcatacaactagaggcttcagctcccagggctctagaactagacctgaaggactttggaaagctgcaacttgactgggcttctttgaaaaagctcagaatgggcggacacagcgcggaaacgtcgttgaggaaaagtctgatactttga

SEQ ID NO: 81090 - DNA, 189 bp, Glycine max
  Peptide Sequence Number=SeqID_197868
atgtctttcaaccactttgagcttgggcctgaaagaaagaataacaagagtggtgtagggaacttggagttcagaaagaagagactgtatccaagtcacctatgctgcaatgagagccatgctcctgtattttgcctcagtgttggatctggccacgacagattgcttcttggatctccaagagattag

SEQ ID NO: 81091 - DNA, 558 bp, Glycine max
  Peptide Sequence Number=SeqID_197869
atggcgctcactgcttcgctcgctcacaactcatttctgaaaatcccaacagccattcatagcgaagcctctccgttatgttcatccttcatgggttctccgcctacactctcgcgctcttctactcttcccgggaaccagtcgctttcgaggaaccaattcgtggtttttgcgaggaagatttcgggattggaggaggccatgaatatcagaagaagttctccagtgtacagagatcgtgaacttcaagttgtgacaaagtttaagaaaaggcctccattaaggtgtgggagagtatcaccacgcctccctgtccctgatcacataccaaggcctccttatgtaggttcagatatacttccagaaattgcaagtgagcatcaagttcatgattatgaaggtatagctaaaatgagggctgcaggtgagcttgcagcgcgtgtcttaaactttgcaggaactatggttaggggcagtggtttcttcatacacttagacactggtgctgattatcatgactacttttttctctttctgctagaatcaataaccaattaa

SEQ ID NO: 81092 - DNA, 2630 bp, Glycine max
  Peptide Sequence Number=SeqID_197870
cttcttcctcactcttttctcttccttattacctttctagaggtgctggcctcgaacccagctttctgcttaacaattttggtgctctcgttgagagtcgaactcaagtgcgaaatagaatcatgcttcagaaaggtctcatacaacccagcacgagccctttctcttctctgatactattggtgaagaagagcggcgggtcatggcggttctgtgtagactaccgcgccttgaatgccatcaccgtctgggatcagtttctcatccccaccattgatgagcttctggacgagctcgaaggcgccagatgcttctccaagttggatcttctgcaagggtactaccaaatacgcatgcacctagaggatgtgcccaaaaccgcatttcgtacccaccatgggcattatgaattctgcataatgccatttaggctatgcaatgccccctcatcctttcaaacaacaatgaacaatcttttctgcccatatctctggcaattcattattgtattcttcgatgatatcttaatctacagcgcgtgcccggatgaccacctgcgccaccttgaattgaccttccaggtattatcagacaatcaattcgctttgaaaataactaagtgcttttttgctcaaaaccaggttgagtatctgggccatctagtttcgcataaaggagtggagcctctcgcttctaaggttgaagccattcagcaatggaggacactgagaacggtgagggaagttcgcagttttttgggattagttggattctataggcgctttatttatggatatgcttcaatagcggccccactcgtccaggcgcctatccttgccctgccggattatgagcatcccttcattgttgaaacagatgctttggggattggtatgggtgcagtgctctcccaacgcaaccaaccaatcaccttcttcagtaagccttttccactgaagttcctcaatgcctcagtttatgttcgtgattacagcagtagtgaaaaaatggagacagtatttactgggtcgttgcttcacaatcatcacttatcacatgagcttgaaagagctattaactcagtacaccttgactcacaacctgatcctgcgaaaaggtcatctatggctcccaaaaggattagccatgattcctacactattagtggaatatcacaccacccccaccggcgggcacatgggcgtgacaaaaaaaaaaccaatcgcttgctcgaaaatttcgattgcccagggctccgacaagatgtgatagattttgtatcaaaatgccttgattgtcagcatgttaagtatgaaactaagcgaaccgttggcttgctatgtcccttacccatcccttatcgaccttgggaagatttgtccttggattttatcataggactacccccgtttcgtggcaatacaatcatattggtagtggtggatagattctctaaagggattcaccttggtatgcttccggcagcacacacagcccattccgtcgccgcccctggcacacagctgcgaatgagctctgcgtatcatccacagagcgacggccaaacagaggtgttgaacagagtcatagagtgcttatgcgccttcgtccatggtcgaccaaaggagtgggaatatatcaagggagcttcaaccttggatgttgtggatgaaatgctcactaatagggaggaaacatttcaggtgattcaaaagaaactccttcgtgctcaggagcgaatgaagctggttgccgataccaaacgaagagaggtacactaccagccaggggactgggttatgctcaagctgtgcccatatcgacaggtatcagaaaagggcacccacgccattagtggcaagctagcaaagaggttctatggcccctttcaggttttggagcgcataggacccgtggcctatcgcttgaagctgccggaggaagcccgtatcaactttgttttccattgttcaatgttgaaacccttcaaaggatctccacatgaggtgccaagagcagaattacccaccaaactcattcaacaccaacccctcatttcccccttagctttgctggattaccgcagaacctcagagcacgcactattggaagtgttggtgcaatgggagggtctccctcctgatgatacttcatgggaattttgggagcaattgtgtgaagacttccaccttgaggacaaggtgaatctccatgggccaacggatgatacgaagcaaggagaagcagaagccaccaactcagagtcgttcaagcatcgctcatggcacggggctgtaacagaaggcgaagcactccgttgtgtcggggtctatctcaaggtgcaccgtcatgctgaacgtgagttttctgtcaaagtagtgacggccgagcgtgtcgatgttgccgtcaggggttacgttaacggcataagggagccaatgccgttagcggggttaaactgccccattaagacaaatgtcgtggaggccatgagggagttgaagctggagaacacgttggggatgagagggaaactgacatcgttttccattgtgtatttgcaggttttagctccacgcgttgttgcggcgtcgttttggtggtggatgatgggctttgtttggttttag

SEQ ID NO: 81093 - DNA, 312 bp, Glycine max
  Peptide Sequence Number=SeqID_197871
atggtggcgaaaaccgacgtgagcggcggaggagaggggcgaaatggtggtcttcaggttggtggtttgaataagcagaaaaacatgggtggtgaaggaagaaacagaaggaaatcaagcactgaagtgaacaatggagcagtgttggcaactgatggggtagatattaatgccaagatgaggtcaatccttgtggagtggttgatagaaatgcataggaagtttgagctcatgccagaaactctttatttgaccttgaacattgtcgatcggttcctgtctgtgaaggctgtgcctagaagggagctttag

SEQ ID NO: 81094 - DNA, 204 bp, Glycine max
  Peptide Sequence Number=SeqID_197872
atggaccaagaaagaatgcagagaggcaatcaagaggattggatgcttaacgaaacagattgcaagagaggcaagcaaggggaattcagtgtttgtgcgacatatttctatattttgggcagggatttttctttgaggagtgttatctctggcagagtgagtcaaggtgtttctacgctggttgtttctattttcttcttgtaa

SEQ ID NO: 81095 - DNA, 507 bp, Glycine max
  Peptide Sequence Number=SeqID_197873
atgatgacattggcgagccaggtagaaaaccttacttctctgacgaagttttccttgaggagcttatcaacttcttctttgatattgcgcgtcggcgatgtgccggtgctcgtgactggtgaggcctctattgaaggtgtcatctcgcggatctatgtgaaattcactgcccaggctggcttagtagatggttgtggctcggatttgagacccttcgtccatgatcatgacttaagtgccttcagccgctccttgacggttacaatttcccctatcagtgtagggaatttcattttcaaatggggtgtggagtctattgctccaagctcattaagtatatctgatggtaaagctcctagagagcttgtcctgaccaaaggtagtcatcaagtccagtctctggaaggttttctagtacaagatatcaatggaaatgccctagtcgataaggaacttggacaccatgaaattcgcaatgatgatggagacggccacggggttgtctag

SEQ ID NO: 81096 - DNA, 771 bp, Glycine max
  Peptide Sequence Number=SeqID_197874
atggcaaatgacgaatgtgcaccaactacactggtatatgtggacgacatagtgatcaagtctcaaaacatacaccaacatctggcggacttggaagaagtcttcggggaactctgcaaatacgacatgtgcctcaaccctataaaatgtactttcaagccaacactcagggcagacgcccttgactttaccaggagatacaatcaatgccaagagtttgcaaacatgccacgcactcctaacaatcttcacagtctgagctcccctttccccttcgccatatggggaatgaacataccgagaccgctaccaaatgccccaggagcagtcaaatacttactagtcatcatcgactacttcaccaagtggatagaaacaataccactatgggaaattacggccaacgaggtggagaaattcacctggaaacaccccacttacaagtacaacctcccatatgccattgtctttgacaatgggtggaacttgaaaccaccaaagaagtccaagaaatggcaaggattagagaagaagttgccaaactctgagcagcaaggcaatagaatacaaaggttcaaccatgagcctttcaacccgacgttctcatatggcgagtctgaggtgaagccaaaaaagatccccgagcgggaaagcttggccccaactgggaaggtcctttcagggtcacagccaaccttgacaacggagcataccgactacaagagatggagggcaaagcaattccaagaacatggaatgtcacacacctga

SEQ ID NO: 81097 - DNA, 156 bp, Glycine max
  Peptide Sequence Number=SeqID_197875
atgtcacttgtcatgggtggcatgtactggagtcataatggcggcatgtactggagtcataatgctagaagaagggcttaccaagggtggaccttgggttttaagagcctcagaggtacgactatggatgctcttgtcttgataagaaaaatgtga

SEQ ID NO: 81098 - DNA, 819 bp, Glycine max
  Peptide Sequence Number=SeqID_197876
atggcttctagcaagaaaaggcggaataatattaagaggtttgtggcaaacaatggtaacattgtgagcgatgcgaagggtttgtgtgaagtgaggagcggtattgggatgtatgtggacaagatatctttcaacagtgtgcactttggttggagcaaggtggatttgggtgttattgaagctatgatgttgaagatgggattctcaggaaaatggctagggtggatctttatgtgccttaaattggttgtgtactcgatctctattaatgtagacaaggcaaccgaagtggaagctacaaggatgcaacacattcttagaacgtatgaggaggcatccgggcaagcaattaatttcaccaagtcagagatcttcttcactcgtaatacaggtcaaaaggttcaatcaaagtttattgaaataatgggagtgatagactgcttgggcactgggcgccttttggctacatcaaagaccgagtttggaagagaatccaatcttggagtggaaggtggttgtctagagctggaaaggaaatcattatcaaacacgaaaggagatgcaagtcatggtattaattggcttaagtgggataagcttacgattagtaaaggtggaggaggaatggggtatttccctaactcgagtttcttggaggccttaatgggaaataacccaagttattcttggaggagtttatggtcttctggagagattgtgaaggatggggatagttggagagtggggaacgtgttaagcattagtgtcagtaaggatccttggcttagggagaaggagagtgcttttattagcacttag

SEQ ID NO: 81099 - DNA, 360 bp, Glycine max
  Peptide Sequence Number=SeqID_197877
atgggggaggttgttgagagtgagtcatattcatcagatggtgttcatgaacttgaattgcttctttcatttctgaacgatagttctattgaagcatgcagccaaggagatgttgttggtattcttttatttagtggcttgacagattcttttgcatatctgaattcaaaagagccaatttcacaagccgtcactgataaaaagggagatatcattacgagtctgcaaagtagattgtatataatctgtgatgaggtagatgtcgactctggtaacaaatattatgttcaaaaccaagtaagcaatgaaatatcggctgaaaagcctgttccccaactagtgttgcacttattggggtag

SEQ ID NO: 81100 - DNA, 270 bp, Glycine max
  Peptide Sequence Number=SeqID_197878
atggtggatgaagatgttgccaagatggcattttgcacacaccaggagccactctctttgatcatcttcatcatctacaattggtctttcatactttgtcacaaagtcaattctacctcaagcgttccaaatgcttgtttgatggccttcgagcaactcaaactcaccatgatggcagctccggttcttgctcttccagattttagcatgccatttactctggaaaccgatgcttccggcatcaccatgggggttgtgttgatgcaatag

SEQ ID NO: 81101 - DNA, 279 bp, Glycine max
  Peptide Sequence Number=SeqID_197879
atgggcccgaaatctaccctaaggctcataagaaccctaaggccttctcttgcatctctggcccaatctacttggagtttttctatccaatgcccttgcggagtaggattgcatcattccctcccccttgaaaaggatttgacctcaaatcccgagatgttgggtgcagataaccgcaaggtgtctctgcatgctatcggactaacgggtcatgatagcaggatggggtggtcgacaaaagcggggcttttgctcctacgtatcctcaatttgagatga

SEQ ID NO: 81102 - DNA, 616 bp, Glycine max
  Peptide Sequence Number=SeqID_197880
atgagcggcaagtacctttggtctaatgggtgcatgtacgagggtgaatggaagaaaggcaaagcgtgcggtggcaagggccggttctcattgccctccggcgtcacctacgagggtgagttcaccgtcgggagaatgcattgccacagcacctttattggcatcgacgatgacatgtctccaatagaaagcgcgtattgggcgagaaacgctatgccaacgctacaaaggagtccttgtggttcggttgatggggatgttaaggaatcgggtcatactgaaccaatggagctagctgccatttgtggaataataccaatgacagtggtgttgaaagacgacgcggaaatggtgaaagaattgaatgtagttaacatggctggagagggggatcacgtggtgattatcttgggaggatacaggggggcatgggatacacgttactgtataattgtgaatggtaatgtgttatgggaacggccactgccagaagggacgaatcattggcatcacagcgaacttcatggtgccgttgttgcaatggaagccgtttcgctcaccacaggcaaagtagtgaggcttccacctcttcaacacaaacttgaagccctctcct

SEQ ID NO: 81103 - DNA, 531 bp, Glycine max
  Peptide Sequence Number=SeqID_197881
atgggtgcgaagtttggacatggagtgatgatactatttgttataagtgcttcaatgttttcgatgagcatggccaacaaggactggtcctttggtttcaactacactgattggtggtctagattcgggaatcatgctcagaacaaaacacaacaaccacccaggcagatacttgtgggtggttctgagcattggcactacggtttcaactacaccgattgggccttcaagaatgcaccattttacctcaatgatactctagttttcaaatatgatgctccaaatgccaccagtttcccacacagtgtgtacatgatcaaaagttttgggagcttcatgaagtgtgacattgaaaaggctaaaatgttagcaaatcccacgcaaggtacaggagagagcttcaagtttgtgttgaagaggtggcagcctcactactttgcctgtggtgagcgaaacggcttccattgcaacaacggcaccatgaagttcgctgtgatgccaatgcttcgtcccttctggcggtggccatga

SEQ ID NO: 81104 - DNA, 217 bp, Glycine max
  Peptide Sequence Number=SeqID_197882
atgggttttttaactgtttgcggtttggtttgctcttccctcccctgcattctcgtgattgtgagggttcgcgctctttgtcaggttggtgctggtgagcatgttggtgctggagagcagagagatgctggtgagcagggggatgctgatgctggtgagcaaagagatggtggtgagcagagggatactgatgctgctggtgagcaaagagatggta

SEQ ID NO: 81105 - DNA, 1302 bp, Glycine max
  Peptide Sequence Number=SeqID_197883
atgcctgtgccaaataatattgattctgatcccttgaatttagagcagtcccctaatataaccaaaagatctctgagacagacacacagaccaagcaagtttaaggacttccatgtttcatacccaacttcaactgtagctagttattctacagaagcactgaatgcagagattaaggctttagaaattaatgatacttgggttttaactgacatgcctcaacataagaatgttattggctgtaagtgggtgtataagatcaagcacatatcagatgggtcagtggagagacataaagccatattagtggtcaagggctacactcaagtggaagggcaagattacctagacaccttttctccagttgccaagctaaccacagtgagacttctattgggcttagctgctaccaataaatggtatcttaagaaattagatgtgaataatgctttcttacatggtgatttaaatgaagaggtgtacatgatgcttcctcaaggtatacaagtagccaagcctgagcaagtttgtaagttgcaaaggtccctatatggactgaaacaagccagcaggcaaaggtatgccaggttgtcttcctttctgatatcacatgggtacaagcagtgtgcttcaaatcattctttgtttctcaagcatggattcaacattatcactactctgttagtttatgtggatgatattgttttgtcaggcaatgatttgattgaaatacaaggtattacacaattgcttgacaatgcttttaagataaaggatttaggtgacctgagatacttcttaggttttgaactagtatctactccatcagattatgctactaaactgcatcaacaatcaggaactcctctttcattggaagatgcttcctcttttagaaggtccatcactggttatgctatgtgcattggtgactcattgatttcatggaaatccaagaagcaagccaatgtatctagaagctcatcaaaagccgaatataaagcacttgccaacaccatttgtgaactacaatggcttacctatctgctggaagaattcaaagtagactttcagaaacctgccactttgtattgtgacaacaaatcttctcttcacatagttgtgaatccagtgtttcatgaaagaataaagcatattgagattgactgccacatagttggagagaaggtgttaagtggtcttgtgaagttgcttcccattccttctacacatcaattagttggtgtttacactaaagccctaatgtctggtgcttttaaatttctgcattccaaactatga

SEQ ID NO: 81106 - DNA, 201 bp, Glycine max
  Peptide Sequence Number=SeqID_197884
atggataagccgttttcaatcattgggccattgtgtgggaaagctttccgctccctgtggaggagggtcttacttgtaggggaaacgagggtggtggagaacacgcgccttgagagagggtggtggaaattttgcaaagaggcaaggggtgttcaaatgattgtgataaggaaggtgtcggtgcgtgaagggacaggatga

SEQ ID NO: 81107 - DNA, 330 bp, Glycine max
  Peptide Sequence Number=SeqID_197885
atgaaattgagaggcatgggaggcgtcagtctgaaaactgaccttgcagaacaaccactgatagatcatattgacaacgagaaaaatgttatagaacaaccacctatagataatactgacaatggtgtagaacaaccacctagagatgatactggcaatggtgaaaacgtgatagaacaaccacctataaataatactgacaacacaaatagtcataatttcaatcaagaactagaagacaatattttagaaataggagtagaagtgaatgttgggcataataacacttctagtgaagtacctacaaatatttatgacccaggactatga

SEQ ID NO: 81108 - DNA, 938 bp, Glycine max
  Peptide Sequence Number=SeqID_197886
aaaaggtcaaggtgtatcttctcaaaaaggctctttatgggctgaaacaagctccacgagcttggtacagcaagatagatgaccatttgttgagcatcgattttaaaaaaagcttgtctgaagccattctttatgttaaacatcagagcaatgaagttctgatgatttcactttatgttgatgatcttttggtgacaggaaataatgcagggatgattcaggaattcaaacaagaaatgatgaaggtttttgagatgacagatcttgggttaatgaccttctttcttggattggaaattaagcaggctgagtatgaagtcttcatctgccagaagaagtatgtcaaggaaattttgaagaagtttaagtttcaagaatgcaaggaattgtgtaaggaagatggagctgataaagttgatgagggatatttcagaagtttgattggatgctcgatgtatcttcctacaacatgtcctggtattttaaatgctgtaagcattttgtccaggtttatgcactgtgcaagtgaattacatctcagagctgctaagagaataattcgatatgtcaaaggcacaagtgattttggtgttaagttcacatggagcaaagaatttaagctggtgggtttctctgacagtgactggggaggttccattaatgatatgagaagtagtacatcaggctactattttactcttggatctagtgttttctcatggagctcgaagaagcaagagatcgtggctcaatccactgttgaagcagaatttattgctgcaacaattgttgtcaatcaagctttgtggctgaggaagattttaatggatctaaatctggagcagaaagaaagcaccaagatttttgttgacaatcaagctgctattgctatctcccataatcctgtgtttcatggaaaatcaagcatttcaacataa

SEQ ID NO: 81109 - DNA, 732 bp, Glycine max
  Peptide Sequence Number=SeqID_197887
atggttttcaattttgatgttgtgacagttagaccaagaatagaaatttctaatcagccttctccttcacaggtggcagagtggggaatgatgcgtatgtgtgatgctgaaagaagatttatggctaatgcattgcttgatatctcaaatgaatggtttatcctcttatcggagtcctgcattcccctccaaaacttcagcattgtgtacctttacatagcacgctcaagatatagctttatgggtgcagttgatgaacctggtccttatgggagaggacggtatgatggaaacatggcacctgagatcaacatgagtgactggcgaaaaggctctcagtggtttgaaattaaccgagaactagctcttaggatagttgaagacaatacttactatcctaagctcaaagaattctgcaaaccacacaaatgttttgttgatgagcactattttcagacaatgttaacaattaatactcctcatcttttggcaaatagaagcctcacttatgtggactggtcaaggggtggtgctcacccagctacctttgggaaggatgacatcaaagaggaattcttcaagaaaattttgcaagatcagacatgtctttataataaccacccatcttccctttgcttcttatttgcaagaaaatttgcacctaatgctttgggccctcttttagacatagcacccaaagctctaggaattggaaaaaggcatagcttctaa

SEQ ID NO: 81110 - DNA, 372 bp, Glycine max
  Peptide Sequence Number=SeqID_197888
atgctgggaacctttaaagaagatgtgaaaatactagacaatggaaccatcagtgttgatggtaagcccatcaaggttgtttcaagcagggaccctcttaagcttccttgggctgagcttggaattgtcattgttatagagggaacgggagtgtttgtggatggccccggggctgccaaacacatccaagcagttgccaagatggttattatcactgctcctgcaaagggggctgctatcccaccttatgttgtcgatattatgtttttcttgaggctacgaaagggaactgtgtccttggatgctatgctcaccacaggccatgcagttgaaatcaagcgattatatggagctggttatgaccataattaa

SEQ ID NO: 81111 - DNA, 981 bp, Glycine max
  Peptide Sequence Number=SeqID_197889
atgcctgactacccacaaatagttaatcaatggcagagcatcaaaggcataatcgatattatgcctacccacacagatatatgtggacctcaaaaaactccttcattagcaggtaatcgatattatgctgcttttattgatgatttcacaagaatgtgttggatttttttcttaaaattcaagtcagaagtggctggagctttttggaaattcaaaaaggcagtagaaaatcaaagtggcaagcaaattcagattctaagatctgataatggcaaggagtacacctcaataaaattcaatcagttttgtgaggaagctgacattgagcatcaactaaccactccctatactccacaacagaatgggaacaagcgtgacaagcttgataaaagagcatcaccaggcatttttataagttatagcactgttaccaaagcctataaaatttttcagccacaaactggaagcattgttgtcagcagagatgttcacttcgtagaagatgaagagtggaactgggatgagcttaagtctcttgcttcaagaatcgaagaagaagaggattggcagagtgaattggtagacgatgcccctgcaagaggaactagatcactctctgatatttatgagaggtgcaatattgtcatttgtgaacctgcagattttgaagcagcaaagaaagatcaaaattggatggctgtaatgaaggaggaattgtctatgattgagaaaaacagaacatgcgaattggttgatcgaccccaagataggaaggtgattggagtcaaatgggtatacagaaccaagctaaatgttgatggttctatcaacaaacacaaggcaagacttgttgtgaaaggctatgctcaaatctttggcgtggattacttagacaccttcgcactagttactcgtttggacaccataaggattttgcttgctgtagctgctcaaatgaattggaaagtgtatcaacttgat

SEQ ID NO: 81112 - DNA, 459 bp, Glycine max
  Peptide Sequence Number=SeqID_197890
atggcgtcgagtttgtggtcccagctccactgtgtcgatttggtcgccccgacaaatatgagatgggtgactcactttatacaccctttgcttttagagaaagatgaaggactcgatgccaacaatgaagtaactagggttgttacacgtggtgcttgtggagtttgtcgattagggttcagagggaggagaggttgcatatggtgtcgattaggggccagaggaaagggtggcataggccttggcttcaaggtcgaggagagtgtggatggtggcatgggatctgattttggagtggaaggagaaggggttggtggtggtgtaaaggtctttggaagcttctttgagggagttgagaatacggtgctcatctatgagaatgagaatgtacaatacaaagagaaaggtggatgggatgaaaatttgtggtgtttgattttttttttttacactttgtga

SEQ ID NO: 81113 - DNA, 240 bp, Glycine max
  Peptide Sequence Number=SeqID_197891
atgcaggcaacgttagcacccccggtagaagggaaaatgctcaaaggactatgtgtttgttatgttgtagttgcattgagtttctttagcgtagctatctctggctattgggcatttggatatcaagctgcaggtctcatttttagcaactttgtagatgattacagcaagcctttggctcccaagtggcttatttatttgcccaacatttgcacaatagctcaattattgcatgtttag

SEQ ID NO: 81114 - DNA, 150 bp, Glycine max
  Peptide Sequence Number=SeqID_197892
atggagttgaaactccaagagcagaagaggagctccattaagagtgctctgattgacacgaaattgcaaggattaataggtcacgacgcaagtgatagggtcatgggttggaaaggtcgccaaaaaaggacaagtggcattgaaagctag

SEQ ID NO: 81115 - DNA, 414 bp, Glycine max
  Peptide Sequence Number=SeqID_197893
atgttccactgctccaataatctgagaacccacaatatcactgtccttgacaacaaagtgaacttcagaagcaagatgtgcaacggggacattgaaatgctgtgtccaaatagggttctcactgtttctgatgacaaaagttctggcaatcacaacaccgggactcgcggacgaaaagatacagagcctgtgctggaaacaaacaacgaaggaaacaagcgaacgaagcagatccacaacaagaacaagtttaagcaacgatcaatcatccaactaacggaaaccaaactcacaactaagctagtaactaccagcacaagttcaagccaaatgcacaaaaactcaaacatgaaacaacgaaaaaaccaaagcagaagagaagatgttggaatatgcagcgagagtatcccttaa

SEQ ID NO: 81116 - DNA, 423 bp, Glycine max
  Peptide Sequence Number=SeqID_197894
atggagaaagaattgattgttggtgcaattgttgctgcttctcttcaggttgcaattgacaggttggcttctcgtccagttctgaacttctttcggcgaagaaaactcgatgacctgagaaagttgaaggagaagttgcggacgatggttgataataataggaaagcatggcttgatgaggtcaaagatgctttgttcgatgcagaagatccactgaatgtaatagattatgaattttttgaatgtgagttggaagctgaatttgaatctcaaactaaggctctacagtttcaagatcaaccttcgagtagttgggaattagttgaaaagagagagaagcataagtctcaagaatgcgtcaatgacaattcctgccaaattgttgaagaatataatctacatcaatcacgtgcctcacaatag

SEQ ID NO: 81117 - DNA, 216 bp, Glycine max
  Peptide Sequence Number=SeqID_197895
atggcgtacgatggtgcaggtcccgtaggtggttcgagttcgacatcgacaataaagcaagtgtttacttggtatggtgcaaccattgaaatggatggtgctactgaaactgattatactgctgatgagaaattttttttttgcagtaacaatgtagaattgtataaagtgcttcttaaagagcttgcagggatgattgacaggcaatttacttga

SEQ ID NO: 81118 - DNA, 234 bp, Glycine max
  Peptide Sequence Number=SeqID_197896
atggtaatgacgggaccaatgcaaatcgtcaatgataatgacgatttcctccacatgttgatccaaggcaaagtcgccagtccaaatgatgttttacattttttgtctccgcattatggacaccctggaagaggcgcaataacaagcaatcaacccaacaagtctttgagtggcagagcctccatgacagcagcacctcagctcgagttcgaacaacgaaagtctgcaaagtga

SEQ ID NO: 81119 - DNA, 501 bp, Glycine max
  Peptide Sequence Number=SeqID_197897
atggggaatggaacgtctgaagaagcagagaggtattggtttgctttcattttgtactctgtcaagaaattgatccagaaaaatgaggagggtgggaaggaagacgccgagaacactgggcttagtttgtgccgtatattgagagcagctaagcttaacattgcagatttttttaaagaacttccacagtttgttgttaaagctggtccaactttaagtaatctatatggcacagattgggaaaacaggcttgaggcgaaagagatgcatgccaatgctattcacttgaagattcttagcaagtactataaacgtgtgtttggagagttcttcgtgtcaactgacacaaatgctgaaaaaaactcatctattactgttcatgcatctgaatatcatcgatttggatggctgcttttcttggcacttcgtgtacatgctttcagccgtttcaaagacttggtgacttgcactaatggtttgatttcaatattggtcagttaa

SEQ ID NO: 81120 - DNA, 138 bp, Glycine max
  Peptide Sequence Number=SeqID_197898
atggaagacggcaagcccatgaatggcggcgaccaagtcgagtctcgcttcgtcgagttctgcaagcggggtaaggctaggataaatgttttggaaatgagtgacatggataaggaaaatgagttgagcgaagcatga

SEQ ID NO: 81121 - DNA, 894 bp, Glycine max
  Peptide Sequence Number=SeqID_197899
atgattgaacttcgagaactagatactgcacttgctattttaagacaaacacaactgatgggtgcaatgaaacaagagcagcctgaaagatatttgtgtcttgaacatctcgtaattagaacttattttgatccaagtgagaacttctctttcattggattttcagctcttgcaacagaagtaactataataccaccatcctcattgatgactttaattggtcaggctttgaagtggcaggaacatcaaggtttgagagggtactatcatccaattaatatttgttgtgctaggtctggttgtttcttttatcttttgggagcatggcaaagaagtggatctaggaagggagataaccttgcattgaaagttaataacctgatgacagactgcactgttttacccaatttgagttttgaatcccatgacagtgatgtagaaattgtcaaacccgatgtgcaaaaacctaaagcattcaagccgtgtgatatgaaatatattgattatacaccttgccaagagcaagaccaaatgaaattcccaataaagaatatgatttatagggaaaggcattgtccctctgaaaatgaaaaattgcactgcctcattccagcccacaaagggtacatgactcctttaccatggcctaaaagccgtgattattcctactatgctaatgttccttacaagatcttgacagtggagaaggctgttcaaaattgggtgcaattcctgggaaatgtgtttaaatttccaggtggagggaccatgttccctcaaggagcagatgtatatatttatgaacttgtgtcagttattccaattacagatggttctatcagaacaacactgagcactggttgttgttggatcaagtggtctcagaataattaa

SEQ ID NO: 81122 - DNA, 663 bp, Glycine max
  Peptide Sequence Number=SeqID_197900
atgaaacaagagttgaaagaggccatcaaaatggagttatcccaaatggcgtcacagcactcacccccggttgaggcaccagatctacaagtattagttgcacatgttgaaggtgatcattgtacacacctggttgcattgggaaaaatatatgatggggtatccaccatacacaacgtgccttatggtgatgatgtggtgaagatgtacaagtatcctttcttcataacatattttcatgtgaatgaaataatatcaggtgaaaaatgtttaaacatctctatactacaattgtggatgatgtttatggatgactggagtacaagtttgggtcatattttggtgtatggattctttgagcctcaatccatgcacaatggaaaggatagatgcaaccaatgtcaacattacattgaaacatgggtcaaggaatcacaacgacaagtctacctaagagcttacttgaatcatgaaatgaagacattaaacagtacttctgttggtaaatttcaacaacctacacctcactcgattgaagtaaagagtcatgttcataccataggctatgagtgtggctattatgtcatgcattggatattgaacatagtcagtggcggtttaaaaaatgaatggaccaagtgtttggtgatggaacaccgttag

SEQ ID NO: 81123 - DNA, 117 bp, Glycine max
  Peptide Sequence Number=SeqID_197901
atgggttatacagaagaagaacttgcaacagggagctttgttgaggctgaaaggaagaagggctctaaacagggctacgaaaattctcaggttgacagtaagttgcaaaatggctaa

SEQ ID NO: 81124 - DNA, 399 bp, Glycine max
  Peptide Sequence Number=SeqID_197902
atggttgatgactctcctaaaggaattcaagatgcttctttgaactcaactcaactagagaaccctcaaattaagcccataggactgccctcagtagaggaaatccatggtcaagacattttgaacaattgtgcagtgcgcagtgtttttagtggagtcctggatcaaaataactggtataacatgtggtctaggccatggcatcagattttaactttccttagggacagccaggtttatatggaggtacgagtcaatgctaggaaaggtgtgattgtagttggtgaacaaattgatagatcgttgttgaacaatgttcttgatatatttgttgagattggtatgggtgaaatggatcaatatgaacaagattttgagcataggttgaggattgcttga

SEQ ID NO: 81125 - DNA, 393 bp, Glycine max
  Peptide Sequence Number=SeqID_197903
atgaagctcaaatttggggaagctttgaagcatatcccttggaagaaagatagttatcctactgataggataatactccagaatactgatgatggtcaaatccgaacagagatttatgttccaaaacccgagtttcaaaaagtggaagatttggttgatgatcattctgcattagaacaagactgggaagactataatgctcaattgatggaagaattgttacacaaaaagagatatccttatcaccacccagtgtacggaagtctcgccagatcaaaagatccatctacttacaaggataaagtgatcgccattggtttgcctgcatcccctggagctgcagtagggcaggttgtgttcactgctaatgatgctgaagaatggcatgcataa

SEQ ID NO: 81126 - DNA, 141 bp, Glycine max
  Peptide Sequence Number=SeqID_197904
atggacaacaacaatcctggactgagtgaaccttttgtactactccaacatcaagctctcaacagatactgcagctttggcaaatgcgaccaatccactatcagaaacaaagcagcaccggcaaaggcacaactgcttcag

SEQ ID NO: 81127 - DNA, 486 bp, Glycine max
  Peptide Sequence Number=SeqID_197905
atgtctatgctttctccttgcgagtctcttcgatctttagtaattcaaaagggaactggttttggtagtgctagcctagccatgattgttcaaattgtgtccccaactttaacatctaacatagtctcagccttagtcaaaatacatggtggaacactcgaactactaaatcttgatggatgttggaaaattactgatgcaagctcggtcgcaattgcaaaaaacttcatagtgattaatgatctagatgtgtcaaagtgtgcaatcaccaatgccggtattgcaattctctcaagggccaatcaacctagcttgcaagtgctttccttgtctggttgttctgatgtatcaaacaagagtgcacctttcctgacgaaattgggccagaccttgttgggattgaatcttcaaaactgcaattcaattggcagtgacataatggagttgctagtggagaagttgtggagatgtcatattctagcttaa

SEQ ID NO: 81128 - DNA, 441 bp, Glycine max
  Peptide Sequence Number=SeqID_197906
atgggtgaagtagaggaggtgcaagagcagatgaaggctgacatggaggccatgaaagagcaaatggccacaatgatggaggccatgatgagcacgaagaagataatggaagccaatgcggttgcagttgccgctaccagcgctgttgctaaggtgaacctgacgcccccatctggcctcaaccaaatgaatcatccaacctcagatatggtaagcaaagatttgggaagtacgggcggcccccatgatgtgaaaattcaaaacgagctgccttcctgccatatgacttgcctcccaactatacaccacccaatgtggcgtacactcccaatgaggatgtcaataactccactcccatactcattgagagccgacgacctcatcatgcacatgtctcttaacccatgggggagacatatgaaataccccaccacaatctag

SEQ ID NO: 81129 - DNA, 363 bp, Glycine max
  Peptide Sequence Number=SeqID_197907
atgggatttctgatgctagtagaaggagatgaagatgcacaaaacaaaagaggacgcctaagggtgcatagatcgttttccttttctttcttcttcctctctctgatttctctcaatttctctcaatgttggaccttggaaccatttactcagcctccatcatgcctatttatagcaaaagatggcatttggggtcatggcagctcacccaggagagctggttactttacccctaagctatttggggcaccaggcgagccagaggctagcctgggcgagccagggttcagaaaaaagcttaaaatgaccctttttcccctctccttggttatttttcacatccttgaccaaaacatcgaatga

SEQ ID NO: 81130 - DNA, 1275 bp, Glycine max
  Peptide Sequence Number=SeqID_197908
atggatggtgtcgggtatttagcaggtccaccaaagttaggcctcatcgcggggtcagcaactctggtgactctgaagggtcagttgtgcgaatggtcagttgccgacaaaggtaaccctaacaaggctatagaggtatcctcttatgtgaggtcgagtgtcgaggcctcttgtagtgacaacgcaagtattattgccaaaataacgattggcgatttcaaagaagtgtccgtcaattactctcctaaggacaataagcctatccatctttgttgctatcgaatggacgcttatgagaggtcggattgggtgttcttagagaatgagtcgtctatcaacatgccaactactagggattttttctatgtttacgattgcattttccgcaatcttaacatagagctcccttttgatgacttcactatgagcatcctctatatattgaacatggctatttcgcagttgcatttgaacggtcaaaagaagaagatttcaagcactttagaggaaattgatgaaaaatatggaagaaaaagcattgaagaaggattggacagcttgctcgacgtgcaatccaggtttccgactaagcccttcgttttgcttttcaagtcctcggctctttttaaggatatgagagttatactcctgtcattcgagagcttggcgttattgtcgggaatgcctcagtggtttagcctaccgatcctcttctgccactgcgtccttttgccaaaaagaataagaagaaaaaggatcatagagagacagagaaggaggttggactttggcagagacattctgcaaggtgtcgatgcttcatttgcattggcaattaatgaagttgaagaaggagttggaggggatgaacaaggaaacaaatcaagcccttcatgcaaatatagaaagctcaagagggaaaaggatttgatggttgccttaaaatgtgaggtggatgcctttaaggaatcactgattaaagctcaagaggagattaaacaagggaaagagcaataccagttcctaatgcgtggttctcgggagaaggtgatcatggagcacaatgtcagctttaacaaagctttgaggcaagttgatcataagttcatgatccctcatgatgctgagtttgacatcctcatggatattcatgaagggacattgatgggtattcaaaaaggaaaccttgcaacgattaaggtgcgtccttatccgaataagggtatttggaagggaatcctcacaacgattaaaggtttttccttagtcaaatag

SEQ ID NO: 81131 - DNA, 351 bp, Glycine max
  Peptide Sequence Number=SeqID_197909
atgaagtctttcggttctgtaactggttttgtcttgccagacccaaagaataggttgctcctttggagtgtcctcatcttggtttcattgatttctggtgcttatttcgttggtaatgcattctttgcaaaggaatacaaacaaagattagcacgatgggggctaattcatacaatgccacattcaaaatttaatgcgtgcaagagacaatgcttgccttttggaagtgaggcattgcctgaaggaattattgctagaacatctaacttggaaatgcggcccttatgggactctggtaaagataatattgtgcagatcagactactggataacaatgacttgctacattag

SEQ ID NO: 81132 - DNA, 810 bp, Glycine max
  Peptide Sequence Number=SeqID_197910
atgaaagggcccatagagctgttgatgagattcgacaccaagaaggatgagtatatagatgtcatagtcaagtacatggtgatccatgtcagcacctcttataacattttgcttggccaactatcgattaatgccataggagctattgtgtttgctccacatctcaccatgaagttgccaatggatgatggatcaattgttatggaggttgcacgatcagtgataactcaagtgttggatgtcaacgccgacctttttgcatggttgatagtcaatatgcctagcatggatccaaactatcattgccatcggttgtcaatctgccgagatgctaaaccggtcatgccattcggcataaaaaatgctaatgctacttaccaatgtttgatcgataagatattcaaagagcaaattggaaataacatggaagtttatgtcgatgatatggtagtcaagtctaatgatgctgaaccacacgcttgtgatctagaagagatatttgcacagattcgtaagtataacatgcgactcgatccagaaaaaattgtattcagagtaggaggtgaaatttttttagggtttatgctttctcataggggaatccaagaaaactcggataagtgtcaggttgttattgacataaggagtccaaagaatataaaggagatacaaaggataattggtcagattgcttcactaacaagtttcctacccaatatagccgaaaaagctaaacacatcatgaacttgttgaaaagagcaaaagattcaaatgggatcaggggtgcgaggatgcctttcaagcactaa

SEQ ID NO: 81133 - DNA, 609 bp, Glycine max
  Peptide Sequence Number=SeqID_197911
atgcctcggcagaaaatctcgacaggggcattacccgatgtacagattccacgcatgctctctgacagcatggatacaggaaatcctctggtggttgtaccttctttccaaaagaaaggaaaaagcgaagagaaaagaaaaggagatgaggagagagcttacagcgggaggaatattgatccagtgaagaggaagacgatgcgggaaggaattggtgagtgggactttgttggtgacagcctgtctccagctgtgtcctccgaaccttccgcttcgtggataaaaggacttgcttcggctttgtccctacgtgtcattacaccctatatcttagttatgccatcctctgttaacgcaaaggctaaggtagacaagcttcttagcatcgtcgtcaacggccttgtttccgcgaccaccattgtcctcacctatgtcatcctttacggcaagggtgtctcacttcctcgagacggtgatcaacaacgaggggttgttgaggaaacaatggtggtaaggaaagaaaaaaaaaatgccagccgtgagaaattgcctccgacgacggcaaatggtggtcggaaggttgctgggagggaggaggagtacatctag

SEQ ID NO: 81134 - DNA, 402 bp, Glycine max
  Peptide Sequence Number=SeqID_197912
atggagtcatcttactcaagatccatacctttaaagtcagcactggtgaaggtacatcctcctcctgcaaaaccaccatctatgggtgttagcccgctttggcatcaccaatactttagtggcaatgacttattccaagatcctttaccggctagcactaagtgtaattattgtagcaaattgttggttgtacttgtgagttcttctaactgcatgaatttagctgcccgacaccggagatcatcaaaatccgatgtcggcttcttacagagactattaacaaagggtcctggtcgtaatgtcataaccagcctaggggtgaacgaagtactaacgaggttggataggcaagttactttctgcaagtggttggcttgcagtatgctggatactttcacttag

SEQ ID NO: 81135 - DNA, 483 bp, Glycine max
  Peptide Sequence Number=SeqID_197913
atggggtgtggagagggtagatgtacgaaacattacccatacaagtgggatagaggcacacagcagcatccaagtcctcaaggccatgaaggcaccagaaagcaagcctatttagcaccactgccaataccaatgtgtatggggccacctagaacatctacacacactgtcccagctttagagtgttggttgtgctggtggcttgaaatggtgcttgtgtgtgaagagcgttggatgaagagtgatattttggcatatgttgttaatgtttgtaaacataaagaactcacttcgtaccccattgcccagaggctcttcgctatgcgaagggctttgggctctccaaccacaacaactagcttttgtggtgtgactctcccaagattcttatcaattggtattagagacttccaccatggctctcagatgcaaatgagcagtgtgggaggtgatgttggcattgcagtgtttgcctgcgactag

SEQ ID NO: 81136 - DNA, 261 bp, Glycine max
  Peptide Sequence Number=SeqID_197914
atgaattcaattacaagaagcggatcgcttagtatcatcctcgttgttttcttctctttgcacttcattcttggtttttccgacgactcatcacctgcttcaaaagatgctacaaagacagaacctcatgccggaagaagcactagtgctatagttatcattctgtggcggaagaagaaaagggaggagcaatatgctcgtcttttgaaattatttgaagaggatgatgagttagagcttgagcttggcctaagggactga

SEQ ID NO: 81137 - DNA, 987 bp, Glycine max
  Peptide Sequence Number=SeqID_197915
atggagtacatgaaccagagaccaaaatatgattgccttctttttgatttagatgatactttgtatccactaagcactggtcttgcaaaagcatgtggccaaaacattaaaggtgagtgtctctttgccaataaagttcttggtaatgtgtttattgttttactctttattggtgttgctgacacgagtggtacaattgatccagactatatggccgaaaagcttggcatagagaaaagcaaaattgatgacttgtccaacctcctctacaagaactatggaacaactatggctggtttaagggcaattggatatgactttgactacgatgaatatcacagttttgttcatgggagattaccttatgagaatttgaaaccagacccagttctgaggaacctcttgctgagcctaccctataggagactgatcttcacaaactcagacaaagtccatgcagttaaggcactaagcaggctaggattagaagactgctttgaaggaatcatatgctttgagacccttaatcccatccacaaaagcactgtctctgatgatgaagatgacattgaatttgtggggggttcaggcacaaccaatccaaccacaaaaaaagatgctagcagctttcaaatctttgacatcattggccattttgctcaacccaatccccacacagttttgccaaagacaccaattatttgcaaaccatcagaaaatgccattgagttggccctcaagatagccaaccttaatccacaaagaactttgttctttgaggatagtgtccgcaacacacaagctggaaaacgtgtgggtcttcacactgtgctggttggaaaatctcagagaattaaaggagcagattatgcattagaaagcatccacaaccttagggaggcagtgccagaactatgggaagatgacataaaatcagaagttgcttatcctggcaagcttgctgtggagacatctgtgactgcttag

SEQ ID NO: 81138 - DNA, 102 bp, Glycine max
  Peptide Sequence Number=SeqID_197916
atggcatatgagacaagttcgatgtcatggattttgagactagagaagaagataaagttaggacctaaatgtgaagggattcaaagacagagcggtaaataa

SEQ ID NO: 81139 - DNA, 447 bp, Glycine max
  Peptide Sequence Number=SeqID_197917
atggccagccccatggacattcaaggccctatggggatttttgggcctcactgggttttatcgttgctttatcaaaggatagccttttacaagctgaaagataccgtgagttcggtgccaactctgcaacttctgaatttctcgaagccgttcatggtggagaccgatgcgtcgggaacatggataggagatgtcctttctcagtcaggagcttatgagtcagaccatccaaaccccagagtaacaattgtatctcgttcatcttcttgggaatcgcatttggttgcccaatggcctcaaccttatcccatcattattgacggagttccatacttcaccaatgggagggcacatgggaatcaagaaaactctggcacgtttgggggaaaactttgtttgggccgctatgcacaacgactttcaatagttcattgtttcttgccttga

SEQ ID NO: 81140 - DNA, 771 bp, Glycine max
  Peptide Sequence Number=SeqID_197918
atgcaaagtccagctgacataagtgactatgcgctaagtcgcaagttgcaggctaagtcgcagatgcgcgctaagcctaacctccaaggtcagcaagtgtggatattaattgatggcagtaatacccacaattttatccaagaacgggatatcgctcttcaggttcaagaccaacaattcttggtcaacttccatgtccttccgctatatggtgtcgatcttgtactcggagtcgagtggttgaagtcattgggtccagtcctcacatactacaatgacctcaccatgaaattccttctcgatggcaaaaatggagtcatcagaccaagcacgagccccttttcatctctggttttgctggtgaagaagcgtgacgagtcttggcgtttctgcgttgattatcgagctcttaatgccatcaccattaaggataggttccttattcccacggtggataaattattggacgaattaggaagagcacaatggttctcgaagcttgacttgcttcaagggtaccatcaaattttgatgaaggaggaagacatcaacaaaatggcatttcacactcatcacgggcattacaagtttctcgtaatgctctttagactgtgcaatgccccatcatcgttccaagctaccatgaacgacactttcaggccctatttgcataagttcatcattgtgttttttaacgatatccttatctataggaagacattggttgaccatctccagcatctgcaacaaacatttcgtgttctggaatag

SEQ ID NO: 81141 - DNA, 2175 bp, Glycine max
  Peptide Sequence Number=SeqID_197919
atgtctgagaaggaaatggaagcgagtaataaagaaatgattactttcagcgatgaaatagtgaaagcacaaaaagaagctgcagcaaaagagtgggaatgtttcgtggacatcttcaggaggaatgacaggaaggaggagttgttgtttgagcctttggacttggtgaagaacactgccattcatgtgctagctcgctcaggaaacaagcaatgcctcaaagagttactccaaatgctaccaaaaacaaagcagttagaagccttgaggaagccaaattatgaagagaacacacctcttcacgaggccgtgttgttccacgatgatccaaagatggtggatctcatcatgggtttcatgccatcgcaaccagacaaagacgcgcttctggagatgaagaataatcagaatgaaaccgtggcttttagggctgctaggtatgggaggctacgtgtgatcaagtatttgcatggcaagctgcagcccagaggcctccagtcttctaagcattttcaacccaatatatatggcggaagggagcgtcccattcttcacacttgtgtgctcaattttagttttggcgctgctatttggttgctgaaaaatgtggataaaagtttagccaaagaaaagtttatggttcagaagaaagagaaagagaatacaaaaatagttttgcaactgacctgtttaaagctgctagcgaagatgcagttggctttcgagagcacaggcaccctggaaatgggactcacaaagagactcctatatgaattgcttcctgaggatggatatgaatcagaattggaagatgacgcagaaaacaattcagtcaaaatcgcaagagatgaagaaagcagccagccgaatgatggaaataaaaagacaaccaaatcaaaagttggagttttctcaagaatcaactatgctttctggaaacatgcaaaagaccggttcagttttatcggtaaaatttgggatcaaaagaagagacataagtttgcagagcaactagttaagttgctattggacattgatgaggaatcatggaagcagtatcctttggtaccctttaacgagccaatagcactttcattggagtttcccggtaacgtcacagaaaagaaagaggatatgaagcttataaatagagttgaaaaagaggagagagtaaaaaaattacttgaagataaaaaaagtaaaaagaagctctactcagatgacaaagtcggaataatgtggaaaagtacacttttcatggctgcagcatcagggattatagaagtggtgaatctaatcgttggaaagtatcctgaagccatttcttatgttaacgaggatggtctcaacatattgcatgtggctctgaagtaccgtcagttggaaatctatgagttcatagagaaaacttcagcatttgagctattgacacaaagaataagtaaagataaacgtactatcttgcaccaagctggaagcatggagtattacagagaacaaggattggcaggtgtggcataccaactgcaatgtgagctagaatggtaccatcgagttagagaaaagattccaaagcaatacttgatgcatgctgatgaagatggtttaacagcaggagatcttttggacatagaccatgcagagatgcatgatgaagcaaagcaatggatgaaggaaacagctcagtcatgttccactgtggcagtccttattgccggtgttgtttttgcagctgcttatgccatcccaggaggtaatgaaggaggaagacccgtgttacgtacctcttctgcattcagaattttcactatcatggatgtcgtggctcttgccacctcattgggttcggtggtgatgttcctttctatactcacttcttcatttgacttgtgggaattccatagggcattgcctcgaaaactaaaatggggttttgctatgctatttttctcactcatcaccacaatgctagcatttgctgccaccattttgctcactattcatatggaggggaacaaaagctcaacaactttagcatacagtttggcctttgttattgtttctatatttgggttgacacaattccctctatataaaatggtcgaagaccaagtgaaggcaatgaagaaatggtgtggcccaaaatcgacgaaatcaagatccaacaaatcctaa

SEQ ID NO: 81142 - DNA, 597 bp, Glycine max
  Peptide Sequence Number=SeqID_197920
atggagatgagacccgtcacaagatgcatcaaaaccatattagaagtggacacgtacactcatgctcctccatcaccattctatttaagcctcaccccctcgatgcgaatgcacacacatccttccatatcaattaacctgctccttaatttcaccatgtctaatataaacatcaatcatccactaccaatagatgaggtggtgacctacaaggagtgtttgcataaccattcagcagcacttggtcatgtcacctatgatggttgtgtcaaatatatcgccggtgaggatgctctcttgtgtgcttgttgtggctgccaccgaaactttcaccacaagaacaccatttttaccgctgagccccaaactcaaacaccggatcaagtgcaagagatgaggtccaagaggaaaaagaggactaccttctcgtcagagcataagaacaagctgattaggtttgctgagagtgtggggtggaaacctcgaaaggaaaagaaggacgaaattgaaagcttctgctctgagatgggaatcacccgtaggatgttcattgtatggctcatcaacaaccgtcaccgggcaatcaataatgcttag

SEQ ID NO: 81143 - DNA, 171 bp, Glycine max
  Peptide Sequence Number=SeqID_197921
atggatgatggagttcctgaagggcatggtaaagccagtggctgccactgcagtggtgtgtttggctgtggccttgtccttctaccagaagcaggggctggagctagagatggttgtttccattattgttctcctaagatcttagatttgtctccaactaaagaacattag

SEQ ID NO: 81144 - DNA, 195 bp, Glycine max
  Peptide Sequence Number=SeqID_197922
atggcgtccaaccgaagaaggctcgcggaagaaggctcgcggaagaaggctcgcggaaggaagaacgagaaggctcgcggaagaaggctcgcggaaggaagaaaagcagaagcaagaagaaggcttagtgattccgggagaggagaagaaaactatttcaatattttaaacttttttaatgaaggggaacaatga

SEQ ID NO: 81145 - DNA, 336 bp, Glycine max
  Peptide Sequence Number=SeqID_197923
atgttgtctcaattcgtggctgaagctcaatggctcttgccctatttgcagaaactcgccacacccgacatcgctgcaggaggtggtgccgctctcttatttttgatatgtagggctttaggtagggatgatggaacagctggttggctacttggagttgttcgtgatctcaagttatctcatctgccacccatagccacggttccactgggcacatggaataatctaccgtttgcatttggttgggggaagaagaacccagggacggatgaacatgcagtcaagtcatttctagatcaagtaatgaacgctaaggaaatgaaaatagacaagtaa

SEQ ID NO: 81146 - DNA, 435 bp, Glycine max
  Peptide Sequence Number=SeqID_197924
atgccaaatagggtgcacctgcttatcaagagggtggcgaaagtcgttggcatcgaggtcgcgaaagacgatggcagaaccaactctgaagtggaggaaggaggaggagacaaatcatcgacatcgaggtcacggaagatgacgacagaaccagctctgaagagacaaatcgtcgacgccgaggtcacgaaagacgatggcagaatcagctctgaagtggaggaaggaggaggagacaagtcatcggcgtcaaggagacaagtcatcgacatcaaggtcgcagaagacgacaacagaactagctctgaagtggaggaaggagggggaggcgaaggggttatgaaggaaggaggacttggcggcgtgggcatggaggaaggtggcgaggaggtgagggttgagagggaggaggagagtatggaagcttcgttctag

SEQ ID NO: 81147 - DNA, 333 bp, Glycine max
  Peptide Sequence Number=SeqID_197925
atgactaagattgggattctattcttcctttctatcttttggggtagcatgcctctcttccaagcaatatttaccttcccccaagagctaacgatgctgaagaaggagcgatcctctggaatgtacatgctctcctcatatttcatgtctagaatggttggtgatcttccaatggagcttgtgtttcccaccatatttcttacaacagtctattggatggcggggctaaaagctagtttggtaaacttcatatacatactgctcagtgtcttcctcgatgtgttagttttacaagggcaaggccttgccattcgtgctattgtaatggaatag

SEQ ID NO: 81148 - DNA, 900 bp, Glycine max
  Peptide Sequence Number=SeqID_197926
atgcgttattttctcgcggtagccgattgcggttcgctcagcgcggccagcgcccagctgtttgtggcggtctctgccattagccgccagattcagcggctggagcagcagctgggcgtgacgctgtttgcccgtcatgcgcgcggcatggtgctgaccgaggccggcgagatttttgcccatcacgtgcgcaaaaatctgctggatatggagtatgcgctggcggagatcaaaggcctgaaggcggtgcggcgcacgctgattcgtgtcgcctgtaccgacgggctggcgtttaccctgctgccccggctgattgccgcctttcgccgcgatcatcccggcgtgctgtttgacgttcgggtggcgagcgcgcagggcgtggctgaactgctgcgcagcggcgagtgcgacgtggcattgcagtttagcctgcacgcggaacgtgcggttgaggtggtgggctcatggccggcgccggtgctgctggtgatgcatgaaagccatccactggcgggcgtgccgcaggtggcgctggccgatctcagccactatccgctggcgctaccgcagcaaaacaccacggtacgccagctgtttgagctggccagccacatgagtggccatctgatcgaaccggtactgacctgcgacaacttctccaccctgttccattttttactgcgcacgccgccggcggtgaccatttgcagcagttttaccctggcggaggaagcgcagcagcagggtctggtgatgcgcgcggtcaatatcgatcagctaagccagcgtacgctgcagctgcagacgcagtcagggcgaccccgcagcgccgccctgactctgtttctgacctttctgcaacagcagctcagcgcgctgtccgctgcgattaaggcgtga

SEQ ID NO: 81149 - DNA, 1422 bp, Glycine max
  Peptide Sequence Number=SeqID_197927
atgacagcacaacaggcggttcagcaggccaccgcatatttcgacagcggggaatttcaacgtatcctggcgcgccgcgtggcgtggcagaccgagagccagcgcgacgatcgcgatgtggcgttacaggactatttgcagcaggagattgcaccgcaactgcaggcgctgggcttcacgctacagctcatcaataacccgcacgctgccggccggccattcctcgtggcggtgcgcatggaagatcccgccttaccgaccttgctgagctacgggcacggtgatgtggtattcggcgatgacgaaaactggcgcagcgggctgtcgccgtggcagctgaccgaagagggcgatcgctggtacggacgcggcagcgccgacaacaaaggtcagcactgcgtcaatcttgcggcgctggagcaggtgtaccaggcgcgcggcggccgtctcggctttaactgcaaatggctgtttgagatgggcgaagagatcagctcgccggggctggcgcagctgtgtcagcagcaggcggaactgttgcaggctgacctgttcattgcctcagacggtccgcggctcaacgccgtgcggccgacgctgttcctcggttcgcgcggtgcagtaaatttccgcctgaccatcaacgcgcgtgacaatgcttatcactccggcaactggggcggactgctgagcaatcccggcacccggctggccagcgccatcgccacgctggtggacgcgcagggcgtgctgcaggtggaggcgctgcggcccgactcgctgacgccgcaggtgcgcgccattctcagcgatatcgaggtgggtggcatgccaggcgatcccgcgattgacaccaactggggcgagccaggcctgacgcctgccgaacgcctgtacggctggaacacgctggaagtgctgtcgtttctcaccggtaacccggcgcgcccgatgaatgccattcccggcagcgcgacggcggtgtgccagctgcgttttgtggtcggtaccgactggcagcggctggcgcagcacgtcagcgcgcatctggcgcagcacggcttccatgatgttgaggttgaatttttgcgcggttcacccgccacgcgtctcgatcctgacgatccgctggtgcactgggtgctgaacagcatggcggcaaccagcggcaaaaaaccggcgctgctgcccaaccttggtggatcgctgccaaatgaggtgttcgcggagattctgggcctgccaacgctgtgggtgccacattcgtatcccgcctgcggtcagcatggcgtgaatgagcacatgctgaaatcgattgcccgcgaagggctgcagatcatgacgcagctgctgtgggagctgggcgagcagggcacgcaatggctggcgcaaaaccgcgcttatgcgggaggtggcgcatga

SEQ ID NO: 81150 - DNA, 240 bp, Glycine max
  Peptide Sequence Number=SeqID_197928
atggtacttataagacctattctaaagaaaaatccctttgatgaagatgtaggttttcaagacaaggatattgctcttgaagatgaaaccgaagttgaagagattgaacaaagcaaagaaatcactgtcaaacctcctaaagacctccaaagagaattgagaaagatcatcgagctgggaagtggacatgctgacactcagaccaagctaggcgcatcagttaaagatagaagaagttga

SEQ ID NO: 81151 - DNA, 417 bp, Glycine max
  Peptide Sequence Number=SeqID_197929
atgcaagggataaagtggctcccaaagctaaaaagtctaagtggaaaagaggctgaaattcctgaggaaagtgaagaagtgcaagctctgaaagcggagctcgaaaaggcaagagtggtgaaagagaagctaatgacggcagtcactaagtgggaaacaaaaaggactcgaaaggaagaatggagcaggaacaagttccgaggggctctatggggcaacagtaacgagctcaagcttagaagggctgagagggatgaatcgaggatggaaagcatggtgttagaaggcctaggatcttcttcatcaatggattcctttgcttcttggaagatgaatggcagaggaatggagaaggaagagagagaggagacgccacttcaaggagaagatgagtctagaagaagctcaccaccatag

SEQ ID NO: 81152 - DNA, 618 bp, Glycine max
  Peptide Sequence Number=SeqID_197930
atggaaccagaattggccatgatactctacacttatagaacagtctttgatgtgccatcaggattaccccctagcagaactcacaatcattcaatcccattggttgaaggtgttgaaccagtaaaagtcaagccatataggtatcctcacagccggaaggatcagattgaagatggcacttggatattttgcacagattacagggccttgaatgccatcacaatcaaagatagctttcctattcccactgttgatgaactaattgacaatctgttgaagaaggaaaactttcattggaatgaccacacttccatggcttttgacaatttgaaagctgcaattaccaaggcaccagtactggcattgcctgatttttccaaagcctttacattggaaactgatgcctctggtataggcattagggctgtattgagtcaggaacaacacccaatagcttttttctctaagaagctcacacctaggatgcaaagacagtcagcttatataagggagtcctatgctatcatagaagcagttgcaaaattcagacattatttacttgggcaccgatttgtgatcaaaactgaccaaagaagcctcaagtcactcactgagtaa

SEQ ID NO: 81153 - DNA, 267 bp, Glycine max
  Peptide Sequence Number=SeqID_197931
atgaaagaatcgctacagactcaaatactttctatttctgaaaaattaaacaaaagcaatgaaagaatcgctacagcaaaatataaccttgagctggaaaagttgagaattgaactaagacatgcccaaggactgcatgcagtagctcaaagtgagaaaattgaagcatcccaaaagctaaatgacctaagcatgattaaaggaagaattataatttggggtaacatcctatattactcaacagctgaatgcccaaccaatgagtaa

SEQ ID NO: 81154 - DNA, 267 bp, Glycine max
  Peptide Sequence Number=SeqID_197932
atgatgcaaaagatactaatattccagttgaagtatagagatattactatctcacaaacaggcctgaggaacctgattcggttggcaatgccaaagctcatggaagctgatgttcagtttgaatcaccaacctgcccttccaatacagcagttgatcctgaattgaatagtgaggatcaggtgctttgttctgtaagcatagctcccttaaggcctacaactgagagtcagcttgtattgcctctttcaacaactgaattaacttga

SEQ ID NO: 81155 - DNA, 178 bp, Glycine max
  Peptide Sequence Number=SeqID_197933
cgatcttgccatccgaccggccactagcggaaatgaaagcagtgaaacctatgaaaagaaagaatgtaagagagcagaagacattgatagtcccggcaagacaacaaactttgttagccttggaaaagtaaagaaggttgtgatagtcttgacaaaagactctgatagtcttggaaat

SEQ ID NO: 81156 - DNA, 1593 bp, Glycine max
  Peptide Sequence Number=SeqID_197934
atgaagggtgcgttggatcggacgaaggtggtgctgcgccacttgccgccttctatttctgaggccgcccttttgtcccaaattgatgcggccttcgctggccgctacaactggctctctttccgtcccggcaagatcagccagaagcatatgtcattttctagagcctacattgacttcaagaggccagaggacgttatattgtttgccgagttctttaacggacacgtctttgtgaatgtaaagggatctcagttcaaagtcattgttgaatatgctccttcacaacgtgttccaagacagtggtctaaaaaggatcttcgtgatggaaccatatataaagagtctttccctcttgataaatataagcatttacatggtgaacatctagattctgagtatctggagtttcttgaactacttgccaagcctgttgagaatcttcccagtgccgagatacaattggagaagagggaagcagaacgatctggtgctgcaaaagatattcctataattacaccactgatggactttgtgcgccagaaaagagctgccaagggacctaggaggccactgtcaaatggaaaagtgagtagaagagctggcacttcatcaaatgggggccctagttccgccacatcaagacgtggttctggaaagaagagggtttctgctacaatgtatgttgcaagggacccagggaaaagttctactatcaaagacaaatcatcttatactttggttcctaagcaagatgatcagcatcttccaaataaagcttcaaacatggcttcttcagatggaaatcaaactcttgatgagaatggagtttctggaaatcatgatgctgggaagaaaaaagtactacttcttaaagggaaggaaagagaaataattactgtatctgatttagatagcatgtcacagcatcacaatgtaacatcttcagctaaaacagttgttggttcaacagttttgaaacagagtcagcggcatgaaggtagtggaaggattatcagaagcatactctcaaaaaaggagttgcatcaaagccagtcttccagggccctctctgagcagaaaatcctgacatccaatctagagaaagaaaaacagccccctcgccccttacatgtccaactaattttgaagggctctaatgggacaccagagaataagattggtgtgcatgattcacatgtttctagtgagaggcaagagagacatgttagacataaagatagacctgatcgtggtgtctggacaagtcgtttcaatggagctgacgtgtctttctcatctcctgcttcctcacaagtagatcctttggaaggtagtcaagcagatttgaaacatgacatgccaaatgcaagaagtgtggaggtaaaatctgaaggaagtgtccgtaccagtcattcatcagaaaatggtttcaataagcattttggtcgtcgtggaccatcatatggggtaaaggatgttgatggctattcagtttcaagtgaagggaagcatcctagaagatctagtacatctgcttatggttccaacgagaaacaagtttgggttcaaaaagcaagttctggtagctag

SEQ ID NO: 81157 - DNA, 321 bp, Glycine max
  Peptide Sequence Number=SeqID_197935
atgcgtttgcaaaccaacatgcaaccaggagataaggatgaaactgccaaatttgcacaatggattctggactttggagatggaattatcgggcatccaaatgatgatttatgccaacaccacaacaacacaaaattcttccaatctagagccatactagcttcaacaaatgaaactgtccaacaagtcaatgattacatactatcattgattccagctaaaattatttctggaaagaatataggactcaaagtttatattcccagaatgtctatgtccccatctcaatcaccatggccgtttaagcttttgagaagatag

SEQ ID NO: 81158 - DNA, 1071 bp, Glycine max
  Peptide Sequence Number=SeqID_197936
atgtatgctgaacagaattatgacaaggctcaattagaacatgatttccaaacatactttgcttctctaacaggtactgggatgacctttatgtggaagacattagcctctgtattgcgttcaaaaggtgatattgttttaactgttacctcaagtggtatagcctcattgttattacccaacaacagaattgcacattccaaatttgtcattccagtgcctacattagataactctacatgtaatatccaccgaggtactgaactagctgagctgttaaaggcaataaagttgattatatggtatgaggctcctatggctcataagtattattttgaagcattggataaaacactgaaggacattatgtgtatgtctcatgtggacaatgttccatttggtggaaaagtagttgtatttggaggcaatttttggaaaatcttacctatgatacctagaggaagtagattagacatagtgcatgctacaataaatgcttcctatctgtgggactactgcatagttttaaagctaacaaaaaaaatgtgtttgcagtccaattcaacaatgtcaaatgcagaagaaataaagagcttttctcagtggttgatagatgttagtgatgggaaactaggaaaaggtgatgatggattttctgagatagaaaatccatctgaatttctaattacaaatttcactgatcctatcgaatcaattgtctcccatacctacccaaatatccagcagaattataaggatgaggactttctaaagtccagagctatactagcttcaaccattgacactgtagaccaaattaatgactatgtattcaacattatcccaagtgataagaaagaatatttgagttgtgattccattgatatgatagatgttgcaacaactgaatgttaccaagctattacaccagagtttctacattcattaaaaatagttggaatacctaatcataaaattaggttgaaaatagacacatttattatgttgattcaaaatttggatcaagcaaaaggactatgcaatggtacaagactaattgtgtctagatag

SEQ ID NO: 81159 - DNA, 450 bp, Glycine max
  Peptide Sequence Number=SeqID_197937
atgaccacaaagaagttcaaactgacgttaaatccagccaaatgcactttttgcgtcaaatctgtcaaattgttaggtttcatcgtcaaccaaagaggaattaaagtggatcctgacaaagttcgtgcaatcttggaaatgccgccccctcgcacaaaaaaggagattcgaggaatgatcgctcgttggcaagtccagttttcagaatatgacattgtatatgtgacacaaaaagcaattaaaggtagtgctctgacaaattatttggcacaccaacctgttgaagattatcagtcaatgcaatgtgaattccccgatgaaggcataatggcattgtttaacaataaatattcgtcaaaagaaagaagatggatcatgtggtttgatggtgcttccaacatcatgggtcatggggtaggagttgtattactctccctagagaagcagtaa

SEQ ID NO: 81160 - DNA, 939 bp, Glycine max
  Peptide Sequence Number=SeqID_197938
gttacaaaaggtggaattactagagcaaaagaacaattgatagcaaactcggggaatgttgctcccaaagaagttagagaagaactatggagatgtttgaaggataagaagaaacaagaaaggaaaacatttcataagatgcgtcaacatcttcttgaagactatggtgatagtgatgaagaaagaactaaaaaggccgcctttatcaagctcaagtccacacctagaagactccgccctctcagagtggttaatgagaaagtcgtcggtatcgatttgggaaccaccaactccgccgtggctgccatggaaggcggcaagcccactatcatcaccaacgccgagggccagagaaccacgccctccgtcgtggcctacaccaagaatggcgacaggctcgttggccaaatcgccaagcgtcaggccgtcgtcaaccccgagaacactttcttctccgtcaagaggttcatcggccgcaagatgtctgaggtcgacgaagagtccaagcaggtctcttacagagtcatcagagacgacaacggcaacgtcaaactcgactgccccgccattggcaaacagttcgctgccgaggaaatttctgcccaggttctgaggaagcttgttgatgatgcttccaagtttttgaacgataaggttaccaaggccgttgttacggtgcctgcttacttcaatgactcccaaaggactgccaccaaggatgctggtcggattgctggtctagaggttcttcgtattatcaatgaaccaaccgctgcatccttagcctatggctttgaaaagaaaaacaacgaaactatccttgtttttgaccttggaggcggtacctttgatgtctccgtgctcgaggttggcgatggagtctttgaggtcctctctacttcaggtgatacccacttgggtggtgatgactttgataag

SEQ ID NO: 81161 - DNA, 231 bp, Glycine max
  Peptide Sequence Number=SeqID_197939
atgacagacaataagagttctttccattcatctcttgcggtttccaatataaggaaccatatctccatcactcttgaaatggagaatgtctgtcgaagagctgcctcgtcattcaacttgtttcgggtctcacaagtgcatatcgagtcgtgccttgcagcagtgatatccagataccgctttcttgatgtcgagcaagacaacacagtgacagacaaagccaaatcttga

SEQ ID NO: 81162 - DNA, 786 bp, Glycine max
  Peptide Sequence Number=SeqID_197940
atgggggatgagtcgcccagaaataaagtgaagttcctctgcagctacggcgggaaggtccttccacgaccctccgatggcctcctcaggtatgtcggcggcgagactcgtgtggtttctgtgcctcgtgacatcacatttcccgagctaatgaagaaggtgagtagcatggtggagggaggcggagagatggtcctaaaataccaactggttccggaagatctggacgcattggtgtcggtgagaacagaggaagacgtgaagcacatgatggaggagcacgatcggcaccacactggaggcttgctccgtgcgttcttgttccccccttgcaagcacataggtctgatggcgtgcgaaacgtatctgttggagcagcgatacatagacgccattaatgggatcatccgaacaagttccaggaagggctctgcctgttcttccccaaaatcaaactcccccgatgccacggatcagcactctcctcgcttttcgatttccagagtgcaaagctctccgaacctcagtggcctcgatcatcatcatcaacatcatcatcatcaaaaccctaattttcatttgtccaaaccgccgcaagatcctcaaatgggaatgaggcttggtggaggaagggctcccactcccgcttttaaccatcattactccaggcaaccaccctacagagcttatgcctactatgatgactctgcagcagcctcctatgcccatgataatagaattcatactgtgtccaggagtcctagaacaaaatctatttgggaatga

SEQ ID NO: 81163 - DNA, 315 bp, Glycine max
  Peptide Sequence Number=SeqID_197941
atgatgagtgggtattccaggattagcgatgagtccagcagccagcaatctgcaagatccatggatgaattttcagaaagcaatgaaggagagaaattcggagtgatgctgggtaggagtgcttcttcttcttcttcttcatctcagtttcagtttcagagggcattctcaatgagaagatcttcatcagtttcagaaagatactgcaggatccacgaccagtacacgccaccgcctattggatctaagaagaagcagagaggaggaggacccaataagatcctcaaagcctgtaagcgcctccttcgactctag

SEQ ID NO: 81164 - DNA, 483 bp, Glycine max
  Peptide Sequence Number=SeqID_197942
atgttggtggaattttccacagttggcttcaatgaagaatgctctactatagttttaaagaaattgcctcctaagctcacaaatccatggaaattttcaatcccttgtactattggtagcttgaaaatcgatagagccttatgtgatcttggtgcaagcattgatttgatgctttattttgtttataagaagttcgagttacaagaaccccaacccattaacatttctcttgtgcttgtagataaaactattacttatctgaaaggaatagtggagaatttgcttatcatagttgccaccaacaagatcatgactattgtggctaagtctcacccaagtgtggggaaggaagaccctccaagaaagaaagtcattccaaaagaccttggacaaagtaagagaaagggaaaggactatgaagtggatgattatactgaaggatcaatgcaaaaagggaaaatcattttgttcgagggtggttga

SEQ ID NO: 81165 - DNA, 324 bp, Glycine max
  Peptide Sequence Number=SeqID_197943
aacaagagagggtacatatcttgtggatcagttcaagtggagggtacatccacttggtttttcaaagagaacaagggagggtacatcccttgtggatctttggcttgtaaaggattttacaaggttgaaagaaatctcatgaaccggttggttgcttggggactggacgttattcattttctggataaggtcgttgagtttaatggccatgaaggtttgggttgttgcgagattaagtttggtggaggtgagtttggcaatggtgtcctcaatgtggtccaagttggatttggagctcgtagaattagccatggagctcaatga

SEQ ID NO: 81166 - DNA, 462 bp, Glycine max
  Peptide Sequence Number=SeqID_197944
atggacatggccaagctaagttccatgatctcgcacgtcggattgagagtaacctttgttaagaggataagagatgaaaccttcaaaacaaaggactctgatgctaaactatatattgaacctctgccttgtatgaaagacagcaagaaaatcatcagactttcttcttcttatttttcttcattggaggcctcccttagtcctcgaattctaaggggttattcctgcattcctaacatcttggtgctttcattgagctccatggctaattctacgagctccaaatccaacttggaccacattgaggacaccattgccaaactcacctccaccaaacttaatctcgcaacaacccaaaccttcatggccattaaactcaacgaccttatccagaaaatgaataacctggaaacagccaatgttggatcaagtggcctcagaataattaagaagggaggttga

SEQ ID NO: 81167 - DNA, 147 bp, Glycine max
  Peptide Sequence Number=SeqID_197945
atgggtgtggtgccgagccaccgcgtcggaaacaatcgtggaaggattgttaggggaagattagacatagaacagataaagaaaggttcaagagggaggggtccaccgcttggattgtcgaaactatatgaaaggttattggagtaa

SEQ ID NO: 81168 - DNA, 645 bp, Glycine max
  Peptide Sequence Number=SeqID_197946
atgggtggaaaagatgtaatatatttgaagcagcagcactcatcaactctccaacctgctgatgttcagaaaaaattgaaagagatggccgataggaggtttctagatgccaatggccactatagcattgcttctgatcaagttttcccaaatgacaagtttggaatcagggagcagaggctaacatttgctaatattagtccatcaagttcttattcacataaggaggatattgtaagcatttgcaagaggaggggtgggagggatgacagaaatctatcccataatgagtggttgcaaactgttcagtcagagcctgatgtgatctcaatgtcgttcattccaattacgtctgtattgaatggagtgccagggagtggattcttgagccatgccataaacctttatttgcgatataaaccaccgattgtagagctccaccaattcttggaattccagctgccaaggcagtgggcacctgtattcagtgaccttcctcttggtccccaacgaaagcaacggagttctgcatctttacagtttagcttcatgggcccaaagctttatgttaactccacacagcttgcttgtggagcttcaatggaggctggatctttgagcttcaatgaggtccttcaatggtga

SEQ ID NO: 81169 - DNA, 780 bp, Glycine max
  Peptide Sequence Number=SeqID_197947
atgtgccatcgaaacactagaaaacccctattagtaatttataacctctgtgctgaagccaggaatacttgtcatgttatatatcaggttgatgtaggtaagaggccagtgactggtctccgtctttatcttgaaggtaagaaaagcaatcggttggccatccatttgcaacacctttcatcacttccaaaaatcttccagcttgaagatgatccaaatgaaaacttttggcggaagtcttatgataggagattctatgagaaggttcaatggaagaatttctctcatgtgtgcactgctccggtggaatctgaggaggatctttcaatagtgactggagcacaattgcaagttgagaattatggcataaaaaatatactcttcttaagacttcgattctcaactgtgttgggagctaaagcagtgaagcatcctgagtgggaggggtcgctcaagttgggagcgaagtcaggactcatatccactttaatcagccaacacttcacgtcaacatttcagaagccacctccgcgaccagcagatgttaatataaattctgctgtctatccgggcggccctcctgttcctgtgcaagctcctaagcttctcaaatttgttgacacaactgagatgaccagaggaccacaagagtctcctggctattgggttatctctggagcaaagcttgttgttgataagggcaagatttctctccgggttaagtattctttgttgaccatggtattaccagatgaagaagagatgttggatgatcagtag

SEQ ID NO: 81170 - DNA, 945 bp, Glycine max
  Peptide Sequence Number=SeqID_197948
atgaagcttcaaaaaggaggaagagatggtgctgctggaagaggaataacgatcaaagaagccaaaatgaaagtggcaaatacacaccaaatagtgctagcagggacttctttgggagttagaaacacctttcattctattgtagccatcttaaccactcttgtagttgtcaccaccgtttgtctaagacaggatggaggacatttacctccaaaaataaatgcttctggtagtaattcgtcgtcgtcgtcatcatcatcaaagtgtgacttgttctatggtaagtgggtttttgataacgaatcttatccattatacaaagagaaggaatgcacgttcatgtcagaccagttggcttgtgcgaagtttggaaggaaggacctgagttaccagaattggaggtggcagcctcaccactgtgaccttaccaggttcaacgccacagcattgcttgaaaggctaaggaacaagaggcttgtgttcgtaggggattcactcatcagaggccaatgggtttccatggtttgccttgttgactctgtactgcccaaaaccctcaaatccatgcattccactgccaatggttcactaaacattttcaaggccaaagaatacaatgcaagtattgagcactattggtccccattactagtagaatcaaactcagatgatccagtgaaccatagggtaccagaacgaacagtgagagtgaaggctattgaaaagcatgccaggtactggactgatgcagactttctggttttcaacacttatctctggtggagaaggcctgtaatgaatgttctatggggatcatttggagacccagatggtgtctacaaaggggttgaaatgttgagagtctatgaaatggccctgaggacctggtctgattggttggaagtccatgtcaatcggaacaagacccagttgttttttcgttag

SEQ ID NO: 81171 - DNA, 624 bp, Glycine max
  Peptide Sequence Number=SeqID_197949
atggctctggctgaggaatggggagccgctaagggtaacaattgttacagcgaaaccgaaatgattgcagaagaagggtattgggggaagggttctgatcctaagatgatgcatatggtggagaacgttcttgatgatttgaaagcaagaggcttgaatgttcaaatgctaaacatcacacagctctcagaatacagaaaagaaggacacccttctatctacaggaagcagtgggatgctctaacccaagaacagatagcaaacccaaatagctatgcagattgcatacattggtgcctccctggtgtgcctgatctctgcgggagggagcccaaaagcctaccatcaccctccatcctcgccctccaccctcaccgtagctccacgatgcttaccagaacgcaggagcatggctgctgcttgacctacgactacgtcaccgacgatgccaccgatctgctcggcgaggaggacttggattcgatctccacactgagagggttgctcatttcgcggcccgcggattcaagcttttcgcacaagaacgcgctgcaccgctgcatggaacacgccaagctatggcttgctcaggatagagagcatattctgtttctctctctttaa

SEQ ID NO: 81172 - DNA, 1029 bp, Glycine max
  Peptide Sequence Number=SeqID_197950
atgaagcgcaagcgtgggcataagaaagggaaggcaaaaggcagcactaaccatggaagcagtggtgctgatgctaacaaggaagaaacctctggtttggaggttgacacaccttcttccacggggaccgggatggatcagcagcagcattacaatcttgctaacataaatcctgatggttctgttgataaggctattgggcgtgttaaggtgaagctcaagacacctaaaatcttagactcccaacccacctcatctgatgctcccagtcccacacaaagcgatactgagagaatggaagatagtgcaaattctttgcctgatatgaaactcagtactctgtctaagagagctgctagcattaaaattaagtcttcatcaaaccacacattgtcggcttccactgagatcaccctcccaaaagaaagaaagaataagcaggaattggatgcttccttagtggttttaaggaaggtaatgaaaatggatgcagctgaacccttcaatgttcctgtcaatcctgaagctctgggaattcctgactatttcgatatcataaacacaccaatggattttggaactatatgtaacaatcttgaaaagaatgaaaagtatatgaattccgaggatgtatttaaggatgttcaatacgtttgggacaactgttacaagtataacaataagggtgactatatcttggatcttatgaggcgagtaaagaagaactttatgaagtactggacagcagctgggctatacagtgaacaatcaaaagggaccaagggtgagacatctatcaatatgggtgtatgttttcattatgaatcacatacagagaggacttcagcagaagatattgcactttctggtgatggaaaagcagggaagggtggtcaattgaagcagaagacaaaaaagcgtcatgggtctgtattttcaaactgcaatttaaccccctatttattatattataattccttatgtggtaattcttcttacaatggaaatgacttagttgctatcatgtaa

SEQ ID NO: 81173 - DNA, 414 bp, Glycine max
  Peptide Sequence Number=SeqID_197951
atgaggagtggtcagtatgggtgtaggaagaaagattttgttagaagagatactgagagtaggaaatgtgggtgtcccttcaagctttgtgggaaatcagtgattggagggcaaggttggatggtgaagttgatgtgtaagactcataatcatgaattggccaagtcattagttggacatgcatacgctgggcgattaactaaggatgaaaagacaattattgctgatatgaccaagtcaatggtgaaaccaaaaaacattttgctaacgttgaagaagcacaatgtcaatagttgtacaacaatcaaacaaatatacaatgcaagaagtgcataccgttcttccattagaggaagtgatactgaaatgcaacatctaatgaagcttcttgaacgggatcaatatatccattga

SEQ ID NO: 81174 - DNA, 1155 bp, Glycine max
  Peptide Sequence Number=SeqID_197952
atgacacagaatctgaagcataccgtggatttggaatgcagtgataatagcaggccgtcaaagatatcaaaaatcgagtatccgagtgacagtgacattgacgaagaagaagaaggaatgagccaaaaccctaggaatgggattcagcgctatttggttgcaatcgagtatattgggactctcttctccggttctcagaagcagctcaatgtccgtaccgtcgtcggtgctcttgaggaagctttttccaaatttgttggccaaccggtctctgtgtcttgttcaagtcgaactgatgctggagtgcatgctttgtcaaatgtttgtcatgttgatattcaacgcatcagcaaaaggaggcctggtgaagtgttaccacctcatgaacctgctgtcgttggaagagctgtaaaccatttcttacagaagcacgacagtgacttaatggttattgatgttcgatgtgttccatctgattttcatgcaagatttaaagcgcaagagcgcactgacactggagagtatcacataattgatagttatttggaactactattcagatacttctatcggttgctttctgggccagagcctttgtcaaccttcgagaaagatcgagcatggcatgtacctgaggagcttagtcttccagctatgcaactattcaagttattgatgatatccatgcaggaagcatgcagagttcttgttggatgccatgattttagttccttcagggcagctggttgtcaggcaaagtcacctattagaactttggatgaactcagtgtcaatgaggtaattgaaagtccatattttccatctctaatggatagagaacaacataataaagtcagtggtgatcttcgtagctgctccaacaacactgaaactgacattcctcctatttctaatccaagcattgataaagtaattacatcaagtcaagatgcaggatttggcaaaagaaggcgacatcgttgcttggtggttagactacttgttggtgttctcaaggctgctggcactggaaacttaacaattccggatgttgagagaattttgaatgcgaagactgttactgccgcaagtccaatggccccggcatgtggtctctacctaggagaggtgaaatatgatctacctaccacttaa

SEQ ID NO: 81175 - DNA, 513 bp, Glycine max
  Peptide Sequence Number=SeqID_197953
atggcgagaggagaacaagagagcccgatatttatttctacacgtaggcatttaagagttgcagacttgcagtttgatgctgctctatttcaagaagacaacaaatttggcttcgctgcttgcattcgtaactctgaaggagtgttcatctcagccatatcttggttccagggaattccaaagcctcaagaagctgaatcctatgctgtcctttctactctccaatggatttcggaccttcagctcactaatgttattattgaaacagattgcaaagccattcctcatgctattcattcaaagcgctttcatgaacttgaagctggtcggattttatgtatctgtgctaaaaaaatttgtaatcttcataactgtagaattcagtttgtaagtagagaagccaatcaagttactcataacttgactagagtatctcgatcctacgcttgtccacaagtttttgattttagtcgtgcttttattgaacactttcttgattatgatataatataa

SEQ ID NO: 81176 - DNA, 669 bp, Glycine max
  Peptide Sequence Number=SeqID_197954
atggggctgtcaccttacaagatcacctttgggaagaaacctcccaatattccgcattatgtgacgggaacatccaaccttgatgccgaggatgactttcttgctgaccgcgaagctgtattcgctgattttaggaagaaacttatcaaagctcatcatactatgaaacattttcctaataacaatagacatgataagattggcccaattgcttaccaactggaactaccacctgggtcacgcattcacccagtgtttcattgctctctgcttaaaccgtttcaaccattaactgatcagactaatcctattgctgagctaccaaccacatcagtcgataatgacccaattatttctcctctggtgattttagacactaaatgggatcaatctgataatgggcctaaattgatggttctagtccaatggaagggcctgttccctgaagacgcatcgtgggaaccttgggagagtctcaaggctgacttccaccttgaggacaaggtgttctttgatgggcacgggaatgttatgaatgaaacagaacagcaacaacaaacaaataatattgatagggcaatacaacaagctgacacaggggagacaattacaaatcaaaggcccaaaaggaggataatcaagcctcagtatttgaaggattttgcgtaa

SEQ ID NO: 81177 - DNA, 1380 bp, Glycine max
  Peptide Sequence Number=SeqID_197955
atgggccctatccttactgactataatgaactcaccatgaaattcatacatgacggcaacattatagaactaaaagggaatactaatagcggccttcattcaatcacacccccacaactccgccgcatgatcaaaactgacaatgtcagtgcttatttccatatccgtatattatcctctgagcccccttcaatcaaaaccaacacaataccttaccctaagattgactccttaatccacaaattctcttccctattccaaactccaacgaccttacctcccagtcgaaacaccaaccatgcaatccatctacttcctaattctgaacctgtaaacgtgcagccttaccgttatccatactttcaaaagcaagaaatcgaaaaccaagtcaagtcaatgctgaagaggggaatcattcagcctggtaccagccccttctcttcacccgttctgttggtcaaaaagagagacggaacttggcaattttgtgttgattacagagcattgaacgccatcaccatcaaggaccgatttccaattcccacgattgatgagcttctggacaaactaaggggctcctgctacttctcgaagttggatctcctgcaaggttatcaccaaatactgatgcaagacgatgatgtgtacaaaactgccttcagaactcaccatggtcattgcaagttctgtgtaatgccattcggcttgtgcaacgcaccatcttcatttcaggctatgatgaatagcatctttgcaccatacttgcataagtttatcatcgtgttctttgacgacatcttgatttgcaacaagtcttttacagagcatcttgtgcaattggaaagtgcctttcaagtgctggtcacaggacaattctaccttaagctctctaaatgtactttcgcccagaaacaaatagaatatttggggcatgtagtttcgcaacacggtgttgaaccagttcccgcaaagatttataaaggactatgcttccatggcggctccattaactcatcttttggccaaagatcagttctagtggacaccagaatctcaacaagccttcgacactttaaagaatgcgatttgtcaggcccccgttctcgggctaccggatttttccttgcccttcgttgtcgagatagatgcttcaggggtgggcatgggcgttgttctgtcccaacgaaaccaccccattgctttcttcaacaagccattatgctcgaagctccttcactcttctacctatgtcagagaactcgtggctatcacctctacaatgaagaaatggcgccagtatctactgggtcatcacttcacgatcttaacagatcactggagtctgaaagagttgatgttgcaggtgatttagatgcctga

SEQ ID NO: 81178 - DNA, 984 bp, Glycine max
  Peptide Sequence Number=SeqID_197956
atggctgaatccactcactcgaaaacgaacctggaacggatggaggaagtaattgccgaattggcttccaatcagcttcacatcactaccaagctcaatgagcttatccagcgcatcacggttctcgagaccaaccagcaacaatcagcctcgccttcgtcttcctccaccaacccttcccacattgctccttcttctcagcttcctcgcatgaagctagaagtgccccgtttcgatggaacagacccctccgggtggatattcaagattaaccagttcttcgcgtaccatgtcacaccggaacacgaacgtctaacaatcgcctccttctatatggagggaccagctctcgcatggttccaatggaagacgagaaacggacaattgacttcgtggtctggattgcttcaagctcttgaagcgcgctttgctccttcccagtacgaggatcctactggaatccttttcaaattgacacaatgcggctctgtcatggactatttgtcgcaatttgagacattggtcaaccgcatcgtcggactgccggcaccatttctcttgagttgctttgtctcgggtttgaagccagacatttgccgcgaagtacaggcactccaacccttgactctggttcaagttgttgcgctggcgcgactccaagaggagaaaatcactgaacatcaccgtgctttccgtggccgtaccactcttgggttaccaccaccactggggtctacctctccaccgccatcgacaattcctttgttgttaccacccgcaaaacctcctcctcttcctttaaacgactatcgctggaagaaatggcgaatcgccgcgagaaggggctctgcttcaactgcgacgagaagttcactcgagggcacagatgctcctcaaagttcttcctcctcatcgcaaacgaagaggccgcagagaatgtcaacaaccctacccaagagccacttccccattctgaaaatataa

SEQ ID NO: 81179 - DNA, 495 bp, Glycine max
  Peptide Sequence Number=SeqID_197957
ttggcccagggcttcccggtatcaacagggacaccaggatttatttatctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgttggcgccaatcaagttgataccacaaccacctgctttactactcaacagaaaaaccatctcggttccttctgggttgttgaatcgatccacgagtttttgacgtttgttgacgttcatggttccgtcgagcctgagactgccatactttttgttacgacacaacttctccatgag

SEQ ID NO: 81180 - DNA, 1228 bp, Glycine max
  Peptide Sequence Number=SeqID_197958
atgtcgacgtggtcgacgtcgccgccacgcaagtacgtcgacgctgccgcgctcgaacgccaccgcgcgcgaggccgcgtccgggatcacgttgaacaccagctcatccaggtagggtttgccgggcttccagtagtcggggttgcgcgccagcttgatgtattcgccgcgtttccattccttgaacacgaacgggccggtgccgatcggtttctggttggccgggttggtcatgtagtcggtgccggcgtagatgtgcttgggcatcatcggcgcgaagcccggctcgaacatcagcatgaaggccgggaacggcgacttcagcttgatgaccaccgtcttcgggtcgctggcctgcaccgaatcgacgaacttgttcaggatcacgcgagctcgcgcatgggtcttgggcagcatgtccgacagcgtgaagaccacgtcgtcggcggtgaacggcttgccgtcgtgccacttgacgttgtcctgcaggtggaaggtgtaggtcaggccgtcgctcgaggcttcccacgacttggccaggccgggctggggcttgaggtcggtgctgtacgtcaacaggctttcgtagatcttgccggcgacgaactgggtgggaccctgctggttgatggccgtgacgatcacgggcggctcgggctggacgatcatgttgagcgtgccgcccttggtctgggccagcgcctgcgtggcgggcaaggcggccgccaggaccagggcgccgatgctgagggagaaccaagtcttcgatttcactgcgagcctccgggctggaagagggttgtcaggtggccgcgcgtcacgcggcgtgtgccggctatgacaagcaaacctcgtgccacctgtttctcggggaactgcggggtggagctgctacaacaatgctgcgtatgggtgcagagacggcgccgcgcaccaatgcggcgacagacgaggtgcacggtgggcgcgctattgggtgatgtcgatccaggtggttttgaggtcgctgtacttgtccagcgcgtgcagcgatttgtcgcggccgaagcccgactgcttgacgccgccgaacggcacggtgatatcgccatcggcgtagcaattgacccacaccaggccggcgcgcaggcggcgcgacaggcggtgcgcgcggcccaggttggcggtccacaggccggcgcccaggccgtacgaggaatcgttggccaatgcgatggcttcgtcttcc

SEQ ID NO: 81181 - DNA, 345 bp, Glycine max
  Peptide Sequence Number=SeqID_197959
atgtctcctcctcccttacgggtgtcgattacttatttaaaacaaacaatagtaaaagaaactgcgaatgcaaaggatactgggctaccttgcagcgatgttctctgcttgtttagcgccgggaaggggcaacgatcggtcggtcgtgaccctatccccacttgcatccgtccctatgtacctgcaagtaggaaacaaaatccgtggccaatcgtgtccggtcatcgtcttaccttggttgatttccgcagtcaacttgtcttgacttctagccgtgacctaagaaggccctgcccctgttaccacaaaatatgcatgtgtatgtgcatgtatgaatgttcctaa

SEQ ID NO: 81182 - DNA, 210 bp, Glycine max
  Peptide Sequence Number=SeqID_197960
atgaagagagaatctcctctatccctgcattataaactgtttgagaggacacatgtcccagacattgtcccgacatcagggaaagctgctgcttcaggtgctgtatccaaggatgccttgattgctgaactcaaggacacatgcaagctgatagaagatgctgcagctagagcatggagacagggggagcagaaagcggatgtcacatga

SEQ ID NO: 81183 - DNA, 333 bp, Glycine max
  Peptide Sequence Number=SeqID_197961
atggatgatatggagaaaagctcgtgggtgatatgtgatgcaaaggtaccgatcaagctaaagggaaagtttatcggattgcgagagaagatcggtagactctgtagtgaggagagtagaccagatggagagaaggcaaacaatttgaggcagaggaagacccaaaaagactataagagaggggggcgtcacattcacaccactttgtgcttcacaaacccttcggacgcttttgttgtcctcaccctcaccactctcactcttagtcgcaattgtgctcagtctcactatgttactggcaatgctgctgctgcaatggtgtggaaagtctaa

SEQ ID NO: 81184 - DNA, 177 bp, Glycine max
  Peptide Sequence Number=SeqID_197962
gaaacaatcttcatacctccaccaatgttaactgcatttagaacacctcaagttaggcctttggcaccaattcgaattatattcccagatggagtatctcataataggaatcaatcgaattacatgagcttcatacctacaccaggattgcccaatcgtcaagattcgaacaagtga

SEQ ID NO: 81185 - DNA, 204 bp, Glycine max
  Peptide Sequence Number=SeqID_197963
atggaaaaatctgacaagaaaaccttcaaagacaagaaaggaaagaaagtatacatcagttgggaagataacaacatggattcatcaggagatttagaaaatgaagtcgtgaatctaagtctcatggccaaaaattatgaaagtgaagaagaggattctttgaaaagaagttgctcattgatagcggaagccaaccacacatga

SEQ ID NO: 81186 - DNA, 633 bp, Glycine max
  Peptide Sequence Number=SeqID_197964
atgatgaccgaacgacgttattactacagcgacgatgtacagggccaggcgcaggtgttgagctgtacgccggccgaggcgggcgcctacgccgtagagctggacgccacgctgttccacccgcagggcggcggccagccgtccgacgtggggacgttaggcggcgtcgccgtgctgcgggtgcagcagcagggggatagcgtggtgcactttaccgccgcgccgctgccgatcgggccggttacgctgcaaatcgatgaggcgctgcgccgcctgcacgcccgctggcactccggcgggcatctgatcggctggctgggcgaaacccgcgggtggcggccggtcaaggcgcatcattggccgggggaggggcgcatcacgttcgcgccagggccggatgcgcagacgatagaagcggactttttgcaggtggagctggcgcgcttgatagccgccgatctgccgcgccggcaacaggcggtggatgggatgcgccaggtcggtttcggcgaactgcccgcctacggctgcggcggcacccatgtcgccgcgctgggcgaggtgggcgcgatcgcgatcaccggcgtaaagatgaagaaggggcagctgatcgtgcagtatgagctgggttga

SEQ ID NO: 81187 - DNA, 279 bp, Glycine max
  Peptide Sequence Number=SeqID_197965
gcaattcttggtggtgaagctccttcttccttggcttattccctagtggatggtgcctcccctctcctcttctcctttgccttccgctgcatctctatgttgtccctcgtcagggtggacgtggccaaggaaggctctaagatctcgcacgtcagactaaaagtagcctttgttaagggtgagatagaacctggtacttatagagtggagtggaagctgcgggtccttatttgctgggattgttacggtgttgtaccaacccttgcatataatgactag

SEQ ID NO: 81188 - DNA, 111 bp, Glycine max
  Peptide Sequence Number=SeqID_197966
gttttccggaagttacgaaggccaattccggaagaagtgcttccggaagatgtttccggaagaccttcatccggaagtggtcattccggaccttcctccttctgtgcctaa

SEQ ID NO: 81189 - DNA, 384 bp, Glycine max
  Peptide Sequence Number=SeqID_197967
atggagatctctgaagatactgacatccctgtaatattgggaaggccattcatgtggaccgcaagttgcatagttgatatggggaagaggaagttggagctaggtaatggatggaggtcaagaggttctgaaaataagaaccaaaacataagatcgcctagtgagcgccagcttcgcgctaagcgcatctttggtcatgcgctaagccgagagtctcaagcgcttagcccccaacctttgcatctgaggctgatttggttcgctaagctagacaaggatgagctaggccaacttcaattcaatctaaattcggctaagcttcagccgggatcgctaagcgacaacttatccttggctaagcgagacctattgtcgccaagctaa

SEQ ID NO: 81190 - DNA, 501 bp, Glycine max
  Peptide Sequence Number=SeqID_197968
atggctcaggtcaattcagggacggtaagtgcggcagccagggctgtacgttatggtttcccggcgattgcggccagcattgggtatatctttactgaagatgaaatgaagaataaatggccaagcacccataaatactggcctgatgcagtggattatgtggttgaggttgttgaaacgctgaatcataaacaggtttctggaacacctttattgcctaaagggtcgggcttaagcattaactatccgccgctgccaaaatcaaaaattaaaggtgtgcactatgtcgaaaatgagatgttccctaccccacagattggttatgatattttgcctgatggacgcgctaaacaaaccatcaatccggaatcgttaaagacagtagagaacgataccgattccggctggcttaataaaggttatatcacctatagcctctttgatggggcaatgaacgccccgcaattccaggcgcaatatgaagaactgttgagtaaataa

SEQ ID NO: 81191 - DNA, 176 bp, Glycine max
  Peptide Sequence Number=SeqID_197969
atggacttgatggagcgtatgggaacgtctgtcggtttgcataccgcagctaacgctttgggggaccatctttcaatggttttcctggcccgcgcatgctgtttttgctggtataatccccacaggtttactctactgtctgctgatcttcccgtcgatgacgctgttctctcgag

SEQ ID NO: 81192 - DNA, 279 bp, Glycine max
  Peptide Sequence Number=SeqID_197970
atggataagagcttgaaggtaggagaatatgagtggagggagaaggagaggagcacgaaattttatagctcaaatgagttatggttcagcccgctaatccaagatcgagttcaagattctccactaagtgtgcttaggtgtcataaggcatataagtgggctcatattgagcccatgggcccaaaatctaccccgaggctcatgagaaccctagggccttctcctgcatctctggctcaatcttcttggactcttctatccaatgcccttggggggtag

SEQ ID NO: 81193 - DNA, 285 bp, Glycine max
  Peptide Sequence Number=SeqID_197971
atggaagatctggttgatggaagtggattcgaacttgtgactgagaatgagttctgcggttctcaacgatctactacggctgcggctttctcttctattgcttatttcgctacttccatccttgagtcttgggtctcgtgtgagtcttctctcccagttgttgcttctttctgggcatcgctctctgtttttacaagcaaatggagaacatggaaaacggatcctaacaaacaacaagagttcagtaggatcgagaataacgacggcacctggaacatcgcctga

SEQ ID NO: 81194 - DNA, 760 bp, Glycine max
  Peptide Sequence Number=SeqID_197972
atggaacagctcatcatcgccgggggtaaggggggaagacaggcgtatttcggtcagcggtcagatccgccgggtgaacggttggattggcggggtaagcggttggcggcctggagaagagattcggccgccggcgggcgacggcctgtcttctcaggccgtctgcatggcctgcagcaggtggataaacgcggcgctgagcggcggcgtggccggctcatggcgggtaaagacgtaaaagcgcgcgctgatgtcgatctcctgcgtcgggattttctgcaggtgcagctgcggggcgtagtgtgcgaccacccgatcgctcagcagtgcgatatagccttgctgcctgaccaggcaccaggtcgccagaaaggagtcgagcgagaagcgctcgcttttcagcgcctgcatggccagatcggcgccgcccgccgcgccgttcaggctgctgaccgccaaatccagctcgcagtttcgcagccgggccagcaggccctccgggccgtcttccaccaccgtcacccgggtatgcgggtagcggcggttgaagccttcgagcacctgcggcagatagcagagcagcggatcgacgctcatccctacccgcaggcgcttctcgccgtcagcgctcaggccgcgcagttcgtcaaacgcgttgagcaactgattggtggcggcgtctatccgccggtaaaacagctcgccgaccgccgtcaggcgcacgccgcggttgctgcgctccagcagccgcgcgccgatg

SEQ ID NO: 81195 - DNA, 339 bp, Glycine max
  Peptide Sequence Number=SeqID_197973
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtcca

SEQ ID NO: 81196 - DNA, 1707 bp, Glycine max
  Peptide Sequence Number=SeqID_197974
ctgccggacggcaaccacagcagcagtgccgcgcccagcgcgatgcggtaaatggcgaaggcggtgaacctgtgcgacttgatgtagcccatcagccacttcactacgacgaagccggtgacggccgcggcaaggaaggccacgcccacgtcggcccagttctcgctgcccagctgcccggccttggccatctccaggaaggtgtaggcgctggcggcgaacatggtgggaatgccgaccaggaacacgaactcggcggcggcggcgcggcggctcaggcccagcagcatggccaggaagatcgccgaggccgagcgcgaggtgccggggaacacgccggccaccacctgcgccaggcccacaccgatcgccactgtccaggtcacctggtcgcggtcgggcaggcgcgcggtataggcctccaccagcagcatccagacgccaccgatgatcagtgcccaggccaccgggctgaccgtctccggcagcgaccagccggccttgcgcaccaccaggccgacgacggcggtgaccaggaaggccgcgcccagcttgaacacgtactcgcggttctcgcgctggttcaagccggtggccagctgcagcaggcgctggcggaacaccagcaccacggccacgatcgcgccggcctggatgacgatgttgaagaagtccgagcgggcacccagccagtgctgggcgatgagcaggtggccggtgctggagatcggcaggaattcggtcaagccttcgaggatgcccagcagcagggcggagagcaggtcggacatggacagtgcgggcacgcgcggcaggaaggaagaaggcattcatccccatccgaggtcgtaccgatgtccgtggaaaacgttgagaagctgatcaaggacaaccagatcgagttcgtcgatctgcgctttgtcgacatgcgtggtgtcgagcagcacgtgaccttcccggtcagcatcatcgagccgtcgctgttcgaagaaggcaagatgttcgacggcagctcgatcgccggctggaagggcatcaacgagtcggacatggtgctgctgccggatactgccagcgcctacgtcgacccgttctacgccgatccgaccatcgtgatcagctgcgacatcctggacccggccaccatgcagccgtatggtcgttgcccgcgcggcatcgccaagcgcgccgaggcttacctgaagtcctccggcatcgccgaaaccgcgttcttcggcccggagccggaattcttcatcttcgactcggtccgtttcgccaatgaaatgggcaataccttcttcaaggtcgattccgaagaagccgcctggaacagcggtgccaagtacgacggcgccaacagcggctaccgtccgggcgtgaagggtggctacttccccgtgccgccgaccgacaccctgcacgacctgcgcgccgagatgtgcaagaccctggaacaggtcggcatcgaagtggaagtgcagcaccacgaagtggccaccgcaggccagtgcgagatcggcaccaagttcagcaccctggtgcagaaggccgacgaactgctgcgcatgaagtacgtcatcaagaacgtcgcgcaccgcaatggcaagaccgtcaccttcatgcccaagccgatcgtcggcgacaacggcagcggcatgcacgtgcaccagtcgctgtccaagggcggcaccaacctgttctccg

SEQ ID NO: 81197 - DNA, 345 bp, Glycine max
  Peptide Sequence Number=SeqID_197975
aacttattactgttcctgaaatgggtatggaggcactagctgtactacctgtgcatcagaagtcaaagcgaactgagatcgcaccacgccgaattcgtaggcccttttctgttgctgaagtggaagcattggttcaagcagttgagaaactgggaactggaaggtggcgtgatgttaaacttcatgcttttgataatgcaaagcatcggacatacgtcgatttgaaggacgtggctatcacacctcacgttgttgagtggcacgctttcttcttcaattcatcatccattaacttcaatttaaaaccaattagtagttgtttcaagacaattgcttgcatattgg

SEQ ID NO: 81198 - DNA, 559 bp, Glycine max
  Peptide Sequence Number=SeqID_197976
ggatgcctgggactgttacgtagataacatccttgaccggaatattcttccagagaggaatgtgaagctatacattactgagtttgatgaattcataagagaagtcaagaggaggaattggcacagggagctcactaatttttttgaaggaagcatagatgtggcagttgttaaaaaattctatgcaaacctatattaccctgaggacaaagcaccaaagcaagttagggttcaagggcacctgattaagttcgatgcggactccctcaacaccttcttgaagactctagtggtcttggagcaaggggagagcttaccttcttactctaggttctacagggctaagttagtttatgggctagtaatgaagatggacatgaacataggagcatttatatctggacagatctcgctcattgctcagtccaactcctcgaggcttggatttccagccctcatcattgccttgtgcaaggcccgaggagtcacctcagattctctcacttatgagtcactcagcccagccattaatttggcttatattaagaagaattgctag

SEQ ID NO: 81199 - DNA, 210 bp, Glycine max
  Peptide Sequence Number=SeqID_197977
atgtcacaaaaacttacggattatgcaatcgtcccctctttggcttccgaaatgttatggaactttacggattgcgcattaacacttcctttcaactcccgacatgtcacagaacttcatggattgcctaacgatgggtgtcaattgatgaaaggcacggatgacgataaggtatctccgcatgtcatcgggcttgccgcctctggatga

SEQ ID NO: 81200 - DNA, 477 bp, Glycine max
  Peptide Sequence Number=SeqID_197978
atggtgaacaatgcctgtatctgcattcatggtttcatggttatcactggcatcgcacttcctgttggatccgacaaactttattctggcagcactgatgggacagttaggatatgggactgccatactggtcaatgtgctaaagtcatcaatcttggtgctgaggttacctctttgatcagtgaggggtcatggatttttgttggtctgcaaaatgctgtcaaggcttggaatatccagaccatgtcagagtttactcttgatggacccaaaggccgagtccgtgccatgactgttggcaacaatacactctttgctggtgcagaggatggtgtcatttttgcttggagaggaagctctaaagccaattctccttttgaactggttgcgtctctcactggccacactaaagcagtggtttgtctggcggttggatgcaagatgctgtactccgggtccatggaccaaagcataaag

SEQ ID NO: 81201 - DNA, 283 bp, Glycine max
  Peptide Sequence Number=SeqID_197979
tgttgtggtggctccaacgataacagtggtggttgcagaagtgacgatggttataatggcagtagcaacaatagtgatagtggtcataatgcatggtgataacaaccacaatgatgatagtaatgataatggtgacggtgatgctggcgactacaagagtgggattggtgttggggtgctggtgacagggacaaggcaatggactctatcattgaaagttatcattaaagaactgagtaaattacatagactctccttaaggtttggagttattacactctga

SEQ ID NO: 81202 - DNA, 402 bp, Glycine max
  Peptide Sequence Number=SeqID_197980
atggtcaaagtcgtggtcagcccaaaagacacaaacctgttcacagaactcagactcatctgggagatactcagaccagagtttcaggagacggggaaggagtttcatgacgcactcagaggccatgatcttctccaaagatggagacatgctcataaattgtgtgtcctcgaccaaatcagatcagatctccggtctctgtctccaaaagctggaaaccatatctcctcgacctccaccaccgcaatgcctagtcaaaatggtgtaactgcttcctttgcgtcatccccaaacttcctagtccagagagtgtttgcatttggtcaggttgaggaatggggagaagttggaaacgctctacaaatgcaccgaagtaatctttgtaggtctcagctagaatga

SEQ ID NO: 81203 - DNA, 439 bp, Glycine max
  Peptide Sequence Number=SeqID_197981
ttttaataaaactgtcgtcgccgtcaaagcttcttcttcttgttgttgttttctcccaccaccagaaatccacactcttgcgacaaagaaagagaacaaagaagatgttgtgttgaaactctcttgtggctctcccactcaacaaaaccctcacgcacatcgcacacccacttgttggagtccctcctcctcacgctgcagtacatcgggtggaatgctcaacgacatcatgttagataagctcaaatctagggttcccaaaatggtgcatcatgttctcttttcttttgatgaagaaattgtccaccatgatcatgttgtcccttctcgcaatcaatcgatccaccatgtcaaaatctttgactcgcgctctaagtacgagattgggagagacttgtacgaaacacttgaggatgaagcagaaggggaagatgagtag

SEQ ID NO: 81204 - DNA, 297 bp, Glycine max
  Peptide Sequence Number=SeqID_197982
atggctagtcctggttttgtcaagggcctagttctggacttgttcaaccaagtcttaaaggttggaagtaggcgcagtatcaaaaaggaaacctgggctccattcgaagagacgaagtttggtctttctccctcacatgatccttccatgagctacttggttggcatcgtgaaaaagaatgttgatcaccctcacgcaggaagaaatgatgaatttatctcctgttgttcaaagcaattaaaaagcaaggttaaggatttcattttcaaagagaatggaacattctccaggatctag

SEQ ID NO: 81205 - DNA, 150 bp, Glycine max
  Peptide Sequence Number=SeqID_197983
atgccgcaacttcttaagctcctagccttaactttgatatggtggagtactgacatattgggagcaactgagttgaaaggtccagttagcttcgagtataaagatttgaaagctggaacaaaaaatttcagtgctgacaataaaccttga

SEQ ID NO: 81206 - DNA, 1629 bp, Glycine max
  Peptide Sequence Number=SeqID_197984
atggaggtagctgcgaacgcgcggaaccccgccgctaagcgaaaattcgacgacgccgtttctaacggcgtcgccgcccccgccgacgtcgatctctccctcctcgaagccatcgagaagtcgcagaacgcggtcgaagccctcgatctccgagccctaaagaagcacgtgctctccttcgagcgtcgcctgaaggataacatcgaagcgcgccttaaataccctaaccaaccggaccgcttcgccgattccgaagtagaactccacgaagagcttcagaagctgaaggtcctcgccggcgcgccggagctctacccggacctcgtcaacctcaacgtggttccctccatcgtcgacctcctcaaccacgacaacaccgacatcgccatcgacgtcgtgcaattgctccaggacctcaccgacgaggacgttctcgacgacaacgacgactccgctagggttttggtcgacgcgcttgtcgacaacagcgcgctcgagctcctcgtgcagaacctgcaccgcttgaacgattccgatcccgacgagaacgccgccgtgtacggctccctcgccacggtggagaatatgatcgaggtgaagcccgcggtggcggagctggtttgcgagaagacgaagttgctgaagtggcttctcgggaagataaaagtgagggagtttgacagtaataagcagtatgcttccgagattttggcgattttgctgcagagtagtactgtgaatcagaagaagctgggacagatgaatggggttgatgtggtgcttcaggctgtggctatgtataagtctaaggatccgaagagttccgatgaggaggagatgttggagaatttgtttgattgcttgtgttgtttgttaatgccgttggagaataaggaacggtttgtaaaggctgaaggggttgagttaatgataattattatgaagcagaagaaattggcttatgggtcggccattagggcgcttgattttgctatgacgaagtacccgccggcttgtgagcgttttgtggatgttttggggttgaagaccgcgtttgcagctttcatggaattgttgagagtgtatccggtgcttgtttttgaattgttgttattggtgtttgtgaaggattatgctattcctttaagtaagaagaacaagaaagaaaggtaccaagaggatttggaggagcgcattgtgtcactgattgcgtcattatttggtggaatcttgaggggttctaggagagaaagattattaagtaaatttgttgaaaatgagtgtgagaagatagacaggctaatggaactatacatcagatattcagatagagtcaaagcagaaactgaacggttgaatcaagttgagcttgatgacttggagttgattgctgtcattttgggtcatctttggtgctcagagcatccacaaatgagagggagaattgaactacttctcaagcagaacaaacttagtaagaagcatatcaaggatatacttcaggagtatcatgacaatattggtgaccttgatggaccggaagagaaggagagagcacagacaaaaattcagaaggtaatggagaaggaacaccgatctgcaaatgtcgttgagatcatagccatgtag

SEQ ID NO: 81207 - DNA, 240 bp, Glycine max
  Peptide Sequence Number=SeqID_197985
atgtcctacaactgcattctatctgaggccatgtcagaattgtgctggtattttctgatgaaggctgccattaggtctttccaggaatggactcaggaagattccagattggtgtaccaagtgatagttgcacatgtcctgcaacagcatggcgctcagcgaggtgtgcaaatgaaaatttctgcaactctcgctcagtctggctcagggccggctcagcgaattaaatgcatcctatag

SEQ ID NO: 81208 - DNA, 849 bp, Glycine max
  Peptide Sequence Number=SeqID_197986
atggcaaaattttacttgatgagtgcacgcctgattttctgtactgctgcgagttctactaaattgttcacggatggaatgacaccagtagaattcctagttattgatgtcaaaagtcaggtttctcaagaggctgaatatggaagcagtttgtttgagaggctggtatcgttgggacataagaagcatctgcttaatgttcagtacagaatgcacccatccatcagcgtattccccaataaggagttctatgagaaacaaatttctgatgccctttttgtcagagaaatgagctataacaggcgttcccttgaaggaaaaatgtatgactcctactcatttataaacatagccaagggtaacacggttggaagaacatggccgaggctgctgctgtttgcaagattattgaaagccttgaaaatggatcctaacttctctgtcagtgttcgttctgttgatggctttcaaggtggtgaagatgatataataataataatctccactgtgagatcaaatgggaatggaaaaataggtttccttgacaaccggcaaagagctaatgtggcactgactcggtctagacattgcctatggatattagggaatgaaaaaactttaagcagtgatgacaagaaactggcaaaggccattgaggaagaagccttgcgtattgaaatacctgatgaatctgagtccccatttaagaaactcagtctaaggggaacatcacgaacaactgctaccaccttaagggtctttcaggggcagaccaaggacaccaaggtggtgactggtgagggatgggaatatatagagattgcacgggaacaacaatacgagttgtaa

SEQ ID NO: 81209 - DNA, 918 bp, Glycine max
  Peptide Sequence Number=SeqID_197987
atgagtatgaacaaaaaatcagcttctagaaaacagactgttagtgttggtgttatatcaccatataaagctcaagttcttgccatacaagatgctcttggaaaaaggtttgttggtaatgttgataatgacttttccctgaaggtttccacggttgatggtttccaaggtggtgaagaggatgtgataataatatccactgtaagatataataacatgggatatgtgggattcctttctaattttcaaagaactaatgttgctttaacaagagcaaggtattgcctttggatagtaggtaatagtgaaactttgatgaatagtggctctgtttgggagagattaatccttgatgctagggctcgagggtgttatcataatgctgatgaggatgagaggttatctgatgctattgcaacttccgtgattgagcttggtcaagttagtgatttattgaaattggattctctgctctttaagaaagcaaagtggaaggtttgcctcaatcaaagttttctgatctctatggcaagaattaagagtgctgagatttgcaagaaaatatgttccctgctgatgcaactttcaagtggttggcgtcagcctcaccggaacataaatattagagttttggatgatacttcttcccaacagttagagctgtataaagtcaatgagtcactttatcttgcatggaccatagatgttctagaggagaactcaaattatgttcaagttttaaagatttgggatgttttgccattgtctgaggtatccaatttggtgagggatgttgacatctcatacaagagttcgaatcatctatccaattataatcttccacaagctgatcccatgcaatttctatgtaaccaattttcttcgctcagactgagggacataaattggaatcaatag

SEQ ID NO: 81210 - DNA, 1545 bp, Glycine max
  Peptide Sequence Number=SeqID_197988
atgaagatgttgtcagaagctccggcgtgtgaaataactgacattaatttgtctgaagattactcacctccacatgatttgttataccagatagaaatgaaaacaatagtagctagtgataaaaaaggggatgtttatgagcctgaggttggacatctcattgctttgactgataagaggccaacatgcattgatgatttgaacaagcatggaaattcctatcttattgctttaattaggaaggttagaaagaaaaatgacgatgaaaatgtttttgaggttcaaatactagcctcacagcccattaaattggaaattttaacaacaaatatgcgtatatggaatgctctgaactcagatccagatggtccagtcatccatgtcagcaagcaactgctccaacctgattctgctgttggggaaaattgtgctcaatgttactcatttcaaaggtacactgatgatggatcaatgattggtgctgccattcgcttattcgatttaaacaaagctcaagaagagggcgttttaagttgtttagctgcaagggaatgctctcacaaaaatactgtgaaattgatttggggtcctccagggacagggaaaacaaaaacagttgcctcattactatttgccctcctcaaaaagaaatgcagaacacttacttgtgctccaactaatgtggcagtactggaagtgacatctaggtttcttaggctagtgacagagtccattgattatcacacttatggtcttggagacatattattatttggaaacagaaagcggatgagtattgacgatcgtgatgatcttcttgatatatttcttgattaccgtgcaaatattcttgccaagtgctttgctcccttgtctggttggaaacatcatttagaacaggtgatattgttacttgaaaatcctgaagagcagtatcgtgaatatttaaagtgtgaggaaaagagggattatgagatagatgatgatgatgattgcttgaaagaagagaatgaactacatgcaattgcaagtcaacaaacaaagcaagagaagaagcatatgtccaaggattcaaaaatttgtaagcaaaatgagtggatgaaaataattaataaaactttaagagaaaacaggttgtgttttaaggaggcaaacaaaaagatgctatcaaacaattcgattactgatcaacaattgtataaggccaggaaagaatgccttacaaagctgaaatcacttcaaaagattattcttcctgatttttttgatgaatatacaatcaaaaacttttgtatcaaaagatcgcgcatgattttttgtactgcttcaagctccgctagattgcatgcagtagaacattatagactagaaatgttagttatagatgaagctgctcaactcaaagaatgtgagtcaaatatacctttacaacttcctggtcttcgtcatgttgtacttattggagatgagaaacagttgcctgccctagtcaaaagtgagatttctggcaaggcagggtttgggagaagtttgtttgaaaggctg

SEQ ID NO: 81211 - DNA, 147 bp, Glycine max
  Peptide Sequence Number=SeqID_197989
atgaaaaacgatatgacctcctttgttttcgacaaaccctcccttgctctcaaacacaagttggcaccttctgattttcttggcacaagaatcttcaacatcgacggaaacacctggaagtttcagtcctcacctcaacagcagtag

SEQ ID NO: 81212 - DNA, 300 bp, Glycine max
  Peptide Sequence Number=SeqID_197990
atgggtgcccaaaggagattaacagtgggaaggtgttgcagattgatttggttgtgggaagatgcaccctcctttaacattgcacaaacacccaatattattgagcagtttcaaaagtgtcatatagaacatcctattgcaaaattctttggtgaatgtactgatttaaaaataaaattggatcgctgtttcagagaagagaaagctttgaagcggaaggccaactttgaagagagcaaaaagttgaaggaacagttgcgagctttgaggaaagaaaatgctgcaagcagtggtcaatag

SEQ ID NO: 81213 - DNA, 132 bp, Glycine max
  Peptide Sequence Number=SeqID_197991
atgtggaaattgattaaggaaaggatggaaaataaggtggttaatttcgtgggtcttaataaggttaagtggtggctggacagaagtatagaaatggcaataactgaagctacagggctccaaatgaggtga

SEQ ID NO: 81214 - DNA, 312 bp, Glycine max
  Peptide Sequence Number=SeqID_197992
atggtgtatcctgaacgtgccaaaaacaatccatgcaccgtgctgacatacataattctagcggctggagcagtgtcaacggaggtgctgtacctggctgagaaaggagacgctgcaacaacgtggagctcagcttgtggctcttttggtcgattttgccataaggtcacagcatcagtagctatcacatttgtggcagtgttttgctatgtcttgctttccctcatttcctcatacaagctcttcaccaactatgatgcaccagcaagcaggcccactgcagccattgaggttgctgctttccctggctag

SEQ ID NO: 81215 - DNA, 354 bp, Glycine max
  Peptide Sequence Number=SeqID_197993
atgtgttcaaaatctaacttgtccctctttcttgaatccatgaatgaacaatcatcacccatttttgacccaaattcgccattggcatccacttctgacctagatctatcacccatgaatgccaacagttgttgtgtgaggttgcaaaggatggtgctccacacgaggctacgaggtgggttgggttttgagtatttgttgatggtgttgttgagggagtttttgagcaaagcaatggcctcaaagatttggtgttttgggagggaagttgtgcacaaatttggtagtgtcaggatcgacagtgtgagagtggtggaggtggtgatggttgtggcacggaggagattggggtag

SEQ ID NO: 81216 - DNA, 286 bp, Glycine max
  Peptide Sequence Number=SeqID_197994
tggtagagttccatgggtttcgtctccgccagtggcttcttctccgaaaaggttgggattggaggctaagggatgttgtgttggttgtatagtgaagggacaatatggtggttttggttggaatagggatggacgtgggttgttcaaagatgttggtgtggtgaagagtggaaaaaggccttgtaagggttttggagattcatgtgttgtagggcaatctattgtggtggagaggggacattgtggaggtgatttaaggtcgtccatggtgatggagatgggttag

SEQ ID NO: 81217 - DNA, 354 bp, Glycine max
  Peptide Sequence Number=SeqID_197995
atgacagtcggtgcttgtattcttccacaactagagacagacctttccagctttccagatagtcctgaatctaatcttcgatttcttgccatgcttgctggtcctctttatcctattcttcatgtggtgaatgaaagcagagatgcaaaaattaaggtggatgagaaacataataggaaatatcagtttaagaatgaatgtgtttgggaggaagttggaatagcatcaattgacggcaaagcagagacttgttttgtagtagtggtttggtcacacgagaagtcgacccataaaaaaattggtatggattccattgctagactcaatatgtgtaaggcacctgaagccctttaa

SEQ ID NO: 81218 - DNA, 285 bp, Glycine max
  Peptide Sequence Number=SeqID_197996
atgcatactggtatagatcaggtcgtactgagtttgataaatctcggtcagactgccgttgagatcgtggcgcagcagctcaggcacccgcgcgggcaggcagtggggtgcagtgccagcggggccatcacgtccagcggcacggcggttaagcgcccttcaagcagcaccgttttcggttcgcgcccctgctcgagacatagcttgtggaaattggtgttttgcgtcggatccaaccacagccgttccggcgtcacgaaccagccgcggcggtcggcgcggtaa

SEQ ID NO: 81219 - DNA, 291 bp, Glycine max
  Peptide Sequence Number=SeqID_197997
atgaccacacttatccgtaaggaattagtggctctactacgggactaccaagatgtctttgcttggtcataccaagacatgcctggtttgcgttgtgacattgtgcagcataggttgcctttgaaccccagttgttccctggtgaaacaaatgctaagaagaatgaagcccgagatgtctttgagaatcaaagaggaagtggaaaagcaggttgatgttggcttcttggcagtggctcgataccctgagtgggtggccaacattgtgccagtccctaagaaagataggaag

SEQ ID NO: 81220 - DNA, 572 bp, Glycine max
  Peptide Sequence Number=SeqID_197998
atggtggaaagggagaaatttgatcatatagaggaaaggctaagggtcattaaaggaggcagaaattatgcctttgttgacatggcacagttgtgcctagtgcctgatgtcgtcatccctccgaagtttaaggtgctggacttcgataagtacaaggggactacttgccccaagaatcacttgaagatgtactgcaggaaaatgggggcatatgcaaaagatgaaaaactattgatgcatttcttccaaaaaagtcttactgggccagtcgtcacatggtacaccaatctggagtcttcctgggtctgttcttggaaagacctaatggttgccttcattaggcagtatcagtacaattctgatatggctccggttagaatgcagctagagaacatgtgtaagagggagcatgaatctctcaaagaatacgcccaaaagtggagggatctggcagctcaagtagcacccccaatgatggagagggagatgataacagtgatagtagacacgctactgatgttttactatgagaagatggtgggttacatgccttcaagctttgtcgatttagt

SEQ ID NO: 81221 - DNA, 330 bp, Glycine max
  Peptide Sequence Number=SeqID_197999
atgtccttggagttacttctcttagttgaaacctactgggcgcttttaacctatcaacttttgaaatttgtttctgcggaaaggggattcagaaattcagatgttgtgaagaaagcctccctttggtggagagatttggcaaaggtgggagaaaatgttactcttggatggggctgcagaggggccaatgtcgattgggaagctgtgttgagggatccggcaaaacttagagcttgggcatggattaatgcgaaagggaaaggaagaaaattctcttattatgaatgggagatgaatcctagggcttgtttgaattgtttaacgttatga

SEQ ID NO: 81222 - DNA, 2448 bp, Glycine max
  Peptide Sequence Number=SeqID_198000
atggtggcacatgcctgctgtcacatcactccaaatcaacggtctagattttcaggccacaaaagagagcctttagtttcaacaccacacttcactctcagcttccatggcgatctcggggaacgtgccaccgttgctgcaggttgttttgtattttgtggggggtgtggactatggagtgaatgcattggcatcatcatggtggaggagaatgttggggaatgcttgtgcaatggcttgaagcaaattgagggagaaaaacaaaagaaggtaaagcttgattatatgaagctttcaacatcagggttggggcagcagggacatgaaggaggggagaagaagtgtctgaattctgagctatggcatgcatgcgcgggccccctggtgtccctaccaactgcagggactcgtgtggtttacttccctcagggtcatagtgagcaggttgctgccacaactaacagagaaattgatggacacattcccaattaccctagcttgccaccccagttgatttgccaacttcataatgtcacaatgcatgcagatgttgaaacggatgaagtatatgctcaaatgacattgcagccattgactccgcaagagcagaaggatacatttctttctatggaattgggcattccaagtaagcagccgtcaaattatttttgcaagacattaacggccagtgacaccagcacgcatgggggattctctgttcctcgtcgtgcagctgagaaagtttttcctccactggatttctcgctgcaaccaccagcacaggaactaattgctagggatctccatgatgctgaatggaaatttcgacatatttttcgaggacagccaaaacgacaccttcttactacaggctggagtatatttgttagtgccaagagacttgtggctggagattctgtgcttttcatatggaatgagaagaaccagctccttttgggaatacgtcgtgccaatagaccgcaaactgtaatgccgtcatcagttctatccagtgatagcatgcatattggacttcttgcagctgctgcccatgctgccgcaaccaatagctgttttactgtgttttataatccaagggctagtccatccgagttcgtcataccactttcaaaatatatcaaagctgtgtaccatacacgtatttctgttggtatgcgtttcaggatgctttttgagactgaagagtcaagtgtccgcaggtatatgggtacaataactggcataagtgatttggattctgttcggtggccaaattctcattggcgctctgtcaaggttggttgggatgaatcaacagctggagagagacaaccacgagtgtctctgtgggaaattgagccattaacaacattcccgatgtatccatcattatttcccctcagactgaaacgtccatggcatcctggcacctcatctttgcatgatgggagagatgaagctactaatgggctaatgtggatgagaggtggacctgtagaccaaggtctcaattccctaaattttcaaggagctggtatgttgccctggatgcagcagagactggatccaactttactaggaaatgatcagaatcaacagtaccaagccatgttggcagctggtttacagaacttaggtagtggatatctcatgaagcaacaaatgatgaattttcagcagccttaccactatcttcaacaatctggaaacagtaattctcctttgcaacttcagcagcagcaaccaattcaacaatctgtgtcttctaacatgctgcagccacaagctcacgtgttgacagagaacctctctcagcacctccttcagaaaccacataacaatcaagaagtccaagcacaacagcagcaacatacttatcaagactcgctcttaattccgagtgatcaactccatcagagacaacactctggcattccttcaccatcatattcaaaaccagatttcttggattcgagcatgaagttccctgcttcagtttctcccgggcaaaacatgcttagttcactttgtcctgaaggaagtggcagtctcttgaatttatcgaggagcagtctgtccttgctgactgaacagttaccgcaacagcaatggactcaaaaatatgcacctgtgcaggtcaacacctatggaggcactgtgtcacatgcacaatattctggaaaagattctgcaatggtgctaccacattgtaactcggatgcccaaaattctacgctttttggtgtcaatattgattcatctggccttctccccatcacagtccctggttacaccacctcgtctgctgacactaattcatcaacaatgccattagcggattctggtttccagggttctctatatggttgcatggattcatcggagttgttgcaaagcgcagggcatgttgacccagaaaaccagagtcaaacctttgtcaaggtatga

SEQ ID NO: 81223 - DNA, 561 bp, Glycine max
  Peptide Sequence Number=SeqID_198001
atggagttaacatcattgattttgcaaccaaacttgacacacttgtttccaacattcacatgctgtgtcaaactcaaaccttctttccagcatttgcagaataataaggaattatcactgaaaatcagtcgaagggtaggggttttggcagccataacttccttgattttgggtgtaaatggaaattttgggacacaaagtgcaaatgcatttgagtttaaatttgtggcccctgatatgacagttgaagatgcattgagtggagtgaggggtcatgcacaagatttgttacatgttagagatttgttagagttagagtcatggagagcagcacaaaagacattgagacagagctcagcaattctgaagaaggatatttataccataatccaaagcaagccgggaattgagagggcacaactaaggaagctctattctactctcttcaacaatgtgactagacttgattatgcagcaagggataaagatggaccccaagtctggcagtgttacgagaacattgttgtggctgtcaacgacattctatccagaatagaatga

SEQ ID NO: 81224 - DNA, 333 bp, Glycine max
  Peptide Sequence Number=SeqID_198002
atgagggttgcagttcatgaaactaagtacgagagcactgactccttcgaccagatctgttctagcagccacacactttgtggaaatcagactgcagatgcaagcactggttttggtgcagttggacagcaagtgctggtggatctacaaaaagcaacacccaaaattagtggctactttacagctaccaagacacaagtggcaggcggtgcaatctatgccattgcacaatgtgatgaaactttcacacaggccaattgtttggattgtttgacaaatgaacagagcagcacgcaaggttatctttccaatacaaatggtagggcattttga

SEQ ID NO: 81225 - DNA, 201 bp, Glycine max
  Peptide Sequence Number=SeqID_198003
atgatgataacgacattggtagtggtagacaacaaccaaaacaatgatgttggtaatgatgatgaaaatgacaatagtgttagtgttggaagcaataatagtagaaataataatgatgactatgatggtgacaacaacaatagtaatgataatgatggccgcaaaaatgtatatatggtagtagtcacaatgataatgtag

SEQ ID NO: 81226 - DNA, 316 bp, Glycine max
  Peptide Sequence Number=SeqID_198004
atgttagaaggtcccattccagatggatttgggaaagtaatgaactctcttgaaggtctttacctctacggtaacaaactgcaaggcgagattccatctttctttggtaacatgtgcgcattgcagagtttagacctctcaaataacaagttgaatggggaaatttctagcttcttccaaaattcttcatggtgcaacagatacatatttaagagcttggatttatcttataaccggttgactggcatgttacctaaaagcattggattgctatcagagttgacggatctttacttggctgggaattctttggagg

SEQ ID NO: 81227 - DNA, 318 bp, Glycine max
  Peptide Sequence Number=SeqID_198005
atgaggacgcgtagccctctaaaggcgaaggcgtgcagccctctacaggcgagaacatatagtcctctaaaggtgataggtactagtacccaagggtccacctttatgagaaagcaagagatcgactcatcgagagggcagattgactgtccttttgaaaaaggtgataattcatgcaaccttatcctatcttttgcaaatctctccgggaactccctcagagtaagcaagatgtttggatgtcttgataatgctaaaggatcaagtgcttctaagttttattcaagacaagaatccaagaaaaatcaagatatatga

SEQ ID NO: 81228 - DNA, 462 bp, Glycine max
  Peptide Sequence Number=SeqID_198006
atgtgtaggtttagaataggtagcgaaatacctttggcaatttacactttgggtgtgatggcaaaatacttggatgtattagaaataccaagaggtgtacatgtgcaatttttggtaatccaaaatgctttgagtatgcatgtatgtgaatttagccaaggagatgtgtgtgatgttatatgccatttttgctttaagagtaacgtcccactggtaaaactaactttccaaatgtttgccttcgcaggaatggccccgaggaagcttgcctcaaagaggtccaggaaggacaaggcggccgaaggaactagttccgccccggagtacgacagtcaccgctttaggagcgttgtacaccagcagcgcttcgaagccattaagggatggtcgtttctccgggagcgacgcgtccagctcaaggacgacgagtatactgatttccaggaaggtgggatcctctag

SEQ ID NO: 81229 - DNA, 123 bp, Glycine max
  Peptide Sequence Number=SeqID_198007
atgctggacttgtttggcagtgattttccttgggcaattttgatgctcagagacagcaatatccaccactccatctgttggcctgtcccagagggaatgttgacaatgaattcccctgactag

SEQ ID NO: 81230 - DNA, 279 bp, Glycine max
  Peptide Sequence Number=SeqID_198008
atggagaatgcactaaccatctcttcgcatagcttccaactcgaaggaggaggtcacatgaacgaatcgcaattcatggggctccgaaaaagctgcaaactcgaaggtggaggacacatgaacgaaaacgcaattcatggggctccgaaaaaggttgagaatggagaattgcatttagcaatcactatgaatggctccaaacttgaaggtggaggacacatgaacgaaaacgcaattcatggggctccaaaaaaggataagaatggagaattgcactaa

SEQ ID NO: 81231 - DNA, 294 bp, Glycine max
  Peptide Sequence Number=SeqID_198009
atgtttgttaaatttctcattttcttctgcaaagcttcaatttgtagcctcaaatcagccactaccattgtttctcttgagacagaagacgaattagaaattcgaatagctgcacgtcttccatggtggcattgccgaatgaaactaccagaaaatgcacaacaactgccacttgcagacatggacaaatcaagtgaacaagcagcagggactgagcctcagagtagaagaagaagaagcaactcagcgtgggaagaagaagaagaagaagaagaagcaaccagcagttcgtaa

SEQ ID NO: 81232 - DNA, 2256 bp, Glycine max
  Peptide Sequence Number=SeqID_198010
atgtctctgaagctcgacgaaatcctccatcgcctttcaccttcatccccttcctcgacctctccaaatccaccaccacagacccctgtccctgcaaccacacataagatgaaattagaagttccccggtttgatggtacggagccactgggttggatctttaagatcaaccagtacttcgaataccacaatacgcccgacaaggatcgccttaccattgcatccttctacatggaaggacgcgcattggcttggttccagtacatgacaaccaatgctcagttcacgtcatgggccgcgttcttgcaggccttacaaacgcggtttgcgccgtcccaatacgacgatccaatcggtatgctttttaaactaacacagacaagtacggctcatcagccactcacgttagtgcaagctgctggccttgcaagtcttcaggaggaaaagctttcttcctcccgtgcgattcctcgacaacctccaccgcaattgctcccagctcctgcgcgcgccgcacccttgccaccactgttgccgtcaccccctcggccccctccacctccactgcgacacctcactccggaggaaatctcctcccgccgcgagcgcggcctctgctttacctgtgatgagaagtatcatcgaggccgtaggtgcgcctctagagttcttctcatgatagcagaagaagaagacccttcatggtctaatatagacacgggacccgaggcgctccgtttaatgggccttatttccgaccaccgtgttatcgtcctggtggacggcggtagcactcataatttcgtccagccccaggtggtcacctccctgcgcttaccatgccagacaatttcgaccccacttcgtgttatggtaggaaatggccagtacttggagtgtgttagcatctgtgaagacgtcttggtgagcattcaagaccataccttcactcttgatctttacatcctacccatttccggcgccaatatcatattgggggttcaatggcttaaaacggagttgtgtgccataacgacgacagtgaagaaatggaggcaatacctcctaagccagcatttcattataatcacagatcatcggagtctaaaggagattcttactcagacaattcagacgccggagcagcatatatatatggcgagattaatggggtacgactatgaagttcattatcgctccgacagccataaccaagccgcggatgccctgtcacgactaccagagacaaattcttctttgtctctgattctatctgtacccacattgacttttatggaggagcttcacaaacaattagaggcaaactctgagcctcttatgtccattgccggtaccaagtcgtccctgggaggatctctccctggactttattgccggactacctccatatcaggggatccaccttggtatgctcccgagttcccacaccgcacatatgactgcttcattttcatcaacatcgtggtgaaaatccatagcatccctcggagcctagtttctgatcgtgaccctctttttatcagcaaagtcttaaaccatgtgatcgagcaatatctgagagcttttgtccatcgccggccaagtatatggggaaaactgctgccgtgggtagagtggtctcacaacacttcgtggaacgcgagtacaggaactactcccttcgaagtaacctttggtcgcaaaccttttaacttcgctgagtacatctcggggtcatccagggtcgatgctgtggaagaaatgatgattgacagagacaccacctttcaagccattcgtagtaagctccttaaggctcagaatgcaatgaagtctcgagctgatgataagaggcgtgaagttaactatcaggtgggggattgggtcctcctcaaactgcggccccgccgggaggtaaccaccaagggagctcaggctattaccgacaaattggccaagcatttctacggaccctttcaggtcttagaacgcattggaccaggcatacctctgcctactgaattactcaatgatcagcctttggtttttccactggtaattttggatactcgccgggcccccgataaaggcacatgggaggtgcttgtccaatggaatggtctctctccagatgacactacgtgggagaattgggaagagctttgcaacaattaccaccttgaggacaaggtggtctttcaagggacggagaatgatacgaatgctcaaacagaaacacacacatgcaggaggtga

SEQ ID NO: 81233 - DNA, 348 bp, Glycine max
  Peptide Sequence Number=SeqID_198011
atgacattttctgctgcttttgtttacttgaaagctgaacatgaaaataactttgtgtgggaacttgaaaggtgtagaggcctttttcacatatttgatggattgcgaaaattggttgtcatagatagagatctagctttgttgaatgcaatgaaaattgtgtttcctaagtcagataatttgttgttccagtttcatattaatgagaatgtgaaagcaaagtgtgactatgaagacagtttgacaaagtttaaagttttctatcaaccatggcatgagtttgttgcgtatgtgaaagatttggttgatccttctcaaggaaatatttgtaaaggtatggacaaataa

SEQ ID NO: 81234 - DNA, 243 bp, Glycine max
  Peptide Sequence Number=SeqID_198012
atggagaattgtcagccatggatgaaacgagagcacgaattgtttgggactaagttcctggtattcgaggatcagacaagtccaagcaaggaatttcctaaaggatttctagaagttgaattcacacactctgcctcaaacatagtcattgaggtaagggaactcaaagagggtgactctttgattgtccagaattttgaagttgaagatgttattggtgaatcaggtgaagttgtccaatag

SEQ ID NO: 81235 - DNA, 378 bp, Glycine max
  Peptide Sequence Number=SeqID_198013
atgtctcctccacctctagaaacctcacaatctctcaaaatctcatccaaagcttcgcaagatggcttcctcgtcaagctcagctctctcttagtctctccacagctaaaaactctcaaaaaactcaacaacctctccaaaatcgagatttcagctttaaataggcattcctgtcgcgccagtcttctctcgcttagcctaagggttaaaggcggtgcccttagcgagttcacactcgctcagcgcctctacacatctcatccttcttccagattcttctgtgtgcttagctggaggatggtgtgcttagcggatgactcgcccagcgagttcataaattctccacttcaccaatcttgcccattttgcctgaaataa

SEQ ID NO: 81236 - DNA, 189 bp, Glycine max
  Peptide Sequence Number=SeqID_198014
atggtagtagacccttctactccattactgaagattctagaggaccctgccacaccagtcctgggactgactaccactcctccagccactcctgtgctacattttacagatgaggagggcactcaggatcaggatacccagcaggatgacaagggtgaagcatgtgttgaaatcataagttttgaatga

SEQ ID NO: 81237 - DNA, 276 bp, Glycine max
  Peptide Sequence Number=SeqID_198015
atgttgcaaaccctcaaggacaacaagttgtatgccaagttgtccaagtgtgagttttggctagaggaagtgagcttcctaaggcatgttatatccaagggaaggatagtagtagatccttccaaggtaaaggcattgatgagttggaagagtcccaagttcatagagggtttttctaagctaactttagctttgactaagctaactcgtaacggtcaagcttttgtgtgggatgcccagtgtcagagtagtttccgtacccttaaggagaggtag

SEQ ID NO: 81238 - DNA, 684 bp, Glycine max
  Peptide Sequence Number=SeqID_198016
acttatcaaggtaatccttgtggcgtctatcctgacttatcttccttcaccgaaagtggcgtctaccctgacttatcttccttcactggaagtggcgtcatccaaatctccgtagcctgtatcaagcgatccgctcctagtcagggtacgaaaaacctaaggaggccaatgggaagtgatcaatatatctattcaggaagcaagatgacttcacatgtagaggctgttgggacttgcagtttagttttaagtagtgaaaatggtgttgcttataattctatgaatgtttctggtgggttaaaacaatgtgttgtaaatgaggattcctctatgttgtggcaccagagatggggatacatctccattgagagaattaagcgattagtaaatgatggggtacttagtacttcagattttgctaattttgagacttgtgtggattgcattaagggtcagcaaactaacaagttgaaaattggtgcaaagagaagttcaaacctattggatattattcatacagatatttgttgtctaaacatggaagcaagtaatacgagatactttatcaccttcatagatgattactcacgatatatgtatctttacttacttcattctaaggatgaagctttggacgcctttaaagtttttaatgctaaagtagagaaacaatgtggaaaataa

SEQ ID NO: 81239 - DNA, 324 bp, Glycine max
  Peptide Sequence Number=SeqID_198017
gttgtaggagagcatcatccacacaagatggttcaaggtaaatttgttccaaatttgggggaggcactggtgcctaagaaaaagggcaagtatggggaaggaatgaatgaaaaagtgaaggttattatatggatgaatgctctcctagaacctaagtttttgaatcctagaaaaaccatgaattgttggcagcctaaccccattacaagcctagaaagtccttcgtattcatttttgtgtgttcattactgtatgataggagatgaaatgcaaaggttggaacttgtgttggttgtttatgatggaataagcctaaacacttga

SEQ ID NO: 81240 - DNA, 180 bp, Glycine max
  Peptide Sequence Number=SeqID_198018
atggccagatgccgagccggatccagaggcaaagaccaatcaaggttagctcgcttgggcgagcacccctgcacctggaaacataaaaacgagggagggggagtttctctccacccaaaactctcctccctcattcaaaaaatgcaaacacccacgggatttgcagattttcacccctag

SEQ ID NO: 81241 - DNA, 198 bp, Glycine max
  Peptide Sequence Number=SeqID_198019
ttctatttctcgatggaggcaagggatataactcagcggtagagtgtcaccttgacgtggtggaagttatcagttcgagcctgattatccctaaacccaatcgaactccagtcgaatatgaagcgcctggatacaagttatgccttggactggaagagaattccgaatcagctttgtctacgaacaaggaagctataa

SEQ ID NO: 81242 - DNA, 222 bp, Glycine max
  Peptide Sequence Number=SeqID_198020
atgttgtcatatgttcaatgcacaacattgcttgaaaggctaaggaacaagaggctagtgttcgtgggggattcactcatcagaggccaatgggtttccatggtttgccttgttgactctatactgccttcaaccctcaaatccatgcattcgactgccaatgattcactaagaattttcaaggccatagtaagtcctcactcttgtaacagacatgcataa

SEQ ID NO: 81243 - DNA, 150 bp, Glycine max
  Peptide Sequence Number=SeqID_198021
atgtcaggacatcgtgtccgacatcgtggatcctgcagcttcacttctgcacttgacttttatcttgcattgtacagtaactccagtattctcgggctggatcaactccagtattctcgggcaggatgtcaggacattgtatccgacatc

SEQ ID NO: 81244 - DNA, 3210 bp, Glycine max
  Peptide Sequence Number=SeqID_198022
atgtcaagtgttgtttgtcccacatgccttgcctggtttcttctcttcacatcaaacctatggtctcaaaatacaataactacctatgcattaggaaatgagactgatcattttgcactgctcaaattcaaagaatcaatatctcatgacccttttgaagtgttaaactcttggaatagttcaagcaacttttgcaagtggcatggagtcacatgtagtccacgacaccaaagagttaaagagctaaatctaagaggatatcacttgcatggatttatatcaccctacattgggaacctttctttattgagaatcctcctccttaatgacaatagcttctacggtgaagtcccgcaagaattggatcgattatttcgattacatgtactcaatttcgctgataacacattatggggagaatttcccatcaatttgacaaattgctctaaacttatccatttaagtttagagggaaatcgtttcattggtgaaataccaaggaagattggatcctttagcaatcttgaagagttgcttattggtaggaactatctaactagacaaattccaccttccataggaaatctatcttccctcacttgtctttccttgagatcaaataaattggaggggaacataccaaaagaaataggctatttgaaaaacttgagaattttgcgggtgtcagataataaactatctggttacattcctctttccttatacaatttgtcatctctcaatgtcttcataatcacaaaaaaccaatttaacggttcttttccggtcaacttgttcctcaccttgcctaatctcaatttttttgcagttggtgcgaatcaattctccggttcaattccaacttccatcactaatgcatctgggattcaaacattggatattggtaataaccttttggtaggacaagtcccaagtctagggaagttgaaagatatttcaattctacaactaaatttaaacaaactgggtagcaattcatctaatgacttacaattttttaagtctttgataaattgtagtcagctagaaatattggatataggggacaataattttggagggccttttcctagttttgtgggtaattattccatcacactcacccaactaattgttggtcgtaatcatttttttggaaaaattcctatggaattaggaaatcttgttaacttaattaccttggctatggagaaaaatttcctaactggcatcattccaactacttttggtaagcttcaaaagatgcaattattaagtttaggggtaaacaaattgattggagagataccttcttccattggcaatctcagtcaattatattacctagaattatcatctaatatgtttgatggaaatattccttcaacaattggaagttgccgacgtttacaatttctaaatctttcaaataacaacatcactggagccataccttcacaagtgtttggaatttcctctttatctactgcactggtatcacataactcattaagtggcagtctaccaacagaaattggcatgctaaaaaatattgaatggttggatgtgtctaaaaattatatttccggtgtgattcctaaaacaattggagaatgcatgaagttggaatacctttatttagaggggaactccttccatggaagcatgcctccttcattggcttcattaaaaggtcttagaaaattagacctttcaagaaacaacttgtctggatcgattccggaaagactgcaaaatatttctgttctagaatacttcaatgcttctttcaacatgttggagggtgaggtaccaacaaatggtgtctttcaaaatgcaagtgcaatttcagtaactggcaatggcaagctttgcggtggggtatctgaactaaaacttccaccttgccctttaaaagttaagggtaagaaaagaagaaaacaccataatttcaagttagtggtgatgataatctgtttggttctttttcttcctatactatcatgtatccttggtatgtatttgataaggaaaaggaagaaaaagtcatctactaattcagcaattgatcaacttcctaaggtatcataccagaacctaaaccatgcaactgatggattctcatctcagaacttgataggaataggaagccatggctctgtatataaaggaagacttgattcaacagaaggatttgttgctataaaggttctaaaccttcaaaagaaagggtctaacaaaagttttgtggctgaatgtaaagcattaagaaatgttcggcatagaaacctagtgaaggctgtcacgtgttgctcaagtgtggattacaatggaaatgattttaaagctttagtgtttgagtacatgtcaaatagaagcttagaggaatggttgcatccacagaatggaagtgcagaacgaccaagaacattggaccttgagacaagattagaaattgtggttggcgttgcttctgcactacattatcttcaccatgagtgtgaggaaccaattattcactgtgatataaagccgagtaatgttcttcttgatgatgacatggttgctcatgtcagcgattttggcttagcaagacttgtctcgaaaatcgacaactgtcataaccaaattagtacaagtggaataaaaggaactataggttattttcccccagagtatggagccagttctcaggtgtcaacaaagggtgacatgtatagctttggcatcttaattctagagatcttaactgggagacgaccaacagaggaaatgtttaaagatggacaaacccttcatgactatgttaaaattgcacttccaaataacttctcggagattgttgatgcaactcttatttcaatgggaaatgaatcatctcctacaataacagtatcagaacaaaacagcatcttcgagattgtagatcatttgcatcctaataccaagaagtgcttgttttcattatttaggattggtctagcatgttcagtggagccaccgggacaaaggatgaatatgatggaagtcaccaaggagctaaatatgattagaaatgttttttatgctcgaaggatcagagaaaacatctcatcattagaccatatggttattcaacaaggccaagtaacatgccaagattatcctaatgatgacactgttggaagcgggttcatgttggattctcttgttgagtgcaagtttgaatga

SEQ ID NO: 81245 - DNA, 264 bp, Glycine max
  Peptide Sequence Number=SeqID_198023
atggagatgttggatatgttggtgtggttcaatgtttattttttggtgaacaagttcaagcaattgtgtaagggttatgaccttgttaaccatgaaagtttttatgttgttactaatgaaggtggtgccctcgttagagttgcagatttgaccgttgtagggtatttgaaagttctacgaatgtcttcagttggtagtggtatttataggatttgttggttgcaagcaggtgttcactgtttagtcacatgcactggtaaatga

SEQ ID NO: 81246 - DNA, 483 bp, Glycine max
  Peptide Sequence Number=SeqID_198024
atgaagagagaggaaaaatctcaacgtggcagaaaagaaaggcaagccagcaagccaggtgacagaaaaccaagacaaaagctggagggcttgggcacaaatgcacatgggagaagcaatgaaggtgcagcaagccaactagacacatggcagaaaacaaaggcaagacaccaagccaggtggcagaagactaaggtcaaagctggagggttgtatgcaagaacatttacacatgcaaaaatcaagtatttcaaaccgccatttgataagctagttggtcatgagttagaatccagaaacatatttgcatgtgcaaagataagactccgtacaacgaccctcccccatatataccttcacgtaaagagaagcctccgtccattgggatacgttagttttttattcaagtattggatcaatgatggaaaattctataccaaaagcacagacagtaagagcaatgaacggatgcaaatatcatag

SEQ ID NO: 81247 - DNA, 474 bp, Glycine max
  Peptide Sequence Number=SeqID_198025
atggcgatcgatcaaattttatcaatagatttggggccatgccgtgccacactgattaataagttgtatggcttatacgggttattcaattatggcattggcattcacctgttggagtcagaaaaggttccggtgaaaaaaagagagatcaacccaaaagaaaatcatatatcgtttcaatgctcagacatgaaagttataatgcagaaactggatgcaatgaagattgagtatgtgacagcagttgtggaagaaggtggaattaaagttgatcagctgttctttcatgacccagatggatatatgatagaaatatgcaactgccaaaatcttcctgtgcttccaatttcttcctgccctctaaagcagctcggaggagaagctacattcaagattaattgctttgcagaagaatctatgtctatgctgatgatggacaatttcgtgatggatatgttgaagatttcaatataa

SEQ ID NO: 81248 - DNA, 324 bp, Glycine max
  Peptide Sequence Number=SeqID_198026
atggctatggataatgaagatatgaacactgacggaacctccataggcaaccctgttaatgctggatttggtggtatcaacggggatcagcatggcaactggatcactggttattctggaagctgtggttacactactagcttgaatgctgagctccttgcaatctattttggtatgaatttggcttggaatttgggttacaaaaccatcgtttgtgaatccgattccaaggttgcattggatttaatcatgaaaggcatcaactcaacgcacccttatgctcctcttattcagaagatcgaagctcttcgtcgtcaagcttga

SEQ ID NO: 81249 - DNA, 921 bp, Glycine max
  Peptide Sequence Number=SeqID_198027
atgctctctgactgcagtggaggtcagggtggtgatggtggttcaaattgtgcatatgccttgaattatgctcttcacccctctggatgggattctgtggttttagaggcactcttggctcctggttcagaactttggatgttcaatgaggttccagaaaaggaaagagagaagaagcttgttgatggtggacttgatgtctctgagctagagaacataaaacttgtccatagggagggtaatgctgtgattaggcggcacctggagggtcttccattggagacttttgattctcatttcaggtttgaaatgaatcggtgtgtcttgaggaaggaatcctctagcacttatgcaccatatgagtcagtggaggactctgttgctcactctgattcaaggtctctagctacccttctactcattcgcgatatacagtcaagacgtctaccatacagagacacaaaatcaacttctctgaggttatctgggttctctcacaactcttggatccgtgaaatgcagcaagcttcagataaatcaattataattagtgaaattttagattctaggactagaaatctagtgtctgtgtccagaatcagtgattatgtgttatctaatgagctggtaagcatggcactagctatggtggctgaagacaagcaaattaaccgtgttcttgaggaattatttgcagaggaggggaacgagatgtgcattaaaccagcagagttctatttatttgaccaggaagaactgtgcttttacaatataatgattaggggtcgtacaagaaaggagattgttatcggctatcgcctggctaaccaagatcgagctattatcaacccttcagaaaagtcagtgccaagaaaatggtcccttggtgatgtttttgttgttattgccaaaggagattga

SEQ ID NO: 81250 - DNA, 1866 bp, Glycine max
  Peptide Sequence Number=SeqID_198028
atgcgaaagagcaatgaggaatcttcgaatctgagtctgaggaagccacccttgaagaggagcaagacaattccgaatccaaaacacacagcctctgccccccatttctctgtctctgtctctgactccgacgagcaatggaactacccttctttccttggcaccaccaccaagaaaaaaaaaccatctttcaaaccccacaacctcaacctttccaaaccctcacttgttccaccaccaccaccacctcctcctcctcctcctcccacttcctcctctccactctcttcccaagtcaccagacctcaacaccatcagcgcactccgatcttgtatctgctttttattacttctattgtttttgtacctcattccgcgtatctacaatataggctcacaaaactggaggatgagaaacttaacctgtgctgccaaattgatttttgtcctggcaatgaaaggacatctatagaaaaagttgatgcttcattttcttatatcctgaacgctgacagtagaacagttgctttgtatattgtggtggtcacccttattttgccttttgtgttgtacaaatatcttgattaccttcctcaaataataaatttcttgaggagaacaaacaataataaggaggatgtaccgttgaagaagagagttgcttatatagtggatgtgtttttctccgtatatccttatgcaaagctgcttgcccttctctttgcaactctatttcttataggctttggtggtttagcattgtatgcggtgactggtggtagctttgctgaagcactttggcattcttggacttatgtagctgactcaggaaatcatgccgaaacagaaggaaccgggcagaggattgtctctgtgtcaattagttcaggtggtatgctaatatttgctatgatgcttgggctagtttcagacgctatatcagagaagggttcacttttgaagcagctagcaatagcaaataagagtgttggtggtggtgttattgtggtgcttgcagaaaaagaaaaggaggaaatggaaatggatatagcaaagctggaatttgatttcatggggacatccgttatctgtcgaagtggcagtcctcttatactggctgacctaaagaaggtttcagtttctaaggcacgtgcaatcattgtattagcttcagatgaaaatgcagatcagagtgatgcacgtgctttgagagttgttcttagcctaacaggtgtaagggagggcttagggggtcatgttgttgtggagatgagtgaccttgacaacgaacctctagtgaaacttgttggtggagaactcattgaaacagttgttgcacatgatgtaattggacgtttgatgattcagtgcgctctacagcctggccttgcacagatatgggaggatattttgggatttgagaatgccgagttttacatcaaaaggtggcctgaactggatggtctctttttcaaagacgtattaatttcatttccggatgcaatacctattggagttaaggttgctgcagatgggggcaagattatcataaatccagatgatagctatgttctgagagatggggatgaagtccttgtcatagctgaggatgatgacacttatgctccaggtcttcttccagaggtatgtaagggactttgcccatggatacgtgatccacctaaatatcctgagaagatattattttgtggctggcgccgtgatattgatgatatgatcatgctctggtggccatgccttggccacaaggggcctcctgtgggtttcaaatccctgcaagctggtgggttttttttttttcaatcattcagaaagattaaacagaaacaggaaacaagaagctaa

SEQ ID NO: 81251 - DNA, 417 bp, Glycine max
  Peptide Sequence Number=SeqID_198029
atggtcgtttgtattggctcagagcttcaacgttcaatgtcgagcgtctcgatatgttacgggactcaatcagacatccgagaaaaacgttattgtcgtttgagttggctcagagattcaacattcaatttcgagcgtctcgatatattacgggactcaatcagacatccgagtaaaaagttattgtcgtttgaattagctcagagattcaacattcaatttcgagcgtctagatatattacgggactcaatcagacatcagaaggttcaacattcaatttcgagtgtctcgatatgttacgggactcaatcaaacattcgagtaaaaagtcaatgtcgtttatatttgctcagagattcaacattcaatttcgagcgtctcgatatgttacgggactcaatcaaacatccgagtaa

SEQ ID NO: 81252 - DNA, 150 bp, Glycine max
  Peptide Sequence Number=SeqID_198030
atggttgggaaaatcttttcaaaccgtgtggagaagttgttgatgttcgtctacatacagatgctgaagggaggtttagaggctttggacatgttgagtttgcaacagcagaagcagcacaaaaagtgtggtactggattggcattataa

SEQ ID NO: 81253 - DNA, 348 bp, Glycine max
  Peptide Sequence Number=SeqID_198031
atgaccttcatgatagaagacaacaacctgtcaattatcattgtgccatggctcaccctcatggaggccaagaccctagtagccaaccaaacccctgaaagtggctcttatcattctgttcctgtcattttgatctgcaacgtaaaattcctgatgggcaataaatcagatcccaaagctggtgctactgctgtgccccctctccgaattgggaagagagagggtgagaatgaagatgagcagcaagtgactgcaaagaagcagaagagagatgaggttgcagaggagcaaaggattatggatgaaattgtttcagatgattccttcgcagattttgaaccagataag

SEQ ID NO: 81254 - DNA, 1278 bp, Glycine max
  Peptide Sequence Number=SeqID_198032
atggatttcagctccaccgtcgacacttctcgtcctttcacctccgtcaaagaagccgtcgccatatttggcgaacgccttctcctcggagaaatctactctccaataaagagagaatcatcatggaggctgtcatcaccatcaccatcaccttcatcaagaccaatgaaaactgatgaagagaataacaacaataacaatggccagcttgctgatataataaagaagctggaggcggagcttgagcaaacaaaggtggagctgaagctgttgaaggaaagagggagcgaaacggaggtggcattggcaacgctcaacgcagagcttcacaagaacatgtccaagttggctcaggccgaggccacggcggcggggaaggcggcgacaacaaagacggtgaggtttgagatcagcgaagatagaaaggatggaacagtagagaagaaaaaagagtcacaaagtttgtctcacatgctgagtcttggagaaaaagatcatcttttcggagggaaaaagggcaaaaaacagaaacagaaacagaaacctatcatccctctcaggtcgaagaaaaacaagagcaaattgggatcgaagaatttgaagaacaccacaagcaagatgcatgttgttgtggtgctcaacacgcaatcctactgcagaggcctagaacctccttcatcttctccttccgtcgtttccaacaagggaacaaggactttgagtttcaggaggctgctgctgcgtccttctcttgggattcatttatcgcgtagctttgctttaaagtgtgttgttactccgaacccagctgtggaattgccattaactgctgaaaatgtagaaagtgtattggatgaaattcgaccctatctcattgcagacggtgggaatgtggctttacatcaaattgatggcaatgttgtgcgcttgaagctacagggcgcatgtggttcctgtccaagttctgttaccaccatgaaaatgggcattgagcgtcggttaatggagaagatccctgaaattgtggcagttgaaccaattgctgatgaagaaactggtcttgagctcaatgaagataatatagagaaggttcttgaggaaatgagaccctacttggttggggctgctgatggaactcttgaattggtggccattgatgagccaattgtgaaggtccgaatcacaggtcctgctgctagtgtcctgactgtgcgtgtagctgttacacaaaagttgcgagaaaaaatacctgccatagcagcagttcagcttttatga

SEQ ID NO: 81255 - DNA, 273 bp, Glycine max
  Peptide Sequence Number=SeqID_198033
atgaaggtgttgcaacggcttgtgccaggttgtgataaggtgactagaaaggcccttatgttggatgaaataatcaattatgttcagtctttacagaatcaagttgagcttgtgacactcctgaaatttttccttgtcctagcatatcggaacctcacattgcaatgtttaactgaggtggcagcccttcaatttgggaattattatgatgtacagtatgtcaagatgtataacatattcatggggattcatattgttccaaatatgagttga

SEQ ID NO: 81256 - DNA, 1740 bp, Glycine max
  Peptide Sequence Number=SeqID_198034
atgagaaggacaagaagtttcggtaatgttgggtgctatggtgcaatgggagtggcagatatggaaagttgcggtgacagagatctcacgcgatgtttgggaaccctagagatgaaagggaagaagaacaccatgaccaaaaacgacgttgaagacgacggagctccggttccttcaccaacagtatccgattccgactctgattacgaggactcttcagcagatgacgacgacaaatcttctgactcgctggattctcaatctgaatcggaattagaagatgcttcacctgagaatggtggctccggcgatgtagaatctgcagaagatgaggacactgtcaatgatgaagacggtggaagtgagagctctgatctccatcaggaaggagctgagagtgattcctccgaggatgaggtggtggctcctcgaaacaccattggagatgtgccattgaagtggtatgaggatgagcctcatattggatacgacatcaaggcaaaaaagattaagaaaaaggaaaagcaagacaagttggattcatttcttgcaagtgttgatgattctaagaattggcggaagatctatgatgagtacaatgatgaggtagttgagttgacaaaagatgaaatcaaacttgtccgtagactgctaaagaatcgggcaccccattctgactttgatccatatccagatggtgttgactggtttaaatgggaagacgccaaacatccattgtctaatgcacctgaaccaaaaagaaggtttattccatcaaagtgggaagctaaaaaggttgtacagtatgttagagcaatccgccagggattaatcacttttgacaagccaaaagaggaagatggtccatatctcttgtggggagatgattctggttcaacagaaagagcaaatcatttggcttacattcctgccccaaagcagaagttacctggccatgatgagtcatataatcctcctctagagtacattccaacccaagaagaggtcaattcttatcaattgatgtttgaggaagaccgccctaagtttattcctaaaaggtttgcatctatgaggagcattcctgcatatgagaatgctatgaaagactgctttgaacgttgtttggatttgtatttatgtcctcgagttcggaaaaaacgtctcaatatcgatcctgaatctttaaagccaaagcttccaagtcgaaaggagcttaagccttatcccacaacatgctatatcgagtataaaggccatgaagatgctgttacatcaatttcactcgaagcttcaggacaatggatggcttcaggtgggatggagatgggtcccttattttctgttatctgcaaaggttcaagtgatggaactgtccgtatctgggaggttgaaactggcagatgtcttaggcggtgggaggttggtgaatctgttagctgtgttgcttggaatcctctgcccaatattcatcttctggcggtttctgtgggccaagatgtacttctacttaacacttgtttgggggatgacgaagagcagaaacagattaaggagcttctctgggttgactcatctacagcattggatgactctggcaaccaagcacctagtgtaagctggcttaaagatgataaacatatgggtttaaggttaaggcactttaagactgttactgctgtagaatggcaccggaaaggtgactacttttcgacagtgatgccggcagatatcctttga

SEQ ID NO: 81257 - DNA, 447 bp, Glycine max
  Peptide Sequence Number=SeqID_198035
atggctccttcatttgacataagtactcacacgatatgcgtgatggatgcttcaggtcacttgggcttcagccttgtccaaagactcctccaaaggggatacactattcatgcctctgttaaaaaatatggggaagaaaacctattcaatggaatttcatccgatcctgataagcttaaggtttttcgatctgacccatttgattaccatagcataatcgatgctctccgaggttgctctgatctttgtgactggaatggtgtttcttgcactgcaactcgagatcatgtgatcaagctgatcttgcatggcaacagtctcgttggagtaatacctaaagaattgggcatgttgaaatctcttaaggtgttggatttgggaattaatcacttaattggaccaattcctccagagattggaaatttgacccaagttatgaaaatgtaa

SEQ ID NO: 81258 - DNA, 363 bp, Glycine max
  Peptide Sequence Number=SeqID_198036
atgaaggatcttgttgaggcttcttttgtgttggggattgagattcatagagatagatcatgccatacactcaagttatctcaaaattcttacattgatagagtcttagagagattcaatatgcaaaattgtaaacctatagatgttccagttgtcaaaggtgacaaattcaacaaggaccaatgtcctaagaatgagattgagagagttgacaacttagaggttgtggggtgcacggattcaaatcttggtgggtgccttgatgataggagattggcttttggatacatctttatgttggttaagggtgcgatattgtggaagagttttggacacctaattttgatcagtgtgggaaaataa

SEQ ID NO: 81259 - DNA, 717 bp, Glycine max
  Peptide Sequence Number=SeqID_198037
atgaatggagttattggagaatgcactgagttgagggatttgtctgcccaaaggggacaattttctaaattttgtgtatgctcatggattaatccatctatggagaggtctaataggttgaatttgattgctatcaagaagactgtctctgaacatcttttgagtggtcttccagagaaagcaatagctaaggagttcctcaatgctttgggaaagaggtaccaagtatctaatgacgttgagtccaaatgtctaatgaaacaattaacaaacataagatatgataatgctaggggtaaaggtcagcaccacaatgtaggaggtcctaggtcagctatctttaagaaagaaaaatttgaaacacttgaaaagttcaaaatttttaaaaacgaagttgaaaaggagttggggaaagtcatcaagattgtgaggtttgaccgtggtggaaagtattatggtaaatatggtgtaactggacaacatatggggttattcgccttatacttgcaggattatggaatagttccacaatacaccatacatgggagtcctgaacaaaatggtgtagccaaaaggcataacagaacacttaaagatatgatgagaagcatgatgagtagatttgagaccacaattgtgactagagatatagttggttctcaagccaatgatatgtttgatcctcctattggggatgagaatgcacaaactaattga

SEQ ID NO: 81260 - DNA, 155 bp, Glycine max
  Peptide Sequence Number=SeqID_198038
atggctacatctgatttcacttatgaaagcttgtgcactcaatatcctgatgagggtgttccatatgttctcaagattggactaatacatttgctgcccaagtgtcatggtctttcaggtgaagatccttataagcatcttaaggagtccatatt

SEQ ID NO: 81261 - DNA, 321 bp, Glycine max
  Peptide Sequence Number=SeqID_198039
atgtgcatgctgctccacgtgcgagctgcagcaaggtccacgactagggcaaggagtgtgccaacgagcatgacgaggcccgcgagggggaagtccctccaggggtggtgcgacgccacatggcattggcgagtgcagcgtacgagtcgaggagcacgtggaccagtgaggtcaaaaagaggcttcctacaaaagattccagcgaggaccgccgacgacgacatcccgaccacgctcgtcaccaagatgacgaagatcgagatcaattttaggtgtgccaccgcgcgggtagcgttcgtcacgcacgctgagagagaatga

SEQ ID NO: 81262 - DNA, 657 bp, Glycine max
  Peptide Sequence Number=SeqID_198040
atggagttggatgagttcaaggctgaattggagaggcgtaacttccataagtgcctcaccaatttagctgacaacaacatcgatctagccttggtgaaggagttctatgccaacctctacagccccgaggggccttcaccaaaacaagtcagaatccgaggccacttgataagaattgatgcagacagcctcaacaccttcttggagacacctgtgtttgttttaaatgctgaaggctatcctgggaagatccttaggaacgatttaacaactcttgctcagctagacatgaatgtaggagctttcatctctggccagatcacatctatggcccagtctaactcctctagactgttccctgctcttatcatagctctatgtaggtccagaggggttgcttctgacagcctggtcttcgaacgcttgagcccgatcattaacttggcctatatcaggaagaactattggaaccttgatgatttgacagctattattagaggggccaggagagcgagggcaaggccagctaaggctccttccacatctgcacctcctcttccagcacgtacctcaacagctccttctaccccaccttctgtagcctggcccgggattcagcctcccattcacagggaagacgaaggtcccactgcttag

SEQ ID NO: 81263 - DNA, 129 bp, Glycine max
  Peptide Sequence Number=SeqID_198041
atgaggaagcaggaacaagaaagagatgatgtgggtttagacttactgcacgccagaggttggaagcaatatagggaagtgttgtcacggtgggaggagagtgagcttcaatcaaagacggttttgtaa

SEQ ID NO: 81264 - DNA, 1281 bp, Glycine max
  Peptide Sequence Number=SeqID_198042
atgaaagaagaatttgttgcgaacaagcctcccatgttcaagggagccaattatgactattggaagaaaatgatgattgccttctttgagtccactcacattgatatgtgggatgttgtagaaaagggcaatgacattcctttagatgctcacaagaacgagatccatagggataaatggaaaaatgataataaatctagatttcttctcaactcatccatgagaaatgccctattgtgcgctctatcacaagaagaatattccaaggttcacgacttcagaagtgccaaacaaatatgggacaccttagccattacctacgaagggtcctctaaggttaaacataacaagttgagccttctaacatccatcaagaatcttgattcaatgactcttgaagaactcgttgggattcttaaagttcatgaacaagagcttgctcaagatgaaggaataaagaaagggaagttgctagcccttatagctcaaagaccaaaatgcaactttgtgtccaaagagtcatcatccgtagctcttgttgttgatgatacttcaaaggaagaatcaaatgatgatgactctgatgaagaagatgaggagctaagtctgatcactagaaagataaaaaagatgtggaaaaacaagaactcctctaggttcaaaagttcatccaagagatccgtccataaaaaggagaaaagtccagacatatgctatgagtgcaaaaagctaggatacttcaaatcagaatgttctgaccttgaaaagttggaggataagaagaagaaattcttcaagtccaaaaagaagagcctcatgagcacttgggaggacctggacgattcatcgtgtaatgaggacaatgaggaagaagccaacctgtgtctgatggctgatgtgttcactagtaaaatagaaccagctctggacgcaagcttagatgatgaagatcctcaaattaattactctgtcaactttgatagtgatgaggtaatattcgaatctagagaagatttaattaaagggtacaatcaacttctttttgcctttgcttatgtctctaaagcttatagaaaactaaataaatgctttcaaaatcttgaaagacaacatggggacctcaagaaaattcatcaagctcatttagttgattttgtcctggaaaccacttcacctggtgatgttctgtttgtgaggaggttaaggcattattggatgaaaaggtatctagtggatgaaagattcttcttaaggattttcaagacttggaagaaagggtga

SEQ ID NO: 81265 - DNA, 222 bp, Glycine max
  Peptide Sequence Number=SeqID_198043
atggctccagagtatgcaatgaaaggtgttgtgtccatcaaaacagatgtgttcagcttgggggtgttgctgctagagatacttagtagcaaaaagaataatagtcgctatcattcggatcacccactcaacctcataggatacgtgaagatcttttgtggatgttccaattcttgtaggcgtggcagctctggaatgcaggcagagctctggagcttatag

SEQ ID NO: 81266 - DNA, 249 bp, Glycine max
  Peptide Sequence Number=SeqID_198044
atgacagcaggaaggcgcgggggtggggaagaagaagaagcagaagaagaaaagaaagaagccaaaaagtttaatcaagttttaattgggaaggagagagatcattttgagggcgtcatcaatgagatcgaacgcaaaggaaatttattggaaaaactcttgaagaaaagtattgaacagagatgcacgtctaggagacgctccacctcattcatgaaaatgggcatggatgttgcgccattgcgatag

SEQ ID NO: 81267 - DNA, 1221 bp, Glycine max
  Peptide Sequence Number=SeqID_198045
atggaaaatctggaagagagagcaagaaaggtggaggaggaggtgcgacgcatgatcaatggagcagacacagaagcattaaggttactggaattgattgacgaaatccaacggctgggattgacctacaagtttgagaaggacatattcaaagccctagagaaaactatttcgttggatgagaatgagaaacacataagtgggcttcatgctactgctctcagcttccgtttacttagacaacatggcttcgaggtttcccaagggactatatacacacacatatacacatatcaaagacttaccgggcttcacttcttttacactgtgtcttgtgagactaacacaaaggatgaagagaaaggaaacgataaagcatcctatgagactgagaaaggaagaaggacttcaaataatagtgtgagaaggagaacaaattgtagaaccgcgagagtgacagtggggttgcagcgcaccacgactgaggatgacagtgatattacaacatcacgagaggatgcaatgctggtgatgacggagttacagtgccgtgagaggttacaaatcagagtgcaaaaacgttcaagtgagagtgatgagagtgagaggtttcaaaatgtgtttaagagatttaaagacaaggaaggaggtttcattaatgaacttaaaggtgacatgcaaggattattgagtctatatgaagcatcttatcttggtttcgagggagaaactcttttggatgaagcaagagcatattcaataacacatctaaaaaacaacctaaaagtaggtgtaaacaccgaagtgaaagaacaagttagtcatgcactcgaacttccttatcatcgaggactgaatagactagaagcacgatggttccttgaaaaatatgagccaaatgaatcccaccatcatgtactactcgagcttgcaaagatcgatttcaatttggtgcaagtaatgtaccaaaaagagttgcgagaactgtcaaggtggtggagtgagatggggctgacaagcaagttgaagtttgtccgagacagattaatggaagtctatttttgggtgttgggaatggcacctcgtcctcaatttagtgaatgtcgtaaagctgtcactaaaacgtttgcattgatcggcattatcgacgatgtatatgacgtgtatggtactttagacgagctacaactcttcaccgatgctattgagaggttcgtataa

SEQ ID NO: 81268 - DNA, 420 bp, Glycine max
  Peptide Sequence Number=SeqID_198046
cttattcatcatcattttcattgccttcaccttcgtacccctgaaaggcaagcaaatccatctctttcgttactgacatataatgcacttgataagcttgcaactgcaacaacaattgctcctttgatttggcagtactactcaaatagcaatctgtcactcaatttcaaggcctacatctccacctccatcaatacctttttagctacatctccacaagggttgacatctttcacaacacctggttgggaagacactaaaccagatgtggaacactcctttatgcaacaacttgtcctttttcattctgatggttttgctcgctttatcccttgttgtgcagatgtagatactggaaagtcaaaggaggagttgttgttgcaattgcatgcttatcaaatgtacatgccagcaatgtaa

SEQ ID NO: 81269 - DNA, 678 bp, Glycine max
  Peptide Sequence Number=SeqID_198047
atgaatacacttccagactacatgaagttgtgttatttggccgtctataacaccgtcaatgacacatgttatagcaccctgaaagcaaaagggcataacaatatgtcctatttgacaaaatcttggtgtgaattgtgcaaagcattcctccaagaagcaaaatggtcaaacaacaaaatcgttccaacattcagtaagtacctagaaaatgcatccgtttcctcctcaggtatggctttgcttactgcttcatacttctccgtgtgccaacaacaagacatctcaaaccaacaagctctttgttctttaactaatttccaaggccttgtgcgttcctcatccaacatttttagactctgcaatgatctagctacctcagcggctgagctagagacaggtgaaacagcaaattcaataacgtgctatatgcatgagaaggacacttctgaggagcaagcacgtgaagagttgacaaatttgatcgatgcggagtggaagaagatgaatcgagagttcgtttcgaattctacacttccaaaagcttttaaggaaatagctattaacatggctcgggtttcccattgcatgtatcaatacgaagacggacttggaaggcccggctacaccacagagaacaaaatcaagttgctgctaatagatcctgttcccattaactaa

SEQ ID NO: 81270 - DNA, 435 bp, Glycine max
  Peptide Sequence Number=SeqID_198048
atgggtgttattttcatgaccttcactgaaccccgatcacattggcgtgatcagaatttcaaaatgatgtccctttgtaaaacccaaaatgctctcagccctttcatgcttgcgtggaaccgacgagcaaggacgaaaaagaaatctccaagtgatgcaatgaggaacccgtgggtagctcacaatagggtctttggcacttgttttgggccacgttcatacgttggatgttgtgtatgttcgtgggaggcgaagtgcactgagcttccagggtctttggcacttgctctaggccacgtacatacgccgtatggagtgtatgtcatagggggcgctttaattggtccatggtctttggcacttacttttggccgtgttcatagctcatacgacataggaaatagagtaactgtggcagagtgtactttgtactga

SEQ ID NO: 81271 - DNA, 264 bp, Glycine max
  Peptide Sequence Number=SeqID_198049
atgatgataagaacatcggatggtctattgaacttacttcaagccactatgacccctactcatgatgccttgctatattacaatgggaggtggaacatgtcacgccaacacgactttgtgggttactcgttcacaagaaaaaatccaaaaagatttgacattccttccgaatgtaccatcgatggattgaaggatatgatcaagcaagttgcacctcaagggattcccccttatggtattcatgaatcacaaacgataaggtga

SEQ ID NO: 81272 - DNA, 327 bp, Glycine max
  Peptide Sequence Number=SeqID_198050
atgtcgatcttgatgatccttcacacctgcagaggacaacaacatatcttcttgtgcacctcatatattgatgcttactctggagaaggtttgcaaggccagaggcatttggtcatgaaggaagttttgcctccatctgttcacatggttaagtctgctgcttcaaagttccttttggaatggttgttccaacatgagcatgaacaccgccaatggtctgctgcagtttctcttggattaatctctagttgccttcatgtaacagatcataaagagagatatcataacatcacaggacttcttgaggctagtgggagtggtgaatga

SEQ ID NO: 81273 - DNA, 360 bp, Glycine max
  Peptide Sequence Number=SeqID_198051
atgttggaaagggagagtgcagggtataatatactcttaattgaggaatcattatcgattccaattgcacgcgcagatgcagatgttgatgctgatgttgtcatggcaatcgctcaagaccgctacctccttgtctccttcaaccatgccatcagcgcaacgatgtcgttcttcaccgcgatttttgcgtttttgatcacatgcaagaaggagactggggtggtgttcggtatcgttgtggcgagcaacagtgaagcggagaagacatcaccgcctctctctctctctctctggcgcgatggagacagcggaggccttggtagggacgttagggttgctgctggctgcatttgcaaataa

SEQ ID NO: 81274 - DNA, 330 bp, Glycine max
  Peptide Sequence Number=SeqID_198052
atgaatgtaactacactttttggcaacctaagggactatgagttagatcttgggagactgaaagatgaagaagaagttgacaagaagaagaagggattagccttaaaaacaagcactttacaatgtgaaggtgcatcttccattgaaggaaaatgtgtggagtcgccaccaacgtttatttggggaaaatgtcggaaaaatcaaaatggaaaaggtcaagggtttgcatattttgaaaatgaaggttcgggagttgtttatgcacggggaagggtgtttccctcgctcctacgtatcctcgagtgcgatgaggatatcagacctacgtag

SEQ ID NO: 81275 - DNA, 345 bp, Glycine max
  Peptide Sequence Number=SeqID_198053
atgagagtttttcttgattccgttgataggggagtaggagatgtagttgtaaatggtcctcatattcctaaggttgttgttgatggaaaagaggtagaaaaatactttaattcattaagtcatgaaggaactacaaaagtaaagagggcaagaaagaaaactctcattcaagaatatgaaatgtttagaatgttatcgagaaaaagcatttcagatgtgcaaaaccattttacacatgtgctgagccatttgttggctcttggaaagaattttgtgttagagataagggaatcaacaacttggaacaacctaaggctaaagcttgaagctcaaagaaaagtttaa

SEQ ID NO: 81276 - DNA, 504 bp, Glycine max
  Peptide Sequence Number=SeqID_198054
atgtgcagatcatggtgggcgaggacgagcccgaggacagaatcatcaaccgctttaagaaggaggtcctcaaagccggtgtgctttaggagtgcaaatgtagaaggttctctgagaacaaagacgacaagatcaagaggaaggcctgcgaagcttctagaaggaatcgaaagagagggtttggacctacgatctttttttcttcctttccttttcaatcacgcagccaagaagccacaatcaagagcttgggcacagaataaacatgattctgaaaagaagaaaaaggatgctgctcatgatgatattgatgattgggaacttccacatgtagttgcacgtactacagatgcttttatttttattactggagtgaaaaatgatacaacacttgctcctcttaccaaaaaggagattagtgacctagtcttgaccgctgattttaaatttgaggatttgtctagtgattccaagggaaaaccaactatggatgaacttgaataa

SEQ ID NO: 81277 - DNA, 468 bp, Glycine max
  Peptide Sequence Number=SeqID_198055
atggacatgactaggatggatgaagaggaggctaaggagaagaaaagtagaggcttagtactaaaatccccaataccatctactgataagagtgatgaagaaagtgtagaaggttctaagagtaagaatctaacattgattgttagaaagttcaagaagtttttggagaacaagaatcccaaaggaagatcctttcagcacaataagaactttaagaagaatgacttgaccttctctaattttattagtttcgaaatgcttctagcacctcaagtgattcaagcaatgaagaagagacaaatctgtcttatggcggatgatgaagttgaaagcgctataagttcttctgatttcaaaactaaacttgatgaaaactatgatcaacttttagatgccttgaatgagatgcatgaagaggctcaaaagttatctcaagccaacaactctctcaagggaaatttgagatga

SEQ ID NO: 81278 - DNA, 2460 bp, Glycine max
  Peptide Sequence Number=SeqID_198056
cccacggatttatttgatcctggtgatgctatattaatttctatattctttggtgagagaagaaaatttcctggagaaaggttcagtacagatggatggcttcgaatactaaggaagcttgggcttcgaactgctactgaagtagaggtaataattgaatgcgccaaaagagttgagtttcttggaattgagtgcatgaaaacaggagatttggatgattttgaggcagacacaatcaacacttgttctgaagtttcgcctgaagtgtgggcattaggaggatctgtagttgagtttgttttctccaactttgctcttttctttagcaacaacttctgtgatcttcttggcaatattgcatgtgtacctgctgaactggggtttcctagtgttggttgcaagagggtgcttgcttcatataatgaagctattttgtctaaagattggcctctagcttggagttgtgctcccattctatccaaacaacacactgttcctccagagtattcatggggacctctgcatctacagagtcctcctcctttttgtacagttttgaagcacttgcaagtaattgggagaaatggaggggaagatactcttgctcattggcccattgcttcaggaatgaacattgaggaatgtacctgcgagattttgaaatatttagacaaagtttggagttcactttcttcatcagatgtggcagagctacacaaagtggccttcctgcctgttgcaaacggaacgcgccttgtggctgctgatgctctttttgctcgtttgatgattaatttgtctccatttgcttttgaacttcctactgtatatctcccatttgtaaagattcttaaagatttgggacttcaggacatgctaacactttctgctgcaaagggtcttctattaaatcttcagaaagcttgtggatatcagcgactaaatcccaatgagctccgtgcagtgatggaaattttgaatttcatttgtgatcagattgtcgaggggaacacattagatgggttaaactggaaatcagaagccatagttcctgatgatggctgcagactagttcattcagcgtcctgtgtctatgttgattcttatggttctcgatatgtcaaatgtattgatacttccagaattagatttgtccatgcagatcttccagagggagtctgtattatgctttgcataaaaaagttgtctgacattgtcttagaggaactggatgagaatcacacactacagactttaggttctctggggtctgtttcactagtgaccatcaaacagaagttatcaagcaagtctcttcaaactgctgtctggactattgttaatagcatgggcagctacattcctgcattcaatagcttttcattggacacaatggaatgcttattgaactctactgcagaaaagcttcaatttgtcaagtctcttaaaacaaaatttctgctcttgcccaatttggtagatgttacacgtgcaggcaaagatttcataatcccagagtggaagaatgattctgcacatcaaacgctttattttatgaaccaatcaagatcccgtattctagttgctgagccaccaacttatatttccctttttgatctcattgctattatagtcagccagatattaggctctcctatcatattgcctattgggtctttatttggttgtcctgaaggatctgagattgcagttgttaatgttttgaaactttgctctgataagaaagaagttgaacccgtaaatgggagcagcaatatggttggcaaagaaatattgccacaagatgcacgtcttgtgcagttccatccattgaggcccttttattctggcgaaatagtggcttggcggtctcaacatggtgaaaaactgaaatatggtaaggtttcagaagatgtaagatcatctgcaggtcaagctctgtacagacttaaaattgaagtttccccgggggatacacaaagtttcctttcatcacatgtattttcatttaaaagtgtatcagcaagcagtcccctaaaagaatcattggtgcatgaaagccatgtattaggcagtaacaggccccatgttgatttccccgagagctcaggaaggggagaaagctactctcaggtgcagcctgtgagagatcagtctggcaaagtttcagctgcagaactggtgcaggctgtcaatgaaatactctctgctgctgggatcaaaatggacgtggaaaagcaggctctatttcaaagaacaataaatttgcaagaaaatctgaaagagtctcaggcagctcttgtgttggaacaggaaagggttgaaaaggcaacaaaagaggctgatacagcaaaagcagcatgggtttgtcgggtttgtctgagttcagaggttgatataactatagttccttgtggtcatagttccattcgccaatataggctaactgaagttggctaa

SEQ ID NO: 81279 - DNA, 261 bp, Glycine max
  Peptide Sequence Number=SeqID_198057
atggacaaaaatcttagaagaactaaaaatactaacaaaaaaatgaatgaaggactaaaagttgaggtgggggcagaagaggtggaggctgaggtgcaaagaaaaaaggaaagtagaggttataaagggaggttgggggcgaaggacggtggggctgacagaggagggtgggggccaacaaaggaggtggcaaaggaggttggtgtgtgtagtgtgaattttaagtggatccacaaaatgtgtctaaaaatttcaaattga

SEQ ID NO: 81280 - DNA, 1736 bp, Glycine max
  Peptide Sequence Number=SeqID_198058
gcggtatcttgcgtacgacttgactcctgttgctggaatagcagcacttatatccagcaatggtcatcatgccaatgtttactcaaggagctcaattatggcccctcttcctatgtctggttgtataaacatgcctattactgtcttaggttgtttccttgtgtgtcacaatagaggccgttatctctttaaataccaagacagagggactttagccgagggacactttgatgctggaaatcaattaattgaatcttggaacagagaggtgatgtcttgtgtacgtgattcctatgttgaaatggttttggagattcaaaagctaagaagagatattccaagttctataattgattctagtgtctgttctgcaatcagtctctctttgaaggcttatggagataaaatctactccttctggccccgttcttgtgagaggcatgttctgagcgaccaacttggtaatcacgataacaaccatccaagtacaacagcagttgttcttaaagctgactgggaatgccttaaagatcgggtaatacatccattttattctcgtattgttgaccttccagtatggcagctgtactcaggaactttggtcaaggctgaagaaggtatgtttctttcacagccagggaatgggttgcttggtaatttacttccagctactgtttgcagctttgtaaaggagcattatcctgtattttcagtaccatgggaattggtgactgaaatcctagctgtgggtttttcagtgcgagaaattagacctaaaatggttcgggatctcctaaaagtctcttcaaaaccaattgctctgcgatcagttgacatgtatatagatgttcttgaatattgcttgtctgattttcagctagcagagtcatccagctctgccagagataatgatcctgctagtgccaatgttttctgtcgggagactgataacggaatcacttcttctcagatggggtctaatatccacggctccactggcatggccactcggggatcagccagttctggagatgcattggaaatgatgacaagtttggggaaggctctatttgattttggtcggggtgttgttgaagatatgggtagagcaggaacacctgtggcttacaatgcggcaggcatagatcaaattcgggaccagaagttcatatcaattgctgcagaactcaaaggcttaccatttccaactgcaactagccatttaaaaaaattgggcttttctgaactttggattgggaataaagagcaacagtcattaatggttcccttgggagaaaaatttattcatcctaaaattttagacaggcctctcttaggtgacattttttctaatttttcccttcaatcactattgaaactgcggaatttctctcttaatctactggccaatcatatgaaactaattttccatgaagattgggtgaaccatgtaatgggatcaaatatggctccatggctttcatgggagaaacttcctagttctggtagtcaaggtggcccttcccctgaatggattagaatattctggaaaagttttaggggctcacaggaagaattatcccttttctctgattggcccctaattcctgcttttcttggtaggccagtcttgtgccgtgtaagagaatgccatctggtattcattcctcctcttttggagtacccaacatcgacaagtgggatttcagaaagagaatctgctggaagttatgaga

SEQ ID NO: 81281 - DNA, 846 bp, Glycine max
  Peptide Sequence Number=SeqID_198059
atggcgacttcttcttcttcttcttcgacttcgagctggcgcgagggcatgtcctccgacaacataaagggactgtgtctcgctctctcctctagcttcttcatcggtgccagcttcattgtcaaaaagaagggtttgaagaaggccggtgctagtggaatcagggccggaagtggaggttattcttacttgtatgagccgctttggtgggtgggaatgataacaatgattgttggggagattgccaattttgcagcttatgcatttgccccagctatattggtcacccctcttgtgctgctcttgctcatattattttacgggagaggctacatatttttggaattcttggttgcgttttgtgtgtcgtgggatctacaacaattgttttgcatgctcctcaagaacgggaaattgaatctgtttcagaagtgtgggatcttgctatggaaccagatatcgtatttaacgactaaccaagaacataatctttctactgcagcatttctcttttatgcagctttggtaataacagctacttttatccttatcttccacttcattcctctctatggccagacacacataatggtttatatcggtgtttgttcccttgtaggttctctaacggttatgagtgttaaggctcttggaattgtcataaagttaacactgtcggggatgaatcagctaatttaccctcaaacttgggcattcactctagttgtaattgtttgtgttcttacccaaatgaattatttaaataagctaaatgaggaaggtcaacaaggaaaacagaagtttgactctcgtttgtcagttggccaagatttccctgtcttttaa

SEQ ID NO: 81282 - DNA, 840 bp, Glycine max
  Peptide Sequence Number=SeqID_198060
cttgcgcgccatcatgctggaattgggcaaggtgccgatgcggaaagccacatcggtgcgatcaagataaagatcaaccagttcgtccgacagggacagaaattccggcaacaaaggctcaagcgccagcgtgcccaatgcaaccgatgcattgacgcggaccgtaccgcccgtgcttgcagaaccttgcgaaagttcgcgttcgacttcctcgaaatcgcgcagcagcccctgactacgctcataataaatctgcccctcggtcgtcagcgacaggcggcgggacgagcgttccaaaagccgcacgccgagccttgcttcgatacgggatataagcttgctgatggtcgaagggatcaacaaaatgacggcccgaagcatgagcctcccaagctcgcgctcctcacgcgaaacgccgaaggccagtcaacaggagataatatgaaaatcgtgaacgcacacggcgcggccatacccgcgctcggcttcggtgttttccgcatgacggatgcggaagtggaaaacgttgttccagcagcgctggaagctggcttccgccatttcgacacggcgcagatctaccagaacgaggctgctctcgggcgcgcactggaaaaagctggggcacgacgcgaagacctgtttctcaccacgaaagtctgggtcgataattatagtgccgaaaaattcagtacatccgtcgacgaaagcctcgacaagctgaaagtggatcaggtcgaccttctgcttctgcactggcctgccgacaaggtggctattgccgaccagattgacatgctgaacacagtgcaaacggcaggcaagacgcgcttcattggc

SEQ ID NO: 81283 - DNA, 2013 bp, Glycine max
  Peptide Sequence Number=SeqID_198061
atggattggacaagagaagaattcatggttgtaatgcaccacatgggaaagttcaagtttgagccatccttgcattatgctgatgttaaaaaggatactttccatggcctgaacattgatacatggtcattctttgaaggtgtgggattgctgaagggtttagtctatgatggtaaaatgaaattttggtggaaagcagaggatgcacaatttgaagggaacctgaaaccatttatgaatgacaatgatgcattgaaattgcccaagtttgcattgttgaataagtgtaaagtagggatttatgttgaacacactgtgtcaattgctgaaattgtagagcaagttgatgatgacacagttaacgtgtgtgggaaggaacaacttggtagtgaggatggtcactttctgaatgttggtgagtctgaaaacgttgatggtgttggtcagtctaaacaaaatagtagcagggatgtttgtagtggcgaactggcgatcagccaaatgatgaagatagcgatgaccatttttcacaagatgcagttagttgtggatgatgaaatgcacatgcaccaaattgaggaagactattttagtgaggaactagttagtgacattgaagacagtgatgttgagggaaatgcttgggcagattgggctagaaaattggctattgaagatgttgaaagggatgccactaagcaatactccttaccttcccttgatgtgcaaccaagatttggagcattttatatgtgcttggacgggtgtaaaagaagttttttggctgcttgtagaccattcataagggctatagttgagtttgaggcaaaggaaagttggaaatggttcctaactttactatttcaagacattggggatgtgaggacatataagtgggtcttcatgtcagaccgacaaaagggcctgaacttagtttttgatgaattgttgggagatgtagagcacggggctagctttgaggaggcatgggatgagaagatgaacatatcaaagagacatgcttgtgctgccattcaagacaacagtcaagaaccagaagactatgttgacaagtattatctaaaggatacttacatgaaatgctatgagcatgcaattacagcaattaatggtcctatcaattggcctgagactcctgctgaaagcatactaccccctgaatataaacaaggtgtgggaagacccaagaaattaaggagaagggagccagatgaagaacctagtgctaccaaatatagaaggacatgtacaaagaaaaaatgtggtagatgcagggaagttggtcacaatgttgggaaatgccctgcagtcattgattctgtgactccaaatgaaaatccagttggtgccactgtcaatgttgatgctacaaatccacaatttgataatgaagtagatggtgatggcacaacagttaatttgacaggatctgggattaatgagagcaatagaatgaatcaagtgcgccaaactgctcaattaaaacaggaacaacatgttgaatctgcaaaagaatgtgggatgcctcaatcaaatcttgttggtgttccaaaagtattaacttctgatgctgtgaaaaaaccaacatctactgctactgctagtgctgctctgaaaccagctattgttggtgctccaaaaattcttaaaccaccaactacacgtgtttccaaaagtgcaccctctactgctgctggtgtgggatctcatgaccaaaatacaaaaggaaagggaaagaaaaaccaccctttaatcccaaccattggtaagaaaatacaagcttatactgttgctcaatgtgtggttgctgctacaaatcacaaggttaagcaacttcaacaaatcaacaaaaaacaaagcagcaacaacagtaagtattcccatcaacacgtgggatcatccacaaaaaaagtagaaggccaaggctatgtgccatttgggaacactcagagtagccacgtgttaaatgaaggacaacatagtggaatctag

SEQ ID NO: 81284 - DNA, 303 bp, Glycine max
  Peptide Sequence Number=SeqID_198062
atgaagttttttattcttgaggtttcaggtactgatctgacacaacgattttgtgatcaattcagtccaatgctcattgatcggaatgacttatggtcgttagctgattctaccattattcgcatgcctctgtcatctgattgcttgaaggttgaacctgaccttggatcaaacagaataaagcatattactgacatatttatggagcatggatctagagcacttctgtttttgaagtcggttttacaggttgtggcaaattcaagcaagaaatgctggggatttgatgtggtgaaaatctaa

SEQ ID NO: 81285 - DNA, 2550 bp, Glycine max
  Peptide Sequence Number=SeqID_198063
atggctagcaatccggagaaatcagctgggaatcatgcccctcatctaatgcagcaggaggaattatttgtatttggagtgagagatctttcaaggtcacctgcagaaagaatgggtacatgtcaaagggggatgatgggtggaagtataagggagtttaatgattggattgcggagttggaggttgaagaagtgccatgggtgggaaagggatttacatggttcaaaccgaatggtactactaagagcaagctggacagaattttcgtctcccctgaatggatttctaaatggcccgggtccttccaacacacgttgcataggaacttctcggatcattgtcctgttctgcttacatctaagagtgtcgattgggggccaaagccgtttagaatactagattgttggctttcagacaattctttcaagaaattggtacaagatagctggacatctaatcatctgagtgggtgggggggatatgtgctaaaacagaaaattaaaaccctcaaagataagatcaaggtatggaacagagaacaatttgggaatactttcaagaaatacaagaagatcgaagatgacttgaataagttggaagaagaatcagatgacagacagttagatcataatgaattgatagtcaggaagcagctccaacaggcgttatgggaggcagctcaagcacatgagtccttattgagacaaaaggcgagatccaagtggattaaggagggtgattgtaactccagatattttcatctgatgatcaattccaggcgtagagctaattgtttgaatggagtgatgattgatggattgtggaaggatgagccagcaatagttaaagaggaaatcaggaggtttttcttacagcatttccatgaaaatgtacaagcaagaccaacgttagatggtatttgctttcagtccattgacatacagcaaaatgacatgttggtggagcgttttaaggaggatgagatcaaaagagcagggattgaacgcatcttttatagccctaattccgaagctagtggtatccccaagttgaagaaggttatgcatctcatcattaatgaaagacagtcagcattcattcaaggtagacatatgcttcatagcgtgatgattgcaaatgaggtggttgaagaagccaaaagaggtcaaaagccttgctttattttcaaggtagattatgagaaggcgtacgactctgtgtcttgggagtttttgacttatatgatgacaagaatgggtttttgcaccaaatggatccaatggatagttggatgtctaaaatcagcatcggtctcggtcttggtcaatggtagtccttcatctgagttctcaccccaaagaggacttagacagggagatccattgtcacctctactatttaacattgttgcggaaggtcttaatggattgctgtccaaagcgatagagaagaggttatacaggggattcttagtgggaacaaacaaagtggagattagcctcctccagtatgcggacgatacaatattctttggggaggcatctatggagaatgttagaactattaaagccatcttgagggcttttgagcttgcttcgggcttaaaaatcaattttgctaagagtagctgtggggcttttggagtgtcagacttatggataagcgatgcagccaattacctccattgtagcttgatgtcttttcctttcaactatcttggtctacccattggggccaatccgcgaagatgtcagacatgggaccctattattactaaatgcgagagaaaactaggtgcccaaaaaagtggtgaacaagttaacaaggttgcagaggaattttctatgggggggagtgtcggagcaaaacaaaatagcttggatccgttgggaaacggtgtgcttgccaaaagaagatggaggaatttgagtgaagcaaggtcagccaataatgaatctacatggtggagggacttgaagattgtagatcagcatcctcaacagggggaagataacagattactagagaaataccctaggctctatagtatatctgttcagcaaaattatttcattcagcaaatgggagaattcaaagagtcagggtgggaatgggacttcaaatggcggagaccgttgttcgacaatgagatagatatggcagtatcatttctacaagaacttgaggggaacagaattcggtcccacagggctgaccagtgggtttgggtggcagattctagtggccaatatacggttaggagtgcctacaatgtgcttagagaggacttattacaggaggaccaggacggagagttcaaggagctatggaaggtgaaggttccatctaaagtaactgtgtttgcatggaggttactcaaagataggttaccgacaagagacaatttgaggagaaagcatgtggagctacaagattttatgtgccctttctgcagaacaatagaggagagtgcagacatcattttcttcagcacatatatggagcatttgaaggaatacagctggacagatggaaggggtggtggctag

SEQ ID NO: 81286 - DNA, 315 bp, Glycine max
  Peptide Sequence Number=SeqID_198064
atgaacgcgaaagtgaaagtgaaggtgggtgggtttctatggttggaaggtttagtagaggcgtgttgccttcatcgcgttgttattctgtgtatgaggtccaacaagctattgatgcgcactggtcagtgtttcctcttgaatggtttcatcttcttaggaagtatattcgtcctaaactcggttgtcatccctgcattgtggtggatattacctgatcaatgctcacagtttgtttctcataaactctgtgacttaggtggcactttgaaattttattctttcttacgtcttgctctcattcagctcttttat

SEQ ID NO: 81287 - DNA, 5856 bp, Glycine max
  Peptide Sequence Number=SeqID_198065
atggagttctttttgcgaggttttctacaagctgttgaccagttgcatgagacacctcatccctatgcctctcaaccagctggcagaaatgaaaataatattcttaggactggtcaggcattctgttttcttccattacctgttagaactggccttagtgtacaagtcaatggattctttgaggtctcatcaaatcgtcgtggcatctggtatggggatgatatggacagaagtggaaaagttcgttctacctggaataggcttcttctggaagatcttgtagctcctgcttttatgcatatgctacttggtataaaagaattgctagggccaacagacatttactactctttgtggcctattggttcatttgaagagccatggaatattttggttcaacaaatatacaaaaacattggtaatgctccagttatgtattctaattacaatggaggaagatgggtatcaccaagtgaagcctttcttcatgatgaaaaattcaccaaaagtgaagaccttggtttggctctgatgcaactgggaatgccagttgtgcatttgcctaattcattgtttgacatgcttttacaatatagttcatgcaaggtggttacttctggtacagtacgtcaatttcttagggagtgtggaatgttcaattatttgagcagacaatacaagcttctattgctggaatattgcctagaggacttggttgatgatgacgttggtaaagaggcttatgatctgcctttacttcctttagcaaatggcaattttgcatctttttcagaagcatcaaaaggagtctcttatttcatttgtgatgaatttgaatataagctgatgcagccagtttctgatagagtaattgatcagaacattcctcccaatatattgaacagactcactggtattgcgatgtcctcaaagaccaatgttattctttgtagtattcaccattttgctcagctattccctgcatttatgtcagctgactggaaatataggagtaaagtgttctgggaccctgaatcttgtcaaaagccaacgtcatcatggtttctgctattctggcaatatctaggaaagcagactgaaatattaccactatttagtgaatggccaattttaccttccacatctgggcatctgttaagaccttccagacaattgaaaatgatcaatggaagcaatctctctgatacagtacaggatatccttgttaaagttggatgtaatatattgagtccgaaatatgtagttgaacatccggatatatctaattatgtatgtgatggcagtgcaggtgctgttctggaatcaatatttaatgcagtttcaggtccagttgttatgcatgcttcatttgatagtctagtaactgaagaacgaaatgagctccggagattccttcttgaccctaaatggtatgttggacgctctatggatgaatttgtcataaggctttgcaagagattacctatatttcaagtctatggaagagactctgctcaagattaccaattctctgacttagaaaatcctcgaaagtacttaccaccattagatgtgccggaaattattctggtgggcatagaattcatggtcagatcctcaactatagaaggcgatattttgtcaagatattatggagttgagagaatgggaaaagcacagttttacaagcaacatgtttttaatagagttggtgatttgcaagctgatgttcgtgatagcataatgttatcagttctacaaaatttgccacttttgtctcttgaagacatatctatcaaggactcattgagaaatttgaaattcatcccgacgttcattggtgctcttaaagtgcttttctcttaccttgaagttaatgcattgaagtggcttcctgatcaagttattgataataaaggagcagttaaccgaatgttgtcacgagcaacaactgcttttaggtcttgcaacacaaaatctgatcttgaaaaattctggaatgatctacggctggtttcctggtgcccagttttagtctctactccttttcagtcattaccatggccagttgtgtcatcaatggttgctcctccaaaacttgtaaggccactgaatgatttgtggcttgtctcagctagcatgcggatactggatggtgaatgctcttcaacagccttattgtatggcctgggatggatgtctccaccaggaggaggtgtaattgctgcacagttactggagcttggaaaaaacaatgagattgtgtctgatcaagttcttaggcaggaattagccatggcaatgccaaggatatactcaatactgagtggaatgatggcttcagatgagattgagattgtaaaagctgttcttgaaggatgtcgatggatttgggtgggggatggatttgcaacttctgatgaggttgtccttgatggccctcttcatttggctccatacattcgagttatcccagttgacttggcagttttcaaaaaaatgtttctagaacttggtatccgtgaattcttgcaacctgctgattatgctcatattctttgtaggatggcagttagaaaaggatcatcccctcttgacacacaggagattagggttgtcacgctaatagtgcatcatctagctgaagtttatcatcatgaaccagtccagctctatctgccagatgtgtctggtagattatttcttgctggtgacttggtttataatgatgccccttggttgcttggctcagatgatcctaatggctcatttggcaatgcaccaactgtggctttgaatgcaaagagaacagttcaaaaatttgtgcacggaaacatttctaatgatgtagcagaaaagctgggagtctgttctcttcgccggatgatgctggctgagagttcagattcaatgaattttggcctgtctggtgctgctgaggcttttgggcagcacgaggctttgactacaaggcttaagcatatacttgaaatgtatgctgatggacctggtactctgtttgagatggtacaaaatgcagaagatgcaggagcttctgaagtaatgtttcttttggataaatctcactatgggacttcttctgttctttctcctgaaatggctgattggcaaggtcctgctctatactgtttcaatgactcagtttttagtccccaagatctttatgcaatttctcgtattggtcaagaaagtaaacttgagaaggcttttgcaattggaagatttggactaggatttaattgtgtctatcactttacagacatccctatgtttgtttctggagaaaatgttgtaatgtttgaccctcatgccagtaatttgcctgggatttctccttcacaccctggtttacgaattaagtttgtgggacaacagattttggagcaatttcctgaccaattttctccattgctacattttggctgtgatttgcaacacccttttcctggaacgctattccgattccctcttagaactgcaggtcttgcctcccggagccaaattaaaaaggaagcctatacacctgaagatgtcagatctctcttggctgctttttctgaggttgtttctgaaacattacttttcctgcgtaatgtgaaatctatctctatttttgtgaaggaaggaacagggcaagaaatgcgcctactgcaccgtgtacatagaacctgtattggtgagcctgaaattggatccactgaagcccaggacatgttcaactttttgaaggaaagtagacatgtcggaatgaatagagttcagtttctgaagaaactaagcctatccattggcagagatttgccttataaattccagaagatcctaattacagagcaaagcacatctagtcgtaattcacactattggataaccacagagtgtttaggtgatggaaatgctcaaaagagaacatctgaaacagccaatagtaactgttacaattttgttccttgggcatgtgttgctgcatatttgaattctgtcaagcttgatggggacctggttgaaagttcagaggtggaggatgattgcatggtttctcctgatctgtttaaaagtgttagtttgcctacatatccactggaaaattttgaaggtcgtgcgttctgctttttacctttaccaatcagtactggtcttcctgctcatgtaaatgcatactttgaattatcatcaaatcgcagggatatctggtttggttctgatatggctggaggtggaagaaagcgctcagactggaatatttacctcctcgaaaatgttgttgcccctgcatatggtcatttgcttgagaagatagcatcagagattggcccttgcaatttgttcttctcgttatggccaacatcattagggttagaaccttgggcatcagcagtacggaaactctatcaatttgttgctgaatttaatctccgtgtattatatactgaagctagaggaggtcagtggatttcatccaaacatgctatatttcctgattttacttttcccaaggcagctgagcttataaaagcgttgtctagggcttctctaccagttattacacttccacagtcacttttagaaaggtttatggaaatctgtccatcattgcattttctgacacctaggctgttaaggactttgttaatcagaaggaagcgtgaattccaggacagaaatgcaatgattctgactcttgaatattgcttacatgacttacaagaatccatgcagtttgataccctatgtggcttgcctttgttaccagttgctgatggttcctttacatcagttgatatgaagggggttggagaaagagtttacattgcacgtggtgatgaatatggccttctgaaagattccattcctcatcaacttgttgattgtgctattccagaagaagttcatagaaaactttgttacattgcacaaacagatggcacaaacatttctttcttgtcatgccagttgcttgagaaacttcttgtgaaattacttcctgtagagtggcaacatgctcgacaggtaagttggactcctggtattcatggccaaccaagtgtagaatggttgcaactactgtggaactatctgaaatcatattgtgatgatcttttgatgttttctaagtggcctatattgcctgttggtgatgactgcctgatgcagttaacacaaaatttaaatgtgataagaaatgatggatggagtgagaagatgtcttccttgttattgaaggttggatgtttattcttgagacatgacctgttattagatcaccctaaattggaatactttgtgcagccggtaacagcaagaggtgtattaaatgtgtttctggctattgctggggaaccacagaagattgatgggatcttaacagatgtatctgaaggagagcttcatgaactcagaagttttattctccagtcaaaatggttctctgaagagcaaattgatgacactaatattgaaatcatcagacaccttccaatttttgagtcgtacaaaagcagaaaactagtaagtttgagtaatcctattaaatggcttggtcctactggtgtttgtgaagatcttttaaatgataagttcataagaactgaatcggaaatggaacgggtcattatgaaaaggtatttagggatgaaagaaccaactaaagtggaattctataaagatcacattttcaatcacatgtcagagttcctttcaaagcaagaagttgtttcagcaattctgcatgacgtacagcatttgattaaacaggatctctctctcaaatcttcattctcttctgcacgatttgttctggcaggcaatggatcttggcaacaaccatctaggtaa

SEQ ID NO: 81288 - DNA, 1584 bp, Glycine max
  Peptide Sequence Number=SeqID_198066
atgctgcatgggaatgttttctttccttctgacaaattcttagatcctgaaattttggatactttagtttgccttggacttaggacaactctgggatttactggtatgcttgattgtgctagatcagtcagcctgttgcatgattctggggacactgatgcctccaagcatggtggagaattactggatcttttagatacactagcatttaagctctcaaataaaagagaaagcaataatggtgatcaacagggtggtgtggctttgggaagtagcagcataatggatgatgcttttctatatgatgggtttcctaaagatgagacctccctaactgatattgattcatttttaagcagctcaacttgtgatatggtagaagaagaattttggtctgaattgaagctaatctcttggtgtccagtaattcctgatccagctgttaggggacttccatggttaaaatccaataaccaagtagtagcacctcccactagtgtgaggcctaaatcacagatgtggatggtatcttcctcaatgttcattttagatgggttgaatggtgtttcatgggtttggattggtgatgattttgtattaccaaatgcacttgcatttgattcacctgtaaaatttacgccttatttgtttgttgttccatctgaactgtcagagtataaagatttgttgataaagttaggtgttagattgagttttggtatttcagactatcttcatgtattacaaagattgcagaatgatgtgcatggggttcctctgtctactgatcagttaaattttgtccatcgtgtccttgaagccatagcagaatgttgccaggagaagccactttttgagccttttgatagtcccttgttgattcctaatgattttggagttctgatgcaagcaggtgatcttgtatataatgatgcaccttggctggaaaacaactctcttattgggagacattttgtgcatccaattataagcaatgatttggcagacatactgggagttcagtcagttcgatgcctctctttagtcagtgatgatttgactaaagatctgccatgcatggactacaataaagtaaatgaacttttggcccagtatggagacaatgagtttttgttgtttgaccttcttgagttggcagattgctgcaaagccaagagattacacctgatttatgataagagggaacatcctcgccaatccttgctgcagcacaatttaggtgaattccaagggcctgcccttgtagcaatctttgaatgtgcctgtttgagtcgagaggaatttagtaatttccagctccgtcctccatggcgattacgtggcaacacaattaactatggtttgggattggtttgctgctattccatatgtgaccttctttcagtcatttctggtggttacttttatatgtttgatcctcgtggtttggtacttggtgcgccttcaactaatgccccatcagcaaagatgttttctttgatagacattgcacaatgtgagatgatagggagtagtggccctaagaatagtagggcaccgatattgtgtgtacttttctactga

SEQ ID NO: 81289 - DNA, 387 bp, Glycine max
  Peptide Sequence Number=SeqID_198067
atggctatactttttccactgtttgttctaactgcaactgggtcagagtccgagcaagaaatatcctttgaaaaacacaaatggagagttgcaggagtgggaagactaccaatattttatgttgcagacaaagtgtcgatgtggatgttatctcttttacccctggaaaaaggggaccaggacaaattctatgtaacaagctctgatgggataggatggggaattgctttggtcaccagcaaaattgctggtgcattgtttacggtgattcatcggaaagtggtggttgtcacaacggttggtttggtcattaatgatggagcaatccataagaagtatacggattgcaaccaatccgtaagaagcatacagattgacaattcgtaa

SEQ ID NO: 81290 - DNA, 183 bp, Glycine max
  Peptide Sequence Number=SeqID_198068
atgacattgcatcaaggtatttctaagagaccgttgtccattatcaccaatagcgttgttatggtctacacattgtcatcatctggaaaagcagtggcacacatagaggtggaaatgagtcaagccaagccaaactttattaggcttgagtttgactcattacctgtcatagactttgtttaa

SEQ ID NO: 81291 - DNA, 2332 bp, Glycine max
  Peptide Sequence Number=SeqID_198069
aaagtaaaacgaaaatcaaatggggatggagctgaagagatggtggagatgaacgatgacgatggaaaggaggatgaagggaataaggagatacctcctcctcctatttctaagaatgggagtgtcaaggatcagaaaaaaagagaccaatgccaaaacgttagatctcatgctgagttccagaagtttgttagaactcagtggaaccacttaattccttggaaggagcttatggtgaaaatccagaacgacctacaaagatggaataaggaggaggtgtggagtaaatatgaggaggttttgattcaagaagaggtgttttggttccagaaagctcgttctaaatggctagcttttagggacacaaattctagttatttccatgggacaactgtaatcaggagaagaagtagagttgatataatccaggatgaggacgatgtatggatttctgacccagaacaactaaaaaatctggcgactggattctataaaagtttatttgcagaaagtgatgattatgtgccttatgttgtatcaggtatgtttcccactctaaatagtcattctctgtctgctctcggtgctcctgtcacttttcaggaagtatataatactgtcagaagcatgggagcattcaaagctcccgttccggatggatttcaggcagtattctatcaaagccaatgggaggtggtgggagaaactttgtggaaaatggtccaaatgatgtttttaaaccaccaacaaattggtgagataaatgaaactcttatcactcttataccaaaagtcgataatgttgtgaagatgaaacaacttagaccaataagcctttgtaatgtgtcatataaagtcattacaaagctccttgcgcatagattgagacctttgatggggaaattggtgagcctttgtcagtgtagctttattcctaatcgtcaaagtcgggataatattgttattgcccaagaagtctttcattcaatgtgtaacaagaaaggctccaaggggtggatggctataaagatcgacttagaaaaagcctatgataggttgagttggaaatttgttcaggatactttgattgatattggttgcccagaaaatttctctgatattgtttggcagtgtttgtcttctcccaccatgcgtttgctatggattggtgaggcattggaagagttcaaaccaatgaaaggagttcggcaaggagatcccatttctccttatctctttattctttgcattgagaggttgtttcaactaatcctaattacagttgataacaaattatggaagccgattcagattgctagagaagctctgaaactctctcatcttgcttttgcagatgatttattaatctttgtgggcgcatcagaagaccgggctgaggttgatcagaggttgtctgcttggaaaacatgtcatctttcatatgctggtcgtgttactctagttaaatcagttctgcaagcaatgccttcttatgtgatgcagttcacttgtattcctagagctgtttgtgatgagatagataagagatgtagaagctttatctggggagattctgaaaatcacaacaaaattcacactgtggcttggaataatctgtcaagcctaagaatgaaggtggtttggggtttagatcttccaggcacggatgacctctgggtctggattatgagagcaaaatacagatgtggggatgatctgggcctatgcagaaactggaagcatgttaatcagaatctttcatggaatattggggatggaactaaagtagaattctggaaggatagatggactcctggaggaggtaaattactggaggcctccactcattctgtcccggatcatctcagttctgatttagcttgtcaatatgtggatgataatggatgttggaatatgaatatgttccagccgtatctcagttttaatagtattgatcttatccgtgctattccactgccaagtagcacaaaaagaaatgatcaactgccttggaatggatctgcgaatgctagagttcgaaggcacctaactcatgatgcttcttgtgagagatgtggtgcagatattgaaaaccttgaccatatctttcgaacatgtgctgaatcgagagtcatttggtatatgattctgccttattctttgcatgctactttctttactcaagatttcgattcttggatgaataccaacttgcagaatgaagataatgtgaatgggagaaaatggtcccgtgtttttgctgttactttggacaatatatggctgtatagaaacaaaactatctttgagagtttccaattccagccgcatg

SEQ ID NO: 81292 - DNA, 369 bp, Glycine max
  Peptide Sequence Number=SeqID_198070
atgcatgaaggacaatcatttcatggggctccgaataaaagtggagaatggagaattgcactaggcaatcacttcgcgtggctccagactcattggtggaggatgcatgaacgccaatcaattcttggggctccgaataaaagtggtgaatggacatttgcattaggcaatcactttgggtggttccagattcattggtggaggatgcatgaacgacaatcaattcatggggtttggattaaatgtggagaagggagatttgcattaggaaatcactacgcgtggctccaaactcattgctggaggaggcataaaggccaatcaattcagggggttccgattaaaagtggagaatggagattgcactag

SEQ ID NO: 81293 - DNA, 736 bp, Glycine max
  Peptide Sequence Number=SeqID_198071
atggaactatcagatttgcaaaacaagaagcagagcagcagcagcagcagcacaggtgctactcatcaacaacaacaacaacaacaacaatcctcttctacccatcttgttgtgccttccccttccaattcttccgcatccctcatcgacgcctccttagccatcgccaccagatctgatgattcgaccaagaagacccaacaaccctccaccaacaccaagcgatccaccaaggacaggcacaccaaagtcgacggccgcggccgcagaattcgaatgcccgccacctgcgccgctagggttttccagttgacaagagaattgggccacaagtccgacggcgaaactatcgaatggctcctccagcaggccgagcccgccatcatcgccgccaccggaaccggaaccatccccgccaatttctccaccctcaacgtctccttacgcagcagcggctccacgctctcggcgccgccctccaaatcagccccgcacacctttcatggcgccctcgcactcgctcaccacccttacgacgaagcctttcaacaccccgctcttcttggcttccaccctcaccatcaccagcagcagcttctctccgccgatcaaatcgcagaagcgcttcccagcgctggcggcggtgactccggcggcaactaccttagaaagcgctaccgagaagatctcttcaaagacgataacatcaacaatacccaatctcagaacgatagcg

SEQ ID NO: 81294 - DNA, 1056 bp, Glycine max
  Peptide Sequence Number=SeqID_198072
atggcgaagaggaaggagcggattcagaacccggagccattcgatccgtacggcgccgaccccgcgaagacgaagaagcgttcgaagccgccgaagcggcaccagcaggaagagcagttcattgctcccaaactcagctccaagatcatgaagcaggcgctgatccagcagaaggaggaagagaaggaggaaacgcacgagaacaacgccgccgcgaatttattcgaagaggttccgaacttcgaggaagacggcggtgacgacatcgacgacttcgccgggttctccgaaacgcagagccagtttgccggatatgatgaggagattaatgaggaggatgagagactaatggaagcattcatttcgaaggagcccgaaaatcgacctgttccaaaattggataaatccataattgacatatacaagggggttgggactcatctcagcagatatacaataggcaaaatacccaaggcattcaaacacatcccctctatgcaactttgggaggaggtcttgtatataaccgaacctgagaattggtctccaaatgctctttatcaagccactaggatttttgcttctaattttggtgcaaaaaaggcagaacgcttctacaagcttgtgttgcttccaagagtgagagaagatataaggaagaataaacggctgcattttgccttatatcaaactctgaaaaaggctttgtacaaacctgctgcattctttaagggcatactgtttccgctatgtgagtcacgtacttgcactcttagggaagcagtcattattggaagcattatagaaaaagtttctattcctccacttcattcaagtgttgcgctattgaagctttctggaatggaatattgtggcaccactagctatttcataaagcttcttctggagaaaaaatatgccttgccatatcgtgtggttgatgcagttgttgctcattttatgagatttttcaatgaaaccaggataatgcctgttatatggcaccagtcacttcttgcttttgtgcagaggtcagtgattcaccatttgtcttga

SEQ ID NO: 81295 - DNA, 345 bp, Glycine max
  Peptide Sequence Number=SeqID_198073
atgacgtcgcttgatccagcatggcacgattctattggccagtacacgtatatttccgaactcaatttgcacaaacatttgatgaacgagaagaaaaatccaaacgaaacgcaggagagacagacagagaagagaatggacgctattgattctgtgttcgatccgctcagggaattcgccaaggacagcgtcaggctcgtcaagcgatgccacaagcccgatcgcaaagaattctccaaggttgctgtgcgtaccgcgatcggtttcgttgtgatgggattcgtgggttttttcgttaagctcatcttcattccaattaacaacatcatcgtcggatctggttag

SEQ ID NO: 81296 - DNA, 252 bp, Glycine max
  Peptide Sequence Number=SeqID_198074
catttcgtttctaaacgaccatttagaggaaacactgggtccaacaaagataggagaaaatcactcaaagtgtatcaatctcacacagggcaaggattgaaattctcaccctgggtcaaggtttatgataagttgggattttggctcaaggcttgtagaacggctggtcatgatatatgtcagggtttggccaacggtttggggataaaggggatgtcctacattatttccatgatacacatgcaacaatga

SEQ ID NO: 81297 - DNA, 126 bp, Glycine max
  Peptide Sequence Number=SeqID_198075
atggacaaaggaacccttaagactcatattgtgctacttgatggagagagtaatagcatgggccatagaatcaataaggatgtacatgaaattatccctgttggaaaggatctaaataccccctga

SEQ ID NO: 81298 - DNA, 636 bp, Glycine max
  Peptide Sequence Number=SeqID_198076
atgttaccagctggctgccttactggtgattcatttcaggttgctattcatgctataggggacaaagcaaatgaccttatcttggacatgtatggtttagtagcttctacaaatggaatgagagaccgacgattcaggattgagcatgcccagcagttggcagctggaaccccaggtcgatttggaaaacaacgggttgttgcttccatgcagccggatcaattgttggatgatgcagactctactagcaaaaagcttggcaaggatagggctgaaaaggaatcatatttgtttcggtcactcttaaataacaatgcattagtggcatttggttctgactggccagtggtagatatcaatcccttaagtggtattaagacagcaatgaaaaggaggccccccaactggcaaagtgcatggattccatctgaatgcatttcattagatgatgctataaaagcttacaccatttctgctgctcgtgcaagcttccttgacaaagatcttggatccttatctccagggaaactggcagattttgtcatattgtccactgattcatggaaagactttgctgaagatgcatctgcaaatgttgaggaaacatatgtttctggtgtgagagcatatccttga

SEQ ID NO: 81299 - DNA, 1282 bp, Glycine max
  Peptide Sequence Number=SeqID_198077
atggccatttgtagcactgttggattttcggatttgttcttaacattcacttgcaatccgtactggcctgagattcaacgatctatttcagctcttaatttatctgcacaagatttgccgtacattgacattgtaacaagagtttttaaacttaagctagaacaattaatgtctaacttaaaggacaaaaaagttttaggaaatgtgctagcatgtttgccacatgctcatatcttgttgtttctggatgttgggagcaagtatccatctcctgcagatattgatcgtatcatatctattgagatactagattctattgaacaaccacaactctatgagtgtgtcaagaaacatatgatgcatggtccatttggtcttgcaaacaggcagtgtaatgatggtaaatatattgacagaaatggtgtagcactagacaacaaatacatggtaccatacaatccatacctattgttgaaatatcaagctcacctcaacatagaatggtgcaatcaatcaatgtctatcaagtatttattcaagtacattaataaaggttatgatcgcataaccgtagctcttgtgcctgtcaaaaatgaagatggaacaactaaacaaactgttgatgacattaagcactatcttgatggtaggtatatttctccttgtgaagcttgctggagaatattttcattccagattcacaagagatcacctgctgttgaaaggttgtacttttatttgcttggtgagaattcagtcatatttgaagatggtgatgaaattgatgccttgctgtccaagctaaccattaaagagtctatgtttacctcttggctgcaagctaatgccattttccaacaagcaaaagatcctacatatctgatgatgttgggtgtggttaaaggaacaacaacttatgaacaaattcgtttagtcaatggtcaattgtattctacatttagagaagcttgctttgctatgggttacttggttgatgataaggaatatattgaggctttggagaagcataccattgggctagaaataaaagagttacagactttggcattgcttgagattaaagatatattacaatgcaacaaaaaatcattgaaggattatccagccatgccttttgcaagacatgtggtgttgtcacaaatgggcactggtggaatgtttttcctgtatgggtatggaggtactgggaagacctttatgtggaagacattagcttctgcattacgttcaaaaggtaatactgtgttaactgttgcgtcaa

SEQ ID NO: 81300 - DNA, 1720 bp, Glycine max
  Peptide Sequence Number=SeqID_198078
gaatacaagtaccacagtagatcagacaaaaactaaatctaatgaatggtctgcctgggaaagtaacaagtctgaaataccagctggtggatctaaagcagttcaagaggactcttccaagtctaacgcttggaatagaagcaccacagcagatcagacaaaaactaaatctaatgaatggtctgcctggggaagtaacaagtctgaaataccagctggtggatctaaagcagttcaagaggactcttccaagtctaatgcttggaatacaagcaccacagcagatcagacaaaaactaaatctaatgaatggtctgcctggggaagtaacaagtctgaaataccagctggtggatctaaagcagttcaagaagattcttccaaagcttggaatacaagcaccacagcagatcagacaaaaactaaatctaatgaatggtctgcccgggtaagtaacaagtctgaaataccagctggtggatctaaagcagttcaagaagattcttggggctccagtaagtggaaggctgatgttgcccaagaagacaattccaggcttggtgcttgggatgcaaatgcagcagatcagacaaaatctaatgaatggtcgggctggggaaagaagaaagatgttacccaagaagacaatgtgcaacattcttggggctctggtaagaggaaagacaaagttacccaagaagacaattctggctctggtgattggggtgccaacagaacagatctggcaattaccaaatctagtgaatggtccagctggggaaagaacaagactgaaataccagctggtggatctgcaaatgtgcagaatgactcatggggcttgggtaaattgaatgatacccaaaaagataattctggttgtggtgcttggggtgaaaattctgggtctgcatgggtgagaaataaagctgaaacaatagatggtggatcagaaaagccccaagaggatgcttggaactctggcaattggaaagctgaatcaaaagttggcaataccacttggggaaaacccaagtcttcagaaagtcatgcatgggattcccataatcagtcaaatcaaaattcaagttcacaggggtgggaatcacatattgcttcagctaattcagaaaatgagaaaggttttcagtggggaaaaggtagagactcgtttaagaaaaatcgatttgaaggttcgcaaggtcggggttcaaatgctggtgactggaaaaataggaatcgcccgcctagagcacctggacagagattggacatttactcatctgaggagcaggatgttctgaaggatattgaacccattatgcagtctatcagacgaatcatgcaacaacaggggtacagtgatggggatccactggctgctgaagatcaactttttgtacttgagaatgtctttgagcaccacccagataaagaaaccaaaatgggtgctggaattgattatgtcatggttaacaaacacagtagcttccaggaaagtagatgcttttatgtggtttgtaaagatggtcaaagcaaagacttttcctaccggaagtgtttggccaactatataagcaagaagtatcctgaccttgctgaatcattccttggcaaatattttcggaaacctcgtgctaggggggaccagactgcaacactagggggagaccagactgcaacaccagcgcaggatgaagcagccacttcgggtgagtag

SEQ ID NO: 81301 - DNA, 3339 bp, Glycine max
  Peptide Sequence Number=SeqID_198079
atggcttcttcttctttggttgttgttggctctctccatcttacttcacagaatggttacaaagtgtgggaagatccttctttcatcaagtggaggaaaagggaccctcatgttaccttgcattgccatgaatctcttgaaggatctcttaaatattggtatcaacgcaataaagtggattttttggcttcccagtcagctgtttggaatgatgatgctgttcaggggtctcttgactgtgctgcattttgggtcaaagatttgccttttgtcaagtccttgtctggatattggaaatttttcattgctgacagtcccaacaatgtccctacttatttttatgaaagtgagttccaggattcagggtggaaaactttgccagttccttcgaattggcagttacatggatttgacactcctatatatacgaacgtggtgtatccatttccactagatcctcctttcattcctgtggaaaatcctactggctgttacagaacgtacttccacattcctaaagaatgggagggtagaagagttttgttgcattttgaagcagttgattctgccttttgtgcatggataaatgggcatcctgttggatatagccaagacagcagactacctgcagagtttgaaattaccgatttttgccatccctgtggttcagaccttaagaatgttttagccgttcaagtgtttagatggtgtgatggttcttaccttgaagaccaggaccaatggaggttatctggtatccaccgtgatgttcttcttatggcaaagccggaggtatttattactgactactttttcaaatcaaaccttgccgaagatttttcttgcgcagagataatggttgaagtaaaaatagatagattacaagagacatccaaggataatgttctcacaaactactctatagaagctacattgtttgattctggaagctggtacacctctgacgggaatcctgatctcctttcatctaacgtggcagacataaagctccaatcatcaagtgcaccagcacaaccattagggtttcatggctatgttcttacagggaaactgaaatcgccaaagctttggtccgcagaaaaaccatacctctataccctagttgttgtcctgaaagatagatctggccgcattgttgactgtgaatcatgtccagtagggtttagaaaagtatctaaagcccacaaacaactgcttgttaatggacatgcagttgtaataagaggtgtgaacaggcatgaacatcatccacaagtggggaaggcaaacatagaatcctgcatgatcaaggatttggtcttaatgaagcaaaacaatattaatgctgtgaggaacagccattatccccaacatccacgttggtatgagctatgtgatttgtttggcatgtacatgatagatgaagccaatattgagacacatcattttgactattctaaacatctcaagcatcccactatggaaccaaagtgggcaacttcaatgctggatcgtgtgatcggcatggttgagagagataaaaatcacacatgttggattcggggaagagattcatctcgggtattgcattatgaaggaggtggatccaggactccgtgcactgatattgtgtgtcctatgtatatgcgtgtttgggacatggtgaaaatagccaatgatccaactgaaacacgtcctctgatactgtgcgagtattcacatgcaatgggaaacagtaatgggaatctacatatatattgggaagcaattgacaacacttttggactccaaggaggctttatttgggattgggttgatcaagccttggtgaaagtttatgaagatggtaccaagcattgggcatatggaggtgaatttggggatgttcccaatgacttgaatttctgtttgaatggcctcacatttcctgatcgaactcctcatcctgttttacatgaggttaagtacttataccaaccaatcaaggtggctttaaaggaaggaaaattggagataaaaaatactcatttttttcaaacaacagaaggattggagttcagctggtctatttctgcagatggatacaaccttggatctggtcttttgggccttgtccctataaagccccagagtagtcatgctgttgattggcaatcaggtccatggtattccctatgggcttcaacagatgaagaagaactattcctgactataacagctaaacttttgaactccacacgctgggttgaagctggtcatattgtttcatctgctcaagttcaattgcctaccaggagaaacattgcacctcatgttattgatattaatggtggcactctggttgctgaaacactaggagatacaatcgtagtcaaacagcaagatgcttgggatttgactttgaatactaaaacaggtttagttgaaagctggaaggttaaaggagtgcatgttatgaaaaagggcatcctcccatgtttctggcgagctcctatcgataatgacaaaggaggaggttcagccagttatttgtccaggtggaaagcagctggaatggactgcctccactttattactgagagctgttctgtgcaaaatattacggagaactcagttagaatattggtggtttttcttggtgttaccaagggcgaggatggttctctctccaaccaagacaagtcaaaggttttatttacaacagaaatggcatatacaatttatgcttctggggatgtcattatagaatgcaatgtgaaaccaaaccctgatcttcctcctttgccacgtgtgggaatcgagttaaatgtggaaaagtctttggatcaagtaacttggtatggaagaggaccatttgagtgttatccagatagaaaagctgcagccctggttgcagtctatgaacataatgttagtgagttgcatgttccttatattgttccgggggaatcttcaggtagggcagatgttagatgggcaacattcagaaacaaagatgcttttggaatatatgcttctaagtatggtagctctccacccatgcaaatgagtgcaagttactacagcacctcggaacttgaccgtgcgacacacaatgaagagctcattgaaggagatagcattgagctatatgcagtgtatgttcattcagtttgctgcattaaaattcatctagatcacaagcacatgggattgggtggagatgatagttggtcgccatgtgtccacgaacagtatttgattcctcctgtgccatactcattctctgttaggctgtgcccagtaaatccagccacttctggtcatgacatctacaaatcccagtttcaaaactcttga

SEQ ID NO: 81302 - DNA, 3949 bp, Glycine max
  Peptide Sequence Number=SeqID_198080
atggaaattattaagagaattccgatagagacaaaaaaaaagcttgctggaaaaggattttttcctcaagatggatatgttttgaagtatcttccggtgccaccaaattgcttgtctgtgccagaagtttcagacggtgccagtgtcatgtcgtcggatccttccatgacaattctcagaaaattgctcaggaaggttgaaatcataaaaagctctagatctggtgaaccaaatttcgagtctcatcacgtggaagcaaatgatttgcagtctgtggttgatcaatattttcaaattaggggcacttctaagccagcacgtgatatagagacacattttggggtcaataaagagcttactgcatcctcaacaaaagcatggcttgagaaaatgaggacattatttataagaaagggttcaggtttttcgtcccggaatgtaattactggagattgttataagaggataaatgaagtaggaattccggttgaagttgcccagcggataacatttgaggagagagttaacatccacaacatcagatatttacagaagttggttgatgaacatttgtgcctgacctacaaggaaggtgtgtcaacttattcactcagggagggctctaaggggcacatatatctcaagcctggtcagatagtgcatcggaggattatggatggggatattgtcttcatcaacagaccacctacaacacacaaacattccttacaagccctttatgtttacatccatgaagaccacactgtgaagattaatcctttaatttgtggaccgcttggggctgattttgatggtgactgtgtccatctgttttatccgcagtcacttgctgctaaagctgaagttgtggagctatttgctgtggagaatcagctgctcagctctcacagtggtaatttgaacctacagttatccacagactcattgttggcactgaagatgttggtcaagagatgttttttgggtagagcggcagctaatcaattggcgatgtttcttttgcttcctttgcctcggcctgctttgctcaaggccagttctgatgatgcttgttggacttccatccaaattttacagggtgcattacctatgggttttgattgcactgggggacgatatttgattaggcagagtgaaatcttagaatttgatttcagcagggatgctctgcctgcaaccataaatgaaatagcagcttcaattttctttggcaagggtcccatggaggcacttaaattcttcgatgtattgcaaccctttttgatggaaagcttatttgcggaagggtttagtgttagcctggaagagttttcaatatccagggcaatcaaaaggataataagaagaagcattggaaaggcttcttctctgctgtatcagctgaggtccttatacaatgagctggtggcgcagcaactggagaagcacattcaagatgttgaacttcctatcattaattttgctctaaagtcgactaaattaggagatttaattgattcgaagagtaaatctactattgataaggttgttcagcaggttgggttcttagggcagcaactttttgataggggaagattctactcaaagggattggtagatgatgtggcatcacattttcatgcaaagtgttgttatgatggggatggttatccctctgctgagtatggactgctcaaagggtgtttttttaatggtttggatccatatgaagagatggtgcattcaatttcaactagggaaataatggtgcgttcttcaagaggattatctgaaccaggaactctctttaagaatttgatggccatccttcgggatgttgttatctgttatgatggaactgtcagaaacatttgtagtaattccatcatccagtttgaatatgggatacaagctggagacaaaactgagcacttattccctgctggtgagcctgtaggtgtcttggcagcaactgctatgtcgaatcctgcttacaaggctgttcttgatgctagtcctaatagcaactcttcatgggagttgatgaaggaaatattactctgcaaggttaattttaggaatgaacctgttgatcggcgtgtcattttgtacttgaatgactgtgattgtggagggagttgttgccgagaaaatgcagcatattcagttaaaaatcaattgagaaaagtcagtctcaagaatgcagctgtggagttcattattgaataccaacaacagcgaactcaaaaggaaaattctgaaactgatgctggacttgttggtcatatttatctggatgagtcttgctcatcttcacatcctgctgcaccatgtttaacattttggctaaagaatcatgatagtgatttagataatgctgtaaaggtcctgtctgaaaatatctgccctgttctgttcgaaacaataatcaaagatacaaacacatgggtccgaaacccttataaatcatctaatggtgaattggcacttgacatcgttcttgaggaggaagctgtcaagcagagtggcgatgcttggagaattgtacttgattcctgccttcctgttcttcacttgattgataccaggcgttccatcccttacgctattaagcagattcaggaattactggggatatcatgtacttttgatcaagcgattcagcgtgttgcagcatctgtgaaaatggtggcgaaaggtgtacttagggagcatctaattctgttagctagtagtatgacatgtggtgggaacttggttggctttaatacagatgtatcaggttattattattcttactttgtaaacgtgactatgcagacacctaaaaagtgttttgagagagctgctgagaaatgccatactgattctctgtcaagcatagttgcctcctgttcctggggtaaacatgtggcagttggtacaggatcaaaatttgacattgtttgggattcaagtgagataaaatcaaatgaaattgaagggatggatgtttacagttttcttcacatggtgaaaagtgtaaccaatggggaagaagaaactgatgcttgtttgggtgaagatattgatgatttgctggaagaagaatatatggacttgggcatgtccccacaacacaactctggttttgaagctgtatttgaagagaatcctgaagtactgaatggttcaacatccaatggttgggatgtaagttcaaatcagactcaatcaaaaaccaatgagtggtcaggttgggcaagtagtaacaaagatggtagatctgaaactgcccaagagaattcttgggggaaaactgtcaaccaagaagactcttccaagtctaacgcttggaatacaagcaccacagcagatcagacaaaaactaaatctaatgaatggtctgactggggtagtaacaagtctgaaataccagctggtggatctaaagcagttcaagaagactcttccaagtctaacgcttggaatacaagcaccacatcaaatcagacaaaaactaaatctaaggaatggtctgcctggggaagtaacaagtctgaaataccagcttgtggatctaaagcagttcaagaagactcttccaagtctaacacttggaatacaagcaccacagcagatcagacaaaaactaaatctaatgaatggtctgcctggggaagtaacaagtctgaaataccagctggtggatctaaagcagttcaagaggactcttccaagtctaacgcttggaatacaagcaccacagcagatcagacaaaaactaaatctaatgaatggtctgcctggggaagtaacaagtctgaaataccagctggtggatctaaagcagttcaagaggactcttccaagtctaatgcttggaatacaagcaccacagcagatcagacaaaaactaaatctaatgaatggtctgcctggggaagtaacaagtctgaaataccagctg

SEQ ID NO: 81303 - DNA, 234 bp, Glycine max
  Peptide Sequence Number=SeqID_198081
atgagcatccgtagaactgatgcaatggatgtattggatgcttgcagtctgaaggaatgggacacaagctatgtgggattcatagttgatggagctaagtggctagtggataacacagatatcaaacttgtaggtagttttccatgggcatttttcctgtcaggtgttccaagtccaatggttgggtctagttttgcacttgtagcatgcttccccttaaattattttgtttga

SEQ ID NO: 81304 - DNA, 228 bp, Glycine max
  Peptide Sequence Number=SeqID_198082
atgaagagattggaaggtaccgtagcaatcgggtgtgtgttagattcaaagaaaacaggagatagtgtgtctaacgaaaactggaggactgcttcggttgttgcggaaccaagctattgcggcacggcagagggcggcgacattgaaggagtcacgagggcggtaggggccgagggagagaagggcgtggagggggttggcggagatggtggatttgaaggaggctag

SEQ ID NO: 81305 - DNA, 2259 bp, Glycine max
  Peptide Sequence Number=SeqID_198083
atgaacaaagagcttacaagctttgtgaaggcttgggaagcagcagttaggaaatcagcaggtccaaagaggagggctaacagcatcttcacaccaatgtctgttgcccatgttgatgatgatgatgatgcaacaagaaatgttgttggtgaggttgagaagattctccccaatggtgacttctacacaggccagtggcttgacaacaatggccctcatggccagggaaagtatctgtggacagatgggtgcatgtatgttggtgaatggcaaaagggtggcatcatggggaaagggaggttcagttggcctagtggtgcaacctacgagggtgatttcaagggtggttatatggatggaaaagggactttcatagggtcttctggggacacctacaagggttgttgggtgatggagttgagacatggccaggggactcagagttaccccaatggggatttctatgatggggagtggaggaaagggttgcagaatggacatggaaggtaccaatggaagaatgggaaccattacattggacaatggaggaatggcttgttccatgggaatggcaccatgatgtggagcaatgggaataggtatgatggttgttgggaggaagggttgcctaaggggaatggaacattcaggtggggtggtgatgggagtttctatgttggggtttggagtaaggatccaaaggagcaaaatgggacttattacccttctggctcttgtgctggccatttggaatgggatcctcaggagctgttctctttggacttggtggagtgcagtgtttgtggccttgagaaggtggcaatttacccttcacacaagagtttgaacatgttggagggtgataataagatgtgtaagaaggggactgatgggactgggaggacaaggaggatgtcagtggatgcaagaattagtaattacagctctgaagatggttcttattcatcctataatggctcaaggagttctcaggtggataattctattccaagagtgccacatttgaggttgaaggctccaaagagacagggagagactatttctcaagggcataagaactatgagctcatgcttaatctgcagcttggtatcagacatgctgttggaagacctgctccaagtacatctcttgatttgaagtcttctgcatttgatcctaaagaaaaagtgtggactaaatttcccccagaaggatctaagcacacgccacctcaccaatcttgtgagtttagatggaaagactactgccccgtagtgttcagggctctcagaaaattgttcaaagtagatcctgctgattacatgctatcattatgtgggaatgatgcccttcgggaactctcttcccctggaaaaagtggaagcttcttttatttgaccaatgatgaccggtacatgataaagaccatgaagaaatcagaagtaaaagttttcttgagaatgctacctggttactacaaacatgttcgggcttttgagaacactctagtcaccaagttctttggcctccactgtgttaagctaacaggaactgcacagaagaaggttcgatttgttatcatgggaaatctattctgctcacaatatcccatccataggcgctttgacttaaaaggttcgaccttcggtcgcacaactgacaaacccgagtcagaaatagagcctacaacaacactcaaggaccttgatctaaattatatatttcggttgcggaagtcttggtttcaagaattctgcaggcaagtggacagagactgtgactttctggaacacgagaggatcatggattacagtatgttggtaggtcttcattttcgaggaatgtcgtgcggtgacaatgttactccttctggtcacagtccaggtccacaaactccaactggccatggtaactttgatgatggagcccctcgtctttctggagtcgatgtggatcatcttgtagtagatccgaatcggtggattcaattgggtataagcatgccagcacgggccgaaatgaccgtgcgaaaaagttgtgacactcctcagctggttggagaaccaacaggggagttatacgagattatcatctttttcgggatcatcgacatattacaagactatgacattagcaaaaagcttgagcatgcttacaaatcattccaatatgatccaacatcaatctctgctgttgatccaaggctatattcaaaacggtttcgcgatttcatcttcagagtttttgtagaggactaa

SEQ ID NO: 81306 - DNA, 594 bp, Glycine max
  Peptide Sequence Number=SeqID_198084
atgtgccctacgccacaatggagtccagcgtgcaacacaaaaaccacaatctccaaagaaatgagggaaaccatgctgttagacaatcctaatttgactctaagagacatagctgatgcgatacaggcacttggtcaaaataatttcggggtgaaccctcaatgtacgaaacctgtggaactgagtgcaaccaaagcatcgtcaaagacgacgaatgtcgacacttctctaccccatgatgaggccattgaaaccatggcttcaacattaacattgctaacgaccaggagacattgtttcggtagttgtcctatttcaagagcaaccaaggaaccaaagactgatgacaaaggggtactccttgaagaatcaaacagccaaaccaaaagtggaaatactatgaatgaacaacccatgaacaacaatgttggcagacatgaccttttcgttactagattcccaagtttgcgcttaaatcttcaacagcatcctcgatccaagattattttgttcactacattgaaggtcaccaaaaatcagttgcacaaagatgttagagctgtgtggtgcctacctccagcttttggggtgtaa

SEQ ID NO: 81307 - DNA, 399 bp, Glycine max
  Peptide Sequence Number=SeqID_198085
atggagtttgtaatgttctctagaatgtttgtggatgcattggatgtgcaaatgtatgatgaacaccattcgacaggacactattctttgagtttgtcaaaatcatgtaagatagttgggggtcaaagatatacaaaagggcttaacgaaaagcagataacttctctgctaaaggtctcatgccagagaccacgtgagcaagagacaaatattctccagacaattcacgaaactgattatgagtataatccctatgcaaaggagtttgggattagcattgatagcaagcttgtatcagttaaggctcgggtgtatacattttttataccagttttctcatcgagtatgttcatgtctaggaatatctcttattccttacaatatatggctgcaatttaa

SEQ ID NO: 81308 - DNA, 267 bp, Glycine max
  Peptide Sequence Number=SeqID_198086
atggagtcaattggaatgccttatggtcacattgtaattgtgttacaggcattagacctcaatgaattacccaagtctttgaggcttgataggtggtcaaaggaagctagggaggaaatttgttgcatatttgttggtgcctgtaattattggtattcttaccttgttgcaagatatgccactattcttgatctttcaagtgcttaccacaccatacaggcttctcaaaaaggcatgttccatctgcaaccaatccaaaacccataa

SEQ ID NO: 81309 - DNA, 300 bp, Glycine max
  Peptide Sequence Number=SeqID_198087
atggctcccgaagaactcaagcagctgactcaacaaatcaggaaccagctggaggagtcaatcacaaaaaaaatgcaatcacagggacttgcactgcctctggagcctgaggttagtccctcagctactcgtgtcagcacaaagaagagttgtgttgatccctcagggaacgatccagagacgggtgactcagacaaatgcgggttgtacatcaaagaaaatccttcctgcctggttgccctaggaagagtttatgaggaatccatagcggttcacaacatccctttgttgcatggttaa

SEQ ID NO: 81310 - DNA, 526 bp, Glycine max
  Peptide Sequence Number=SeqID_198088
gatgtgtggaaaaaggcacaggccatccagaagcaaaacaccgccccacgtgttgtctcatgggggttatgaatatttagaacagaagctgatagttgagaagactaagaaaaaattggaggaagctgctcaatccggatgcactgagggagtgattaaccctccatctcccattagacgacacgtgaagtggaagatggcccgcaccaagaaaattgggcagatgacgtctaaggcagcaaaggaaattgctgagaagattgcgtcacaggattcgtttgtcccccatggatgtcaggatgtcttgactgctgccattgggcgatatgaacaccctagtcgtgtgcgtgctgttggagccggtgcgaccataaaacaatactttggatcggctccacgaacctcccataattcttcatccatggctcccgaagaactcaagcagctgactcaacaaatcaggaaccagctggaggagtcaatcacaaaaaaagtgacacgacagttgatgttatccttcagctag

SEQ ID NO: 81311 - DNA, 1580 bp, Glycine max
  Peptide Sequence Number=SeqID_198089
atgaatgtgatattgtacactttgccctatatgcagatgctgaacctgtgagtttcgaagaagccttgaagaatgacaagtgggtcaatgctatgaaagaggagctgaaatcaattgagacgaatcatacctggcagctaatggagttacctaaacttaaaagacctattgctgtaaaatgggtttttaaagtgaagagaaatcctgttggtgaagtagttaaacacaaagccagattggtggcaaaaggattcctacagaaagaaggtgtaggctatggtgagatctttgcccctgtggcaaggattgaaatagtgagacttgtagttgcaatatcaagcatgaaaggctggtcaatgtatcagcttgatgtaaaatccgcatttctgaatggtccccttaaagaagaagtgtttgtcaagcaaccacctggatttgaagttgttggacatgaaggaaaggtatacaaactaaagaaagcattatatggcctaaagcaagctccaagagcttggaacaagaagattgacagtgtcctaattcagattggttttagcaaatgcatatctgaacatggagtatatgtaaaaggagaaaatgagtcagaattagtaatattgtgcctctatgttgatgatttactcatcacaggaaacaacaagatagagatagacaagattaagcaactgctgaagaatcagtttgaaatgactgacttaggatctctctcgtacttccttggaattgagttcaaggaaactaaagttggaattatgatgcatcaaagcaaatatgctacagacctgttgaagaagtttcgaatgactaactgtaatgcagcagccaccccagctgaaacaggattggcattgagtttgagagatgaaggagaacctgttgatgaaactcagtacagacaaattgtgggttcattaaggtacttgtgcaatacaagacctgatttggcattcagtgttggactgatcagcaagtttatgcaagctccaaaaactcctcacatgatggcagcaaagagaattctaaggtatattagaggcacaattaactatggtattctactgctaaataccatcacgagttcaaacatggaactggttggctatactgactcagactggagaagagataatgatgatagaaagagcactgctggatatattttcctacttggaaatgcattggtgtcatggagttcaaagaagcaagatccggttgccttatcaacttgtgaagttgaatacatagcagcatcaatgtgctcgtgtcaaggcttatggctaagaaaactgttgaaagaaatgaagatccagaagactgaagctataaacatactggtggacaacaaatctgcaatcagccttgctaaaaatccaattgatcatggtggaagtaaacacatagaaacaaggtacgattttattcgagacaaggtgagcaaagggaagttaaaactgctatactgcaagtcaaaagataatcttgcagacttagtgaccaaacctttgaagaagaacatatttgaagacttgagaaacaagatgatgatcatgattgaatga

SEQ ID NO: 81312 - DNA, 480 bp, Glycine max
  Peptide Sequence Number=SeqID_198090
atggaaatgcctgccagaagatccatcaactactccctcctcagccaaactcccgacgacaaattaacgccgccgttgttcggttcctcctccggcgacgctaaaatcaacaacagcaagttcgagagagtctccgattgggactccggcgtcgatcaccgccaggggaatcggatcgggaatttgcactcctcgtttgggatgcagcggcagtccatcgagagcagtttcggcgagagctcgctctccggcgagttttacgcgcctattctgtcgaccgtcgcggcgaatgagatcgacggattcagaggccaggtctccgggaaattcggcaatgaggagcggaggttcctctggcaagagctgggcgcagcagacggaggagagttatccagttacagctggccttggctcttcggctttcatcggaggccacgtgtgctgatgatcccaattttctcggatcccggtgcccgatga

SEQ ID NO: 81313 - DNA, 1077 bp, Glycine max
  Peptide Sequence Number=SeqID_198091
atggatccatatgtatggactgtgtgcaccaatctgcaggaaaatgaccgaattcctccacttgagacactaaaatctataaatccttcttctgactcttcacttgaagtagtttttgtggatagacgtagcgatcctagcttaagagaactgcaaaacagagtacaagacatttcttgttgctgcatagaaacaactgatgttgtagaccagcttgcgaagctggtttgcaattgtatggggggttcagcttctgtatgggaagatgatctttttcctatatggagggagcgcattaatgatctaagagattgcttaggatctgttgttgtaccaattggcagtctatctactggactttgcaggcatcgtgctgtattattcaaagtactagctgacaccattgatttgccttgtcgaattgctaagggctgtaaatattgttcaagagatgatgcctcctcatgtcttgttcgatttggacttgacagggaatacatggttgatcttattgggaagccgggttgcttatgcaagcctgattccttgatcaatggtccatcctccatttcattttcttcacccttgcgctttccaagacataaaccagctgagcctaccattgatttcaggtcactggccaaacaatatttctcagattgtatgtctgctgagcttgtctttgatagtagttctgcagattttggattctccattctagaacagtatgaaaggcagtacatgggcaggaaccctgggccaattccaaatgataacaacaaaagttctctcgttcctctgcattcacaaccttattgttcaagtgcacatgatcgaggctctgaaacatttaaatcaggtaaccctgctcagaatgctgtagagccgacaatgacaagccgggattcattgcctttaaagcataaccgtcctggtcatagagatacaaagacccgactactgattcctagcaaaccaactagagagttttcccttgatatggaggatttggacataccgtggactgatcttgatttaaaagggagaataggatcaggtatttatgcttttctataa

SEQ ID NO: 81314 - DNA, 774 bp, Glycine max
  Peptide Sequence Number=SeqID_198092
atggaacaagacttcaaaggtgaacgcttcaaggaattcctgagggaggttgcaataatgaaaggcttacggcatccaaacattgttttacttatgggtgcagtcactaagcctcctaatctatcaattgtcacagaatatttgtcaaggggtagcttgtataggctgttgcataaacctggtgccacagagatgttggatgagagacgtaggcttagtatggcttatgatgtggctaaggggatgaattatcttcataaacgcaatcctcccattgttcatagagatctgaaatctccaaaccttcttgttgacaagaaatatacagtgaaggttggtgattttgggctttcccgactaaaggcaaatacatttctctcatccaagtctgctgccgggactcctgagtggatggctccagaagttcttcgtgatgagccatccaatgagaagtcagatgtttacagctttggtgtcatcttgtgggagctcgcaacattgcaacagccttggagtaatttgaatccgccacaggaaccacaaacaggggctaagagaaccctgcaggttgtggcggctgttggctttaagggaaaaagacttgagataccacgtgatttaaatcctcaattagcctcaataattgaggcttgttgggccaaggtttttagttttgatgtccaacaggaatacactgtttcagtagtcccagggaatgactatcaattttcaaatggggagtggggacattatcttccagatattgtgtcatga

SEQ ID NO: 81315 - DNA, 3315 bp, Glycine max
  Peptide Sequence Number=SeqID_198093
atggagagcacgcgcagatcgttggacagatccagagaaccaggtcccaagaagcctcgattgatcgacgaactcagcgcccgacagttacctcaacgcactgcggcagttactacgctggcgtctacgaggtttcgagcaaatgacagagactccgaaatcagcgatttgggtcgtggcggtggcggcggcgggtatcagccgcagcctccgccgcaccaagagcttgtgactcaatacaagaccgcacttgctgagctcactttcaattcgaagccgataattaccaacttgactattattgcaggagagaatctctctgctgccaaggcaattgctgctgctgtttgtgctaacattatagaggtgaacaaaatatatagattgggtcttaagtggtacactctgccctgcaccttaaaagaacaaaaaacatatttacttttccaatcaatgtcctttggccaaatgacggtggtttggtattttgattgggggattgagaatcctggaaaacatggaatttttcatttacaagagagaagtgaaccccaacagtttccaatctcaatcagtgctaaagttccaagtgatcaaaaactgccatctctttacctcttagacagtattgttaagaacattggacgggattatataaagtattttgcttccagactacctgaggtattctgcaaggcttacagacaggttgatccttgtgtgcattcaagtatgaaacatctttttggaacttggaaaggagtctttcctcctcagtcccttcagatgattgagaaggaacttggctttgcacctgcagtcaatggttcggcttcagtgtctgctacagtcaggagtgatttgcagtcacaacgcccacctcatagtatccatgtgaatcccaagtatttagaaaggcagcgtcttcagcagtcaagtaggagcaaaggagtagttagtgatatgactggagctgttttaaactcaaatgaggattcggagaggccagatagagctgctgcacgaccctggctggatccgaggattaacatgcttaataatcagcacacacacagagatgcatttaatgattctgttactgaaaagagcattgatggatcatacggaagcagtgaatatagttctgtcatttcaagtaatttggtctcaggggctggaagaactggaagtaagctcattgatttaggacatgacaaaacatggttcaaaacagatgggggtgatgcagatactacatctgggcaaagaaatggttttggtctcaagcgtagtttttcaaatcaagaagcaccaaagtccatgaatttggatgcacatcgtcagccaagacaaagcataactaacttacggaacaatgtgatgtcaggtaactggaaaacttctgaagaagagttcacgcgggatgagatgaacaatggtttgattgatcatggacccaatgtattaagcaatttgagcacagacacatggatggctgatgatgaaaatttggaaggtgaagatcacctccacctccaaatcacacgcccaattgggacaaaggtcgatagagaaatatccactgttaagaaacaactacctggtttggggggccatccaccatcatcatggcaattgcagaagcaccactcaattgataagttgaatctaaagccagattactctgaaggatttgtgtccactcttagtggcttaccaaccaatgcaagttctttggctgtcaagaaggggaaccaatcctttatgtccaatgcagtagtaggaatgaccaaatttgtgggacaacaatttgattcgggtgaaactgaatccccttctgggcagtcacctttgcggcaacagtctccatcactgccaggaacagtacaccaccctcattcaatgcaaaacttggctaaccaagaattgccaccgagtctcaaaacctctcaacttttgggaggtcagataatcagtcagcatattagagatcactcacctacccttcgtcccattgtaaaggttggtaacttgcgaagatcacaagaaaaggatatgcagggcccattatcttccatgacctctcttcgaccaaagcttcagcaaaagcagctgaacccatctcagactgaagttactgctacaactaagctgccccagtctaaagtttctttaaccagagaaacttcagaacagttgaccacaaataatttgtcagctgcacctgtcaaaactggaatcatccccaagaaatcaattaccagtaatctggatccaaggaagcgtccatctcagactggggttcagcctactcagtctggtaggcctaccacattaatttcttcagggtctgctgtggcatcaccatcttcattagatcctctgcataatgattcatctacactgccaaaaaaacctaaaggaaaggctggacaaccaccacaaaggctttctactcaaccacctgcttcctctaatgttagcagttcctcagctccgatcttaaatgcggccaaaaataataaaccaaatccaattgcaaaccttttaagcacattggttgcaaagggtttgatatctgccgaaacagaatcaccaactacggtaccaagcgtggcaccaaagggatccaaagatcaaactgagatcattaccaccagttgttctttaccagttacatcaatttctggttctgcagctgtcccagtatcgtcttccgatgatgaggtagatgctgctacaaaaacctgtcttgcctcacctcaatcaactagcacggaaatcagaaatctcattggctttgattttagacctaatgtaattcgagaattccacccatctgtaattagggaattatgggatgatatccctcatcattgcaaagtttgcggtattaagcttaaacaagaagaactctttaatagacacttggagtggcatgccacaagagaacatggtccaattaaggcatcaagaagttggtatgcgaagtcaagtgattggattgctggcaaggcagaatattcatctgagtccgagtttaatgattctgttgatgtacacgatgaaaaaacaggcagcagtcaattggatacgatggttctagcagatgaaaaccagtgtctgtgtgtattgtgcggcgagctatttgaagatgtgtactgtcatgaaaggaatgagtggatgttcaaagggaccatttacatgaactattcagatgtcaatagtgagatggaaagtggaaatgtgggtcccatcattcatgccaaatgcttatcagagaactcaatcatcaccaatttggataatgattaa

SEQ ID NO: 81316 - DNA, 102 bp, Glycine max
  Peptide Sequence Number=SeqID_198094
atggcatatgagacaagttcgatgtcatggattttgagactagagaagaagataaagttaggacctaaatgtgaagggattcaaagacagagcaataagtaa

SEQ ID NO: 81317 - DNA, 231 bp, Glycine max
  Peptide Sequence Number=SeqID_198095
atggcagcgtggtggctatattacggtgacactgtggtggtggtgggagtcgtggagtggcagttgcgacagatagtaaatgaagcaacacgatggtggaagaggtactacaatggtgggggtgccgcaatggtggagggatggtacatagtgacaatggtggtggggatggtagagtggaaaacatgcatgggcgatgaggggtggcaacgaagacgaataatggactaa

SEQ ID NO: 81318 - DNA, 375 bp, Glycine max
  Peptide Sequence Number=SeqID_198096
atgactcctcatttctaccccaaattgcaaggagaagccattttcggagtcttggagcacacctctacttcgtggggcttcaaatttcagggttttatgatgatgctttgtgatatatgtatgctgaaaatgttgatagaaaaactggtagagatgatggggagagttaacctagggttaaatgtgagaatggtaatgttgaaagcttgggcagagcaaatgagaaaaatgagtgacaaatgtgaaaggaaagagccatttctaggaaaaatgctgttaaattgtgcagcagatttttaccatagtgcagaaaaatggttgtgcattgctagtcacgggaagggtagtacatctcatgttccaagcatttactag

SEQ ID NO: 81319 - DNA, 639 bp, Glycine max
  Peptide Sequence Number=SeqID_198097
atgtcgttcatggtggacactgatgcgttgggaacagggatgggatttgtcctttatcagttaggtcatcttctagcattttttagcagtatatatcaggcaaatcgaataaggtggcgaatgccctgtctcgagcttctaaagattcacaaggctcattatttgtcctttccgtacctcacttcgcctttctggatcaactcaaacatgagttggctattcaccttgagttcatcgccctgtaacagaaaatcaaaggaatccatttggttgcccaatggccttaaccttatcccatcattgttgacggagttccatacttcaccaacgggagggcatatgggaatcaagaaaactctggcacgtttgggggaaaactttgtctgggccgctatgtgcaatgatgttcaacagttcattgcttcttgccttggctgtcaaaataccaaatatgaagcacgaaaaccggcgggactactgtgtcctttactagccccggtgagaccatgggaaaacctttcattggacttcattgtgggtcttcccccttatcatggaaatactaccattatggtggtggttgacaggttttccaaaggcattcacttaggcatgctaaatttgaactttacgacgtag

SEQ ID NO: 81320 - DNA, 453 bp, Glycine max
  Peptide Sequence Number=SeqID_198098
atgtatgttttggtggtgtcggcaagagaccaggtttgggtgacgaagggggaacccgaggagggggcggacctgaaatgggccaaggttgtagcctacaccatagtcaaaggttgtgaagcttggacctcctgccgaatttccggtgccaaagtaaaaacaaaacaactcaataagaaggatcctcatattgagaaggagcaaatcaggtctctaatgcctgcaagaaagcggtccatgacgaaaattggttgttcctcgacatccattggaaccatgctagagccggtccttccatataaaaagaagcaatcatccaaccaaagggatcggaaccgtcaaaccgcggtacttccaacttcatacgaagagaggaaggggatgagtgatgtggattatgatgggttatggacgatgttggtgaatgggaggttgtctccaggagaattataa

SEQ ID NO: 81321 - DNA, 930 bp, Glycine max
  Peptide Sequence Number=SeqID_198099
atggctcctgagactctacgcttattgggcctcttaaagggtcaacaagtgtggatattaattgatgggggtagtacccacaattttatccaagaacggttagttctagcactgaaggttcaggaccaacaattcttggtcaacttccatgtcctttctctatatggtgtcgatcttgtacttggagttgagtggttgaagtcattgggtccaatcctcacaaactacaatgacctcaccatgaaattccttctcgatggcagagttgttgaattaaaaggggaacgcgaaggcactgcaaaatcaattacaactcaccagctacgtcaacttgtccaaacccatggagttagtgagttctttcatctgcgcattgagccctctttaacccaaacttccaagctaccatatccaacacccgaaatagagaccttgattcagcaattccaacatcattacctccgtcccgaaattgaacttcaagtggactctatgttgaagaatggagtcatcagaccaagcacgagccccttttcatctccgattttgctggtgaagaagtgtgatgggtcttggcgtttctgtgttgattatcaagctcttaacaccatcaccatcaaggataggttccctattcccacggtggatgaattgttggacaaattaggaggagcacagtggttctcgaagcttgacttgcttcaagggtaccatcaaattttgatgaaggaggaagacatcaacaaaatggcatttcgcactcatcacgggcattacgagtttcatgtaatgctctttggattgtgcaatgtcccatcatcattccaagctaccatgaatgacactttcaggccctatttgcacaagttcatcattgtgttttttgacgatatccttatctacagcaagacattggttggccatctctaa

SEQ ID NO: 81322 - DNA, 132 bp, Glycine max
  Peptide Sequence Number=SeqID_198100
atggggcaatgtgatgtgaacactttcactggtgctggtggtttgtctgcgcccttggctgcatatggggcaaggaacaatggtactattatagagtgcaaacaaggaaacacaacattttggagcaggtga

SEQ ID NO: 81323 - DNA, 201 bp, Glycine max
  Peptide Sequence Number=SeqID_198101
atggttgatgaaattgatggttgtgttgatgaaattgaagaagggaatgagggagggaggaaggaagggaagggtctgtgtttgtgtttgcggttgttggtttcagcgtcggttggagtgatgatggtaccggttgtatctgggaagcggttgcctctggagttgggatacagctgtaattggacacgcgtcgcttcttag

SEQ ID NO: 81324 - DNA, 1394 bp, Glycine max
  Peptide Sequence Number=SeqID_198102
atggcttccaatggtcattttccctcaaatcttccaattctaatcagcaagaacttcaacagatggagtgtgcaaatgaaagccttgcttggatttcaagatttgaccgatgtgattgaggatggaatagaaattccaaaagaaggagcctcagattcacagaagactggattcaaggatctgaagaagaaagactacaaagccttggtgattttgcatcaatgtgttgatgattctcactttgagaaaatcgcaaatgctaaatccgcaaaggaagcatgggacattctgaacaaggcttatgcaggagctgataagatcaagaagatggaagagactgagagcattggagattactttggaagattgcaggttcttgcaaatttaatcactagttgtggtgatacaattactaatctgacgttagttgagaaagttctgaggactttgaatccaagattcgattacattgtggttgcaattgaggaatcaaaggacttggaatcattatctgttgatgaattacaaggatcacttgaggcatatgaacaaagattgcacgaaagagcaaatgataaggctacagaacaagccctgcaagcacaccatcagtcaagaaatggtggtcactatgcagaagaatgctggtataaggagaaaaatgttgatgatgaagcacaattagccacaagagctgtttctgacactgaaccagtgttgttgatggtcacaacaaagactggaactgatgcagaagatcaatggtacttgggcataggatgttcaacacatatgactggtcacaaggactggtttgttagccttgatgagtcagtaaatcacaaggtcagatttgcagatgatagcactataagagttgaaggtcatggcaaggttgtgattaaaagaagggatggtacagtgtcatacattgaggatgtgctctatgatccaaacatgagatgcaatcttctaagtcttggccaactacttgaaaagaaatacataatggtgatggaggacaaagaaatgaagatctatgacaaggacagaaggttgatcatcaaagctccattgaccaggaataaaaattttaaggttggtattcaagtcatgaaacacaattgcttgcaggctgagataggtagagaggaatggttgtggcactacagatttggacacttgaatttcaagaatttgagtcaactgcacagaatggctcaaggaatacctcagctgagacagatgacagaaaactgcagagaatgcttggagtgcaagcaaccaaggaatgcatttcagaaatttgtaccagtaaagtcaacacagaaattggaggtgatttattcagatgtctgtggtcctcttcaggttgaatccctaggaggaaacag

SEQ ID NO: 81325 - DNA, 273 bp, Glycine max
  Peptide Sequence Number=SeqID_198103
atggagaacaagaagtgcatttataatactccatttggtattcaaaccattggtaagatgaaatggcatggaactgcaaccactagacatggcaagaaaattcatacccgtgggtacccgcccgaatctgtcccgactttgacgggtaatacccgagttgaccggggatacccgatacccgacgggtacggggatgagacaataaacttaaacccgtcaggtatcgggcttgacgctggtgctatcgatagtgcgacgagtgaggttctttag

SEQ ID NO: 81326 - DNA, 181 bp, Glycine max
  Peptide Sequence Number=SeqID_198104
atgagtgcatctgttgctccagaattgttagagctccaatcttttgtcgagtcaacagtgagtggaagtcttagttcaaaatcaaaaaaatctgttccatggttacaaattgtcatacttgtggttggaactagaggcgacgtacaaccttttctggccattgcaaagaaacttcaggcat

SEQ ID NO: 81327 - DNA, 264 bp, Glycine max
  Peptide Sequence Number=SeqID_198105
ggtgtttgtgtgtgctacaagatgaggatgaggtggtatgggttggctggtgggcatagtggtgagcttatccaaaatggtggaaagaacaccatgaaaggcatcgtgatgggtgtctataatgttttgaagctactcagtatggctatcccacttcacttgatgtctcctcaattcgtgtttgatcttcaccaatctgcgcttcatcatcatcaatccgtctgtggttgtcgtcgtgttcatcatcgtctcgctattgccgct

SEQ ID NO: 81328 - DNA, 237 bp, Glycine max
  Peptide Sequence Number=SeqID_198106
atggtgccaccaccacttcgccttcccgtcatggtcgtgactacaaatctcggtcatgctgaagcctacgccaccttcattccatcgcaacacctctatgtcatcgtcgtagccactaaaaccatcatgatgccaccaccactctgtcttgccgtggcagggaagggagtcaagagaggtacagaggaagacgaagagatgaggaggcaggagagacgctcaaggaagatgttatag

SEQ ID NO: 81329 - DNA, 225 bp, Glycine max
  Peptide Sequence Number=SeqID_198107
atggttagtgtggacctcgttttggcacaagcaaggcacgagggaagtgtgtggatttatgcttggggtgtgagcatgaccctgtcccaggatgaaatccaattgacacaactcagcaaaattgttggagataccagccaggaatgtcaacataatggtggtgttggagccttgcatggtagcaatagcatagcgaatccttcaacgaaaggttgggtcatttaa

SEQ ID NO: 81330 - DNA, 456 bp, Glycine max
  Peptide Sequence Number=SeqID_198108
atggattcaaacatcaattttgatacgcttttggatcaaatcatagatgaagaacttgaagacaacaccgatgaagaagtcataaggtatctgtttcttcgatttgtggaggccttcaccaatcatgatgagtatttccaaatgagggtagatgcaaagcgtagaaacgacttatcaccgttgcagaagtgcattggtgttcttcgtatattagcttatggcttacccgttgacagtgtgaatgagtatattcagattgctgaaattactgttgtggagtgcttacagagatttgtatcagacatctgtgcaatatttggggatgaatacctaaggaggccaaatgacgaagacactagaagactactacaaatgggagcaatatgtggcttttcaggtatgttaggttccattgattatatgcactgtgaatggaaaaattatccagttgcatag

SEQ ID NO: 81331 - DNA, 2691 bp, Glycine max
  Peptide Sequence Number=SeqID_198109
atggcagccactacagtctctctactgggatactaccttcccttggagccaaaagtaaccgcagacttaagctcaagcccttcattgtttctccctatgaccgccgttacagtttcattgcaaaatgctcttccattgagatctatccatttcaataaaaatcatcatacaccaacaacaataaccttatctcattggaggatatgggaaactttccttgttattctggtggtttacactgcttgggtttctccctttgaattcggattcctgaagaaaccacaagcacccctttccataaccgataacattgtcaatggattttttttcgtggatatagttctgaccttcttcgtggcttacattgacaaaagcagctatttgatcgtggatgaccgaaaacaaattgcttggaaatatgcaaggacttggttgtcctttgatgttatctccatcattccttctgagcttgtacaaaagatatcaccttctcctcttcaatcttatggcctattcaacatgcttaggctttggcgtcttcgaagagttggtgcattgttttctcggcttgagaaggacaaaaattataactatttttgggttcgatgcgctaagctcattgctgttaccctcttcgctgtccattgtgctgcatgtttctattatcttattgctgctcgttatcatgatcccaaaaagacatggattggtgcaacgatggataatttccttgaacacagcttgtggtcaagatacgtgacatctatttactggtccattactaccttaacaactgttggttatggagatttgcatcctgtgaattcaagggagatgatctttgacgtcttttatatgctctttaatctgggtttaacagcatatttgattggtaatatgaccaacttggttgtccatggcacaagtcgaaccagaaaatttagggataccatacaagctgcctcaaattttgcccaaaggaaccaattgccacatcggttgcaagaccaaatgcttgcacacttgtgtttgaagtatagaacagactcagaagggttgcaacagcaagagacacttgattctcttcctaaagccatcagatcgagcatttcacattatcttttttattctctgattgacaaggtgtcagagatgaaagcagaatattttccacccaaagaagatgttatcttgcaaaacgaagcccccactgacttttatatactggtcactggtgccgtggttgttggagaggccaaaactggtgatctttgtggtgagattggtgtgctttgttataagccacagcttttcacagttcgaacgaagcgactaagtcagttgctcaggctaaaccgtactacgttcttgaatattgttcaggccaacgtgggagatggaaccataataatgaataatctccttcagatctttttcaaaaccggcattcttggtgcgtatgggaattgtcgtaagacaatcccctgggttcagatcttttcaaaatttaaatgtttagagcatttgaaagagatcaacgatccaatcatggagggagttttggtggatattgagaacatgttagctcgtggtaggatggacctaccagtgagtgtgtgctttgcggcagcaagaggagatgacttgttgttgcatcaattactcaaacgaggcatggatccaaatgaatccgacaacaatcgaaggacagctttgcatatagcggcatctcaaggaaaacagaactgtgttttgcttctgttagactatggggcggatcccaacattagagatttggaaggtaatgtgccactatgggaggctatagtgggaggacatgaatcaatgagcaagctgttatcagagaatggagcaaatttgcaatgcggggatgtgggccaatttgcatgtactgccgctgaacaaaacagcctcaacttgctgaaggaaataatgcgctacggaggagatatcacgcttccaaacagcagcaacacagggaccacagctttgcacgttgcagtctctgaaggcaacgttgagactgtcaaattccttttggatcacggggcgagtattgacatgccagacaagcatggctggaccccaagagatcttgcagatcagcaggcacatacagaaatcaaagccctttttgattccattggggagcctaaggtccattcttccgtcgctattccggtgaggaatagcaagatcaagtaccttggtaggttcacaagtgagccaaccatgacattgcctcttgatggatcgtttcatggaactgatggctcttggagccagaaccagagccaaaaccagagccggccgaggcgtcggagcaacaactaccataactctctgttcgggatattgtcagcagcacacaatggggaaaagtacctgctttcagctgttgacatgaataacaatgcaaggaatggtatgaagagtagtagtgcagttggtccaactagagttataattagttgtcctgagaagggtgaggttgttgggaagcttgttttactgcctggaagctttcaagagctagttgagattggagccaagaaatttggtttctatcctaataaggttgtatgcaaagatggaggtgaaattgaagatatagagataattagggatggtgaccatcttgtttttcttggtgcaagtggagggtgctag

SEQ ID NO: 81332 - DNA, 225 bp, Glycine max
  Peptide Sequence Number=SeqID_198110
atggcggaacctatggggatggtttttgccaatactgctggtggaacctatgctggatggtgccgcgatatatggcatggccatggggatgccgctgacatgcatattggagttggcgatatgcatgccatgcaagcatgggattacgctgatgaaaacggtgatatcacgtaccccttgaggaatatgtttaaaaagggaccccttttgagaataagtttgtaa

SEQ ID NO: 81333 - DNA, 504 bp, Glycine max
  Peptide Sequence Number=SeqID_198111
atgggggattggttggagagagtgattgaagtagaccgtatcattgccattgccgttgccattgcgatcctcatgtctaagatcatgtcagcacctacacttcatcatttctcttctctcttcacccttttcatagttttgcttcaccactccaacgctgacgttggcaccgcttctcgttactcccctccatatttaccatccgggtgctacggtaccgaagcgacgcagtttccgtcgagcaatctttttgcggcggcgggagatggaatatgggataacggagctgcgtgtgggaggcaatacctagtgaggtgtataagtgcggagcaacctaggacttgcattccagaccagagtattcagattaaaattgttgattacgctgccactgccgtgtcgccggcttccgccggcggcaccaccatggttctttccgataaggctttcgggactatagctaacatgtctgccaccttgatcaacatagagctccaacagtaa

SEQ ID NO: 81334 - DNA, 150 bp, Glycine max
  Peptide Sequence Number=SeqID_198112
atgagagacataaatggtcaaatttcaaagatagataggcaaaagaagtgccaacaatgccaaagcagcggcacccttggtggtgggtggaaaaagataaagattgaagacggagcgtcattcagaacgttctatgagtggggcaggtga

SEQ ID NO: 81335 - DNA, 672 bp, Glycine max
  Peptide Sequence Number=SeqID_198113
atgaaggaaggaggacttggcggcgtgggcgtggagcaaggtggcgaggaggtgagggttgagagggaggagaagtgtatggaagcttctagggcacgaggagcaaagaaagagaatggaattctcagcgtcaaagtaaaaagtaaaagtgagaatgagaagaacccatcaggtgtttataaaagggagtttgtttgccatcgtgcaggcaatgctaaacatcacaaagtttgttgtctcgtaagtctcataataaaagttcttgagttagagaaaggaatagatgcagacaatctatcatttttagagaaagatattaagaattttattcaatctcaacatagtattgaagaagagaatgaaggtactgaggttctcaaattatgcaaaagtttgaaagacaaggatgatgccttccaatatgatttcacattagatgaaaacaataaattggagcatattatttgggtatttggtgattcaattcgagcatatgaagcttttggagatgcggtcatctttgataccacatatggaattaatcgttatgatatgcctcatggactatggattggggttgataattgttatgctctctgctattcaacaagtgtaccgagtctacaatgttcttatgccgagaaattacccaaaccaagatccctcgagtga

SEQ ID NO: 81336 - DNA, 651 bp, Glycine max
  Peptide Sequence Number=SeqID_198114
atggccttttggaacttgtcttttttgggtgcattttacttgcaatgcagagttcaaaatccagcagaagcaacttgtgaccagggcggcaacacccaaatattgataagggtacataatgtggatctccttggccacaggacatttggacaagtggctaaatgttgggattcagataccaacagttttgttgtcgtgaagatcattaaaaatcaacctgcatactatcaacgggcgctgattgaagtaactattttaataacggttatcacaaatatctcaggttttcccaaagatgatgaagctccccctggaggtatagatgacatgacaaaactgtcatacttgcatgaaccaagagttctgcacaacttggcagctagatatgaactcaatgaaatctatgtacctaaacgtatactggcaataaacccatttcgaaggttaccacatctatatgatacttacatgatggaacaatataaaagagctgcatttgagtcctcaagcttaaacaacaggagctacatcaaaaaacccaagaagaccttgaatgaagttacaaaagagctttgccctgtgggttctcagttacacaagatcagtacaacgtactgggatgaacaacacattatcccacaatacaaatga

SEQ ID NO: 81337 - DNA, 180 bp, Glycine max
  Peptide Sequence Number=SeqID_198115
atgcttcttggaaacaataatccttgcaagactgctggaattggatctataaggtttaggctacatgatggtgttgaaaggctccttattgaggtaagaaaagacaagtgtccttggctatgtattgcaatgaagaattcaacatactcactaaatgaagagaaaaacttcaagccatga

SEQ ID NO: 81338 - DNA, 276 bp, Glycine max
  Peptide Sequence Number=SeqID_198116
atgaagatgagagcacttttggtgcaacagggtctggtagaggcacttgaaagagaagctaaacttgaaaaatcgatggctaacaaggataagaaagcaatattggagaaaacacacaatgtgattatctcgagtctcggtgataaagtactcaaacaagtcttcaaagagaagaagactagtgtaggattttgggcaaagcttgaagggttgtacatgaccaaatctctagcaaatcgtctctatctcaaacaatctttatattctttaagatga

SEQ ID NO: 81339 - DNA, 171 bp, Glycine max
  Peptide Sequence Number=SeqID_198117
atgctcaatctcaatgcatatttgcaatgttctcagaactggactggtcatcgaactggtaaagacattggttcaagagtcaatggttcaaccgagaaaaagttttcagcgaaaccggttaaaccagttaaatcaacgggttcaccagttttcaacaggttcagtgattga

SEQ ID NO: 81340 - DNA, 846 bp, Glycine max
  Peptide Sequence Number=SeqID_198118
atgaaggttgatatggaggccatgaaggagcagatgacaatgatgatggaagcgatgatgagcatgaggaagatgatggaggtcaatgttgctacagttgttgctgctagtactgctactaagagggacttggttcacccgcccggtttcaatcaagttcagagcaagtcttctttttcaccatatagtttacctcccaattatacaccgcccactgctgtatatgctcctggtgagagtattggtaattctgcacccatatttattgagagtcaacaacctcaactcaatgatacccctgcccatgtctctcaacccatgggggaaacacatgaagctccccaagaccacactatgaccgacttcagggtttattcgggatataccactgaagggtatgcactttctagtgtccctatgccaaacgctctgggggcccctcagtatcgaccaccatcacaacccttaagttttttcatgggtggaggaccttctattgatcttatggatgtcttcaataggcagtatcaatataactctgacatggctccagatagaatgcagttacaaaacatgtgcaagatagataatgaatcattcaaagaatatgctcaaaggtggagagatttggtggctcaaatggtaggttacatgccttcgagttttgcagatctagtgtttgcttgcgagagagttgaagcagtcttggtaatgggggacccaggaggagtggcaagaggaagaaggagtgagaacctcatgttgtggcagcagttctcgctagctgagatttcaagaggacaatcacttgtgaattctaacgtcgtcaagcaatactatgcatga

SEQ ID NO: 81341 - DNA, 105 bp, Glycine max
  Peptide Sequence Number=SeqID_198119
atgatgctcaatctcaatgcatatttgcaatgttctcagaactggacaggacatcgaactggtaaagacattggttcaagagtcaatggttcaaccgagcaatga

SEQ ID NO: 81342 - DNA, 2004 bp, Glycine max
  Peptide Sequence Number=SeqID_198120
atgaataattgtacggcgaagagacgtgagaatgcgaggagcagcagagaggaagatcaactgatagtgactccattgggcgctggaaatgaagtgggtcgttcatgcgtctacatgtcctacaaaggcaagacggtcttgttcgattgtggaatacacccagcttactctggcatggctgctttgccctatttcgacgagattgacccttccacagtcgatgttcttctcatcactcactttcacttggatcatgctgcttccttgccctattttctcgagaaaaccaccttccgaggccgtgttttcatgacctacgccaccaaggccatttacaagctccttttgtctgattttgtcaaggtcagcaaggtctccgtcgaagacatgctttttgacgaacaggacatcaaccgctccatggataaaattgaggttattgattttcatcagacagtagaagtcaatgccggtgttcgagtgctttacaccggagactattcacgtgaggaagaccgccatctccgagctgctgagaccccacagttctcccctgatgtatgcattatagaatccacctatggtgtacagcaccatcagcctcgccacacacgcgaaaaacgcttcactgatgttatccactcaaccatttctcaagggggtcgtgtgttgattccagcatttgcccttggccgtgcacaggagctcctccttatccttgatgaatattgggcaaatcatcctgaactccagaatatacccatctattatgcttctccacttgcaaaaaaatgtttgactgtgtatgaaacatacaccctttccatgaatgacaggatccagaatgcaaagtcaaatccgttttcctttaagcacgtatcggctttaagtagcattgaagttttcaaagatgtaggaccatctgtggtgatggcaagccctggtggacttcagagtggcttgtcacgacaattatttgatatgtggtgctctgataagaaaaattcttgtgttttaccagggtatgtagttgaagggacattggcaaaaaccatcatcaatgagcccaaggaagttactctcatgaatggactcactgcacctcttaacatgcaggtgcactacatttccttttctgctcatgctgactctgctcaaacaagtgcgttcttagaagagctcaatcctcctaacataattcttgttcatggagaagctaatgagatgggcaggctcaagcagaagctcataagtcaatttgctgatcgcaacactaaaattcttactccaaaaaactgtcaatctgttgaaatgtatttcaattcgcagaaaatggcaaaaaccatagggaagctggctgaaaaaacaccagaagttggtgaaactgtcagtggtttgcttgtaaaaaaaggcttcacatatcagattatggcagctgatgatctccatgtcttttcacaactatcaacagcaaacattactcagaggattaccatcccttattcaggtgcctttaatgtcatacagcatagactcaaacagatatatgaaagtgtagctcagtcagtggatgaagaatctggagttcccacattgcaagtccatgagtgtgttactgtgaaacatgaatctgaaaagcatgtctccttgcattgggcctctgatcccatgagtgacatggtatctgattcaattgttgctctggttttaaatatcaaccgcgatgtcccaaaaatagtgaatgaatctgatgccattaagattgaggaagagaatgagaaaaaggcagagaaggttatgcaagccctcctcgtttcactctttggagatgtgaaggtaggtgaaaacggaaaattgataattaacattgatgggaatgtagcagagctaaacaaagaaagtggggaagttgagagtgaaaatgaaggtctcaaggaaagagtaagaacagcattccggcgcattcaaagttctgtgaagccaattcctgtttctgcgccatag

SEQ ID NO: 81343 - DNA, 1476 bp, Glycine max
  Peptide Sequence Number=SeqID_198121
atggcgtcgtcgttaattcacctccgccgcaccgtcagagcactctccggcgtcgcccagtctttctctgtgcatgcggcatcgtattccgtccccattcggtgcggtgtttcatggagtttgcagtcaccgaagggtgtggttcagccccgttcattcaggtcaagctcaatttcacttctctcttttcgatcctcgcagcggcagagcaacatccccgatgagattggtcccgataccattctcttcgagggctgcgactacaaccactggctcatcgtcatggaattcaaagacaaggacaacaaaccctctcccgaagacatggttcgcgtttacgaagagacttgtgccaagggtctcaacatcagtttggaagaggccaagaagaaaatatatgcgtgcagcacaacaacttacataggctttcaggcggtcatgactgaagaagagtccaaaaaatttgaaggtcttcccggagtcatcttcgtgctaccagattcctatattgatcccgtgaacaaacagtatggaggagatcagtacattaatggaacaattatccctcgacctccaccagtacagtttgggaggaatcagggaagacgagactggaataggagtcctggtcaatacaaccggcaagagaatccagtgccaagcccccaagggaatccctcttacaatagtcagggacccatgccaaggggtggaaggaactatgggccttcgcaaaattatccaccccaacagaactctggtcaagcatcacagaattatccaccccaacagaactatggtccagcatcacagaattatccgccccaacagaactttgttcgagcatcacagaattatccaccccaacagaattatggccaggcatcacagaattatccaccccaacagaactatggccaggcatcacaaaattatccaccccaacagaactttggccaagcatcacaaaattatccaccccaacagaactatggtcaggcaccgcaaaattatcctccccaacagaactttgatcaagcatcacagaattatccccaacagcaaagatatgggccatcttcaccacaatatgcacaacagcagagctttggaccaccaggacaaggagaaagaagaaattatatgccacagcagaacattggacgaccgggacaaggagaaagaagagatcctgtgcctaggcatggtgcttcagaggcgaggggtgatacttttaccccatcatatgtgcaggatttcaaatcagcatacaaggaggaatttgaacaggctgagctggggaaccatcctgccaaagaacagacaggatcgcaacaaagatatccaccttctggcccaggcacttttactggagagctgcactgttctgtgacaaagttggatctggtaggtgttaccgaatgtcagttttgggatgagcaacttgatggtcttccagaaccaaatagcctataa

SEQ ID NO: 81344 - DNA, 444 bp, Glycine max
  Peptide Sequence Number=SeqID_198122
atggctgctttgccctatttcgacgagattgacccttccatagtcaatgttcttctcatcactcactttcacttggatcatgctgcttccttgccctattttctcgagaaaaccaccttccgaggccgtgttttcatgacctacgccaccaaggccatttacaagctccttttgtctgactttgtcaagcatacatcaagaacaatgacatgttgctggcacatggggacaatgggaatgtacaaaaagaggtgttactacacaaagatcgaggagagtttaccttcagaaggatgtacttttcctagaaaaatttcattcaatggcgatgaaccatctcctgacacctaccctaactcctctacacagctcatgtcgccacaaaaaccctcccatacttttcttttcaatgttacagctcctactatttttctagaagtttag

SEQ ID NO: 81345 - DNA, 207 bp, Glycine max
  Peptide Sequence Number=SeqID_198123
atggagcaacctaagaattacccaaccccacctgcaaaacaaccagaaaattcccaagcagatacaacaagaaactcaccggcggccaaggttcccaccagcaagatagcagggaacaaagcaaccaatcatgaaaagaaagaaagggaaaaaagaagaaaggaagaggaagggaggagacgaaaaagtgagagaatgagggaatga

SEQ ID NO: 81346 - DNA, 945 bp, Glycine max
  Peptide Sequence Number=SeqID_198124
atggctggcaacgactccacatctaaatctactttctatcccaccttttctgtctcaaacattaaaaactacattcaaataaccctagaaatggagaatgttcattacgattcatgggtagaattgttcctcaatacggccaatgcctttgatgtcgccgatcacattattccacccaaggatgcgactgttaagaaagatgcacaatggtcccgactcgatgcaatcgtgaaacaatggatttatagcacgatatccattgatctcctacatacgattctaaaactcggtgccaccgctcaagaagcatggaatcgcttgaaggacatctttcacgacaataaaaactctagagccgtatatctagaacaacaattctcccaaatccacatggataattatccaaatgcgtcgtcgtattgccaagcattgaaactgatagccgaacaacttagcaatgttggggctccggtcaacgaggatcgcctggtcctccgccttgtgacaggtctctcaagtgggtatgatagtctcgccaccatcattcaacaattagatccactgccatcattttacaaagcgagatctatgctcacacttgaggaaacccgtcgcaataagaacactggtgccaagtctgccctcctccacgcacaatctgatgtttcttctgccgctccaaatcgatctcctgatgttgcaccttctcgctccaacaaccgcaacaccgacggtcgtggaaagcaatatcgtggcaagggcaataataataacaaaggtaactcttacaagaattcctttgacaataacaaaaataactctggcacaaataacagacaaggaaatcagcctacttcttggacatgggttccttttacgcctccctcttggccacaacagccatcttggaacccaccaccatgtccataccctaccacgggctag

SEQ ID NO: 81347 - DNA, 606 bp, Glycine max
  Peptide Sequence Number=SeqID_198125
atgcaacaaagctcctcttcttcccctcatgaaactaatagtggaccattcaaccaatgtggagagggccatgaaccatttgtttcgtatgagggtcttgagcagctgcaccggttcttatttgttctcgggatcactcatgttctgtatagttgtctggctgttggtttagcaatgagcaagatctatagttggcgcagatggggaaatcaggctgcaatggcaaccggtggaaacttgcaaggaaagaaaatcaaggtgatgaggcggcagacaacatttgttttccatcacacttctcatccatggagcaggagtccaatcctaaactggatgctctgttttgtgcggcaatttagaagctctatacaaaaatcagattaccttgcactccgcttaggtttcatcactctggccgctttggatttatgccatagtctgcatcttcgtgaacatccatggtctgaatatatacttctggctatcatttatccctgcaatttggggattccaagaacgatcgtgcttcatgagaaaccattacatgatcatcacacggttggcatgggttggtttcacctctctttcaagaatgctttgttttag

SEQ ID NO: 81348 - DNA, 975 bp, Glycine max
  Peptide Sequence Number=SeqID_198126
atggctcaacaagtaaccacactcgaacccacacatcaaactgtggccgcatcacctgttccctctcccccaatgagaacacgagcacaacatgacattcacaaacccaaatccatttttgacctctccgttaccacctcagtctcaccaattcccaaaagcccaatatccgcactccatgataagaattggaaacaggccatgaccaacgaatttgatgctcttattaaaaataagacttgggtcttggttactcgtcctcctgatgttaatattactcggtgtatttggctatttaaacacaaatataaatctaacggtgatttggagcggtataaggctcgtcttgttgtcaatggcaggcacctttctgaaaccgtctacatgcatcagcctcctggatttcgtgatcgaaatcatccggatcatgtctgtcttctaaagaaatccctatatggccttaaacaagccccaagagcatggtaccaacggtttgcatcttttctctccaccatcggatttgttaatagcaagaccgaccactctctgtttatctatactcatggtgacgacacatcatatattcttctctatgttgatgatattattcttactacatcctcacactctcttcgtgacaccattattgctgctcttcagtctgaattctccatgacggacctgggccctttgaattacttcctaggagtgtcggctacacgtcattctggtgggttattcttgcatcaatccaagtatgccgaagacataatctcttgtgctaaaatggtaaattgtaaatcggcactcacaccagtggataccaaatccaagttaagcgcaacttctggtgaaaaatttgatgatccaacactctaccgttcacttggcggtgctctccaatatcttatatttacaaggccggacatctcctacgcagttcaacaaatttgtctctatatgcatgatccatga

SEQ ID NO: 81349 - DNA, 255 bp, Glycine max
  Peptide Sequence Number=SeqID_198127
atgggtcaggttcaaccaatcaacaaaaggaagaatgaaggggacagaaaggtggaggcaaaccttaaagcaattgaggaaataaaagttgcaactgatatggctttgaggaatacagagatggtagattctgcaaaggttctagttaagggtgaactgaggcttgttgaagaacaatgcaccaacggtctatgtgtagagatgactacttgggcagggcatgactgtataatttatgttgtccttggccattga

SEQ ID NO: 81350 - DNA, 1608 bp, Glycine max
  Peptide Sequence Number=SeqID_198128
atggctactccacctgcctcgcctcctcctcctcttcctcctcctcctgcagacgcatcagcaactccatctacgttgaagcggacacgcaaggtgacatggctacgatcattggctactagaccacctagggcagaaagacctgtggtcaacatcgatcctgctaccagcaaggccgacggtccccacaagaagaaattaagaacatatttggggattgtcgctcgtgataaggtcgacgtcacatatgacacctggaaggaagtccctactgctcaaaaggatttgatatgggaggatattcagcgctggaggcagtttagatctgacttgactaggaaatgggcacttgtagccgacaaggacgatgtggacgacattgtctgtgaaaaatatggcattagcaaggagaaatgggcccagttttgtcagacccgcagagacccctcatgggaggatgtgcggaaaaaggaacaggcctcccagaagcaaaacactgccccccacgtattgtctcgtgggggttatgaatatttagaagaaaagctcatggctgagaagacaaagaaaaaactggaagaagctgcccagtttggaagcactgagagcatcattgaccctccatctcccatcagacgccacgtgaaatggaagatggcccgcatgaagaaaactggacagatgacgtctgaggcagcaaaggaaatagctgacaggattgcgtcacagggatctttcgtcccccatggacgtcaggatatcctggctgctaccattgggcgaccagagcaccctggtcgtgctcgtgttgttggagccggtgtcaccattaagcaatactttggatcggcttcacgaacatcccgcagttcttcctccatgcctcctgaagacctagaacagctgacccaacaaatcagagaccaactggaggagtcaatcacagaaaaagtgactcgaaagatgatggcatccttcagccagatgcagtcccagtttcagtctcagatgcaatcacaaggacttgcactacctccagagccaaaggttggtccctcaggtcctcgtgtcagcacaaaggagagttgtgttgctccctcagggaacgatccagggacgagtgactcagacaaatgcgggctatacattgaagaaaatccttcccgcctggttgccctaggaagactttatgagggatccacaacagttcacaacatccctttgttgcatggccaagtcaaggttggtgttgaggaggttaaagatgcagaggctctcgttcctgtacccactaacgaggttaccttagtggggcaaacacttaacaccttccttgcttggccaacacatcttgtgaagcgtttatcagaacatgcagctatgtctccagcaaaacctccagaaagcctggatgaagaggtcgatgatcccctgtacctgatgacattgaccatcccacaactgtttttgaagcctctccaggttatgtgggatgctaccatattcggggtgtttaatcaaaacttcccgttatatataaagcacgaagatctctctgaaattgcacacggtggtcaatgtctcagcatatctgttatacagttgtag

SEQ ID NO: 81351 - DNA, 276 bp, Glycine max
  Peptide Sequence Number=SeqID_198129
atgaagatgaaagcaaacaaaacgagaaatgaattaaaagtctcggattcaaacacttaccggtcaaagaccgaagaacgaatgaagaacgaacgaaaaacggtgaagaatggtggaaaatcttcacggatttgctcacggaaacgtcttggaagcgttacgttgaaatgcatagtgtgggggtcagggatccttgaaactcagcctcctccccctatttataggaaaaatggggaggtgcttgccgcccagaggcttcttgaggaatatttctga

SEQ ID NO: 81352 - DNA, 872 bp, Glycine max
  Peptide Sequence Number=SeqID_198130
atgtattggattttattgcagtatcaacaagatgacccagttaccctttgggtgaacaaagttggtccttataacaatccacaagaaacgtacaattattacagcctaccattttgccgtccacctggtaatactgcacacaaatggggtggtcttggtgaggtcctgggtggcaatgagctcattgatagccaacttgagataaagttcctaggaaatgtggagaagaccatattttgccgtatagaacttgatgaagcaaaggttaaacagttcaaggatgcaatagagaataattactggtttgaattttttatggggtatgttggcgagttacatcccgataagaatggtgataatggcaagcatgtactttacacacacaagaacatcaatgttcaatacaataaagatcagatcattcatgttaatctaactaatgacaacccaaggcctctggaagtaggaaaacctttggacatgacatattctgtcaaatggtctcctacgaatgtcacttttggacgccgatttgatgtatacctggactatccgttctttgagcatcagattcactggttctccatttttaattcttttatgatggtcatcttccttactggattggtgtcaatgatattaatgcgaacgttgagaaatgactatgcaaagtatgctcgggaagatgatgatttggaaactctggaaagagatgttagtgaagaatctggctggaaacttgtgcatggtgatgtttttcggcctcctcgcagtttggttattctttcagctattgttggtacaggtgctcagcttgcattgctggttcttcttgtcatcttgttggctattgttgggatgttgtatgttgg

SEQ ID NO: 81353 - DNA, 1502 bp, Glycine max
  Peptide Sequence Number=SeqID_198131
tgatcgggactcacagcgtgaagaccagaagcgagagtgaaggcaaagactgggatcaggttttcgccttcgataaagaaggcctcaattcgacgtcgttggaggtttccgtttggtcagaggaggtcaaagaaggggatgagaaaagcgagagttctctcggaacggtgtcgtttgatctgcaggaggttcctaaaagagttcctccggatagtcctttggctccgcagtggtacactctcgaatccgaaacctcgccgggaaatgacgtcatgctcgccgtttggatcgggactcaggctgacgaggcctttcaggaggcttggcagtccgattctggcgggctgataccggagacaagagctaaagtgtatctgtctcccaagctttggtacctgagactaacggtcatccaaacccaggacttgcagctaggttcgggacccgaggctaaggctcgaaatccggagctgtacgtgaaggctcagctcggcgcgcaggttttcaaaacaggaagagcctcacctggctcggctaatccaacgtggaacgaggacctcgtgttcgtagcagccgagccgtttgagccgtttttggtggtcacagtggaggacgtgtcaaattccaaaaccgttggccacgcgaagctccacgtggcatccatcgagcggagaacagatgatcgaacggacccgaagtcaagatggttcaacctctccagcgaagacgagagcaattcgtacacgggtaggatccacgttcgagtatgcttggaaggagggtatcacgtgatagacgaaaccgctcacgtgaccagcgacgttcgagcctcggcgaagcaactcgcgaagcccccaatcgggttgctcgaagtagggattcgcggcgctgcgaaccttctcccggtgaagaccaatgacgggacacgtggcaccacggacgcttacgtggtggccaaatacggacccaagtgggtccgaacccgaaccatcatggacaggttcaacccgagatggaacgaacagtacacgtgggatgtttttgatccttgcacggttctcaccattggagtgttcgataacgggagatacaagcgaggggaagatggagaacctaacagagattgcagggtagggaaagttcgcgtgcggttgtccacgctggacaccaaccgggtgtacgtaaactcgtactccttagtcgttttgctaccaagtggcgccaagagaatgggggagatagagattgctgttagattctcatgctcctcatggttgagtctaatgcaggcctacgcaagcccaatcttaccaagaatgcactacgtgcgccccttcggcccggcccaacaagacatcctacgccaaacggccatgaagatcgtaacggctcgcctcgcccggtctgaaccggcattgggtcaggaagtggttcagttcatgctggactccgacactcacgtgtggagcatgcggcggagcaaggccgaactggtcagagtg

SEQ ID NO: 81354 - DNA, 1014 bp, Glycine max
  Peptide Sequence Number=SeqID_198132
atggaacgcatctcgccggatgagccacaggataagctctacaacgagatgatgacgctgtgtgaaatggccgatgaagccggcatgcatgctatctggaccggcgaacatcatgggatgaattttaccatcgcgccgaacccgtttatcaacctcgccgatttagccaaccgcaccaaacgggtgcgtttgggcaccggcaccattattgccccgtttaaccatccgctgcggctggccggcgaggcggccatgaccgatatcatcactggcggccgtctcgagttgggggttgcgcgcggggcatacaattatgagtatcagcgtttgatgcctggactcgatgcctgggaagctgggcagcgaatgcgtgaattggtaccggcggtgaaaaaattgtgggaaggcgattacacgcatcagggggagtactggcaatttcctgcatcgacctcctcgccgcagcctaagcagcagccgcatccgccgatctggattgcggctcgggacccgaatagccatgagtttgcagtcagcaacggttgcaacgtgcaggtgacgccgctgcatcagggcgaagaagaaattgtccgcctggcggagtgtttccacgaaacccgtcagcgcctggcgccggagaaaccgctgaaaattatgctgctgcagcatggcttcgtcgctgaagatgaaaatgacgcccaacaagccgccgaagaacttaaccgtttttataactattttggcgcctggtttaagaatgagcgcccggtaagccaggggctgattcagccgcttagcgacgaagagatcgctgccaatacctattattccgccgccgccatgcgcaaaaatctcgccatcggcacgccgaatgaaatcatcacccggctgaaaaaatatgaagcgctgggctatgacgaatttgcgttgtggattgatagcgggatgccgtttgagcggaaaaaggcgtcactaacccgctttattcagcaagttatgcccgaatttcgttaa

SEQ ID NO: 81355 - DNA, 234 bp, Glycine max
  Peptide Sequence Number=SeqID_198133
atggagttggagaatggagagagaagactaaggtgcagagcagttacgcaaaataaaaggtggcgaatttatgagagagagagagagagagagtgggatttgggagagtttcgaaggaaagcaaagaatcgtgtgcgcaatttgcagcaagaacttgtgttgtcagttccttcttatggaaaaattacaaaggtagaaggatcgtatgaagggtctaccttccaaggggcataa

SEQ ID NO: 81356 - DNA, 357 bp, Glycine max
  Peptide Sequence Number=SeqID_198134
atggctaattgcaaaactgttccttttgctgagtctaagataggtggctgtcataccctaatttcgtccgggaacctttgctcgatgacgtgcgaccattctttggtcctcgtgaggtgcttggcacccatcattaggcaatttgtgaaattccaggacatgccgaaaaaccaaaaaaatattgatgcacaatcccagaggggggtgtacttagtaaaaatgggggtgcaaatagcacccaggcccacttgggccctccggaatattcctccagaaggcggttgcttctggaggaagcaacccagctcgcctgggcgagctgggcggcaaccacctcccctattttgctataaatag

SEQ ID NO: 81357 - DNA, 1569 bp, Glycine max
  Peptide Sequence Number=SeqID_198135
atgagtgtaagggtactgcaagcagaagcagatatgaaaataccacacgtgctgagtgttgctgggtctgattctggaggtggtgctggaatccaagctgaccttaagacttgtggggctcgccgtgtctactgttccactgtcattactgctgtaactgctcagaacactgctggggttcagggactcaacattctacctgaagattttgttgcagaccagttgcactctgtgctctctgatatgcatgttcatgtcgtcaaaactggcatgctgccctctcttaatatagtcaaggtcctttctcagacccttaggaaatttcccataaaagctcttgtggttgatcctgtcatgatatctaccagtggggatgtacttgttggtccttccgttcttgctggatttctggaggagctgcttcccatgactgacattgtaaccccaaatataaaagaggcatcagttttacttggtggtgtgccactgaaatcagtttctgacatgcgtactgctgccaaattgatacatgatttgggtcctaggaatgtacttgtcaagggtggtgacctccctaattcgttagatgctattgatgtattctttgatggtgaggatttctatgagctgtgttctccgcgtgtaaatactcgcaatagtcatggtactggttgtaccttggcatcctgcatagcagcagagctggcaaagggttcatcaatgctttctgcagttaagacagctaaacattttattcaggccgccttggattatagtagagacatgacaattggaaatggagctcaaggcccttttgaccattttttggcacttaagatcaatcagagttcttataggcagaataggttcaatccaaatgacttgctgttatatgctgtaacggattcggctatgaataggaagtgggaccgttctattgctgaagctgttaaggctgctgtagaaggaggtgctaccattgttcaaataagggagaaggatgctgagacacgggattttcttgaagctgccaaagaatgcctcaaaatatgccattcctatggagtacctttacttataaatgatcgtatagatgtggcccttgcttgtgatgctgatggtgttcatgttggtcagtctgacgtgcctgcacgtcttgctagaactctccttggtcctgaaaagataattggtgtatcatgcaagacgcctgaacaagcccaccaagcatggattgatggtgctgattacattggttgtggtggtgtttatcccactaatacaaaggcaaacaatcgtactataggcttagaaggcttgaaggaaatatgtctggcctctaaactgcctgtggttgcgattggtggcattggtctgtcaaatgcacgtgaagtcatggaacttggtgtaccaaatctcaatggggttgctgtcgtttctgctctatttggcagggaatgtattttgactgagacaagaaacctgcacgcattaaatgtgggagcaattttgcttaagttctttctagtcaaggaagtgattgcaacagttgtagttgctttcacctag

SEQ ID NO: 81358 - DNA, 276 bp, Glycine max
  Peptide Sequence Number=SeqID_198136
atgccttgtcttgtcactactctcctagccttacaacctagccttctacctaagctaaactcaccctacaacaagcaaatgaaagtcgttggtctctctttttgcccacgagcatgtgtgcttagccatgcctcacttgagaaagttagagggttgtgtgttttttggagattctatctaagagttggaaggagttcaaggaagccttgctcccttggtggtcaggtgaaggagaggaagaaaagaaacaacaccacactttccccttttgagtaa

SEQ ID NO: 81359 - DNA, 380 bp, Glycine max
  Peptide Sequence Number=SeqID_198137
atggttagaataggtagcaatatacctttggcaatttacactttgggtatgatggcaaaatacttggatgtattagaaataccaagaggtgtacatgtgcattttttggtaccccaaaatgctttgagtatgcatgtatgtgaatttagccaaggagatgtgtgtgatgttatatgccatttttgctttaagagtaacgtcccactggtaaaactaactttccaaatgtttgccttcgcaggaatggccccgaggaagcttgcctcaaagaggtccaggaaggacaaggcggccgaaggaactagttccgccccggagtacgacagtcaccgctttaggagcgttgtacaccagcagcgcttcgaagccattaagggatg

SEQ ID NO: 81360 - DNA, 222 bp, Glycine max
  Peptide Sequence Number=SeqID_198138
atggcttgtggcatgaaggagatgtgtgaagatgataaaggatacaacttttgttgtcctaattgcatggactggattttgttatcacttgtacacctccttaaatgtttgtttcctgttgttacaataggtatcaaggagtttgatactggtttagttgcaccaagccactggggtcttgtttctaataagcaaatgatgcaggaggagcagcctctttag

SEQ ID NO: 81361 - DNA, 330 bp, Glycine max
  Peptide Sequence Number=SeqID_198139
atgaatcctactgagaagcattgcaaaacagccatatattgtgttatgcatgggtacaagtttacaaataactccagtatgcaacttgcgtctgaaagcacttcatggtggtgggtcattggaccccaaggatcagctgtttacatcagttggcacatggcctcaaggtttggagagtttacactaggaagaataaaggaaggaatggcagaatgtcgagttgatagagagagagaaataaagaagagggttgttactgatttgtggtttgcagtagtattggtgggaatgtggggtaataggggtatcacatggaaaacattacgatag

SEQ ID NO: 81362 - DNA, 487 bp, Glycine max
  misc_feature (474)..(474): n is a, c, g, or t
  Peptide Sequence Number=SeqID_198140
cctccctcgtcgatgtaggtgacgcaggggtcgtcctcgacctgagcggcaattttgtggaggatgtcctggacattggagtaggcatggtgggacccaccgggcatgagggaggggtcgtggcatgcgccgttttcaccaccagaggtgccaatgccgaggtagaggaggcctttgtcggcgacgaggttcatgcagcgctcggtgttctcgtaccactcattgtcgccgtcgatgatgcagtagccggggtcagggagagaacgaagtcgcgaggagtgtattggctcgtgagagggagggagccctcgttggttcatgcggcgctcgatgttcttgtaccactcgttgtcgttgtcgatgatgtagtcgtcggggtcgaggtggtcgaagagggcgacgatggtatggtcgactggggagtcgaccttgatgaggatgatgacggatctggggtgcttggagggaaagaancaagaaggggaaa

SEQ ID NO: 81363 - DNA, 486 bp, Glycine max
  Peptide Sequence Number=SeqID_198141
atggggattccaccctcgttcctcctcagttgtttcgtctccgatctcactctagagatccgctttgaggtgcaggctcatcagcctctctccctcactcaagccgccgacttggctcgtctccaaaaggagaagttctttgatcatcgtccatcacctcccccgccttgccctcgaccaccctccctgacaaaccatggaccccttcaccctaacccgcagctaaccctacttcctccttcccctcggccatcaccatctattccctcttcttccccacgtccaaacccgccaccacccttcaagcacctgacctttgaggaaattgtctctcgccgtaagcgagggctctgctttagctgcgatgagaaataccataaaggtcaccgttgtgcctctagggtctttcttttgctagcagaagaggacaaaccgcctgacccgcttcttatagccaatttggaccccagcctcgacccttcctga

SEQ ID NO: 81364 - DNA, 285 bp, Glycine max
  Peptide Sequence Number=SeqID_198142
atgaacctcgtcgccgacaaaggcctcctctacctcggcattggcacctctggtggtgaaaacggcgcatgccacgacccctccctcatgcccggtgggtcccaccatgcctactccaatgtccaggacatcctccacaaaattgccgctcaggtcgaggacgacccctgcgtcacctacatcgacgagggaggctctggaaactgggctgccatggttggttttagaggttgctacaatttttccgatggaagagaagggacagggataaggaaagggaaatga

SEQ ID NO: 81365 - DNA, 1056 bp, Glycine max
  Peptide Sequence Number=SeqID_198143
atggggagcataagcacaagcagcatcagagctcccccaacccgaagaacaacagtcactcctttctcttcccttctccccaaacccaaacctcattttctctccctttccacttccaaatcccacgcattccctctctccaagcccctaaccatttcccccaattcacatcccctcattcccaaatccatccccaccctctcctcctcctcccccctaaacctcaagtcccgactccgcaacggagagaccctctacggcctcttcctcctctccttctcccccaccctcgccgagatcgcgggccacgccggctacgacttcgtcgtcgtcgacatggagcacggtcctggcggcatccacgacgccctcccctgcctccacgccctcgccgccgccaacaccgccgccatcctccgcgtcccggagtccaccgctgcttgggccaagaaagccctcgacctcggcccacagggcctcatgttccccatgattgactccctgcagtcggcccaggacgcggtctcctactgccgttttcctcccaccggactccgcggcgcggcccaccccatcgtccgggcctccaagtacggcctcgacgaggggtatctcggtaattacctcgacgagctgttaatcatgtgccaggtggagtccgaggagggcgtggcgaacgctggcgcgatcgccgctgttgatggtgtggactgcgtgcagatggggccgttggatctgagtgctagtttagggtacttgtgggaccctgggcacaagaaagtgagggaggtgttgagggaggccgagaacaaggttttggagagccgaaacgacgacgttgagagtggggcctacttggcgggtttcgctacggcgtatgatggggcgagggatttgaggtcgcgtgggtatcacatggtaagtggcgccgtcgacgtggggctgttccggagcgcggccctggaggatgtcacgcggttcaagatggacggggatgggtcggagagtgatgagggagaggagaaagagggtgatgagaagtactggagtgaatga

SEQ ID NO: 81366 - DNA, 1245 bp, Glycine max
  Peptide Sequence Number=SeqID_198144
atggttggatgcaatcattgtaaagttgttgggaaaatctatgggatatgtgccaatgaaggaatcactgaaaagtgtgtggaattggccatgccttgggatgagtactatgataagagcgttcttttagcactagcgacagcggttggaagatcggttaaagttgatatgatgacactaaatacatcaagtggaatgttcgcgcgcgtgtgtgtagacgtcgagttgcaccaaccaatggttggcaagtgtggttcaaaaactcatggtttaaagttgagtatgatggaagagaaggttgcaatgttgaaggctagacttgttgtcatgtcaatcttgaaaatggttgaagatctggtcatgggtgatgggttagataatgtgatggagagtgaaagtttgtgtggagagcgtttggggtacatgattaaggatgctgtggataaaggtgattgggagcctatcacgttgagtaggaatggtcctaagctctcccacctattctttgttgatgatgcgttccttttcactaaagcaaagctttctcagatgcgtgtcagccttgagaaatctaaagcctttgcttccaatagggttcctagaagaaacaacattgggatatatcttggcttaaatattgttcatggtcgggttaccatgaaccattttgatcctttattggataaaaatcaaagtgtcttgcttcttggaaaggccatctattggggagggctagtcattggtagcatggagcgtaaggttcatcttgtcaactggaaagtgatcactaggaaaaggaaacaaggagttgagtatattgatattcgtgatgttgaagtgaaggttggagatgtttatacatctaataagtgggattttagcaacctttatattgaaatcttgtctggtaccaaagattatttagcaagaatgaggttgatcctacattatgcaagttcggatttgattgtgtggtttggagacatcttaggctacattccaaaatcgcatccttacactatcgtctctcacgttagtactagtgctagtcaagtgatgcttcatattgatgggagttgcattttgaatccagggtttgctggttataaagggctggtgaggaactccaatgacatattcatgtatggctttttcgatgatattggggtgcaggagggtcttcctaattgccatcagtatgcttccattgttctcagcataagagatttcttaagggaagattga

SEQ ID NO: 81367 - DNA, 1167 bp, Glycine max
  Peptide Sequence Number=SeqID_198145
atgggtaaaagcagctcaaccaccttagctgctagtgtgaattttgttgatttggcagggagtgagcgtgcatctcaagcattatcagctgagtccagattgaaagaaggctgtcatataaatcggagtttactcactcttggaacagttattcgtaaacttaggttgtccccttctttcttagcctatggtgtctaccttctttattcagcttctaatattgttagcaaacctacatctggattgtttaattcaactccttccttaggtggcaattctagaacatccatcatttgcactttgagccctgcgcggagccatgttgagcaaactagaaacactcttctttttgcttgttgtgcaaaacaagtgactactaaagcacaggttaatgtagtgatgtctgataaggtattggtcaagcagctgcaaaaagaggtagccagattagagagtgagttgagaactccttgtcctccttccaccaattgtgattgtgcagcaatgttgagaaagaaaaatctccagatacaaaagatggagagggagattagggagcttattgagcaacgtcatcttgctcaatctcagattgaggatttgatgtgcatggttggaaatggtcagaaatctagaaaagaagatgatgattcaatatcagagtcatcaagcacttatccttttgatttacgcattagagaattcaacaatcctcactacaacaatgaaaatagtgaaagtagtcctgatagtaagttttttcttttcttccctttgccagtaaacacccgatgctgcaaagaaattcaaagtgttgaattggaggaatcaagtagagatgaccttgaatatgctgatccatcagtaagtaacaacggggtgttggcattaacattgtatggagaggaaaatgtaataagccaggagataccgacccctgtgaatgaagatagggaagagaaacagaaccaattaacatatggtgtgttggagcagagactcgatgattcacaattgagtaatgattctcctatgactatgtcagagacagtgccaaattgtaggaatcttaaattactaaggagctggagttgtagggaatattacacaagtagttctcctgagaaagcgggagttcctcgaccttttacacttgatgatgaatga

SEQ ID NO: 81368 - DNA, 615 bp, Glycine max
  Peptide Sequence Number=SeqID_198146
atggcgaaaatcaagatgggtcacccaccgggtcaatgtgaacaaaaccaacacgccttcattataaattatcatttagattatttttctctatgttttgctcgaaaaaaccctttgtttgttctttcatgggctcattctgggagcgccatgagcaaacgcaacactttctttcacaatctcatcaagcccttcaaattcagccccagcaaagagggacaaagcgaagtagaagaaataaagaacctagctgcacaagagcaaaagatcttcccctacgaaacattggttgctgctaccaacaaatttcacattcttaacaagctaggtgagggaggatttggacccgtctataagggtaaattgaatgatgggagagagattgcggtgaagaagttatcgcatagatcgaatcaagggaagacgcagttcgttaacgaggcaaagttgttggcacgtgtacagcaccgtaatgtggtgagtttgttcggttattgtacccatggcttcgaaaagcttcttgtttacgagtatgtccttcacgagagcctcgacaagcttctcttcagtgagtgcttctttgcaaatcctctttgtttacttgatttaatttaa

SEQ ID NO: 81369 - DNA, 687 bp, Glycine max
  Peptide Sequence Number=SeqID_198147
atggcccaagccctccgcgtcggagagcacctctgccgcgtgataggcagcgacgactgctcccttgactggcaggtgcagttctatgtgtccccctcatgcccgcacttgatcgacactccgcgagctcagacaatatttcttgaagaagatgatcatcggtgtgaagcaagaatcgcaagttcgagaacaggatttcgaaaactttcagtgagggtgaacctcggttgtggagtacccgtggtttttttgagatggaaagatgaaaagagattgaaacccaaattaggtgaccttgtcatcctaccttttctgggtccaaatcatgatttaccgataggggcaagaacggaaaaggtggctaagtttataaggaacttagtgggcacttatgccaaatgggatggtggaggtgagatttgttttggcagaaggatgtgcatcaaagtgtctatagatgtgaggaaacctccgaggaaggaccatgtcataagggagtgcgatgaacataacagagaagaaacgatagagggagatgagggatgggaactacttggtcagatcggcaaatttgatgcatcctttagggtctcatgtgatgctctctggaagcaaatttgggaagtgaatgtggcccataaatgcaaaacacatggtgtagagagcatgatgcaacatcttacttga

SEQ ID NO: 81370 - DNA, 150 bp, Glycine max
  Peptide Sequence Number=SeqID_198148
atgcagaaacacagagggagactgtatgttgtgatttgggaggaaattcagactgttatgatacagtccaggcctgaaatcaggctgtttaaaatcacaagtgacggctccgatgacaagattgaccacttgacttggccaaattcatga

SEQ ID NO: 81371 - DNA, 222 bp, Glycine max
  Peptide Sequence Number=SeqID_198149
atggcacaaagaaaaatagttcccaaatactattttggtgctcaagtactgctcactcgtcacttgccaaatattcttgttcgttcacttgggagtgccaaatgggacaaagggtatattcatgtggaattttgtcaatttagaaaagtgggcctagaaaggaagatggagacaagtagttcagagaagagaatttattccctgcgtagcatctccaaataa

SEQ ID NO: 81372 - DNA, 111 bp, Glycine max
  Peptide Sequence Number=SeqID_198150
atggccaaaattccagattcagatccctcaaatctttgtaaggagtttgaaggaaacagtagcaatggcacaagaaagcaaagaccaatccacccaaactggacttattag

SEQ ID NO: 81373 - DNA, 213 bp, Glycine max
  Peptide Sequence Number=SeqID_198151
atgactgatattgagactctaagtgttggaactataagcgttgagactaggcatggcacccgcgcgaggcgggggcgaggagtactccctcgctcctcgtccccgaaccttaccctgctccccgtccccgctccctgtggtgtgggtattttttgtcccgttcccgtttcccggctccctgaggggacatgcggggaccctgttttacattaa

SEQ ID NO: 81374 - DNA, 714 bp, Glycine max
  Peptide Sequence Number=SeqID_198152
atgtcaccggttggattaccacctggctttaggttccatccaaccgatgaagagcttgtcaactattatctcaagagaaagatcaatggccaagaaattgaacttgatatcattcctgaagttgatctctacaaatgtgaaccatgggaattagcagagaaatcatttttgccaagtagagacccagagtggtatttttttggaccccgggataggaaatacccgaatgggtttaggacaaatagagcaactcgtgcagggtactggaagtccactgggaaagacagaagagtttcatgccaaagcagacctattggcatgaagaagactttggtgtactatagaggcagagctcctcaagggatcagaactgactgggtaatgcatgagtatcgccttgatgacaaagagtgtgaagacaccactggattacaggatacttatgcattgtgtcgtgtgttcaagaaaaatggaatctgttctgatattgaagagcaaggacaatgtaatatatcactaattgaaagctcccaaaccataattaatgagtgtgaaaccatgtcacctgacataccaggggcatcatcatcatgcttggaagaggaggacaaagatgattcatggatgcagttcattacagaagatgcatggtattcttctaatgcagcaatggttggtagtgaagaagtgtcacatgttacatttacaaactaa

SEQ ID NO: 81375 - DNA, 933 bp, Glycine max
  Peptide Sequence Number=SeqID_198153
atgttgctgtcacaagccaaactgcacaacaacaacaacaacagcatctccaatgccattaacatgagtatgaagaacaagggtaacaacaacaataacaataatcattgttcaccagctatactttacctctacccttgtcttgatggtgtttttgctgcccttgctgcacacctttactttaaggccacttcattattatcccctcttttttttcccaacactgtctacaaccccctcagtgctgaagatcttcctctgaatgaaattggtgatctttatctcttagattttgtggggcctgatggttttgttcaggaaatctccaccaaagttccaagggtaattgttttggaccatcacaagagtgcccttgagatgctaggcaatgaggcttcgcttggtgagaatgtggttaaggttattgacatggagaggagtggggctactattgcttttgattacttcaaagataagattttgagtcctgatgttgcggttaagcacccgtcagtgcacgaagaatttgagcgtgtcaggcaactttttctgtatactgaagatggggacctttggaggtggagattcccaaacagcaaagcttttggaagcggtttgaaggatttgaacattgaatttgatgccaggaaaaacccttccttgtttgatcagttgctttcactagacttggataatattattagtaaaggcaagctgagcttatcagacaagcaaaaattaatcgatgaatatctcaggaagtcatatgaaattgcccttgggaatgctgaatttggtcattgcctggctgtcaatgtggatactgttttttcagagttgagaagtgaattaggacatcaattagctactaaaagccagaaaatgaatttgaggtatgtatttcctcctaggaattactccctctatccctaa

SEQ ID NO: 81376 - DNA, 153 bp, Glycine max
  Peptide Sequence Number=SeqID_198154
atgcaactcgcaggagtcattggcgagtttggtgacgaggtgacaggttgcaggaagcgtggcagctttaagcagttgaaaatgccagtgctactggcgatttgcgctgcagttggagttgctagtagcactggcgagttgagcttcaagtag

SEQ ID NO: 81377 - DNA, 378 bp, Glycine max
  Peptide Sequence Number=SeqID_198155
atggagagttcaatgagacttggatacttgatgactatctttgctgtgtcaggaagcatggtctttttgtttcatcaagtcaataagcatttgtgcaacaacttcatgaagaaatttgagattgaaattcgaggctcaatgaaacatcaggcaaaaaagaaggtgcggtttgcaaaagatgtggtagaatttccaatggaggagaagaatgatcatataaacgtggcaaggactcaagaggtcattaagaaggttttgtttatagatgatgttaagaaatggaagcatgaacaaaaattgaaagatgtcatgcctcctaatagggcaattttgtacaaggggattatgaatgataggaagggaagacttggtttttaa

SEQ ID NO: 81378 - DNA, 294 bp, Glycine max
  Peptide Sequence Number=SeqID_198156
atggctaaactacataggcaaaagcaaaactcaaggaaagaaaaattggatatccctaaactctcaatttgtccctttgccgagaagcaccagagcacactggaggaattgcaaacacatggtgtcccaggtgaggaagataggaaacctattggagacactgtaattgacgaaggaggtgcagttgctggaaaagaaggaacatcccacctaacaatccttccttctcacttcaccaatagatctgctacaaaggcatctagacacgcccatggggacgctacgccgccgtga

SEQ ID NO: 81379 - DNA, 207 bp, Glycine max
  Peptide Sequence Number=SeqID_198157
atggacaataagaatcccttgcatcaaaagtctatctggcgggtgagtccatgcatggaggtcaggaagcgtgtttcatggttgtggctcggtaaagagcgcaatggtgcaaggtgtgacggtgcaagactagcttgtggaagagaaacatacttgagggggagattgttggaatacaaatttgagatgaagttccacattgggtag

SEQ ID NO: 81380 - DNA, 531 bp, Glycine max
  Peptide Sequence Number=SeqID_198158
atggcacttatagcgacaggtggggatatacgcccacagatgaatttgcggcgcatggctcaggctatgctgcatggcgcggaaaaaattcggcagcggaaaatcgtcgatatcaccgggaaacacatggcagccaaaaggatcatgcaccacgtattccagcaaatcggcgttttcaggccggctaagcacctcgcatatggccgggcgaggatagtgacgatcgatatcctgcagggattgcagccaggcagcacgcatcagaacaccccgccgtttgcaaataataccagacaaagcgggcgaaatcattttccgttacctgagcaaagcaggccggcagcggcggtggctcgccaatctctgcgccgacggcacgacgcagcgcggcaaacagctcatggcggaattcaaaatagaggcgaaacgccggggttttgtagctgtgaatcggcaggaaatcggtcacgctcatctcctgcattatgctgtgaatgcgggcgaacaggcgttcagccacctctggcgtga

SEQ ID NO: 81381 - DNA, 1692 bp, Glycine max
  Peptide Sequence Number=SeqID_198159
atggacctctctcaccctcagtctaacttgtccctcggattttcttcctcccacgcttcgccgcctcctcgctccgacccgccggtgccgctgcagctcatggaaccgcagacggagaatggcaacttagatgttgaatcggacgacgatgaggacaaagaagtcgaggagtttcgcattctaggccactcaatgtgcctcaagaggcgaagagattgcgactcctcatcctcctcctccgccgccaagagggtttccgtcgagcccgatctcgacgcgcgtaaggcagcggtgcgcgcgtggggttgccaacccctctccatcgcggaccccgacgtccacgagataatggaaaaagagaagaaacgtcaatttcgcgggattgaactcatagcctccgagaatttcgtgtgcagagccgtgatggaagcgttgggaagccacttgacgaacaagtactctgagggaatgcccggtgcgcgctactacggcgggaaccagtacatcgacgaaatcgaaacgctctgttgcgaacgtgctttgaacgcgttcggtctcgaccccaagtgttggggagtgaacgtgcagccatattcgtgcacatctgctaattttgctgtttacacggggttgttgctgcccggtgatcgtatcatggggttggatactccttctggagggaacactagtcacggttactatactcccaatgggaagaaagtttctggggcttccattttctttgagagcttgccctacaaggtgaaccctcaaacgggttatattgattacgataagcttgaggaaagggcgcttgattttcgccccaagatacttatttgtggtgggagctcctaccctcgagagtgggattatgcgaggtttaggcacattgcggataagtgtggagctgtgttgttgtgtgacatggcacagattagtggcataattgcagccaaggagtgtgtgaatccttttgattattgtgacattgttacttcgacaactcacaagagtcttcgaggtccaaggggaggcataattttttatcgaaagggtacaaagccaaggaagagagggatacttctaagtcagggacatgaaagtgatcaatatgactttgaagaaaagataaattttgctgtttttccatcaatgcaaggggggccacacaataaccacattgctgcacttgctatagctttaaaacaagtcgctactcctgagtataaggcatacatgcagcaggtgaagaagaatgctcaagctttagcatgtgctttactgagaagaaaatgccgtctagtaactgggggtacagacaaccatctaatactttgggatttaaggcccctgggattgacaggtaaattttatgagaaggtctgtgaaacatgtcatattactttgaataaaattgctatttttggcgacaatggaactataattcctggaggtgtaagagtaggtacccctgccatgacgtcaagaggatgtctggaagctcattttgagacaatggctgaatttctcattagagctgcacaaattgcaagcatactgcagagggagcatgggaaattgcagaagacaacattgaagggacttgagagcaatagagacgtcgttgagctccgggcacgggttgaagcttttgcaactcagtttgccatgccgggttttgacatttga

SEQ ID NO: 81382 - DNA, 234 bp, Glycine max
  Peptide Sequence Number=SeqID_198160
atgtcaatgcaaagaagaatagagaagtttgattcagtcaagggcagtgctagcaatgaccaaggaccaccaaggaccggagacgattcacacttcacaatcacatgggctggggttcgcacttcacacacttcacaacagccttcgagaaccctagagcaaagtgttgctttaccttctttttcaaattgggtcaagtctcaaacctacgactttcatattatcagcacattg

SEQ ID NO: 81383 - DNA, 939 bp, Glycine max
  Peptide Sequence Number=SeqID_198161
atgggcactaacacttccgtgagtggcttctacaacttcctcacacaaggactcaatgaactccaccaatccttcctctcccactccttcatgtcattccaattcctttcacaggtcatctcctctctccagtccttccattcccaactcaccatcttggtccgcaagcttcgcttgcccgttggaggaaaatggttggatgaatacatggacgaaagctcgaggctttgggatgcttgccatgtactcaaatctgccatttctggaatggagaattattactcagctgcctctaacattgcttcttctttggatggttaccatcattttactccagaactttcacgtcaggttattcgagcaataaatgtttgtcaaagggatattctaggattggaagaggaaaacaagagcttaatggaaacaaggattgaaccgttgtcccaatgtttgattcagaacatctcaatggaatccaagttaaatggattcagtggattccgaggtgttctctatgcaatgaggagtgttagttcactacttctgatgattctgcttaacgggcttgcgtattgttggtcctcctgttgctttcaccaagggtacgatgggcacatggtttttggatctgacttcatggtttcaatggcaatattgcagcaaaaagtggcagaggagatagaccagattgaagggcagccagggattctgctgtttgagttccaacaagcaaagagtgccatggaggaactcaaagtggagttggagagaatagcaagtttaagttatgctgagatccaagaaaaagttgacaacgtcaagagttgctttgggttgttgagatgtggggtcgatactataacggggcaacttgatgatttctttgatgaaatagtagaaggaaggaagaagcttttggacatgtgcagtcataggtag

SEQ ID NO: 81384 - DNA, 171 bp, Glycine max
  Peptide Sequence Number=SeqID_198162
atgccaccatactttcatgttccaaactggatctcttccccgcataattttctagctacttcgaaatgcaccaacagacaatgcacaagatctaaaggctttattcaagataactttgcacaaccattagaatacaaaattgtgataagagtgaacaagagaatagaatag

SEQ ID NO: 81385 - DNA, 270 bp, Glycine max
  Peptide Sequence Number=SeqID_198163
atgtgtgtccaatttgattcatctaggaacttaagagggagtgagtggtgtcgcaacctacccttcggcgggtgcacgaaaaggccatatcatgggccaaagcgtttgtctccaagggagaaaatgagcggagttgccaccaacgtttattcgaagaaaacgttagaaaaaccaaaaaaagacgaaggtttgcatattttgaaaatgagggttcaggagtcatttatgcacgggaaaggattgattttaaccgaacaaaagtcgttttaa

SEQ ID NO: 81386 - DNA, 315 bp, Glycine max
  Peptide Sequence Number=SeqID_198164
atgaacaagcaagaagaaggtaaaaaagggatgacacagaaaggtgaaaagggaaggttggcaggcaacacaatcctcttttctatgttaaaatcattgatcatttccactttcttattttcccatgtggaaccacttttgactttagcagaggaagaggaagatctgctgttgttgctgattcgtagattggcggtgacaacaactgtggcatccaagagacgctggatttacgctgtcgtcgtcgaaaatctccattgtagcttccaggagaagctctaccacctggaagaagccgtctccgtcaaagattga

SEQ ID NO: 81387 - DNA, 285 bp, Glycine max
  Peptide Sequence Number=SeqID_198165
atggcgatctcttcctccttgaaggcctcatgcaagaagaagaaaatgaaggctaaagttttggttttcggagaggaaatgggtgtcataatgaaaaacctcgtcgagcgcctaggagtacatggcaggacatgcctcacaatgggtgggatcggcacaggcttacaggagcactcaaaccggatgacccctaagacctacactccgaagagtccgtcagggcctctccctcctgattcagtggatcccatcacaactcatcgcgcattaactcgtcacccttaa

SEQ ID NO: 81388 - DNA, 540 bp, Glycine max
  Peptide Sequence Number=SeqID_198166
atggagtgtgaaaattttgctaggtttctaaggagaattcgaagaaggaagatgatctacttagaagcacaagaaaatttaaaaggaaagtcgatgaagaggagattacacaagaactctccttacaaagaaaagttgcttttaagtgaagggacaattctgttttctacctttgatggtagatattatggtagcctagacaaggagattccacaaccatctatatcttttcttcctttgatgctagatattatggtatcccagacaaggagattccacgaccatcaatatcgaaggaggataaggagagatatcagaaggttcctatctctgactaggaatttactgattagtcgttgtaaaaacatttatgttcctttttctctgactctcaagaacactaacagagcaaccagagggggagctctagagagcaccataaatgtcaccattactaatagagaatgcttgagcgactaccttgaggtaaggggttactcatgcttggggattagaatgaacatgtgtaaggtttcctag

SEQ ID NO: 81389 - DNA, 381 bp, Glycine max
  Peptide Sequence Number=SeqID_198167
atgcgtcgtgccctcactgagatcgtgcccttcattaatcgttggtcgtcgaatgtctctcccgtgttgccccgctgtcgtgtacctttgtcgtcatcgaagtttgcactacatattttcatattaaaattagacattgatgcaagctccattggagcttgtaggcctaggatcttcttcatcaatggattcctttgcttcttggaagatgaatggcagcggaatggagaaagggagagagagaggagacgccacttcaaggggaagatgagtctagaagaagctcaccaccataggaggccatggataagagcttggaggaagaatgagatgaatgaagggagagggagagaagagcacgaaattttgtgctctaaatga

SEQ ID NO: 81390 - DNA, 702 bp, Glycine max
  Peptide Sequence Number=SeqID_198168
atgttgtctcaaactccaaaagttgaaaatagcctggacatgctcaagcctgaaccatcaaggcaatacccttatgaggctctggaatcagtatctttggttgaaaatgagtttgtgttccttgacaaagacttaatgcaaacctttgaagctttctatgacacaaaagcttcagatgatctagtaacatatgggtggatgtttaagaaagagtttaacttcaagagttttgatgaattgattgtcagtaatgagatagctctaacagatgacatattcaaatcattgcatgtgcttgttttctctgatcacataaagatgataactctacatgacatcattgtaaaacaattttccagcttgaagaccttacccctctctgcctctgatggaatttacttaaactgggatctactcgaagaagataagtgcaattgtaaaatctctaactggtatcataacatattggccaagatagatctaaacaaccaagattttggaggaacatcttttgatgatggaaaattggtatttgatctagttttttgtgatgataccataaatgaatgtgacattaaacaaaatgaaaagttgaagaaattgctttctaattgcatgcctctacttgataatcatcctgtaaaagttgcttcaggaaaaaatttagaacatgtatcttctaaacaaggaagtcaagaataa

SEQ ID NO: 81391 - DNA, 595 bp, Glycine max
  Peptide Sequence Number=SeqID_198169
atgaaggtattgaaaggttatacgaagaaccaataccgaccaaaagcaagcattgttgaaaggtacgttgttgaagaagctattgagttttgtttggagtacatacaaacagctacacctgtggggcttcctaaaagtcgccatggttgcataaggggagaaacaattttggctaatgatagttcttccaaaacattaagattgttagatgttggtccaaatctcaatgtccccacttggaagggatatgacatcaacaagtattccctctacactgagtcacaggatgataaaaatagcgtgcagaatagtaaggtgaacgttgatgttgattctgatcatttttgcggtgcattatataacaacccatgggtaaatggaaatatcggggtgtgtcaagacaaaatgggatttactttattagaccttcaaaagttggcttacaaggacgagcctttcatcatggcaaaacaagtgagacaggtgttttacatcgaagatccgtgtaactcaagaagatcagttgttctacttggaagaccaactgaacatgaggaggaggatgttcatgcaaatcgtaatgatcatgatgaag

SEQ ID NO: 81392 - DNA, 348 bp, Glycine max
  Peptide Sequence Number=SeqID_198170
atggcgcatgtagtgaaaatgcaaccacaaacaacaaccatccagcaaaggtgtgctgtgggtccaacacaaccaggaaatgatattgatgtgtatctgattccgttgattaaagacttgagaaaaatgtggtacagggggttgatgtgtatgatgggaatgtttagtagacctcagaaagcatttaatggaagccaacagattcaaagtgcaccgacatcgttagctgtacaagaagtatttgatcgagtcaaggacatcataaatatctttgggaagactcaaaagaaagatgcatctaagaagaacatttggaagaaaaggagaattataagcaattgggcttag

SEQ ID NO: 81393 - DNA, 1236 bp, Glycine max
  Peptide Sequence Number=SeqID_198171
atggatcttcgttatcaggaacgaaatgataaaatgcttcacatgaagactttgatggatcagattcagttgatgatgaataaattgttgaaaattgtttctcaacctcatggaagttctgcgaacaatgacactcatgttgtgacgctgattagtgtagcattaccgacaaaggagatctctcttggatttttgcattttgatgggactaccctgaagctatctatggtgtctacttgtccggaattgactcgtgctttggagtcacaatttggtccttctccattcaattttcctatggctaagttgtttaagttgcatggtttaaatcgtgatttacatagagatgttgctgctatgactcctcctactttacttcgcgcagtagccttagctaagcttttagaagaaaaatacaacccaatccctaaatacactcgtagctcttatatacaaaaatactctcagatatccactactcttgtttctattagttcccaaccaaaaattcaaaataaaaatagtttacccgaacttttacctacccctcaggggcctcctttgaaatcctctaatgttaagaagactagtcccatggaaatgcagttgagaaggaagaaaggcctttgttatttctgtgatgagaagttttctttcagtaataaatgtcctaataggcaatttctgtttctacagttggaagaagaggatgttgaggattcttctagagttggtactatcagattcatggcctatattgataaacttcctatgactgtgctaattgatggaggaagttcagacaatttcttacagcctagagtggctaagtttctaaaattaccagtcgaaccagctactcaatttagagtaatggttggtaatggatcaggcatagctatggatgcaaacaaattagaggcaattcagaattggccagagcctatgaatctaaagaaattaaggggcttcctaggacttacaggttattatagaagatttgttaagacctatgctaccattgcaacacctctgactgttctattgaagaaggactctttcaaatggggtcaagctactgcccaggctttccaaaaacttaagatagccatgacttctgcacctgtcttggctattcctaatttcaataaactttttgtattagaaactgatgcttcagggaggggagttggtgttgtgttaagccaaaacaagcatcctattgcttatttctaa

SEQ ID NO: 81394 - DNA, 201 bp, Glycine max
  Peptide Sequence Number=SeqID_198172
atgggtcaaggaatcacaacgacaagtctacctaggagcttacttgaattaagtcatgttcaaaccggaggctatgagtgtggctattatgtcatgcattggatgtggaacataatcagcggcggtttgaaaaatgaatggaccaagtggtctggtgatggaacaccgttagacattgatgctataacaacaattcgctag

SEQ ID NO: 81395 - DNA, 299 bp, Glycine max
  Peptide Sequence Number=SeqID_198173
cattttccgctatggtcgaagaatttgtgaaagactctgttcatcaagacagcgtcgctgtcataaccctcgatcaccccaaaggaataaggacaatcgaccgtgctgcgaagacttggcaaactgcattacgtgctcctgatgatggtatcatgacagctgaacttcttgaaagggctgcgttaggtgctcttgaggatggtatcatgacaactgaatttcttgaaaggttgtatttggagataaggaataaggacaccggcagtgcgactcatatgaagtcaccgagagtgctatga

SEQ ID NO: 81396 - DNA, 795 bp, Glycine max
  Peptide Sequence Number=SeqID_198174
atggggaagaagcagaacgagatccaaaaaacggggctaggtcgagccctgctgtctcgcttctacaggaagaagttccttgaatccttcaccgaagtctccgacatcgacgccgtcgtcgagcaatccctagaacccctccccaaactcgccgctgccgcttcaaccactcttatcagcctggaacttattgagaggatcatcgtgttcgggttttattatagggagatggagcggttttcaggaaagtgcagggatttaagttggataaggtctgcaaatgcgaaccctttggagaaaaaggagaagggaagtgtttatcgtagggcacttgccaatggcattgttgaaatactctcagtttataggtctgcggttctgcatattgagcagaagttgttgtctgaaaacatgcctatcttggccacagttactcagggccttaacaagtttctttgccttttgcctcctctgtatgagctcatcctagagattgagcgtgatgatattcgtggaggtcagcttcttaatcttctacataagagatgccactgtggagtgcctgaattacagacttgcatgcaaaggtatgcagttcttttcacgtgtagtattcttggtaatgttaagatgcaggagaagcaagttgatcttctttcgaagttgaaaaagaatgtaagcactccagagggggttccacgcctttttgatttagtgaaagttcaagatgaaagaatgaagcttgctttctttgcggcacttagaaacactgtggttgctaaagatcttgaccag

SEQ ID NO: 81397 - DNA, 270 bp, Glycine max
  Peptide Sequence Number=SeqID_198175
atggatgaacaatactcacaactacaaaaagcatattctacatcggtcaaactaagctatctacgtcgggcctcccaccgtctttgttacagatgtcgttgtaagtcgacaacaacgacatcggtcagcccaaccaccgtctttgtaatgtcagaagacaacagcaccgtcgttgttcggatcgatttcaacgtcgggtgtgaatggggcccgtcgttgtttcagaaatctataaagacgggtggaggttgcacccgttgttgcttttaa

SEQ ID NO: 81398 - DNA, 582 bp, Glycine max
  Peptide Sequence Number=SeqID_198176
atgaggcaattgcaagcaagcttaggagctgatgaagagggtaggaggagcgctgttgatccagcatttcgcaaggcatggttggatcaatcattgaagacaatgatggagatttatgtgagtttgcatctcaactacaacatgcatggagagggcattctcaaagtagtgaagggtcaccaagctcagaatctcgagggctacccttccattagtgtcaaaccacaaaagaggtttagggctgaccttcaaggtaaggtactcctagaagacaatatgaaggaagggagtgaaattgtggctgaaggtccacggtgtagtcttcgtagtagaaagtgccctgtctgtgactatttaaagatgttcttgctgaatgtcccagagactgtggttgcactaggattgttcttcttccttgatgatgtgactggatttgagatctcatatctgataaagtatcagacagacaatagtttcattcttacatttccctctaatgtccctttcccctcttcatatatcagtatatcttctagtcagaaaaaagaacctctagagtgcaaagttcactttagagtttag

SEQ ID NO: 81399 - DNA, 4209 bp, Glycine max
  Peptide Sequence Number=SeqID_198177
atggcagagcatggaacccgccgcaccaccacggactgcctcgaggaggccatagccgccctcaccgagaaacactccgatttggctaataagtttgaggccatgtgtgagcgtctctctcacatgtcttcttctgctccgccacgtccccaagttccgcgaccaccagtcaagctagacgtcccgcgatttgacggccacgatccgcttggatggatcttcaaaatctcacagtttttcgactaccagggaactccagaagaggatcgtatcatggtagcttccttttacttggacggccccatactcagttggttccaatggatgttcataaacgggttcatcacctcgtggtcggcccttctccaagcaattgaatcccgttttgctccttcaatttacgatgacccccgcgaagctttattcaagctaactcaacgaggcacagtcacaaagtacttaacggaatttgagaagctcgcaaattgcatcaccggcctgtccccatcggttcttctcagttgcttcatctccggcctaagcccggagatacgccgtgaggtacaagctttccaacccctctctctacctaaagttatagctcttgctcatcttcaggaagataaaatcaatgatcgtcggaaacacgcccgcactccatgtaaccacccatcaccaaacactacctcctctaactctcattcaacgcagacacctcgaccaaagcccccattcgtccagagaactcaagaagacatggcgtatagacgcgaaaaggggctgtattataattgtgatgaaaaatggagctcctcccaccgttgtaaagggcgatttctcttcttcattgcgaactccgatgagtcatcaccatcagaattgagtctcacggaacccttgtctccttttggaagtgaacctgacccatcagtggacgaacctacccagcccttcgacccagcctcattgcaaccacatataagcctccatgccatggctggcatgccagccacggatactttcagattatacggccttatcaacaacatttgtgtcaccatcttagtagatagcggcagtactcataacttcgttcaacctcgtgttgcgaagttcctcaacttacccatgcaagatacgatacctctcagagtgatggtgggaaatggttctgtgttggattgccagctaatgatccctgagaccaagatactcattcaggatcacagcttcgtggtcacgctgcgtgttttgccattaagtggagccgacgtcattttaggagttgagtggttaagaacattgggcccggttgttacttactacaccacttttactatgaagttcaccctttttggaaagcccattcatcttcgcgcagatgttcaggtagacaccaacttggtttcggcccatcaggtaaagcgcctcatatccactaactctacttcgggcctattccacttatctctacaacccattccttcacctgaattactaaacaccgcactccaccccgtccccgccattgatgagcttctactcaaatacgagtccctgtacccgtacttccaaaagactgaaatcgaaaaacaagtgacggcgctccttgacttcggtctgatccaacccagccgtagccccttctcttctccggtactactagtgaagaagaaatacggcacttggcgtatgtgtgtggattacagggcattaaacttcatcacggttcgtgatcgctttccattaccaaccatcgaagaacttttagacgaattgggccatgctttgtggttttcaaagttagatttaagacagggcttccatcaaattttaatggtgaaaagagatatcccgaaaacagctttttggacccatcaggggcattatgaatatagagtcatgcccttcagtttgtgcaatgcgccatcaacatttcaggcagcaatgaatgccttgctcattccattcttgaggaaattcacggcggtgttcttcgacgatatactcgtctacagtgcaaccctgcaagaccacttacaccacttggaatgcgtcttcaactccctgtctcaagctcagtattttctcaagcgttccaaatgcttgtttggacagcgtcagcttgattatctagggcatgtcgtcttcggcgaaggtgtacaaccaaatccttccaaggtacaagccattctcgactggcccaaacccagttccccgagggaccttcgtgctttcctcagtctcactggattctatcgaaactttgcagcctttgataatctgaagaaggccgtgatagctgcaccggtgctggcccttcctgattttaccctaccttttgcactagaaacgaatgcgtcaaactatgctatggtccgcgagctacacaccatcgttgccgccgttcgcaaatggaggcagtatctactgggtcacaggttcaccatttttacgaaccatcgtagcctccgtgagctcgtatctcagaccatccagaccccggagcagcagttctacttagccaagctgctcgggttcgactacgatatccagtacaaggcaggtacctcaaatgtggttgttgactccctctcacatgtgagtgattcaactcaaggacagtgcctcgtcctctcagtccctcaccatgagttcatgcttcagctgaagcaatccttatcaagcagcccagagttccaaaagcaacgtgaagcgatccaagttgcccctgcagatcaccctgacttctccatcttaggtgatttcgttctattcaaaggtgcaatttggattgatgcacagaacccattcattccggcattattgcatgagtatcatgctgctccactcgcaggccacttcggcgtaaagaagacgttccaccaccttcgttccaactttcagtggaccaacatgctcagagacgttaagactttcgtccgcaactacaacacctgtcagcaagtgaaacccatcatgcgcaaaagtgctggcctcttacaacccattttgataccttcgggtatctgggaagacctctccatggatttcgtaactcatctcccaagctctcagagattcacagctatcctcgtcgttgtcgacaagttctccaagggagtccaccttggagctctaccttcccactatacagcattcaaggtggccaatctcttcctcaatatcgtatgcaagctacacgggttccctcgtagcatcatctccgacagagaccccattttggtcagctccttctggcgggagcttttccggttaagtggcacaactttacgcatgagcacgacttaccatccacaaacggatggccaaaccgaagtgatgaaccgcatgattgaacaatatcttcattctttcgttcatcgaaacccagctgagtggtacaagtttctggccttagttgaatggtcatacaacacatcgcagcattccggcacggggttcaccccctacgaggtcgtctacggcaagcctcctccttcggtcttagactacctcaagggctcttcccgcaacgatgcagttgatacaatgttagtcacacggggagtcgttcacgctgcactcagaaggaaacttctaaaggctcaagaagatatgaaacttctcgcggacaagagacgtcgagatgttcagtacgaagaagggcagatggtttacgtccgccttcgtcctcatcgccagctttccctgcaggaccagtcacctaacaagcttgccaaacgttacttaggaccattccccatcatcgaacgcattggtaaggtagcatatcgattacaacttccaaaagcgtctaagatccattcggttttccattgtttcatgttacgaccccaccatggccccttggaactaccagtctccgcccttccaccagacacaattcaaaaccagcccatattgaagcccttgaccatccttaattcacgtatggatccttctactgacccctcaactcagttagttttagtacaatggattggcttagcacctgaggaatctacctgggaaaagtgggatgacatttgcagatcccaccaccttgaggacaaggtgatttttccaaggggggggggggatgatgatagagccactagtgcagcaaacaccgtgaatgaaggagcacgtgcagaaaggccaaagaggaacgtctcgagacccaaacatttagatgactacgtgtga

SEQ ID NO: 81400 - DNA, 1848 bp, Glycine max
  Peptide Sequence Number=SeqID_198178
atggaggggatgaacttcagttctttatacaatcctcaacttgcctctagctctaagaaaagttacagtaagcaagagtataatcattcaggggagcatcatcatctcaatgaagaaggttatatgtctccctctttcaatctgcggaatatttcaaagctcattcttcccccactgggtgtttcaagccagaatccagttaactcaaaaggatggatcatatcaccaatggattccagatacaggtgttgggagagttttatggttcttctggtagcttattctgcatgggtgtatccctttgaagttgctttcatgcacaagtcttctaatatgaaaatctacattgcggacagtgttgttgatcttttcttcggtattgatattgttttgacattcttcgtggcttacattgatcgaaccactcatctactagttcgagacaagaagaagattgtagtgagatacttgtctacatggttcgtgatggatttggcatcaactataccatacgaggcaattggatatttgttcactggcaaacggaaattgggtctcccatacttcctcttgggtctgtttagattttggagaatcagacgggtcaagcaatacttcacaaggcttgagaaagacatcaggttcagctatttctgggtccgatgtgctaggcttctttctgtaacacttttttcaattcattgtgctggttgtctctattacatgctagctgatcgttacccccaccaaggaaagacatggattggagctgtgaacccaaacttccgagagacaagccttcggatcagatacatttcggccatgtactggtccatcactaccatgaccactgtaggttatggtgacctccacgccgtcaacaccctagaaatgatcttcattattttctacatgctctttaaccttggcctaacagcttacttgattggtaacatgacaaatcttgttgttgaaggaactcgccgtaccatggagtttttcagattcttgacaacttggaatccatctaggtttcttggaatgctgccagagttatatgttattgtgactaatgtcccatgtaacttcatgtcattatctgtgcagagaaatagcattgaagcagcatcaaatttcgtgagccgaaatcggttgcctccaaggttaaaagagcagatcttggcttatatgtgcttaagatttaaggcagagaacttgaatcagcatcagcttattgaacagcttccgaaatcgatttgcaaaagcatctgccagcatttgttttttgcaactgtagagaaagtctatcttttcaaagacgtctcaaaagaaattcttttgtccctggttgcaaaaatgaaggcagaatacataccaccaagagaggatgttatcatgcaaaatgaagcaccagatgatatttacattatagtctctggcgaagtggagatcatccatactgaaatggagagagaaagaattttggggactctacatactggggacatgtttggagaggttggtgcacttattagtagacctcagagctttacctacagaaccaagactctaacacagctcctgagactcaaaaccaatactcttatggaagcaatgcagattaaaagagaagacagacaaatactcaaaaattttcttcagcatatcaagcagcttaaggatctgagtatcaaagatttgatggtggagaatgtggaagaagaggaccctaacatggctgtgaacttgttaactgtggctagcactggcaatgctgcttttcttgaggagcttctaagagcaggtttggatcctgacattggagactccaaagggaaaactccattg

SEQ ID NO: 81401 - DNA, 186 bp, Glycine max
  Peptide Sequence Number=SeqID_198179
atgggaaactgtttccattcaggtacagaactgttgcaacaagctagagatagaatgcaaacttataattccaagaagatatctgagaattttctgaatgttctgcatgttgtggatgaagaaatgtataaaattggacaagatgtgaaaaagggaggtataacaagcaaaaaggagcagaaataa

SEQ ID NO: 81402 - DNA, 210 bp, Glycine max
  Peptide Sequence Number=SeqID_198180
atggaagtgttctacatcggttgtgaagggagaaccaatgtacaatggggagagttctacatcggttatgagggtgaaaccggtgtagaattgggaaaattctatactaaggttgcttacttcttttggatttacaacctagctagcctcaaggttcttaaagaagaggaatatggtcaattggtcatcatgtactacaacaacatctag

SEQ ID NO: 81403 - DNA, 576 bp, Glycine max
  Peptide Sequence Number=SeqID_198181
atggatcgttcaaaagatttagcatcagaagtggaattcaatggcactgagtctggatggaccacttatattggatctcctacctacaatgaagtctccaatggtgacgatgagcacagtgtatattttgaagactatggcaacaattacaagaatgctcatagaaacatttatgatgatgacaacaaaagagagaacaatgatgacttcaaaagagatacagatgaagagagtgatgattccatggcttctgatgctgcttctggtccaagtcaccttcaccttgtatgcataaacagtgagggaagtcatggcttggatttcactgagcataccgaaaatgataatgagaagattccattgaccaagagagccagcaaacagatagtgctgctagtcatgtttaaggaggagtcagctgaatttttccacttggaaatatggagaaggggagtgtactcaaaccaaagttttcttctaacatcaaaggagactcaccgaccaatcatggagtgtgaactagtgtacaagctagttaaggttggaggaaaaatttgtaaggtttatgtgaaataa

SEQ ID NO: 81404 - DNA, 249 bp, Glycine max
  Peptide Sequence Number=SeqID_198182
atggagcaggctgtcaagacagcaggaatgaagataaaatctttcaaggatgaggatacaaggatttcaatatggaacattgctgggcatggaagtgcctcatttttcatcatcatatcaagcttattcagaaaaccatgcaacaaagaacaaaaaagttcaattgaaattgaagaagacctgcaatattggctcaggttcattgtttccaactttaaaagggcaatacaacagattaagttccaataa

SEQ ID NO: 81405 - DNA, 915 bp, Glycine max
  Peptide Sequence Number=SeqID_198183
atgcctacaacatccacacataggcaacaggaagttgcccctgttgctgaggatgatcttgtgcttactaaagatgtacatgcacatgctgaagaagctattgatgatgctgagggatttccaggtgggccgcgtgacctatcagtgttgactgactatggtgaccatgttgcagtcatcgtatggaatgatgaggaacgtcctgaattgaagttatcctcccatggaaggaaggttctgaaatttgggaggcctgctccagaaattgaagggctagtcgctatcacaggattaagtcctttgatcgcatgttcagtagacactggcgatcgaggacttatatccacttttgtcgagaggtggcataaggaaactagcagttttcatcttcctgttggagagctgaccatcaccctagatgatgtgtctctagagaggaagctagagctgagacaacataatgtcatggggcatacgtatgcctatcgtggctatgagatatttatcagagtagatgtcatctacgatggggtcccattgtcgtcagacaccgaccagagagggtggtgcggcaatttggatatgttcagaccttcctccattaactacgggacagtgtgcatcagattacatacagtggatgacacatatgtggagccacatatccctgaggtcctagtggcaccagcagcagcaccggcatatgccccttctgatgtggagcagcccagacatgtagtggcttgccaaacaattgcagaaaggttggaacgtttggttaacctaaggatagtcactgcaggcacaaaaatacacgaggtcatggaagacaacataaggatcgctaggggtgtcacaccagatggcaatgtttatgtcaggtcgcgacaaaggcgacgcacggatcagccatag

SEQ ID NO: 81406 - DNA, 789 bp, Glycine max
  Peptide Sequence Number=SeqID_198184
atgcagccattaacggagatgagaagcttacctcgacggtggaagagcaaaacagagctgcaggtccttaatgccgacaacaaaccacctaatgtgtggcaaacgaacctccaacgaaagcaaacaacgtcgggaggagaagaagctcgaacgtcaccgcgaaaacaagcaaacggcgcagcaaagaagaacggcatttttgcccattcacttaaaattctgggtgctccagcaataatgctaggtgcaactagcaacacccatgatataatatttcattggcttggcttcaaagcgaaagtaactacgtcgatcgtggacacccgtctttgtagttacggcgcgatgggtgttttcataatttacacccttccttctactacagtgtcattagtaaaccgcctttgtatgttatcgataaacatacaaaggtggtcttgtcccaataattgtcgttgtacaacaagagtgcctgcacgagccacacacgctgattcgatcatcacttcgaaatctcccattgacacagtgctagcgcttgccctagcagtagcttctctcctgtgtcacaccttcttccctttgtcgtgcttcgcgctcctcatcccgagagagttcgtaaaccttcacctcacactcaacaatctgactccacttcaggggttaagagcatttgttaaccgcaactgggtatccatagtagaaaacaagttagaaagcttggaaggatttgaaggactgagtaagctcactattttagcttctttggtgctcttactggcgtgttag

SEQ ID NO: 81407 - DNA, 252 bp, Glycine max
  Peptide Sequence Number=SeqID_198185
atggacgaaggtggcagcaagcaactggagaacgcaggggagaagtgggagagcgagagcggaagaaggagagacaaacggaagaagctaggagtgactgttcactccgcgttttgctttttaaaatttttaataacaagggcaaaatgggaagtttctaatattgctggtcttttatcggactggtggtgggtatatcaaccaagctacaaagcctgtattttagaaccaattgttgttcctaacaagtaa

SEQ ID NO: 81408 - DNA, 372 bp, Glycine max
  Peptide Sequence Number=SeqID_198186
atggttgacacaagtgaagcaagggaatgggaattggaggaccagaggaggaagcaagggagtatcaatttgttggagacaaatgtgagtttgaaggagtctgatgcctggcctgctgagccacaagatgcatatgggctggagaagcttgcaacagaagagttatgcaagcattataacaaggattttggaattgagtgccgcattgggagattccataacatatatggtccttatgggacatggaagggtgggagggagaaggctcctgctgctttttgtcgcaagtcacttacttccaaagaccgatttgagatgtggggagatggattgcaaacaagatccttcaccttcattgatgagtgtgtctga

SEQ ID NO: 81409 - DNA, 327 bp, Glycine max
  Peptide Sequence Number=SeqID_198187
atgtcacatcctatcagagcattgtgtcctgacgtccttcaacacaagggtcaaaacacaatatcaccaagtcaatcaacatcgatcaatacacaagcgttatgcaacatctacactaagactcaatcttatatgcaatgtggtaccatatcagtgaaaaacctcgtcgagcgcctaggagtacatgacaagacaaaacatacactagcaagtcagatcactctcactaggcttaaaggagcactcaaatcgggtgtatttacccccaaggcctatactccgaagagtcagttagggtctctccctcctgattcaggtccaacctaa

SEQ ID NO: 81410 - DNA, 1461 bp, Glycine max
  Peptide Sequence Number=SeqID_198188
atggtggctgagctgcttggtgtgacattgggtccaaaggggagaaatgttgtgctgccaaataagtatggaccacccaagattgtaaatgatggagaaactgttctcaaagagattgaattggaagatccgttggaaaatgttggagttaaattggtgagacaagctggtgctaaaaccaacgaccaagctggtgatggctcaactacatctgttgttcttgctcatggcttaatcagagagggggcaaaggttattgcagctggaatgaatcctgttcaaattgctcgtggcattgagaagacagcaacagcgcttgtttctgaactcagattgatgtcaagagaagttgaggatcatgagcttgcagatgttgctgcagtcagtgctgggaatgattattcagttggaaacatgatttccgaggctctgcaccaagtaggcagaagcggagtagtgacaattgaaaccggaaggagtaccgagaatagtcttgagattgtggaaggaatgcaatttgatcgcggatatctgtccccatactttgtcaacaatagaagaaagatgacagttgaactccacaactgcaagttgcttttggtcgacaagaaaatcacaaaaacaaaggagttgatcaacatattgaacaattctgcgaaagaaaaatatccagttttgatagttgcagagggcattgagcaagaagctctagctccagtcattaaaaataaacttcggggtgctcttaaggtagctgccattaaggctcctgccttcggtgaacgcaagacccattacttggaagatattgccatcttgactggaggtactgtaatcagagaagatatgggtttcaacctagaaaaggctcacaagaatgatctgggttctgctactaaggttgtcataacaaagaattctaccttaatagttactgatgggagtactcgagaagctgttgagaagagggtttgccaacttaggaggcttgttgagaatacagtggaaaatttccaaaaaaagatattgaatgaaaggatagcaagattatctgggggcattgccattcttcaggtaggagcacaaacacaggtagaactgaaggataaacagttaagaatagaagatgctctaaatgcaacaaagattcttagaacaaggcaggccgcaatcgaggaaggtgtagtagttggtggtggctgttgccttttaagactatcccaaaaggtggatggcataaaaaaactcctggaaaatgaagaacaacagattggagctgaaatcttcaggagagcattgagctatcctacaagaatgatagcaaagaatgctggtgtaaatggcaatgtcatcatagataaggttttatcagacgataacctgaattttggttacaatgctgctagagactgttatgaggatctcatgaaggctgggatcatggatccaactaaggtatga

SEQ ID NO: 81411 - DNA, 2772 bp, Glycine max
  Peptide Sequence Number=SeqID_198189
atgccatttaggtctgttttagggggatggacacagtcagcaagaggattcacgaagaaagatgggttgttgtcaagctcaattcagaagctgatcctccactatctcaaccagcaatgcaacaagctagccactggcaagggttgggtgatggctcacccccttactgagttttccaaattgtggaccaagaagaatgctgttggaaaacaacaagtggccaaattagtggatgagacgtatagaaagttgcaggtatctggggccattgatctatcatcaaagggacagggtgcctcagatagcagtaatgggaaaattaaaggtgaaattgacaattcctttcaatcagatacgaagattcgctgtctctgtggaaatgtattagatacagagccattggtcaagtgtgaagatacaaaatgccatgtgtcgcagcacatcaactgtgttattattccagagaaacctatggatggaatcccacccgttcctgataaattctactgtgaaatatgtcgactcgatcgggcagacccaaccaatccggtacagagtgtggaaagaacgtttcaactcacaagagcaaacaaggagctggtatcaaaatcagaatatgatgttcaggtttggtgtatgcttttgaatgacaaggtttcattcaggatgcaatggccacaatttgcagatctaaaggtcaatggtcttcctgttcgtgcaattaacagacctggttcacagttgcttggggctaatggtcgtgatactggtccagttatcacgccatatacaaaggacggaattaacaagatttccttaacagggtgtgatgctcgcatattctgtttaggggtccgtattgttaaaagactcagcatgccagaggtcctaagcatgattccagaggagtctgatggtgagcgttttgaagatgctcttgcacgtgtctgttgttgtgttgggggtggaaatgcaaatgataatgctgatagtgatagtgatttggaagttgtttcagatacttttagcatcaatctccgttgcccaatgagtggttcaagaatgaagattgcaggaagattcaaaccttgtgttcacattggttgttttgatcttgaagtttttgtggaaatgaatgaacggtcaaggaagtggcagtgccccatatgcgttaaaaattatgctttggagaatatgattattgacccttacttcaatcgcatcactactctgatgaaaaattgtggtgaagagattgcagaggttgaggtgaagcctgatggttgttggcgtgtcaaggctaagaatgaaagtgaacgccaggagttggggactcttgctcaatggcaccatcctgatggatccctcattgtttcgactgatgaagtcaagagcatggaaaatttaaagctcaaacaggaaggtctttcagatagtcctattgctggcttaaaacttggcatcaggaagaatagtaatggtgtttgggaagtcagcaaacctgagaacacaaacacctcttctggtaataatagattgaatgaggattttgaaaatcatgaacatgttattattccaatgagcagcagtgacactggaagtggccgggatgaagatgatcctagcataaatcagggtggtggtgagcatattggttattctactaccaatgggattgaaatgaattctgtgtttaacaataatatagattcagcttatggatatactgttaataacgcatctgctacgatgggtgatgcaaaaattattattcttagtgattcagaagaagacagtgatgtattgatttctcatactcctatatctgggtacagaaataatcaaactagtgatgcagttgatgtttactccgtgctacagcctggaattattgatccatatacagaagatcacaatcctggtggaaatccgaccttgggagtttttaataatcccagtgaagatgattttgggatgccccccctctggccattgcaatctggaactccggcagtctcaggattccaattattcagttctgaagtggaggatgtttcagatgcattgattgatttgcatcatggcaatattaattgttcctcatcattgaatggttatatgttggctcctgatactgctttgggatctagcactctggtaccagattcctcagcaggtcgacctgatgatgatttaaatggtggcttggttgacaatccactggcatttccaagagaagatccatcccttcagatttttctccctccaaaaccagcagaatcatctatgcagcatgaactgagagatcatgcagacatgtcaaaaggtgtcttcattgaggattggatctctcttcgtcttggaggcagtaccagtggcagtaatggtgacatttccactgcaaatggattgaattccagacagcaaattacacccagagaaaatgctggagattctttgacagatgccgctcctttgcttcctggtatgaatgatgttagatctgaaaaggcaagtaggcaaagatcagatatccctttctcatttccccgccaaaaacgttcagtaaggccccgcccaaatcttccttcagattccgagaaatggaagatgatgtggtctgaggcacctcttggtattgtttccccattgatggtgagggtgttggcagcaaagattcccaattctttatgcttgatattcaagtcatatgacatactgaaaggtcaggtcaggggcatgctattattcccattttcagcgaggaactga

SEQ ID NO: 81412 - DNA, 285 bp, Glycine max
  Peptide Sequence Number=SeqID_198190
atgattgatcgctgctggaggtggcatgcgctagcttccggggccttgcttgcggatttctcttcgtttttgctgaagattctgtgcaaaatggattgggtagccagttgcaaggaaaaattgcaatatttccgtttaaaagagctcaaagatgtgctcactcatttgggactttcaaaacagggaaagaagcaggatcttgttgataggattttagctattctctcagaggaccaaggtaagattgtactttctttctccatgacatacacacaaggtggttga

SEQ ID NO: 81413 - DNA, 975 bp, Glycine max
  Peptide Sequence Number=SeqID_198191
atgcagtgcaggccacagctgaatgggatatccttcagtaacattggccagcagcaaaatcagatgttggtgtgtaatttttatgagcaggaaataagggctttcaacaaggcactacttggaaaatggaggtgggatatgcttcagcaaagtaacaagttatggtccaagataatgcattccaagtatggtggatggagatcattggtggaaggcagtagaaggaataatgagtcaggttggtggaaagacttaatggaggttacacattaccaacagatgaattctatcctccaagatggcactacttggagggtgggatgcggggataaaataaaattctgggaggactcatgggctggacacggaaaggctcaaaagatgaaatacccaaggttgtataggatatcacttcagcagcataaactcattcagcaggtgggaagtttcaatgactcctcatgggaatggaacctctcatggagaaggtctttgttcgataatgaaatcgcatctgctgcaggttttttggaacaaatttgtcagattacaatccagccacatatagcagattgttgcaagtgggaagcagagcctaatggttgctactctacaaggagtgcatataacataattcagcaggaggatgcagcccatctctttttcaattgtaccaaatctctagccttatggtgggaatccttagcgtggactggaatagttggggcattccccataatccctaggtaccattttctgcagcaccaaaatgggatgaatggagggaaaagaaacaataggtggaaggatgttgacgaagagaaggacaaggaagaacaaaataaaaagaagattaaggaagtgtcacatgaatgctccttggtgaacaagcacaaggccatttggatgacaaagcctgaggagatcacaaaggaggagtattctgctttctacaagagtctcaccaatgactag

SEQ ID NO: 81414 - DNA, 936 bp, Glycine max
  Peptide Sequence Number=SeqID_198192
atgacgatggaactttttcccacttccaagctttgcactcttaaacctttcttcctcatcttcttactactactcacatcaacccatgcaaccccctcctcaagctcaaacttatttcgagaatacattggagctgagttcaacaacgttaaattctctgatgttcccatcaacccaagtgtccaattccacttcattctctccttcgcaatcgactacgacacctcatcatccccctctcccaccaatggaaagttcaacgtcttttgggacaccgacaaccttagccccacccaagtttctgccatcaagagaaaaaactcaaacatcaaagtagccctaagtctcggaggggacagtgtcgtcggaggtggcaacgctaacttcaatccatcttccattgattcgtgggtttccaacgcggtttcttcactcacaagcatcatcaaagagtacaacttggatggaattgacattgactacgagcatttcaaggcagaccctgaaaccttttctgagtgtctgggaaggctaatcaaaaccctaaaatccaatggggtcatttcttttgcttctattgctccatttgacgatgaccaagttcagagtcactacttgaccttgtggaagagttacgggaacctcatagattatgttaacttccaattttatgcgtatgataagggcactaccgtggaccaatttattggttacttcaatgcacaaagttcaaactataacggtggaaaagtcttggtgagtttcagtactgaagggagtggtgggttatccccagatggtgggttcttcacggcttgccatacactaaagagtcagcaaaaactccatggtatctttgtgtggtctgctgatgactcgatgtcaaatggtttccgctatgagaagcaatcacaggcccttttagctttaccttag

SEQ ID NO: 81415 - DNA, 516 bp, Glycine max
  Peptide Sequence Number=SeqID_198193
atgaaacaagaactcaaaaacttcgacatgcttaccttcacactagcaaggtcgcgacaccactccaaagggcacgagatcggatacgtggtggtggtcagaacaatggctagagtttttgttcttggtggtcgaaaaggcaatgtcacgattcggatgagactccttcaccatcacctctatccccccctccccaatcatacttttggcacattctcgagtaacttcactgtcatgagaaaggatttcttgttgaaagaggggcaaatttactgtagggggcttgttttaaaaacaatttaccaaatagggtctgttttaaaacaaattgcaggggggtctattatttacgtgggtgccgtcattgttactggcgtgaagcttgtaacgtcattggcaataacgggaacggcgatgccgccattggcagcagcgggacggggaggagagaggagagagacccgccattggtgctggcaggacaggaagagagaagagacccgtcattggcactga

SEQ ID NO: 81416 - DNA, 234 bp, Glycine max
  Peptide Sequence Number=SeqID_198194
atggtgactaataaaaaggtggaagagaaagtggtaactaaagaggagagtcagaaatcaaataaacaagctactgacaaaggaaaagttgtagtaaaccatccaccagttgagcatcgtgcttatccacatgcttcgtcaaagaacaataagcaaagaagaattatggacaatgaaaaagtagaagccattggctcaccattgttgtctaattgtaggaagcctgagccataa

SEQ ID NO: 81417 - DNA, 147 bp, Glycine max
  Peptide Sequence Number=SeqID_198195
atggattggaacttggaacatggaacatgcttaaaatatgatggggatccatctgctccccatggagttcgacttttgatcgaggactatccttatgcttctgatgggctacaaatatgggatgttatcaagtctaaaggatattga

SEQ ID NO: 81418 - DNA, 465 bp, Glycine max
  Peptide Sequence Number=SeqID_198196
atgaaatcaccaaaacacccttggtatccactcaagaggtgcaaggtcaagggattgttcaagttgatgtttgattgtcagatccgggaacaaaaaccacaaggaaaggggcaaaatggtcattttctggaacttcctagacctaaactcgcccaagccagcatctggctcgcctgggccatgggaaagcttcagcctgaagcaactaggtcgcctgggcgagctgatacctttaagctaaagcaaccagtttgcctgggcgagcttcccctgcaccaaatggttgttgaaatattggcgatcaaaatttctattcctgcgaacatagggtcgaaccaagcgcaatctttaaagaaaaggattttatcaagtcaaggtcaatgtatggaagtaaccagcttgcgaaagttggggcaaaagatgggtcaaatttacatagcttctttgactactgccaacacatga

SEQ ID NO: 81419 - DNA, 2414 bp, Glycine max
  Peptide Sequence Number=SeqID_198197
agcctgaaaataacaagggctcttgcagggatcttgtgtgtgaagctcatgcttttgagatttccaaactggatttctgcttgaatcataggaaactggctgaatcagaaactatgtgtgaggattgctcatcttcatgtcaccaaaattttgtggacttgtctcagagctttggcttcttttcatggatgcagcaaaagggtatgatacatgatgctgatgataataacaaggtgcttgagactggggtggagcctttgaagtgttcttgctgtggtgtcaactttgttagagacaagccttctttgagggttttggattattcccagaaacagaattcgatcactgaatgtggagttgaggcagagattgatgaaggacatcatcactcagatcatgacagagatgattttgagcttgatcatcctgtagaggaacagaacattgtagaaaacagggaaaacagcatggttttttatgttaatgagggttctggtggaggaggaaagggggcagatgacattagtgtttgttctatgtgtgatggtggcaaagaaactgtgtatggtgaaaattacaagcttgatttgggcatagggaaagggcaagaagaaccaactagagaggaaactttgaatgtccctcgggatgatcaaccttgtgaggagaccactcatcaagtttcttgcactagtgagaacactgagcagattccacccaaacatttggaatttgtcattcatggtaatgattgctttttgattcctgttgaatttggtgactcctttgctacaaaaagtgaaaaccaacatagatataaggtgggggatgatgggtttagtggggatgaagatgttgttttggattttgatataaattctggtgcagagtctgcacctgttattgagaattggcacacttccggggatactgtgtcactgttttcggatccagggtgtacaaaggtgttcaaggccaatggatttgagttaagaagtgaacatttggagcaaaactacctagatatgaaatttgctcaatcaactgaagactcaagcatcaatggtaatgttgaagcaaacatgaaaagaagagatgtggaattatgttcagttgtacctcaagtgtctgaaggtgtaacacaaatgaggggtgatgaattagaagcagaagtctcaactcaagatcaagatattcttgaggattcgagtcaacaaatacaagaagtcccaccttctagctctactacttttactatccaagatgatagtgagaatctgcatcagctacgcaagaggctacaactgcttggaaggaaagaatcaggaacagaagaatcattagaaggaagtgtcatgtgtgatatagaatgtggtgagttaacaattgagaagttgaaatcagcactgaaagctgaaagggaggccttaaatgttgtatatgcagaactagaagaagagaggagtgcatctgcaatagcagcaaatcaaacaatggcagtgataaataggcttcaggaagagaaagcagcaatgcagatggaagctttgcagtatgagagaatgatggaagaacaatctgagtatgaccaggaagctttgcagcttttgaatgaccttatggtaaagagggagaaagagaaacttgagctagaaaaggaggttgaaatatatagaaaaaaggttcatgaatatgaggttagagaaatggtgatgtcaagaagagaaagtcatatgagaagcagaacttctccctcttgtagcaatgctttagatagtgatgaactatctattgatttgagtcgagacttaaagaaaaaaaatggtaattatacccatcaagagttcagcaaccagaatgctcatgaagatgctgtcttatatttggaggagtcattggaaaactttgaggaagagaggttattaattctagaacaactgaatatgctggaagaaaagcttgttacattgaattatgaagaagagtattttgatggtattaaatcaatagaacatctttgtgaagagaatggaaatggataccaagaccataatgattacattgttcatgtaaatggattagcaaatgctaagcatcaagatggaaggaaaaccaagtgtacaaaagcagaaaacggggtcatgagtaatgggttagattttacttccttgcaaaatagttcagatgaaaatgtccaattagagaagaaaaaacttgatgtaaaagtagaggtggaccatgtttatgagagactacaagctctagaggcagatagagagtttttaaagcactgtatcagctccttggggaaaggggacaagggattagatcttattcaagaaattttacaacatcttcgtgatcttaggaatgtggaactcagaatcatgaacatgggagatatttctgtgtaa

SEQ ID NO: 81420 - DNA, 249 bp, Glycine max
  Peptide Sequence Number=SeqID_198198
atggtggttgtgaggctagagttgggagcgatgttacggttgttggatgcaaatctggctggggcagggtgtgaacatggtagtgtgtggtgtggaagagacagggtaggacgatcacatagtgtggatgtggtcggtgatgatgatggctatgcgagttcagatctagatggaggtgatgagttaggagagaaaaaggtggtgggaagagagaagggtaaaaaaggtggtgggaagagagaagggtaa

SEQ ID NO: 81421 - DNA, 351 bp, Glycine max
  Peptide Sequence Number=SeqID_198199
atgtgggattggcacattcttaaaggagcactcaaaccaggtgtatttacccccaaggcctacactccgaagagtccgtcagggcctctccctcctgattcaggtgttgttgacaccagtttctacacaaggcgtgagatcgttcgatgttttggtcaaggatgcgaaaaatacctaaggggaggggaaaaatttcattttaggcaattttctggaccctggctcgcctggccccacaaattgcttagggctgaaggaaccaactcacctgggcgagccagtttcttcaggattaagcatcagctcacctgggtgagctgccatagtcccaaatgcccctatttcctataa

SEQ ID NO: 81422 - DNA, 197 bp, Glycine max
  Peptide Sequence Number=SeqID_198200
cattcttagcaagctcaaaatctaaagagagtcttgcccagaatcttaaggaagttctccagctacttcaacaggaagaagaagaagaaccccccaagaaggaagccgaatcatccgaaaaaaatgatgaccaagaagatgatccattctaccagaatgaggatgactgttttggtatatcgttagacgatgattag

SEQ ID NO: 81423 - DNA, 459 bp, Glycine max
  Peptide Sequence Number=SeqID_198201
atgtgggttcatatcacaagggaagaaaagacaataccacaaaggttgagagagctaagtgaaactgataaagagttcgagggatttgtgcaggttgctcttcaaaagcgaaaggctactacccaagttgctcttaccccaaaaagaccaaaaacagtccaaccaactcctgcaattagagaatctgttattccatccactatccctaaacgtatcaagacacgagctacaaaagctaatcccaagtttggtgagaaggaatggaccgtctcctttactggcaacaaggagaattttgcttcatcctcttcaaacagtgagtccacggatgaaactctcatctcccctctccaaaagtgtccagttcccatacctaaacaatgtccacctccatcccacattcacctcaagaagtttaccagatcaacactacaaaaggaacccttgacaaaggcttag

SEQ ID NO: 81424 - DNA, 537 bp, Glycine max
  Peptide Sequence Number=SeqID_198202
atggttgagggccttatgttcttaaggaaacgcttaaaaagggtaaagttggatctggagacatggagtaaggagcactttggtgaacttgagtctaagagaggcaatttgatcaagaaaattggcgtactagatggtagagatgaagttggtagtctgtctctgagaagaataaataacttgaacgacctctctatccaatgggaggaagatcctaagaaggtgaaagatgaagtcaagaggttcttcaaagataagtttagggaggaagattactcggatgtatccttggatggtgtgtggtttaagtcttttgcagcagaagataatattatgttgtccaaggagttctctgaggaagaaatcaagctagtagtgtgggattgtgataggaacaaatgctcagggcatgacagtggcaagaacatgctagacaatattgttatagcatacaaggtgaatcaagaagctaagattgggaaaaggttgtgctacgtattcaaggcggattttgaaaaggcctatgattctatgtag

SEQ ID NO: 81425 - DNA, 456 bp, Glycine max
  Peptide Sequence Number=SeqID_198203
atggagaagaaagtcaaatgtgtatttgaagatggtttggttgcctttgaagatggattctccgtttatgcagatgccataatccactgtacaggatacaagtaccactttcctttccttgaaaccaatggactagtaaccgttgatgataatcgcgttgggccactatacaaacacgtctttcctcctgcattgtctccatggctctctttcattggtttaaccttcaagaattcagtctaccaaataattgagttgcaatgcaagtgggttgcaaaagttttgtctggtaaagttcttttacctacagaaaaggaaatgatggaatctgttaaagaatactatcaactcatggaggaaaatgggttgcccaagcgttacactcattccctttatccacttcagatattcaacatttggacttggttagacctgcattgtaatatatcaaactag

SEQ ID NO: 81426 - DNA, 3432 bp, Glycine max
  Peptide Sequence Number=SeqID_198204
atgacaagctcgaatggaaatctcatgggcaatcttccaattcttgatggaatgaattggggagaatggcggattcagatgcaagttgtatttggatttcaagatgttcctgaggttgtggaatgtgaaattgcagaacttgaaaaacaatcaagtgatctgcagaaagccgcatgcaaagatgccaagaaaagtgattgcaaggctttattttttattcatcaaagtgtggacaaggcaaatttccagaagattgctcatgcaaagacaacaaaggaggcatggtgcatcttgagaaaggcatattcaggagatgcaaagttaaagaagggctgtggagagaagcttgatgatcagatgattatggagaaaatcttgaggtcactttcacctcggtttgattacattgtgtgtgtcatagaagaatccaagaatcttgaggatttgaagatagaggagctgcaaggttcattggaagcacacgagcaaatgctgaatgatagagacacagaaagatccacgaaccaagctttacaagctcattcctcaaaaggcaaaggaagagggaagtggagcactgataaaggaaagggaagtcacaaaactcatagcaagaattttgaagaaactcaatcaaaaactagagaatcttcaggacaacacaagaatggaatgaagagttggaagaatgagggaaagaaatttgataaaagaaaggtaaagtttttcaattgtaataagtatggaaactttgcctcaaaatttactcacaaacagaaagaagggaggaacaaggctggtgatgaggcaaatttagcagaaggagctgataatgactctgagcaggttttgctaatggtgactgagaaatctgacaaaggaggatcagaagtttggtatttggacacgaattgctctaaccacatgactggaaacaagcattggcttgtgaatcttgatacttcacaaggcagcaaagtaaggtttgctaatagttctttaatcaactgtgaaggtataagaaatgtggtgatcaagagaaaggatgagagcaatgatgtaattgagaatgtgatgtactgtccaacaatggatagtaatctactgagtctaggacagctgcttgagaagggatataagatgaggatggaggacttgatgttgaaagtatatgataaaaaacaaaggtttatcttgaaagccaagatgtctagtaatagaaaattcaaggtaaatttcaatgtagcagatgttcactgcataactgctgaaggaaatgatgtcaattggctttggcacttcaggtatggacatctaaacttccaaggtttaagtagattagttgctaagcacatggtcagtggtatgcctcaaatcaaagcaccagcagaagtatgtgaaggttgtgttgcaggaaaacaacctaggaattccttcaatgtgtctttgcctcctagagctaaagaaccactagaagtagtttgttctgataaatttaaggcatatgcagaaaagcaaaatggagcaaccttgaagatcttgaggacagatgggggaggagaatacatctctaaggaatttgaagacttttgtgaaagcaaaggaatagaacagaactttgctgaacatggtgtggagcatgctaaaattgaaggggctgccaaaggaactttgaagctagaagagatcacaccagaagaagcatggacaggaaagaagccaagggtgagtcacttcagaatttttggctcaccttattggaaacatgtcccagatgagaaaagaaagaaattggatgacaagagcactcagatgatcatgaataaaactgagaaggttcaatcaaaaggcatgtcagtgcttgatgaacttggtgaaaccagtggagaagaagcaattggcaatagcataggtggggcatctcctatagtagctcaaagacctcaaagagtatcaaagccttctacaaggttaagtgatttcaaggtgtacactgatgatgcaatcacaagtaaaggagagctagtttattatactcttctagttgatgcagaaccagtaggatatgtggaagcactgaaggaagaagtacggaagaaggctatgctggaagaactggcagcaattgaaagaaacaacacttggaaactggtcagactgccaaaaggaaagaagcctatcagtttgaaatgggtgttcaaggttaaaaggaaacctgatggaactattgcaaaacataaagcaagactagttgtaagaggtttcatgcagagggaaggtcttgattatactgaagtgtttactccaattgctagaattgaaataattaggattgtagtggtcttggctcattcaagaggttggaatatgtggcagttggatgtaaaatcagccttcctcaatggattacttaaggacgaagcaccaagagcttggaacaaaagaattgatgggttcctactgaaaattggttttgagaaatgtaaggtggagtatggagtgtatgttaaggatgagaatggagacataatcatattgtatctatacgtggatgaacttttaatcacagacagtaatgaagttgtgattcaaactgtcaagaagcaattgcaacaggaatttgatatgatagacctgggagtcatgtcttatttcttaggaattaagttcattcacaagaatggaggactggtgatgcatcaaaagaagtatgcattggaagttcttaaaagatataagatggaagaatgcaacctagctaagagtccaattgattttggattaaagctaggtgctggtcttgatgaaaagccagtggatgccacattgttcaagcaaatggtgggaagcttgagatatttgtgccatagtaggccagatattgcttatggtgtaggtctgggcacacttgattatggcttgttattctccaaagcaagtcataatcaaggactaaggttaattggtttttctgatgcagactggagtggtgatttagaggacaacaaaagcaccactagatatgtcttcaaattacttggatcaacaatatgttggagttctaagaagcaaaaagatgttggactttcaacttgtgagtcagagtacatggttgctgcctcagcagcttgtcaatcagcctggttggagtcactatttgtagaattgaagattcagctttattcagttgttcaacttaacatggacaacaagtctgttatatgtcttgccaacaacccaattgcacatggaagaacaaagcatattgggacaaagtaccactatcttagggatcaagtgaggaaagaaagaataagtttggcttattgtaagtcagaagaacaagaagttgacattctaaccaaagcgcttcgtggagagaagttttacaagttcagagaaaaacttggcatagtgaattgcttaaactag

SEQ ID NO: 81427 - DNA, 228 bp, Glycine max
  Peptide Sequence Number=SeqID_198205
atgagtggaagattgagagatgagattttagggaaaaagatagggttgaaagggggtggctattgcaagaagaagaagtttggggaaagagggagaaagcgtggagaccgtgcgaaacagcttgcatcaggcatcacatttctcaagcagcttggagacactgcgagactgcaacaacttgtgatccatttaaagttcagcttttgtatggagagcatcatttactag

SEQ ID NO: 81428 - DNA, 423 bp, Glycine max
  Peptide Sequence Number=SeqID_198206
atggctgagaaattcattagtcacacagtttctcatttctccttttttcgaaagatcgtgaaggaaggaatgatactgagtcaatttcgtgccctcagtcagtacactcaccacctgcgcgctgccctcactcagctcaccctcttcgtcactcacccttccatgccggcccgccctgtcatcgaacatatttggccgccattcaattactaccgtcatcatccaagatttgttgtgtatacttactatgttccaacaactctattggtgttttcttcagatcattgcaatccaaatattctagcgaagccaaagtcagagattcttggattcatttcttcatcaagcaatatattgcttgccttcaaatccgtatgtatcacctttagtcttgaatatctgtgcaaatacacaagtcgttga

SEQ ID NO: 81429 - DNA, 483 bp, Glycine max
  Peptide Sequence Number=SeqID_198207
atggccacctcattgggaatatccgttcaggcatttgataaatggggagttatccctacagagaaacgtggccgagaggtgttctacgatgtccgttcagtactggaaaatcgtctggctcatcaggtacgaaaacaacaacctgacgaagatagcgaggttgctgctgaacagcgcctgcaaatcgccaggatccggttgacggaggctcaggctgaagcacaggaattgaaaaatcagaaagggaaagggttggttgttgagacggcattttgcacgtttgctctttctcgggtggccggagaaattgccggtattttggatggcatacctttaaccctgcaacggcgcttcccaggtgtcgatccccgacacctggactatctgaagtctacgctggcaaaagcaatgaatcggaccgccgttgtgggggaacgagtagaggcgtggatggatgaatatatcgaacaatcagctgactaa

SEQ ID NO: 81430 - DNA, 601 bp, Glycine max
  Peptide Sequence Number=SeqID_198208
atgactgcggttgaatgggcgaacgaatattattacttgccaaaagaatcttcttatcaggaaggccgttgggaaacgctgccattccaggtggcaattatgaatgcgatgggaagcgatgatattcgggaggtgaacctgattaaatctgcgcgtgtcggctattcgaaaatgcttcttggggtcgttgcttatttccttcagcacaagcaacgcaacgggttgatgtggcagcccacggatggcgatgctgaaaattttatgaaatcacatgtcgaacccacgatacgcgatgtacccagcttattggcaatggcgccatggtttgggaagaagaatcgggacaacacactttcaatgaagcggttttcgaatggaaggggcttttggtgtttagggggaaaagcggcgaaaaactatcgtgaaaaatcagtcgattttgtttcctatgatgagctagctgcttttgatgaggacattgaaaaggaaggttctccaacgttcctgggtgataaacgcatagaaggtgcagtttggccaaagtctattcgaggttcgacaccaaaaattcggggtatgtgtcagattgaacgcgcggcag

SEQ ID NO: 81431 - DNA, 213 bp, Glycine max
  Peptide Sequence Number=SeqID_198209
atggacccatacattgtaattaaaaaggatttgatgggaacgggagaggacgataaaggtggtacgtgtaccaatgttcaaagtgtttatgctagagaatattactcattaaggagtcctaaagttaagaaagagattaaaaacttcaacgagtttaatcatgtgcatgaccttggtgtgatgaggtttttgggaggtctagaatttgcatga

SEQ ID NO: 81432 - DNA, 417 bp, Glycine max
  Peptide Sequence Number=SeqID_198210
atggatgttgcagctgggattcttggcttcgaggctgaaatagcacaaaacaagaattgtcagttgaggagtttgaaccagcgacctctcctccctagtttctcccttcttcaccccttcctcagccactgggtcattttctgtgctcctagttttgttgtgaaattcatgttaataagctccccattgttgttttcagcaaaacaggttaaacacttaaggttgtggatatttgagtgtagagagccaggtcatcaaaccttcatgttggggttgggtgcagctgtgcttttgggactagcccatgctataaccaacttgcttggtggctgcaattgcatttcttctcaacaagagtttgaaaaggcttcttccagtaggcaactctcaactgcttgccttattttaacttggtag

SEQ ID NO: 81433 - DNA, 1602 bp, Glycine max
  Peptide Sequence Number=SeqID_198211
atgtggaactttactccaatcactctccaacccgcatgcggccacatgccctacgctcaacacatcttccaccaaatcgtgctaaagaactcattcctctggaattccatgatcaggggctacgcctgcaacaactctccatccaaagcccttattttataccgcgaaatgctgcattttggacataagcccgataatttcacctacccttttgtcctcaaggcatgtggggaccttttgcttcgggaaattggtagaaaggttcatgctttggtggtggtcggtgggttggaagaggatgtttatgtgggcaactcgatactctcgatgtacttcacgtttggtgacgtggcagctgcgcgggtgatgtttgataaaatgcctgtgagggacttgacttcttggaacactatgatgtcggggtttgtgaagaatggggaggcaaggggtgcttttgaggtttttggggatatgagaagggatggttttgtgggagatgggatcaccttgcttgcacttttatctgcctgtggggatgttatggatttgaaggcggggagagaaattcatggttatgttgttaggaatggtgggaataggagactgtgtaatgggtttttgatgaattcaattatttgcatgtactgcaattgtgagtctatgtcctttgcaaggaagttgtttgaagggttgagagtgaaggatgttgtgtcgtggaattctttgatttcagggtatgagaagtgcggggatgcttttctagttcttgagcttttcggtcgaatggttgtagttggtgcagtgcctgatgaggtgactgtgacttctgtgcttggggcttgtaatcaaatctcggcattgcgattgggtgccagtgtgcagtcatatgttgttaagaggggttatggagtgaatgttgctgtgggaacggccatctccattttttatgaaatgctaggtaaaggtgtgacttcagatgagggcattttcactgcagttttgtcggcttgtagtcattatggattagtgggtgatgggtacttagctgaagcatatggagttatagagaatatgaaattgaaacctaatgaggatgtgtggactgctcttctttctgcttgcagattacatcggaatgtcaagttagcagtgatctcagcgcagaagctttttgaattgaatccagatggagtgagtagctatgtttgcctttccaacacagagatgatggttcatcaattttttgttggggatacttcccatgaacagtcggatgatatttatgccaaattgaaagacttgaatgagcagctgaagaaagctggatacaagcctgacactagtttagttctctacgatgttgaggaagaaataaaggagaagatgctttgggatcatagcgagaggttggcacttgcttttgctcttattaatactggtccagggacaacaatcagaataaccaagaatctttgtgtgtgtggagattgccacacgatggtttatgctcatgcggtggatattggtgagctcatggaagatgttttggaattgctacaatgcagcatcaccgttagcattgcagatgcaaccggactataa

SEQ ID NO: 81434 - DNA, 141 bp, Glycine max
  Peptide Sequence Number=SeqID_198212
atggtggaacaaggtttgggaagaagggttgctgttgttttaaggagtaacattgaggctgagggtgtcttccatgaatcatggagaggaacaagtacgaggactgggactaggactaggagggagtactttaaatactga

SEQ ID NO: 81435 - DNA, 186 bp, Glycine max
  Peptide Sequence Number=SeqID_198213
atgaatcaaaatgtgtcggctggattgtatttttttgagttcatggacatcggtacccatgaacaccccgtcaaacaactcagtatggtatggcttgcttcaaggtatgagttatggattcaagaacttgactatcagaacatggtgctggaattggattgcaagccagtggtgtggatgggttaa

SEQ ID NO: 81436 - DNA, 2529 bp, Glycine max
  Peptide Sequence Number=SeqID_198214
atggaattgataagactcagttatgcggttgtttatgtcattctcctttgtgcgttggcccaagggggctcagaagggaagggggggaaggaagaggagatttctagagatggtggagaagctttctcatcttccattaattatgtgcatggaattaataaggtagaaaatgaattgaaacattgcaggaaagaattgatagagaggaacaatgatgtcaaaactagtacttctcctcctgctcctgtttcagaaaagggtagctctagatatttattgccaaagcattctagatcaaccttgggtgtggaaagtgctcatggcagaaatttgattgctgattcaccacataatgcaccaagtccttctgctactactgctgaaccaccaagtcatggtccaacaccaacaagttctccatcatcaccaactccatcatcaccgtctcaatcatcaccaactccaagtccaaaaggtgtggatttaccactccctccagatatgtttgtgccacttccaccatcaccccgtgcacctcatcctcctcctcagaattttcgacctatagtagatgctcctgttgcttcatcacctaacaatgaaaacaaaaagaagcaaacaattattttagctgcctctttatcaggaattattatcttgataggcttggccctctgctatcgcgaggccagaggcaacaaaggtgacagagatgacaggcccttgttggtattaacctcaagtgactattctggtggttcaaagaaggttgttcgattgggagatgctgacaaggaagaatctgacattgacaatggaaagaaaccttctaattttagaaattggtccattaagggtggacataacaatgcctcactggttgagacaacagcatcagaaggtgtaggacaagttctcaaaggaaagcctgcccctccacctccacctctacctcctggaccaccaccaccatcagctccaaagccgccaccgcctcctgctcctcgtgcaccgccacctccaaaaggtgctcatcctccacctgctcctcccaaaccattgggaggtaaaaatcaaggtccattacttgctaaagaaggaacttcaagtgacggtgatgctccaaaaccaaaactaaagccatttttctgggataaggttaatgcaaaacctgaccaatcaatggtgtggcatgagatcagtgcaggatcatttgtgatcaatgaggaaatgatggagtctttgtttggctgcaccaaccagaataaaaatgaacctaaaaaaaattcactacatgtagatacttcagtgcaatatattcagattattgacccaaagaaagcgcagaacttatcaattcttttgcgagctctgaatgtgacaacagaagaagttattgatgctcttaaagaaggtaatgagattcctgtggagctcatccaaacattgttgaagatggcacctacaacagatgaggaactgaagctaaggctattcaatggacaactctcagaactaggcccggcagagaggtttctcaaagtgttggttgacattccattcgctttcaaacgtcttgaatctctcaagttcatgtttatgcttaaagaagacttctcaagcattaaggactcctttgccacattagaggttgcatgcgacgaactcagaaaaagcaggctattcctgaaactcctcgaagcagttctcaaaaccggcaaccgcatgaacgacggaacctaccgcggaggcgcgcaggcgttcaggctcgacaccctcctcaaactctccgacgtaaaaggaacagacagcaagacaacactcttgcacttcgtggttcaagaaatcatccgctccgagggaataagagcggcgcgaacagaaagagcaggaagaagcatctccagcgtcggaaccaacaatgattccgacgaaggaggagccgaggagtccgaggagcactaccgcagcctcggactccaggtaatctccgggctcagcaatgagctcggagacgtgaagaaggccgcgcttatagacggtgatgcactcagcagcaccgtcttaaagctcggccactcaatggtgaagactcaagaattcttggacaatgacatgaagaacattgaggaagagagcgagttccagcattgcatggagagcttcatggagaaagcgagggaggaagtgacgtggctggtgaatgaagagaagaggataatggctttggttaagagcactgcggactactttcacgggaatgccgggaaggacgaaggcttgcgtttgttcttgatcgtgcgtgatttcttgatcatattggacaaggtttgcagcgaggtgagggaatctaccatgaagatagccaaagctgcaagcaatagcgccaaagaggcagcgaggagttcggtttcttcgtcgcaaaactcgccaactccatcgacgtccgatatgcatagaaggctgtttccggcgatcgccgagaggagaatggattactccagttctgatgaggatgaggacttctaa

SEQ ID NO: 81437 - DNA, 312 bp, Glycine max
  Peptide Sequence Number=SeqID_198215
atggtggagcaacgttcaacagttggggttggagtaacaggtgaatcgttcaaaggaccattattgaacggtctcaaggaagaatggaatagactcagaaagggacatcagcaaaaacaagatatcattgaagttggggccagagacaacgatttcctttttgcaagcgagaagaggtcatcagagaggggagatcgtggtcagggttgggcaccaagatggctaccaaacaatggcaaagggaggcatggtattgttcacctgcagagagctgcgcaaacgattgcgaagagggatcaaaccctaatctga

SEQ ID NO: 81438 - DNA, 1968 bp, Glycine max
  Peptide Sequence Number=SeqID_198216
atgttggcctccactatcctaacgccctcgaagctcgtcccacccatcaccgtcgttgtcgccgcagaaactcacccgagaaacagagtcgcactctttccgaaatccaactccaaactcgctttcgttgccagggccagtggtaacgcccgtgatggcaccgttgacgccacctctgccccggaaattgatgcagttacaagttcatcttctggccttggtgatggttatgtagccttgttcgttcgtatgttaggccttgatcgtgatcctctggatagagaacaagctatagttgctctctggaaatattcgcttggtggaaagaagtgtatagacactttaatgcagtttcctggttgtattaatcttgttgtgaacctcctccgatcagagtctagttcagcatgtgaggcagctgcgggtcttctgcgatcactatcttcagtcaatttatatagaaattctgtagctgatagtggagcaatagaagagataaacagattgctgaggcaatcttccttggctcctgaggtaaaggagcagagtttgagtgcactgtggaatttatctgttgatgagaagctctgcattaaaatttcaaagactgagattctgccattagctattaagtaccttggcgacgaggatataaaggtgaaggaggctgcagggggcattttggcaaatttagcattgagccgcgttaaccacgacatcatggttgaagcaggtgttatacctaaattggcaaagttcttaacatctaatttggaaggatctaaagttattaggaaggaagcaaggaatgcattgctggaacttgttaaggacaagtatcatagaattcttgttattgaggaaggtctggtccctgtgccattaattgatgctgcagcctttaagtcattcaccccgggcttacatctgtggcccacgttacctgatggtacagaaattgaaaggacttctagactgccatccagatatggtgcttcggaattacttcttggattaaatgttgatgacaagaatgctaacttagaggaagcaaaagtcaatgcaattgttggacgaacacaacagcaattccttgctcgtgttggggctttagaaatggaagaaaagactatgcctcattctgaatgctcaaatgatctaaggtttacacttttaccatggatggatggtgttgctcgtttagtactgatactagaactggaagataagtctgcaataattaaggctgcagagtcaattgctactgcatgtatcaatgaacatatgcgtattgcattcagggaagctggagcaattaagcatttagtaaggcttttaaattgcgatgataatgcagtccagttggcagctacacaagctttggaaaggctgtccgttagcaatattgtttgccgggttattgaagctgagggggttttaggtcctttagttagtattttgaaatgctcagagatagctggaactattgtggaaaagtctttgaacatacttgctcggatattggaccccagtaaagagatgcaattaaagtcttatgatggaccagctaatgaatctgaaaaggcatttggtggagcaaaaggtgactgtgtttcaaccgggtttagtagcactgaacaaacggtatcacaaacatacacaaggaatgatatactggattctgttttcattgcgcacctggttgagattctgaagtcctttcctcccagtttacaggaaaaagctgctactgtgcttgagtttgtggcattgactgacccaactcttgccccaattatatctttggatattgaatctggtctcaattctgcttttcagcaaaaaattttgaaaatttcagtggcatggacatcggtacagatgcaattcaagaccatgagagagtcgtatgagttgagaggagagaccatgactggatcgtcttgtggtggtgaagtgagaccgtga

SEQ ID NO: 81439 - DNA, 246 bp, Glycine max
  Peptide Sequence Number=SeqID_198217
atggcattgtggaacgtgacacatggtgacagtgtcacgtggatgtcacatgggaaaggtgaatgtgaagaagaggtggtagagatggttctctccttccagaaattattaggttctgcaagattacaatatggtcatggtatcgggtggtttggtgaccgtcctttaacatataactacatgttcctctactccatcaccaattcaccacctttgacgttgcatacagttgcagagggacagtga

SEQ ID NO: 81440 - DNA, 496 bp, Glycine max
  Peptide Sequence Number=SeqID_198218
atggcatattttgttgggagaattgaaagaaggcactacgaggataccatggctgaacagagagccttatgcttactggaaaggattggtttcgagaattacaagaggggttcaacaaatcagacttgccaagtcaatgcacttatagatataaggtgtacattgaaggttctgcttggtcagtcagtcaaaaatacattctgtcatgtgactctaccactctacgtgtacgactacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgaccctccaactttgtatgcaacatcacagagaaaggaaagctcaattcaacaagttgaatcatgggagaaaa

SEQ ID NO: 81441 - DNA, 363 bp, Glycine max
  Peptide Sequence Number=SeqID_198219
attcaaaggactaaccgcctgagaattctttgtcttaacacattggagggtacatcctttgtggtacaagtagagggtacatctacttgggttgttgtaactgagaacaagagagggtacatctcttgtggatcagttcaagtggagggtacatccacttggttgttcaaagagaacaagggagggccatttgatccaacagtccaggttgcttggccaaaaggccaacgtccttctgttagggggggtgacacctttggtgtagctaatgatgatgctgcagatattgtagctaatgatgattatgttgcggacatcagagatgctcatagaacttgggatccaggacccacacaggattga

SEQ ID NO: 81442 - DNA, 189 bp, Glycine max
  Peptide Sequence Number=SeqID_198220
atggagtgtaatgggaaacaagatggtcaaatgcatgaaaaagtctgcgacttggtagtttttccaatggagaaaacctccaaagcatcacgtgaagcatcggattgcaagtcaccatcttggccaagaaaagctttgcctacccactatagtagtcttccacgacccaaaggaaaaaagttaatgtga

SEQ ID NO: 81443 - DNA, 463 bp, Glycine max
  Peptide Sequence Number=SeqID_198221
tgggtcccaatctgaaccatttgatgtacaaataggagatcgcttggaggatatgattcatgaccttggacaagagtcttttcagcaagcacatgcccctatgtatgatacattgcaaattgattcaaagaaacttttgtatccaagttcaccacttcaagtagtgcacgatatgcttccagagggaaacacattgcttaaaagttactatcaagagaagaagatattgtgtccgatgggtatggagtatcagaagattcatgcttgcccgaatgattgcatattgtacagacatgaatttcaacaaatgccaaaatgccctaggtgtggggtatcacggtacaaagtgaagtatgatgaggagtgtagtagtgatgaaaactcaaagggcccgccagcgaaggtgttgtggtatcttcctattattccaaggtttaagtgtctatttgctaatggagacgat

SEQ ID NO: 81444 - DNA, 201 bp, Glycine max
  Peptide Sequence Number=SeqID_198222
atgttggtgcgcatgatccacactcgtctttttgcagcggcacgggtgaaatcttgccctggtatgcatagtagatgcgtgatagcctccctctctggatgtgctcgcacagttggtcgccctctaatatcagggggtggcccaggatctaagggcaaaggaccttatattctcttaaggtgtggatatggagcatactga

SEQ ID NO: 81445 - DNA, 261 bp, Glycine max
  Peptide Sequence Number=SeqID_198223
atggaaagtaactcttttaaagttactctcggagtgttgggaacttatgtggcaaaaggaaccctgtacaatgaaaaaaaagggaggcatggtggaaaagggtccctcatgatgagatcaggggaggaggaagggactttgctcgcaagcctagctgtttgcactgcagcatcagcagatgcagcttcaggagtggcccgcagaatttcacatataagttgttggcattcactctataaaaacatgggtgaaggtatataa

SEQ ID NO: 81446 - DNA, 393 bp, Glycine max
  Peptide Sequence Number=SeqID_198224
atgccacctcatatatgctgggccacagctcatgtgcgaaatgggggacaaagaaatgtgagaagaaagaggcttggacagacaactcaaagagcatcaaatcatgttgggggaaaataccatcacagtcgttcagacagtgcacctacaaggagtctagcttcatttgctcaagattataggaaactggcaattgattgcctcaaggttttacgcatagagatgcaattggagacagtattccatatgcaggaaatggcaaatacagaatacttggatgaccaagatgctgaagagccggatgacttcatcatttcgctcactgcacagttcttagttgtatcctgggatggatatggaaatgaaccattgggagttacaagagtaatgtaa

SEQ ID NO: 81447 - DNA, 414 bp, Glycine max
  Peptide Sequence Number=SeqID_198225
atgcatgagttctccattgttgatggttttgtggagataagtgaatgcatggcagagatgaccaatcagcaaaacagaaggctagcagcttcaagtggcgacagcttgatactaggggatcaacagattccatggatgagaagccaccgatgtaaccctaatttgccattgtcagtcacatctgtaagcgttacttcatcttttcaggctgccgaaactgatgagttgcctgtatcaagccaggttgaagaagagcctcagcatgaacagactgatttactgatattagcactaatttcttgtcagtatcagaaagatttcaaagctaataaagaagctaaactagcggagtggctggatggaactggggaccttgatgataattgcggtacaggtgatgagaaaaggtcttag

SEQ ID NO: 81448 - DNA, 378 bp, Glycine max
  Peptide Sequence Number=SeqID_198226
atgggtgactattatgagtcatcaaaatcaaatttaggttttagagatacttcagtaccttattggtgtagtaatgtcttacaagcatttgaaaatggaggtggccctttgttgctgttaaattggcaaatcagcttcttacaaagaaagaaggtaatttcaagagagaaagaagggccattgattgcatttatttgcacggatgaggcttattgtgacaatgaaaggagaagcagaaagacagaacttaacctaccctgctgcagtggcagtgaagcattagcaacagcaggaggagagaggcttcttgatatgcacggtgcgtatcgtcaacattctgtctctcctttctttgtctcttctccgctaccaatttga

SEQ ID NO: 81449 - DNA, 159 bp, Glycine max
  Peptide Sequence Number=SeqID_198227
atggggatattacactggaataacgttgatgagcaagaacatgccgcagatctgataactccggcgaagaacgaagtcgtgaaaaaggttgtgcattacgacgctgatgcgagggctctgagattgtgcatttcgagtcacgaaaatataataatttag

SEQ ID NO: 81450 - DNA, 219 bp, Glycine max
  Peptide Sequence Number=SeqID_198228
atgtcggaggaagagaagttgctgaaggaggcgaagaaactgccatgggaggatcgcctcttccacaagaattggaaggtgcgcaacgaggcgaacatcgatttggcttcgctctgcgactccatcaccgatcccaaggactctcgcatccgcgaattcggtcgggtttacgcgttttccgattcgatccctgatctccgtgtggcggatctggatgcg

SEQ ID NO: 81451 - DNA, 1191 bp, Glycine max
  Peptide Sequence Number=SeqID_198229
atggagaaagcgataaaaaacaaagttgctaaagcggtggtacctgcaatagatgttatgtttcaagctttaagtgattttggtgcaaaaattgtgcccccaaaaagaattttgaagatgcttccagaactctttgatcatcaagatcaaaatgttcgtgcatcctctaaagggttgactcttgaactttgccgttggattggtaaagatagtgtaaaatcaattttgtttgagaaaatgagagacacaatgaaaaaagagctagaggcagagcttgtaaatgttacaggaacagcaaagccaacccgtaaaataaggtggatgctgattttgatggttttgaattttcccatcccaatgtatggacattaccattttattctatcatgtcgtagatctgagcaagataaggaacctgaacaggaagctgtgtcagaggttgtgggtcctggcccttctgaagaatctgggaatgatgctcctcaagaaatcgacgaatatgaacttgttgatcctgttgatatattgattcctttggagaagtcaggattttgggatggagttaaagctaccaaatggtctgaacggaaggaggctgttgctgagctaacaaagcttgcatcaactaaaagaatttctcctggtgatttctctgaagtttgtcggaccttaaaaaagcttattacagatgtgaatattgctgttgcagttgaagctgtccaggctattggcaatcttgctcgtggattaagaactcatttttcttcgagttctcgttttttattgcctgttttacttgaaaaattgaaggagaaaaaacctgctttggctgaggcattgacgcagactcttcaagcgatgcacaaagctggatgcatcagccttatagatattgttgaaggcagtaacaagggtgttattatgaaggtgcacaaggattatgtgccaatctgtatggagtgcctaaatgacggtactcctgaagtcagggatgctgccttttcagcattggcaggaatagctaagtcagttggcatgagacctctggagaggtcgctggagaaacttgatgatgttagaagaaagaagctttcggaaatgatttcaggttctgaagatgctgtgcctggggcttcttctgcagatactcatccatctttaactatttcaatctgcgatgcacgtggctga

SEQ ID NO: 81452 - DNA, 912 bp, Glycine max
  Peptide Sequence Number=SeqID_198230
atgctttctcataagggtgaacccttgggtactagtaccctcacctttagagggctgcactccctcgccttcagaggactgcacgacctcgtctttagagggctgctcgccctcgccttccgaggactacacgtcctcaccatcagagggctgcacgccctcacctttagaggacagcacgtcctcacctttagaggacagcacgtcctcaccttcagaggactgtacgtccacaccttcagaggaccgcatgtcctcagctttagagggttactcgccctcaccttcagaggactacacgtccttgctattagagggttgcacgccctcaccttcagaggactacacgtcctcaccttcagagggccacacgccctcgctttcagaggaccacacgtcctcaccttcagaggactacacgtcctcaccttcagagggctgcacaacctcacctttagaggactacgcgtcctctccatcagaggactacacatccccgtcttcagaggactacacgtcctcacctacagaggactacatgtcctcaccttcataaggctacacgccctcaccttcagaggactacacgtcctcatcttcagagggatgcacgccctcgcttcagaggactatacgtcctcatcttcagaggactacacatcctcaccttcagaggactatacgtcctcatcttcagaggactacacatcctcaccttcagaggactgcatgtcctcaccttcagaggattgtacatcctcaccttcagaggactacacgtccttgccatcagaggattgcacgtcctcgccttcagagggctacacgtcctcgccttcagagggctacatgtcctcgtcttcagaggactacacgtcctcgccttcagagggctacacgccctcgccttga

SEQ ID NO: 81453 - DNA, 471 bp, Glycine max
  Peptide Sequence Number=SeqID_198231
gtagtggattatgtgaataaatattactcaagggaaatatatggtgtttgttatggccataaggtggtatcaatcaatggtatggatatatggccagatgacattcaaccactaaaatacaaaaagggtcttagtagaccaaagaaattgagaaggagagagcctgatgaggaccctaacaggactagactaacaagggatccagttgcatataaaggcactagatgtcgggcaataggtcataattcgaggaggtgtccattgccacctccaacagtacttgaagaagaaaatgtggaacttaatggagctcaggatgcaaatcaaggtgcaggtgaaggtgcaactcaagatgcaaatcaaggtgcaggtgaggatgcaaatcaagctgcaggggtcacccacgatgtagaaaatgatgtcagagctgctgacgatgatgtcggggttgaaaacaagcctgtaaggtag

SEQ ID NO: 81454 - DNA, 735 bp, Glycine max
  Peptide Sequence Number=SeqID_198232
atgtcatctgctactgccattggattctcagcaaattggtggttgcgctgtcacgggcgaatgactcctccttcatgttttccggtttcagtgtcttattcttcctctttcaactccaactcttcttcttctaagttcaactacattcatggagcatcctctgaaggacttcctaatgagttggttgaagactcaaaatttgttcctttgaatgaggaggatcctatatatggtccacctgccttattgttgttgggctttgaagcagatgaagctctgaagtataatgtgcatcctgatcttgagcagattcaacagcttttgaaagagttggatggtgaattcctgaaggtcatctattgtactgaagacatgattacacgttcgctttgggaggcaatgcatacaacccaccccactttagaagaggttaagatgcttctaatgcacctgggcactttcagcatttcacaaacaatacttatctttgctgaaggaatagccaagtcacttcctcggatatgtttcttatctggtttaagtggagaggagatgatgatgttcatagattctttccctgaaactgaactaaaaccagctgcatttgcggcgcttgttcccaacagtgctaataaaccactggaggagttgatagaagaaataatgggagaccatgagatgttggaaataacatcttttatggctgcagactggggagcagttatgaagatttaa

SEQ ID NO: 81455 - DNA, 964 bp, Glycine max
  Peptide Sequence Number=SeqID_198233
atggaggcaaagcgagaccattccatcacgtgcttagcacgtgtttcactcttcctcttcgctctaaccctatcctctgctcacgagagcaccacggttcacgacatagcgagaaagttaaaagtcggggacaacgagcttctgcgcacggagaagaagttcaaggttttcatggagaattacgggaggagctactccacaagagaggagtacttgcgccgtttggggattttctcccagaacatgctcagagcggcggagcaccaggcgctggaccccaccgccgtccacggtgtcacgcagttctccgatctcaccgaggttgagggactgccggagaattttgattggagagagaaaggagctgtcaccgaagttaagatacagggtagatgtgggtcatgctgggctttcagcaccacaggatctatagaaggagccaattttcttgccaccggaaagctcgtcagtctcagtgaacaacagctccttgactgtgacaataagtgtgaaataacagaaaagacttcatgtgacaatgggtgtaatggaggtcttatgacaaatgcctacaattatttgctcgagtctggtgggttggaggaggagtcttcatatccctacactggggagagaggtgaatgcaagtttgatcctgagaaaataacagttaggatcacaaattttaccaatatccctgtagatgagaaccaaattgccgcatatttagtcaaaaatggtccacttgctatgggcgtgaatgcaattttcatgcaaacatacattggtggtgtctcatgccctctcatatgcagcaagaaaaggctgaaccatggtgtgttacttgtgggatacggtgcaaaaggcttctcaattctcaggcttggcaacaaaccatactggatcatcaagaattcatgggggaagaaatggggagaagatggctattacaagctctgcagag

SEQ ID NO: 81456 - DNA, 387 bp, Glycine max
  Peptide Sequence Number=SeqID_198234
atgtacatcaagtatgtttcgaaggatacatcacgaagcatagccaacaaaacaagttatccaaatgaaacaaaaaaaaccccccacacttattcccaaaatgattccaaagctccaaaattccttaaggatatggtgatatcatgggttttttcatttaaggcttgtagtgagcttcaaaaacaaaggaaagggaaacaaggctcaaaagggctatcaaaggaattaattcaagggaagcatcaacaagaatcaagccaaggctattgtgcaagcaatcaatggggcaaaacacaccaaatgattatgatgatggatggctcaaattctcacaaaggtaaactcatcactttcaaattgagttttcaaaactatcatgacatgtag

SEQ ID NO: 81457 - DNA, 256 bp, Glycine max
  Peptide Sequence Number=SeqID_198235
atgacaatgtcgataataataatagcgatgacaatatcaatattagtgatagttgatgattctggtgatggtggtgataatgataataacgatttcagtggtgttggtaattacaacaacgatcataatgacatagtgacaatgatggtgttggtgggggtagaagtagtaacaatgttagaggtgttgacaattacaatgtcagaagtgatggtggtgttgaggatagtaatgatgctagtggtagtagggagaa

SEQ ID NO: 81458 - DNA, 138 bp, Glycine max
  Peptide Sequence Number=SeqID_198236
atgggatattgggtaaataattggtgtcgcatatgctttttctctgtaccctcccaaacaaacaatgttatttttagaggggccaatgggaattgggaagctgtgttgtgtggccgcatgggatttggcaaaacatag

SEQ ID NO: 81459 - DNA, 600 bp, Glycine max
  Peptide Sequence Number=SeqID_198237
atggacgttgataagatccttccatctagcaacaccttaggatggcacagccctaaagttaatgtcgaggttcaaatgaaaaaagacttatggtggatacctgggcaccccgagacgaggaagggcgtagtaagcaacgaaatgcttcagggagttgaaaataagggtagattcggggattcccgatattggtcaacctttcaaactgctgctgaatccacgggcaggcaagagacaacttgcctaaaccgtgaaaatgaggttgtgggagagctatacaagtgttgtgctactaggcgaagcagcagagaatgctgcaccctagatggcaagagtctagtaaccaaaagcatcactagcttatgctttgacccgagtagcatggggcacgtggaatcccatgatgagttatggtcatgggtgaaatgccactcgaacctagagctagctggttctccccgaaatgcgttgagagacaaccaagaggtttgcctagaagcaaccaccatcggtgcaggccgcaagagcgataccaaatcgaggcaaactctgaatactcaatgtgacctcaaaataacatgggtcaagatcggccagtga

SEQ ID NO: 81460 - DNA, 537 bp, Glycine max
  Peptide Sequence Number=SeqID_198238
atgacaccgcagcgggatgtgtatgcccgtctggccagcgaaagactcaactggatgaatgacgatcagcgccgcagaatgcaggacatagcggacagactcggcaggggacttgatgagatcgactcctgtatcgcgcgaacggcggtgatggcggatgaaattgctcaggtgatgcaggagtcgctggcgagaagaacctatacgatgtctctgatggcgatggtcttcttacccagtaccttcctgacagggctgtttggcgtcaatctgggggggatccccggtggtgcttaccattacggcttcaccgcgttttgcgtcatgttagttgttttgattggtggtgttgcatggtggttgcatcgtacgtctaccctaaaagcgatgacagtcaattctggagggaatgatgagcatcctcaacgctctgctattgcaacaatcacgtcagtccgatcccaccccgaccgatccggtgccaatgcccgatcccatcccgcgtcctcagccgatgcccgacccgccgcccgatga

SEQ ID NO: 81461 - DNA, 252 bp, Glycine max
  Peptide Sequence Number=SeqID_198239
atggactcaagcggtgcgtttagtaggatgatccgtcgctcagcgaaaatgtacagctcatctttcttccagattcttcctcatgctcagccaaaggagtggtgcgctcagtggatgggttttatacacaatgtggaagcaaagctttcccaagtttattttgatgatgccaaagactcaagtcaagaattaagagtcaaacaagtttcaagaatcaaagagtcattcaatcaagaatcaagatacaagtga

SEQ ID NO: 81462 - DNA, 336 bp, Glycine max
  Peptide Sequence Number=SeqID_198240
atgtacaattatcatgagaaaggaaaagctcctaatcttgaaagtgtattggcagacttcatgacatatcaagctagctctaaaggtgattgctattcaatgcaacagcagggaactcagtttgaaagggactattcttttgcagattatcaatgggagtcagaatggcaaccttattattgtggtgtccctaaattaatgactgaagtggatcctcatcaccctctagaaagtcaagggcatccacagcaggctcagggaggtagctcctccagatcctcctcaggatcttcctcggatgacgtcacctcggatcacttggactggctccactag

SEQ ID NO: 81463 - DNA, 578 bp, Glycine max
  Peptide Sequence Number=SeqID_198241
atgcccactaggaggaaggaaaccgtatctgttttctgggttatacccctccatggcaagagtagcgaaggtggtcaagatctcagcgcaagaattggaccgacattcttggtctttgaggtcgtcctctttccaaatttggatgggttagtggatctagtggtgatcgatgtttttcttgcttatcaccatagcaaggaaagcatcgcaaacgtccccttgatgggaatgaggggttgtattaattataatcccatacttgccataagacaattaggctaccccatgagaggggcgccaatagaagagagtattgcgcttttcatcgcacgaagtttcagtgacccctatgaaaaaatgcttcaaagagtccgaaaagcatggaatgcggtgcaaaggaaggataaggatcttagaggaagcagcaacggtgttattggcagatatcataaatggttgaaggcttggatgcaagggataatttggctcccgaagctaaagatttcgagtggggaagaggctggagtccctgaggagagcgaagaagtgcaagccttgaaagcggaacttgaaagaac

SEQ ID NO: 81464 - DNA, 420 bp, Glycine max
  Peptide Sequence Number=SeqID_198242
atgggggatcccatcagcagactctccttccctggtaggcgcattgtttttcactcaaaaagcatatgctggaatatttgtctctttgctaaagcatgtttgcattttagtggagaaaacaccgagactttttcaagtctcacaagttatccagaactacgtaggtctgaattcctcattggaggatacgtaggagcaagagcctcgcttttgtcgaccacaccgccttttgttgtcatgactcaagagctggtagcccgcggagataccttacggttatccgcacccttttgtcatccagaggcggcgggcccgatgacaagcagagaccaagtttggtcattctgcacccatgatacgcggagataccttatggttattcgcaccccttttgtcatccagaggcggcgggcccgatga

SEQ ID NO: 81465 - DNA, 426 bp, Glycine max
  Peptide Sequence Number=SeqID_198243
atgcagagttcacaacgcgatgtctatcttggagcctacctaaatgggttccactgcagcggacactggcagatggtggtcatcctgcccaaggaacacctagttgtctggttttgttcattgcataacaggccagacaactaccttaaggggattattaatagtgctatcaagggtcttgatgatgctccacatcctaaatcaaaggcttctgcaaggtggattgtcgtcatgtgtaatagacaaaaaggaagtactgagtgcggttactatgtgatgcactggatgtccaccatcattttaggaacttttaggaataattgggaagcatattttaacgaacctagaccattggagccaaagaaattaaaagcattgcgaatccagtgggcacaattttatctccaagttagagttcaggcctag

SEQ ID NO: 81466 - DNA, 543 bp, Glycine max
  Peptide Sequence Number=SeqID_198244
gtatggtgcctactaggcaccctctggacacagataagtccaacagggccctggggtttccggtgctgatcacaggcctctgccagtcctacagagttcccgtcacccccagtaaggtaatccgactgccgatcacccgagccttcatcgagaagtactgcacgcctaggcaggcgcatgctaggccactgggcgtagagcgttatctacagcatttggttcgccaacaggcagccaaccaccgtgggcaggggcagggtttcgccccttttgtatgccctacctcgaagcagtttggggctgaggttgcatggcctggagactggcccgatgcccaggtaggggaggagcctgcaggatcccccggtgaggcagatgaatcccatatggatgaagatatgattgacctgctaggtttcttggggcaaggatggacattctcaccctgggtcaaggtttatggtgagttgggattttggctcaaggctcattgtcgcaacctacccttcggcgggagggcgacgcgtgactcgcgggatgcgt

SEQ ID NO: 81467 - DNA, 588 bp, Glycine max
  Peptide Sequence Number=SeqID_198245
atgaaagccaacaaaacaagaaatgaattgaaagtctcagattcgaaaacttaccggttgaagaacgaagaacggatgaagaacggtgaagaacagaggaaaaccttcacggatttgctcacggaaacatcttggaagcattacggaagcacctcggcatggattttcttcacggaaacaattttttcaccaaaaagagctgaaatgcttagccaagggggaaaaatgggaggaggttgtcgcccagctcgcccaagcgagctaggttgcttcctccataagcaaccccgcttccaaaatgttctggaaggacccagattcgaaaatttgaaaatttctatttgcacacccatcttgataagttcaaccccctttttcgtaatttacggaaaagttacaaaagccttacggaagtatttcggatttgattttcatcttttttcctcttccctttcaccaatattaagtgaaatatgtttaaccaaggttttcaaaaattttacggaagcattacagaagccaaggaagccccggaaaccatttttcaacaacgtggaggagcttgccgcccagttgcttcctccttaa

SEQ ID NO: 81468 - DNA, 207 bp, Glycine max
  Peptide Sequence Number=SeqID_198246
atgtgtcacaggcaatgcactaacctttgtgtggatgagctgagggactttggaggtggaggcagtgcgtctgttgcccgctgccggccatccccaggctactgcggtgtctcgccttgcgcctgcctgggggtgcagtacttcttgatgaaagctcggttagtagggggcttgatgaccttgttgggggcgacgagcactccgtag

SEQ ID NO: 81469 - DNA, 162 bp, Glycine max
  Peptide Sequence Number=SeqID_198247
atgaatttgagtcctatgaaagataaaagtgaggactttgagtcccatgaaatcataaagcaaaggacgttgagtcctatgaaacaagccaatgggcactggtaccaaagggctcaaccttatgaaaaagcaagagatgcatgcaacattcatcttaagtga

SEQ ID NO: 81470 - DNA, 1083 bp, Glycine max
  Peptide Sequence Number=SeqID_198248
aataacggacaagccgccgccccacaagttcccccggggcaacggcaagccgaatcggacccagcgcaatcaggccaggcgcacgccctcgtgcagggccgcgatgccggccgtcaggttgaagtactgcacccgctccaggccggcggtgcgcagcatgtccgccagggtttcctggtcgggatgcatgcggatggattcggccaggtagcggtagctggcctcgtccttggccaccgtcttgcccagccagggcagcacgttgaaggaataccagtcgtaggccggcgccagcggcttggcgatgcgggagaactccagcaccagcagcttgccgcccggcttgagcacgcgggtcatctcggccagggcgcgatccttgtgggtcatgttgcgcaacccgaaagccacgctgacgcggtcgaaatagcccgtcgggaacggcaggcgctcggcgtcacagacggcggtgggcaccagctggccggcgtcggccaggcggtcgcggccgacgcgcagcatggaatcgttgatatcggtcagccagacctcgccggtggggcccgcgcgcttggcgaaagccttggccaggtcgccggtgccgcccgcgatgtccagcaccttcatgccggggcggatggcggcgcggccgatggtgaaggccttccagacgcggtgcaggccggccgacatgaaatcgttcatgatgtcgtagcgctgcgccaccgagtggaagacttcggcgaccttgcgggctttttcgctttccggcaccgattggaagccgaaatgcgtcgattgggacgcggaatccgcggaatgttgcgattcggaggggttttgcatggtgaattcccgatatatcgtccaatgcaccatcctcgtcgtcgaagacgaacccgcaatccaggaactgatcgccgtcaacctgtccttcgccggccacaaggtgctgcgcgccttcgacgccgaccaggcccagaccctgatccgcgccgaactgcccgacctgatcctgctggactggatgctgcccggcacctccggcctggccatggcgcgcaagctgcgcaaccccgatag

SEQ ID NO: 81471 - DNA, 228 bp, Glycine max
  Peptide Sequence Number=SeqID_198249
atggtggaggatgatccctttctcttctttgatggttctgccattttgatgaagtttcagtggatttcaatcggtggaagtgaaagaggagtgaaaaagaggaagattgggctttacgggacacgatttggtgaagatttgagtaagatacgaagtttggaagatttaggatgttgtaatcgattacaggctgcctgtttatgtgtaatcgattacactggatggtaa

SEQ ID NO: 81472 - DNA, 411 bp, Glycine max
  Peptide Sequence Number=SeqID_198250
atggcacgtaatgtgtttgctccgtgcccctatttaaagggacctatatgggagggaactaaaaaggcttttagtgataattcccaaggtggtcatatctctcttgatgcagtagggactactagcaacaataagttttcaaagagaaaagctctagatgagggttctgatgcaaactccattggagcttgtaggcctaggatcttcttcatcaatggattcctttgcttcttggaagatgaatggcagcggaatggagaaagggagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 81473 - DNA, 455 bp, Glycine max
  Peptide Sequence Number=SeqID_198251
tcattttcaacattcagaactatcaacatgcaaagagatctaattctgcaaaagccaggatcaacaggaaacgtatcatgcaacagaagcgacatcctcatgctcagtcatcttcacaaccaacaatgaactgcacttccgaatatgatagttcgggctctaattttttaagtgcctatgaggattgccaatctccaactaatcatcttgtaatcaacaccgaaggatattctgatcttggtgatcaactcatgcaatgtagatattgtaatgcacaaatgtggtatgatgaaagaatatcaaaagataaaaattgtcagagtccaaggttcagcttatgctgtggagatggcaaagttgaattgccattattacaaaatccaccccaatatctccaacgacttctgtttgatgataatacaattgatagtaaaaattatcaacataacttatga

SEQ ID NO: 81474 - DNA, 375 bp, Glycine max
  Peptide Sequence Number=SeqID_198252
atgattataaggggccaagacatttatagtagccaagatgaggcaactacttcaccttcctctagtgaaagtgaggaagcaaaaggggaagaatccagtaaagagatctacccccaagaagaaggacaacctttaatggtcaaggaggagtgtaaggagacacttgttagcattgccacacctcttaggcttgagtttattcctcaagtaaaggagttgttggatgagggggttcccatgaaccctaagagaataaaggtcattcctgagtggcccactccaccaacatcactcattgagttggtgaggaaccatgttcctccatgggaagatgcccatgaaatgggtgctgaggaaaaaagcccagagttttaa

SEQ ID NO: 81475 - DNA, 792 bp, Glycine max
  Peptide Sequence Number=SeqID_198253
atgcgatcgccgagccgcccgaggcgcggcgccgagatcagcgctgcaatgccgggcacggcggcgatcatgccgctgacaaaggcgatattgctgacgtcgccggacagctcgcgaatgaacaacggtgaggatcagcgtcggatagggcagcgaacggaacaccgccttgccgctcagctgatccgcttttttcaccgtgatgcgccgctctttaatcaggaacagcgtcaccaggaagctgacgaacatcagcccggcggtgacgaaaaacactacccgcagccccagatggtcggccatcagcccgcccagcagcggcccggcgatcacgccggagatctgcccggtagaaagcgtgcccagcgcccagccgcttttatcgcgcggcacctgcgaggcgaccagcgccatggcgttgggaatatagccggacgtcagccccatcagggcgcgcagtgcgaacagctgccagacgttggtggccagcccttgcagcgcgatgacgatcgccatgcccagcgaggcgcgcagcagcatcagtttgcggcctttgcggtcggccaggctgccccacagcggcgacaccaccgccgagaccaaaaaggtgccgctgaacaccagcccggaccacaggctgagggattggtgatcgctgacgccgagctgttcgacgtacagcggcagaaaagggaggatttggctcatcgccagcccggtgtagaaacacccgagccagaccgagatcagattgactttccacgcttccatcggcttaccgtaccacgttga

SEQ ID NO: 81476 - DNA, 534 bp, Glycine max
  Peptide Sequence Number=SeqID_198254
atgaggcgtaaacgcgcgactataccgccgtcgggcaagacaagcccgatgagtaggggggcgcggtcgctgcaaacccaggcgcgagcccgggcggagcggtcgtcggtgcagatctgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 81477 - DNA, 630 bp, Glycine max
  Peptide Sequence Number=SeqID_198255
atggcatcgaagaagagaaaggcacctgccacaccttcccaagtcagatatgacagatcaaggttcagttctctagaggcttgggaaaggtacacatacatagtggtgcctagaaagatacttccagagagaaatatggtgatataccacactgagttcgatgatttcaaagaagagcttgagagaagaaattggcatgaggagttgaccagctttgaagaaagcaacattgatgttgccattatgaaggagttctatgctaacctctatgatccaaaggataaatcaccaaaacaggtgacggtcagaggccatttagtgaagtttgacgaagatgccctcaacacattcttgaagacccctatgatcattgaggagggggaaacactatctgcttattccaagttcgcactcctgaggcctaatcctcaagaattggcagccaagctctgtatcccagggaggggatttgagcttaatgttgatggcttgccattgaagatcctcagaaagaacctgactaccattgctcagacttggagtgtgctttccttctcaaacttggtccctacctcacacacatcagatatcactctggatagggccaagttgatttatggaataatttag

SEQ ID NO: 81478 - DNA, 1020 bp, Glycine max
  Peptide Sequence Number=SeqID_198256
atggcgcgattctccgatggcctggacgagatcctggtggtcgaggaaaagcgccaggtgctcgaataccagttgaaggaggaactgttcagctggatcggcagcggcaagaagatcccgcgcgtggtcggcaagttcgacgacaaggatggcggcgaatgggcggtgccgcagggcaactggttgctgccggcgcactacgagttttcgccggcgatggtggccaaggccatcgccgcgcgcctgttgcgcttcgaattgccggccgacgtgcgcgccggcatcgaggcgcggctggccttcatcgccgatcgcgaacaggaaagaacgcgcccgcgcgtggtggaagaccgcaagccgtggttctgttcgggctgtccgcacaacacctcgacgcgggtgccggaaggctcgcgcggcatggccggcatcggctgccactacatggtgacctggatgggccgcagcaccgacaccttcacccacatgggcggcgaaggcgtgacctgggccgggcaggcgccgttcaccgataccccgcacgtgttccagaacctcggcgacggcacctacttccacagcggttcgctggcgatccgccaggcggtcgccgccggcgtcaacatcacctacaagatcctctacaacgatgcggtagcgatgaccggcggccagccggtggacggcccgctgagcgtgccggacattgcaaagcagatgcgcgccgaaggcatccacaccatcgtggtgctgtcggacaacatcggcaagtggaccggccagcgcgagcacttccccagcgacgtcgagttccatgaccgcagcgagctggacgaagtgcagaagcgcctgcgcgaagtgaagggtgtttcgatcctgatctacgaacagacctgcgccaccgagaagcgccgccgccgcaagcgcggcaagctggaagatccgcagaagcgggtgctgatcaattcgctggtctgcgaaggctgcggcgactgcggcaagaagagcttctgcgtgtcg

SEQ ID NO: 81479 - DNA, 222 bp, Glycine max
  Peptide Sequence Number=SeqID_198257
atggagatcgtctttggcacttatccattgagttcgtgtttgtcgcaaactgggctgtgcttccgtgactgcaaccacattgtcgagttcgcgtttgtggagttcgtgtctgcgcttccatcgaagttattgcagaataaattatggagtaacaacaagggggttaggcagtttttagtgggttttcaggaagggagacaagaggctgtcaaatttacatag

SEQ ID NO: 81480 - DNA, 384 bp, Glycine max
  Peptide Sequence Number=SeqID_198258
atgagatttaaacctaatctatcctcctttgttcgagaaaagaatgagactcagagcaataactcaaagaaaacccaatccttatatacctatttcaaaactcttgaggcaccatcagtaaatccttatttctctcgaacaagcccgctgccattggaacttccaaaacatagtggttttacacaatttaagttggatgactattgggagtacaccccttatcatagtacaacgatgaagttctcaccaacacaattatggcttgcatttgtcaggttgctaagttggaattgtggaagtgcaaccacaaactcggtgccacacccccaagaaacaacaagtcagcaatctatccctcaagtaccaccccgtgtggtcatctaa

SEQ ID NO: 81481 - DNA, 267 bp, Glycine max
  Peptide Sequence Number=SeqID_198259
atgcatcattcacatacaaccatgcttatttttcttttcacattggtggcattgctcatggcatttttccatgaaatcagaactgtaatcattgtaatcaaaaggaaagaatgcactctacaacacctttatcgaatgcatgccagagctagagtaaggagtgagatagaggaggtgcaagagcagatgaaggccgacatggaggccatgaaagagaaaatggccacaatgattgaagccatgatgagtatgaaaaaaatgatagag

SEQ ID NO: 81482 - DNA, 768 bp, Glycine max
  Peptide Sequence Number=SeqID_198260
atggtggaaggcatcctagcttctattaaggctttgtttgttgaagagcataagaagaagctagcagaagatgcaagattgtctgctttggcaaagaagggaaaggctattgaggaggccaccatgatggacatagatggtgagtctatacctgaagaagtagtgcttaagtttgtaaacaatcattctaagaatgaagctatgaacgttgttctgtttgaagaaatggatgcagacataatcagattattagagagcatctgtgggactccaatgcctgaagggttccaaggtaataatcccttcaactatccatattgggatactctacttgaagaagaagaagatgcacttggagtgtatggagaaaaggaactagtgctcaaagaccagggagttttctaccgtgtggattttgatgttgatgcctcagttgatctagatgcctttgttgttgaagtttatgatccttcacccttcagagagtatgttagactcatcgaggctgagcttcttaggatgagaaaagcctctgcccaagctcttgaggatcatgcccatgttgagatggaagttgataagtggcatcataatggagatttcttttacaagaaggtcagtgggtgggaacctccaaggacttttactcctccaagcagtctagttgtccttggtcctattaatctctcttcagattttgactcttctgatgaagaattgaagactcttgaggacttagctgccaaacaaaaaagggaaaagaagtaa

SEQ ID NO: 81483 - DNA, 495 bp, Glycine max
  Peptide Sequence Number=SeqID_198261
atgaggaaggttccaaattttaagtttgaacttgaatctcaaccccatcaaaatggccaaccattaagattaaacatccttcgacatggcaaacaaactcgtaccggcaggtaccaccctacacctgccccaactttgatggggaatccccgcattgaccaagcacgggtggggatgggtataaggcgggtataccccgatccacaacgaggacggggatggagaaaaaagtccatacctgtcgaggatgaggacaaggaaaccgtatacctgtacccgccccaccctgttgctatgtctaaacatcctcaatcccaacctcaacctactcccatcacttttcccaagccacaagaatctgcatatgagattcttgcaacctctcaatcagagccagcctcaccatcaaaggaacaagaatttgatgttgagattcttgaaactccaacacttaaacttgcaccttctctggcccttccaccccagacttcttaa

SEQ ID NO: 81484 - DNA, 2541 bp, Glycine max
  Peptide Sequence Number=SeqID_198262
atgtataacagaactacaaatctatgctctatatttagacttgcattttcaaggtcaaaactcatgcacacagcaggaacaagcatctgcaacaatgtcatgtcaaaaccagaaactcaagattacctcacaacccaattggaatctttgttccgggcttgttcggatgcttctgtggttcagcaagctagacaggttcacactcagatcattgttggcggcatgagtgatgtttgcgcactgagttcaagggttttggggctgtatgttctttgtggtaggatcagtgatggtgggaacttgtttttcgggctcgaattgtgcaatgctcttccttggaattggatgataagagggctttacatgttgggttggtttgattttgccttgctgttttacttcaagatgttgggtagtaatgtttcacctgacaaatacacgttcccttatgtgattaaggcctgtggtggtttgaataatgtgccgttgtgtatggtggttcataatacggctcggtccttggggtttcatgtggacttgtttgttggtagtgctttgatcaagttgtatgcggataatggttatatttgtgatgcaaggcgggtgttcgatgaattgcctcagagagacaccattttatggaatgtcatgctccatggttatgtgaaaagtggagattttaacaatgcgatggggactttttgtggaatgaggacctcttatagtatggttaattcggtgacgtatacttgtattttgtctatatgtgccacgagagggaaattttgtcttggtactcaggttcatggtcttgttattggtagtgggttcgagtttgatccacaggtagcaaacacactagttgccatgtattcaaagtgtgggaacctttttgatgctcgcaagttatttaatacaatgccacaaaccgatacagtgacttggaatgggttgattgctggatatgtacaaaatggatttacagatgaggctgcacctttgtttaatgctatgatctctgctggtgtcaaaccagattcggtcacttttgcaagtttccttccttctatccttgaatctgggagtctcagacattgtaaggaagttcatagttacatagtgcgacatagggtgcctttcgatgtctatttgaagagtgctcttattgacatatacttcaagggaggagatgtggagatggcacgcaagattttccagcagaatactttggttgatgttgcagtttgcacagctatgatctcaggttatgtgcttcatgggctgaatatcgatgctataaacacttttaggtggttaattcaagagggaatggtgcctaattccctaaccatggctagtgttttgccagcttgtgctgctttggctgctctgaaattagggaaggagttgcattgtgatattctaaagaaacaattggagaatatagttaatgtgggatctgccatcacagacatgtatgcaaagtgtggaagactggatcttgcttatgaatttttcagaagaatgtctgaaacggatagtatttgttggaactcaatgatttcaagcttctcgcagaatgggaaaccagaaatggccgttgatctttttcgtcaaatgggaatgagtggagccaagtttgattctgtgagcctatcatctgctctctcttctgctgcaaatttaccagcactatattatgggaaagagatgcatggctatgtgataagaaatgcatttagttctgacacttttgttgcaagtgcactgatagatatgtattctaaatgtggaaaactagctttggctcggtgtgtgtttaacctgatggctgggaagaatgaagtttcatggaacagcatcattgctgcctatggaaaccatggttgtgctagagaatgccttgacctattccatgagatgttaagagctggggttcaccctgatcatgttacctttcttgttataatatctgcttgtggccatgcgggcttagttggtgaaggcatacactactttcattgcatgactagagaatatgggattggtgctaggatggaacactatgcatgcatggtagatttgtatggtcgtgctggtcgtttgcatgaagcatttgatgccataaagagcatgccattcactccagatgcaggtgtttgggggacattgctgggagcttgtcggctccatggaaatgttgagttggctaaattagcttcaagacatcttcttgaattggacccaaaaaattctggatactatgtattgctttcaaatgtacatgccgatgctggtgagtggggaagtgttcttaaggtgagaaggttaatgaaggaaaaaggagttcagaagatacctggatacagctggattgatgttaatggtgggacccatatgttttctgctgctgaaggaaaccatccagaatctgttgagatctatttgattctgaatagtctccttcttgagttaagaaaacagggttatgttcctcaaccttaccttccacttcacccacaaatcacgggcaataattga

SEQ ID NO: 81485 - DNA, 164 bp, Glycine max
  Peptide Sequence Number=SeqID_198263
atgcaaggtgacatgctaatggtgagaaggctcttgggaagtcagatgcagccactggacgacacccaaagagaaaatatttttcacagcaggtgcacaattaatggtaagctttgctctttaattgttgatggaggaagctgtaccaatgttgctagttccag

SEQ ID NO: 81486 - DNA, 270 bp, Glycine max
  Peptide Sequence Number=SeqID_198264
atgatgagaaaggaagggcaggagatagatacatggactgagatgagaagggttatgcaaaagaggttgtcccagggaagtttgactgtggaggagtactacaatgagatggggatgacactagtgagaaccaacatagaagaggaagctgaggacacaatggctcgttttttgaatggtctaaatcctaacattagagatattgttgaattacagaagtacgtgaaattggatgacttgctgcataagacagtccgggttgaacaatag

SEQ ID NO: 81487 - DNA, 756 bp, Glycine max
  Peptide Sequence Number=SeqID_198265
atgggattaaaaggcagagcacttgtagaagagaaattttcatccgagttatcgtctggagcatggtacacacaagatactcctaaacgtgatgttaaattaggaattaccataacacactttaaccgtaaggcttatgtgcttccttcgataaagcgtgttaagacggaactattagaagaccccttatacaaaggaaagattgattttacagtagtagacaactcgcagaatattacccaagaagaatcgatgggggttaacgtgatccctaataaaaatttaggcggttctggtggtttcatgcgtggactaatgcattataaagatgcaggaaactatacgcatgtgctttttatggacgatgatgcttcttgtgaaatcgatactatatgtcgcgcatttaatattctgagttttgcccaagaggattctacggcaattgcaggtgctctactaagagaagatataagctacctcctcattgaacaaggtgcttatttcgacagagtttgtatccccttatttcataatgaagatgtacgaagcaaatctactttaacgaacattgagcatactacgcgtcatgctggctatggcgcatggtggtttttcgcattccctcttgaacaacttaaacattggagttttccgttctttgtccgtggtgatgatgtattatttagcatgactaataatttccatattgttacttcaaatggtattgcatgctatggagaggatttttccacaaaa

SEQ ID NO: 81488 - DNA, 258 bp, Glycine max
  Peptide Sequence Number=SeqID_198266
atggtttcgaggtttcacatcgacaaaaatgtcaaggaaaaatgtaaatcactaattggtaaaaaaaatgtttgggagtatgtcttggatgcctggagaaatctggtagattgtccttcggaacaacagtttgatgaatgccttaagaagtttgaaattgtttgttcaccttggccaatggttgaatatgctcattgggctttaaaaagagtattacagaatagccttggagactatgtagtgtttgagatgccatga

SEQ ID NO: 81489 - DNA, 210 bp, Glycine max
  Peptide Sequence Number=SeqID_198267
atggaagaaaagaaggaattccctaaggaagaatttttaggttttaagtgtgtattagagtgctctgagactcggtatgtcttttttccttggcttgaccctctttttatagttgctggagtggacttggactacgtacttgcgctaagcctgcgctactcgcttaacgcgggtgcttgtattcacgctaagtttgtgttgctcgcttag

SEQ ID NO: 81490 - DNA, 471 bp, Glycine max
  Peptide Sequence Number=SeqID_198268
atggcatccaccacatcagcagttacatcaatgcttctttcaggatcaatgctaagctcagatggccttattcacccaaacatattggaaagtactgcagcactttcatgctcacagaacacagcagcaaccctctcagcttcagctccatttccaacaataactttggatctcactcaaagtgctaccaataattcctcacagctactacaaggagcaccacaagataaccaacatagcctcctttccccagttttggctcagaagtttatgtcatcagctacaaacatttttgaccagggaacagaaactgcttcatttgtggacacggtaaatgcagcaacagctgctatcactgcggacccgaaattcagtgcagctcttatggctgccataacatctattattggaggttcacattcaaacattaatggtactagtggagatatccaacatggcaataacaattaa

SEQ ID NO: 81491 - DNA, 249 bp, Glycine max
  Peptide Sequence Number=SeqID_198269
atggatagctcaaaagcctctgaattggcaatggatttccctcaatatcgtcgatcccaattgagtagcaacacttaccatgctctcattcacctcctctctcacatttctgcgtacaacgcttcaattcaacccctcaacattcccgtgttgttaattagcggaacgaacgctatagatgtagtagcgggtttcgccgttaatgcgattgcgacggcgccgtgttgcggaggcgcgtgggcgtttagg

SEQ ID NO: 81492 - DNA, 1302 bp, Glycine max
  Peptide Sequence Number=SeqID_198270
atggcagcggtagaatggattaagaaaaccaggaaaaagaatgttgattctgattttttggatcccaaggatcctataggcccgaaggatatattggaggtccaggaaaccattgagggggttggagacaaggatatggattttacttccaacaagatggtcctagatgatatagtgcatatgatgggaatagaggacatgtctacccaagcaaatggttttgataaggagcagaagctaatgattgagtttgagcaggttatgaaaggaactgaaaatcttatttgtgatagtggtttaatccccctgaatttgggattagataagacacacaatgatggtggtgaagctgagccgatggattaccaagtagaaatggaagagggagaaatttctggagacttgggaatagatggcaattcatttgatgtggcttctgcagatgctttaattttagaacagatggaagtagatgagtttcagaagcctgaaaatgtaactggaaacatggtatatccttctaagattgggaatcaagaaaaggaaaagggctatgactctaaatcttctttggtaaatgcacttcaagatgagaataatagtggaactgtggaagtaccaaccaaagaagatatccctacaccttcaaatatgtgcagacctgagttgtctccacttctgtacggaaatgcaaattggagcacaccacttaacaacaatcatggctctagttctgtccagaaaaaccactctagtaattctgcgggaaatcatccttccaccagtgttgaacataaggtgacaaacactgtacagaaacagccaagaccacctaaaagaattagtttcatcaatcttgcaaaattatcacccagccttagttcactgaaacaaagcacagtaacgaccaaggaaagtcctgttcaaattgggaccgtgaagagtaaagtgtatctcacaaaactcaaaacaagttttaaaaatgtgaatagggaaaatggcatcaagttgcctcagttattcaattctggtttgcctgagcaggcaaaatcctcactaaataaagatgattacaacaaagctaaagaaatgaaatcaaagcttccagagaaaacctcagtagatgtttttatgacggatcacagctatagtgaatcagttcaagagggtaaaatgtcatttgataattctcagagttcaaaaggtcaaaaggcactcttatcaactctagcttttgcagctgagcatgaatctgacattaagatgaaataccctactggtgctgaaagaaatttttgttga

SEQ ID NO: 81493 - DNA, 597 bp, Glycine max
  Peptide Sequence Number=SeqID_198271
gagttagagagggcaaaggcacctcctgtccaccttccaacatcgtggcactatacttcttatttccaaccgctgaaactcgggggcgacgacgcccacttctttgtccttcctcgtgatgataagttctctgctgtctatcagcccttgtacgtcctcttgtaccttagggcatccttttacattcaccggacatatttcacacgctgcatgatcatggtcaaacagagctgcctcgcacatcttgatatgtattgggaccaggggagttcgaacgtgctggacgttcaggatgacaccgtcttcatcacaatcttgtatcatgttaacagcaggcccatggacatagcagttttcaacgtcatgacctggggccccttggcggggagtaagtcagcatatttcatcgggattggatcaaagggtattgtggctgatggtattgctgtggaggatattgttgtggagggtattgttgtggagggtattggtgtggagggtattgttgtggagggtattgttgtggagggtattggtgtggagggtattgttgggggtaatgtggcctttgttggtgatatgatgggtttgggatag

SEQ ID NO: 81494 - DNA, 789 bp, Glycine max
  Peptide Sequence Number=SeqID_198272
atgaaagaaggttcaactcctgctggctctccagtgccaccgcgtcacgctccaaaaggttcgatctttgtggaaaattttcaaatggggtgctcacaaaaaggaagctttcaacttcaagcacccttcacagtcccacgaaatcatgggcctcgctgctcttgcaagtggggttgtttgaagaagccgaggacttgctcttcacggtggaaagtgaagaggacgggtcttgcatctagagtggcttttgatttggtggatttgggtgtcccattgactggtgatgaggtgagagcattggagaagattcaggaagcaaggaatatggtgaagaaggtgttggttcttaattctgaggttagtagtttggtttatgatgaaattgcgtctggatattgtgagaggagggacttcaaagatttggttagtttctttgttgaggtgaagtgtgcccctagtgtgaaggctgctaatagagttgtgaattcgttgttaacctatgggatgttgattggttggattggttggagttgtcgcgaagcgaagatgagaaatgcgttgagttgtttgtcagttatgctatcgaaaagccttgtgccgcatgtgtatacttataatgctcttataaggttgatgattgcgaggggggcactgcctgatatttcgactttcagagttcttatagcagggtattgtaagtctaggcggtttgatgaagtgaaaaaattgattcatgagatggggaactgtggattggttaaacattctttgatggagaatccgatttag

SEQ ID NO: 81495 - DNA, 297 bp, Glycine max
  Peptide Sequence Number=SeqID_198273
acatcacggctattcaaggagttcgccactctctttctcatgcccgttgtgtccgacgcaagggtagtgtgacggagagaaatccttcaacgcacggcgggcgtggcgctctgccttccgaaggtggcagcccctctgacctcctctttcttgccggcggtggtttggtgagggctaacatgttgagcattaagagggttcctactgtggtttcaaattatcaaaaagaagagacaggggaggctgctgctgccggtggatgtggtcgtaactgcctcaaaagttgttgcattcaag

SEQ ID NO: 81496 - DNA, 438 bp, Glycine max
  Peptide Sequence Number=SeqID_198274
atgttggtgtgcatgatccgcactcgtctctttgcagcggcacgggtgaaatcttgccccggtatgcatagtagctgtgtgatagcctccctctctggttgtgctcgcacagttggccgtcctccaatatcagggggtggcccaggaaccgtgcggatgtggagcacactgaaaatgaggacacgtagccctctaaaggtgagggcgtgcaaccctctcaaggcgaggttgtatagtcctctggaggtgagggcatgtagtgctctcaaggtgagggcgtgcagccctctgttggcgaggacgtgtagtcctctaaaggtgaaggcgtgtagccctctgttggcgaggacgtgtagtcctctaaaggtgagggcgtgtagccctacgaaggtgaggacgtgtggtcctctaaaggtgagggcatgtagccctacgaag

SEQ ID NO: 81497 - DNA, 414 bp, Glycine max
  Peptide Sequence Number=SeqID_198275
atggatctagttgattgtgttgttgtgaaagggcagagcgtcgttggaatcgttggcaaaaggagcaatttgattctcatggtggttttttgttaccgaattgtgggatcaatgccaacgctgctgtacaactcagacgtttccgtcgcaactcttgtcgcaatgatgaatttggaggttgcaaaatacggcaaagtcgtagggaccaacaaaggtggcggtggtgggaagaagaggaaagctaaaagtaaaggtcgcagtttggaagggagagtgaattcgaaaggcgaatgtggcaatggtgggttgagaataaatgctcctgatgatgctgcatcgagagacgatgctaagaatgattcgaaatgtctcttcaactcgacaaatgagaaaggagtagatggaagtaagtaa

SEQ ID NO: 81498 - DNA, 267 bp, Glycine max
  Peptide Sequence Number=SeqID_198276
atgaaggttgaaggcatatggaacgtgaatatgaagttccatgatggtgctattcgaactttctcaaatgcgaggtttgtaccttctgttgttgttaatatgatttctatggggaagataacgtcacaaggatacaagtatgttgatagacaagccttaaagaggaaccatgatagtaaagtgaagaagaaattaaagttttctaatgttgtagaagtgttaggagatacttccattggagcgggagtttgttcactttcaaattga

SEQ ID NO: 81499 - DNA, 459 bp, Glycine max
  Peptide Sequence Number=SeqID_198277
atgtgtcacacgttgtgtgcgtgcacttctctcgccagaaaagggccctttgtggggtcgctacgacagtgtgttgagttggctagttggctgcacatgtggatggtatggcgttcaagagggcagtgcactggtggtcgaacaggaccaacagtgggcgtggggacgttggtgaatgtcgttgaggaagcagagtccgaaggaatctcgatagccatgaagggagaggcgacggtagtggtcattggcaaaaggatgccaagacagctgccaaacagaagcaaaggtgtgtggtaccgcacgcacgtttgtgaagagagggaacataaccttagaagggcagaggaagttccaccagggacaaccacactaagcccaaaagtgttgggtgtgagaaggtgtgttggaaaaaacctaagccccacatcgactagaggtcaagatagagtatataaataa

SEQ ID NO: 81500 - DNA, 351 bp, Glycine max
  Peptide Sequence Number=SeqID_198278
atgaattgttgcacatgctttttctcctctgcagctcatatacctttatatctgtatcccttccttaatacaacaagcaagtcaagaccatttgagtacttgaggcttaccagtcttggtgtaattggtgcattggtgaaggttgatgatacagaagttataagtttccttctttcaacagagataattcccctgtgcctgcgcaccatggaaatgggcagtgaactatccaaaacagttgagttttctgattctttattcttagtctttggtgaacttatgccatcacattgtctggaaactttacttgaggaaagtgcctgtgagattattgtaaagccttctgaatag

SEQ ID NO: 81501 - DNA, 759 bp, Glycine max
  Peptide Sequence Number=SeqID_198279
atgacttctccgctggtggcggagggcgccgccatgacggcgttccggtcggtgatgctccgggtgcatcaggcggcggagagatccgggtccaaacccgagcgggtccgggtcgtggcggtttccaagacgaaacccgtcactctgattcaacaactctacgacgccggccaccgatacttcggcgaaaactacgtccaagaaatcatcgaaaaagctcctcagcttcctcaagacgttgagtggcatttcattgggcatttgcaaagcaacaaagtcaaaacacttttgggtggagttccaaatctggccatggtccagagtgtggacaatcagaaggtagcaaatcatcttgaccgtatggtatcaacccttggaagaaatcctctgaaggttttggtgcaagtaaatacgagtggagaagaatccaaatctggtattgatccttccaactgtgttgagcttgcaaaacatgtgaaattgagctgcccaaacctagtgtactctggcttaatgacaataggaatgccagactatacctcaactccacagaactttcaggttttctcctttgtgaaaaatcagaccctatcaaattgcagaactgaagtatgcaaggcacttgaaatgcccgaggaggaatgtgaactgtcaatgggcatgtctggcgattttgagttagcgattgagatgggtagtactaatgtaagaattggatccacaatatttggaccgagggagtatgcaaagaaacaataa

SEQ ID NO: 81502 - DNA, 430 bp, Glycine max
  Peptide Sequence Number=SeqID_198280
atggctttgtccatcgcactaacgatgaaaaccatcactcatcaagaggaagcaaaaccagcttttgtgcaccatgattttccctcatcatcatcaacccctcatgatcaaaagaataataatgtgcatcttccttccaagagggtgagtcgcttcctcgctcaagtgaaaaaccctaatgctgctgatcactgccacaaggaccacgaggtttgcaccttggtgggtgccaagaactcaacatgttgcaacaacaagtgcattgatgtagggtatgactaccacaactgtggcgcgtgcaagatgaagtgcaagttaactgatgcatgttgtagaggggaatgtgttaataccaactttgacaagaggcattgcggggagtgtaaccatcggtgtgaagtgggtgcatattgtgtctatggaatgtgcg

SEQ ID NO: 81503 - DNA, 294 bp, Glycine max
  Peptide Sequence Number=SeqID_198281
atggaagctacctgcaatgatatctctaatgttgcagttacacagtcttctccaacgatgtcgtttaatgggaaacgacttgtcgtggatgagatagatttcttcgcagagaagaagaagaagaagaaaagtgaagttgatgatcaaatggtgcatcaccaaatggagcttcctaatactagtttagatctccttattacaaatagtacttcaacgagcaatagatcaaatatggaagaagaactgtccgaggcaaaggataataccagaaataagtttgtagtagctagctga

SEQ ID NO: 81504 - DNA, 483 bp, Glycine max
  Peptide Sequence Number=SeqID_198282
atgaagattattatctcaattccattagagtatgtttggatggagaaatttaataggggagaggtgggagagggggtcaagttcggaatcagagaggggttggacgaggaagtggtgagaggagggggagatgcgggtgatgaggggctctggggtgccgaggaaggggtggcggccggcgagggggcggaggttggagacggaggggagaggggagtcgaagtggaagcgatcgacgtggacgaactggccgagctggaggcggttggagaggatgaggtcggtgtcaaggtgggagaggaggacgtaggtggagttaagggagtcggagaggttggagccggcgagagcggggacgatgctgatgacctggaggagaggggagcggtggtcacaggtgacgcgggtgttggtgttcatggcctgcaacattttcaggagaatgccttgggtgagggaagccgttgctattgctctgagtga

SEQ ID NO: 81505 - DNA, 571 bp, Glycine max
  Peptide Sequence Number=SeqID_198283
atgtacgattaccatgaggaagaaagagcccctgatctagaaagtattttggcagacttcatgacataccaagctagctctaaaggttactgttattttatgcaacagcagggaactcaatttgaaaggaaccagtcttctgcaggttatcaatgggagtcataccggcaatctgattatcacaataaagcagaaggaattcttaatttggatgatctgttaatgaaattcaaagatattgtagagtcaatacaagatgcctttagaagaactgaaactcagattagtaagttggtggatgacatgactaacgctgcggctaggaaagaggaagagcgtgtagagattgaaatacatcaagaaaacattcatcaagttacctccatctatcatcaattgaccaatgaagaggaaaagcctgaagtctccagtactccagaatatccctactgggccactgttggctatgttggagggaaagataaaggtagattggaactcagtgtggaggatcaaaagatctcttttgacatctttgaggccacgaaacactcagatatgggtgatgcct

SEQ ID NO: 81506 - DNA, 726 bp, Glycine max
  Peptide Sequence Number=SeqID_198284
atgggactgcaggtcgtcaccttcagagggttacgcgccttcacctttagaggcatacacgtcctcacctttataaggctacacgttctcaccttcagaggactacacgtcctcgccttcagagggttgcaccctctcaccttcataggattgcatgtcctcacctttagagggctacgggccctcacctttagaggactacacgtcgtcaccttgagagggctacccgctcttaccttcagaggactacacgtcctcaccttcagtgggctgcgtgccctcaccatcagaagactacacgtcctcaccttgagacggctacacgctcttaccttcaaagtattacacgtcctcaccgtcagagggctacacgctcttaccttcagaggactacatgtcctcacctttagagtgctacgcactctaaccttcagaggactacacgtcctcactttcagagggctacatggtcttaccttcagaggactacacgtcctcgccttcagaaggatgcacgctcttaccttaagaggactgactacacatcctcaccttcagagggctacaagctctaacctacaaaggactacacatcctcaccttcagagggttgcacgccctcaccttcagaggactgcacgtcctcaccttaagagggctacgctccctcaccttaagaagactacacgtcctcaccttgagagggctacacgctcttacctttag

SEQ ID NO: 81507 - DNA, 303 bp, Glycine max
  Peptide Sequence Number=SeqID_198285
atggtccatcaagatgataggttagtgtcatcaacaaacttaaatttggtgacacagtccaacacaagctcctatttaccaaactatggttggtgtctaagagaactttccaatgaaaatggccgattagaagcatcacaacaagtatccaaatatacaagtatagacaacagcacaaacaaacacgatgaagagcaatacctctgttcggccaggcattattggctttccagcaagcagctctgccaaaatgcaaccagcactccaaagatcaataccaacaccataaactgtagcccctag

SEQ ID NO: 81508 - DNA, 1407 bp, Glycine max
  Peptide Sequence Number=SeqID_198286
atggtcagcataggcaactatgaggtgaacttgttagctagagaagacatagaacatcaactgtggcgtgttaatggtttcggaggaaatggatattcatcaaccgtctttaatgtcatcagtgatgcaactgaagcttctgagtcacaagttagaaaacagttattgtcacctttgaatgggatgctgcttgcggatcattttaaaggtgatccactagacattggtgctggtatttatcaaagtcgttcaaaggctggtgatcataattctaatgctttacatgagtataagaaggatcatattggaaacaacaataagattcattcaatgatctggactacatcttgttttcaggaatttacaaattcatcctgtaatgacaatactataaaccatattgtatctagtcatcaccaacgtgcagagccatggtctattaagcattttaaatcatctccagtacgtaatgcttctgaagaaacaactaaaacaaggtcccaaacagctgcattgtctataccacaaaaaaatgtgtcatcacctaccttccctttgtctcctctgggtaaaaaatcttctaaaaatgaaaatttgggagaatgcagaaatattgatgttatcttggacaatgacaattttacttttaatagtgtggaacagtcacttgatagaacttgtcaaggcatttcatcagcacaggagataccaagtacatcacagctcaatttgaacaatatgcagcaaaagtctgacctgtttactcctgacaacatgattaatatgaaagagtattggactcattctggtagctttcctccttgggatgccaagttacgtggaactatgagtagactgccaattagaaggtccttggttggttcatttgaagaatctttgttatctggtcgcttactatctgggaaagttagtcagaaaattgaaggctttcttgcattcctgaatgtaactggcggcaatttctcacctcaatcacagaaaataccatttgcagtaaccagcgtggatggagacaagtatttactttattattcatcaattaatctttcaggaaagctattatcaggcaagtctagagttgctaaatttcagagaacccttagcatggatgaatctcgatctgaaaagccccatatacgtgtacctatgaaaggacgtattcaactggttctcaccaatccagagaggacacctatccataccttcttttgcaattatgatttgagtgacatgccagctggtaccaaggtaggattgggatacaatccgagttttaaggagtataatcgccaattggagcaacttgctgtaactatacttgcattatacctcggcctcaatattaaaggcctatgcttgtgtgatctctgttcgaacagctgttaa

SEQ ID NO: 81509 - DNA, 651 bp, Glycine max
  Peptide Sequence Number=SeqID_198287
atgggatcgagccaagcgccttcgcttaaaaagaggttctatcaagtcaaggtcaagagcctaagaatcaccagtctaaaagagttagggcagttgatgggtcagcttcagcgacaagcatttcgcaaagcttacgaggccattgcctccctcgccctgtcttatgaccagccgttgaggtgcttcacttttggggacttccagctatcacccatggtggaagaatttgaagagatcctaggatgccctctagggggtaggaaaccatacctcttcttaggattctatccctctttagctaaaatttctaagatagtccaaatctcggcgcaagaattagaccacagaaagcaagtcgaaaatggggtggttggagtaccgagaagatgtttggaggcaaaggcaaggatcttagcagcgatcgacgcttttcttgcctatcacgaccccaaggaaagctcggttgtcgctatactagccgatctatatgacaccttcgaccgaagatgtgagaagagcagtgcaaggattgtttgctgtactctggccctctatgtatggttggtttcacaccttttttgccaagaggtgaggcatgactgccccctagaaagccaccgttcatgcacagagaaaagaggggcaaattag

SEQ ID NO: 81510 - DNA, 796 bp, Glycine max
  Peptide Sequence Number=SeqID_198288
atgtgtgcggattaccgtatagggcatctccgcatgctacctaacttctcaaaggtcggggtagcagaactgtgtatcttcgcctgccacctgacttcacgtgtcaggattaataaaagttgtctttgtacggaaaaccacttgggtatctctgcctgccacctcacttcatggtcaggattaacagaagttgtatgtgagactaaaaagtctcgaccggaagatgctgacatctccagaaagggtgtagatgagcacattggtgcggataaccgtaaggcgtctccgcatgctatcggattctcgggtcactggatagcaaaagtgtgtgggcagataaccatcgggtgtctctgcatgccaccgaactcttgggtcacgtctcagccggaagacgctgacatctccggggaaggtgcagatgatgactctcggccggaagatgctgacatctccgggaaaggtgcaggtgacaactctcggctggaagacgctgacatctctgggaaaggtgcaggtgacgatatagcaaatgagactttttcgcagtcccgattgaaagacgctgacatctccgagaatggtgcaggtgacgacgtgatgacgttagtcactgtatgctaccggactttgagtctgacggatagcgaacgagtgtgtgcgggtttccatatagggcgtctccgcgtgccaaaggactcacaggtcacgatagcaaaaggtggggcgatcgagaaaagcgaggcttttgctccaacatatcctcaatttgtgatgaggaactcagacctacgta

SEQ ID NO: 81511 - DNA, 234 bp, Glycine max
  Peptide Sequence Number=SeqID_198289
atggttacttccatgcttcaacttgactcgatgaaccttttcataaaagcacgagcttggttcaaccccataacccagggaatggcaattttgatcgccaatacttcatcaacaattcatagggatgaaagactcgggaatatgcatgctatgcatggaaaattgaaatgggtttatgatcccaacatgggtaaaacgcaggggtcacgtatgagcaaacatgtagaacaaaag

SEQ ID NO: 81512 - DNA, 364 bp, Glycine max
  Peptide Sequence Number=SeqID_198290
gatcatggccacagatccgacgtctcctccgcagtccgatggtcaatcagaggcgacttccaagaggagtagaacaacgacacggctgagaacattgacattaagaaccgtggatcagcccagaccggctgtttatgtggatcccgctaccgggagagcatccggaccgatgcgtgaaaagttccacagctacctaggcgtagtggcgcgagaaaaggttcccattatccacaataattggaaagacgtacctgaaacgctaaaggagattgtgtggaatgacattctattaatcactatcctagacttctatatttgtaaagaacagcacaagggcagtttttattttaaacatgaatattag

SEQ ID NO: 81513 - DNA, 132 bp, Glycine max
  Peptide Sequence Number=SeqID_198291
gtcaggtcttctatcagctttcgaacacccggtaacaatagtgcactcgaccctttatgctctccaatgaaccgagatgagggatatgagacaacagcgggagatagctgccaaactaccctcaagaattag

SEQ ID NO: 81514 - DNA, 435 bp, Glycine max
  Peptide Sequence Number=SeqID_198292
atggcgatggaacgcgtctctgaatttcctcacacttatatggatcgtcgcccgagaaaaagagttcccaaggttgtagatctgatgaaatttgtgtacattggttatgtttgcttcagtttccatggttctctaaatcatggagacggaatgcatctccgaatttcctcacaagaaggatccagtaggaaagtaacactgatcttgcctattgaatgttcttttcctattgagaaaacccatctcttctttcttcagttttcttcagcttggtggttgtgcaacgtgatgatgaagaagcatccagcaggcaaatttttgctgctccatggttttgcaacgtcactcgcgaggaagtatccagacattgactcatattcttgcacatcagcaaagggccgcactcttccgttccaccattcccctgcaacgtaa

SEQ ID NO: 81515 - DNA, 177 bp, Glycine max
  Peptide Sequence Number=SeqID_198293
atgtcgtacagcttcatcttgcgccacagcgtggtacggccaatattcagcaactgcgacatctcctgtacccggccgttagtcactcgcgccgcctggataatcgcctctttctcgatggcgctgaaggagaggctcgacggcagtagcgatgaggccgtttcgctgcccggccgg

SEQ ID NO: 81516 - DNA, 171 bp, Glycine max
  Peptide Sequence Number=SeqID_198294
atggcctctgtggagacttctaccagggctaagtcccagattttacctgtgaaaaatggcacgctgcgtgtccgctccgtgcccctattcaagggacctatatgggagggagctaacaaggcttttagtgataattcccaaggtggtcatatctctcttgatggtctctag

SEQ ID NO: 81517 - DNA, 732 bp, Glycine max
  Peptide Sequence Number=SeqID_198295
ctgaacgatgcggaagatcaggctgagcgtttcctgcagcaggttaacgcgaaggacgccggtgatgacgaagcgatgttctacgacgaagactacgtcaccgcgctggagcacggtctgccacctactgcgggtctgggcattggtatcgaccgcctggtcatgctgttcaccaacagccacaccattcgtgatgtaatcctgttcccggctctgcgcccgaccggggacttgcctgtaccccggtgggagagggccgctgtggttttctccctctccccgtggcagaaggccgctctggttttctccctctccccgtgggagagggccggggtgagggcaccagaaatcaccatgagtgcaaaagcggctacgttagagggtcggattcgtcagcactgggatcaactctccagccacgagcagcgacttgccgatgtactgctcgccgcaccgggccagttagccatgaacaccgccactgaactggcacacagcgcgggcgtgtccaaagccaccaccacacgcttctttcgccatctcggctacgaaagttatgaagccgcacgtcggcaggcgcgtgaaatgcagagcagtggttcaccgctctatctgcaaccggtacccagcgcgtcgccgctggccagcatcatgcagcagcatctggagaaagagatcgccaacctggttaacagctatcgcacgctggacagtgaacagttgcagcaggcg

SEQ ID NO: 81518 - DNA, 863 bp, Glycine max
  Peptide Sequence Number=SeqID_198296
atggacatcacccgtgaactggaagcgccggcgcagatcgtccccggccagccggttcgggtggcgatcacctggtggaccgatagctggtttaacccgccgccgcagtggcccgagtttgccgtcaaaaacggcgaactcctgaataccgcgttgccttcacagctggtgacgcgcaagaagaacgggatcgtctggagcggcattcgccttgaacgtcaggtcagcgcctggcagcagggcgtgctacgcctgccggcgatcgacattaccgcgacctccgccgatcaggctccggtcacggtacatcttccggcgctggaacacccggtaaactggccggccaataccactcaggcggaccattttttaccggccagccagctgacgctcagccagcaaattcaacagtaccacgcggggaaagacgccacgctgcgggtcggtgatgtcgttgaccgtatcgtgaccgtcgaggcgcaggatgcgctgccggggcaaattccaccgctgctgtacgccattagcggtagtgaaagccagcgtctggcgccggtcagtgaggcattaaaaagcgagcgcggcgatgtcatcggcgctcatcgggtggagcggctgcgttatctgcccagccatagcggcacgctgacgctaccaccgattagcttgcgctggtgggataccgttaatcatcaatggcaaacggcgaagctggcgggagaaacgttgaacgtcgccgcggcgcgacagggcggcgcggagcaagcgctgcgcggtaccacgggaatggtcacctggcagagcctgatgtggatagtgattgccgctgccgcggccggtgggggatggtttggccgccgctg

SEQ ID NO: 81519 - DNA, 657 bp, Glycine max
  Peptide Sequence Number=SeqID_198297
atgatcgcgccgatgctgttcctgctgctgttctggcgacgccagttactgatggtagcgctactatttcccgcgctgctgtggtcgccgcacagcgatgccgcctggctcgatgcctgggttcgccccgatattcaggggcagcacgcctttcgccgcggcgactacgccgctgccgccgggcattatcgcgatccgttatggcaaggtatcgcctggtatcgggcgggcgactatcctgccgccgccagcgcgtttcgcgccgcgccgccaaccgcggaaaccttgctgtggctgggcaacagctatgctcagcaaaagcagtggcagcaggcgctcgacagctacgatcgcgccctctacctacatcctgactggtccatggcgctgcaaaatcgcgataaaatctcgcagattgtgatgggcattcgccagcaagagcgcgagcgccaacaggcgcagggcgatgcgatggacgatggcccggataaggtggtccacgacctgcagaaaaaccagggcatcaatcagcagcaaatcggcgctatcgccggggagagtccgcaggttaatcaatggtttgatgcgctggaggtttcgccaacggggctactgaaaagcctgtatcgcaacggctcgggagataccacgccatga

SEQ ID NO: 81520 - DNA, 367 bp, Glycine max
  Peptide Sequence Number=SeqID_198298
cgtctcgatatattattggcctgaatcagacatccacgtcaaagattatggccgtttggatttcccttgcgctttcaccatcttggcatattatgctcctaaatctgacatccgagtgaaaagttatgacaattcgaaatattatatgccagaatcgtgtagaagcaatgacttccaagattattttgatgatgccaaagaatcaagagttaagcaagttccaaagaagcaggagtcaaaatgcttcaagaatcaagtttcaagattcaagattcaagaacaatcaagtttcaagaatcaagattcaagaacaatcaagattaagattcacgactcaagattcaagaatcaagagatgactcaatga

SEQ ID NO: 81521 - DNA, 885 bp, Glycine max
  Peptide Sequence Number=SeqID_198299
aacgccacgcgcaccgcggcgctgctgtccggcgagatcgacttcgtgctcgacccggccgcgcaggatctggaccgcctgcgccagtcggccaaggtggtcgagggcaacgagtaccgcaccatctacctgggcctggaccagaagcgtcccgagctgcagtattccaacatcaagggcaagaacccgttccaggacatccgcgtgcgcgaggcgctgtaccgcgccatcgacgtcgacgccatcaagcgcgccgtgatgcgcggcctgtcggcgcccaccggcaccatgatcgcgccgcaggtccacggctggaccgagtcgctgcacaagcgcgtgccctacgatcccgaaaaggcccgcgccctgctcaaggaagccggctacgatggcaccctgaacttcacgctcgactgtcccaacaaccgctacatcaacgacgaagccatctgccaggccgtggtcggcatgtgggccaaggtgggcgtgaaggcgaccatgaacgccatgccgcgttcgacctacttccccaaggtgcagaactccgacaccagcgcctacctgttcggctggggcgtgccgacgttcgacgccatgtacacgctgcagaacctgatccgcaccaagggcgagggcgcggacggcatgtacaacctcggcaactacagcaacaaggaactggacgcgatcatcgaccgcatcaagaccgaaaccgacgcggccaagcgcgacgccgacatccacaaggtgctggaagtgcatgccaaggaattcggccacatcccgctgcacgaccaggtcattccctgggccatgcgcaagaacgtctcggtgatccaccgcgcggacaaccgcctcgttgccgactgggtcaaggtcgactga

SEQ ID NO: 81522 - DNA, 141 bp, Glycine max
  Peptide Sequence Number=SeqID_198300
attcgtcctcgtgctcagacgagcagtgttgcactcagcggatggctcgctaagccagaagattggcttagcgagagggtgaaaatcagcacttcacaaacttgcccaattaacctgaaattgagaggaaatgattattaa

SEQ ID NO: 81523 - DNA, 150 bp, Glycine max
  Peptide Sequence Number=SeqID_198301
atggagttacttttggaattttgggtgccactcttgaaaaatgctccacctcattatgttgttgttgatccaggatatgtgcatggaaatgatgcatggaggagacaaggctcagtgttaaatggtttgatgaggcaagtaggcttgtag

SEQ ID NO: 81524 - DNA, 168 bp, Glycine max
  Peptide Sequence Number=SeqID_198302
atgctcattgattatgtgaagttcctacagctccaagtcaaggttttaagcatgagcagattgggcggtgcagcggcggtggcaccccttgttgctgaggaaaagaatgcacaccctaatagtctactaccattttgtgttagcaaagcaaagtgcgagacacggtga

SEQ ID NO: 81525 - DNA, 420 bp, Glycine max
  Peptide Sequence Number=SeqID_198303
atgacaatatcaacatcgttaggacatttacaaagaattaaaagaagagaagaacaacagcaccatgtacaggaattggcacagtcgacgaaagcaaaagctgcagaaaccctaacttaccagaagttggggaaaacagaagccccgacgacagaagagggtaggacgccagctgcgaattcagacacccaaacggcacaggcaaaaacggcagctgaaacggtgatggtgcttacgacggaaccatcgcttgctactgttgttgttcttgttgaggttaaacctgaggtggtggaggtggagatgggtgactcaacaggcgtgtggacggtggggaacgacggtagaggagataacgatgtgggaggtatggaaaaaacagagaagctgttgaaggtaatgacggcaaaggaagcttga

SEQ ID NO: 81526 - DNA, 255 bp, Glycine max
  Peptide Sequence Number=SeqID_198304
atggaggaaagctttggaaaggtcgtgtggggagctttgtctgtattgtgtgttatgtttgtgaaggatgagagatgtggatcttcatatgatgtgttgatgagctcatgtagtttagtttactatcgtcaagtaccattaatagaagaacatgcacaaacctgtaaaggacaatcccaatggggaatgttgttgaggaatcagccctcaaaagcgatgtatgactgcaaattggtactcgaggattgcaagtga

SEQ ID NO: 81527 - DNA, 156 bp, Glycine max
  Peptide Sequence Number=SeqID_198305
atggctgatggcatggaatcatctggtatgggtactggagatggctctggaatctggctcctaggctgcggaagccccactccctccagaaggagaaggctaggctcttggctaggccacctgcgtgtcaaactcatccatgctcatgatggatga

SEQ ID NO: 81528 - DNA, 396 bp, Glycine max
  Peptide Sequence Number=SeqID_198306
atggatacccgcatcacccagcttgaagaggatttatatcatcttgtgttggttgccacgaactttggctttttgatgttgccaaagggggagagaaatggggtggaattaaattgtcatcataaaaaaggaggagattgtagaagcaaagactttgcctttgatgttttgatgatgccatatgatcatgatgttttgatgccttatgaaaatgcacttttcaagtttaattcaagacaaaaatccaagaataacggatacaacaacaagaagatctctagtgttttaggaagggaattccaaattgaaactgcaaaaggtttggccaagaaatttaagcaaaaatgtctttttcaagagatttactctctggtaatcgattaccagaggatgtaa

SEQ ID NO: 81529 - DNA, 763 bp, Glycine max
  Peptide Sequence Number=SeqID_198307
gactacacgccctcgccttcagagggctacacgccctcgccatcagagagctgaacgccctcgccttcatagggctgcatgccctcgtcttcagaggactacacgtcctcaccttcagagggctacgagccctcagtttcagaggactatgcgtcctcaccttcagaggactacacgtcctcgccttcagagggctacacaccctcaccttcagaggattacacgtcctcgccttcagaggactacacatcctccccttcagaggatacaagtcctcaagttcagagggctacacacgctcgccttcaaaagactacaggtcctcgccttcagaggactacacgtcctcaccttcagagggctacatgcccttgcctttagaggactacacgtcctcccctttaaaggactacatgtcctcgcaattagagggctacacgtgctcgcctttagagggctacatgtcctgaccttcagaggactacatggcctcacctttagaggactacacatcctcgctttcagagagctacacatcctcaccttcagaggactacacgtccttcccttaagaggactacacgacctccccttcagaggactacacgtcctccccttcacagggctacacgccctcgcctttagaggactacacgccctcgccatcagaggacaacacctcctcgcctttagagagctacgcgtcctcaccttcagaggactacacgtcctccccttcagagggctacacgccctcgccatc

SEQ ID NO: 81530 - DNA, 357 bp, Glycine max
  Peptide Sequence Number=SeqID_198308
atggagaattatgagaagcaaatgaaggttctagcggagagactaaccgagatgatattcaacttgatggacatagtggggaaaaaagaaaagaacaaaagtaatattgtggatgtcttaggacatgcaggaagtcttgcctcattgaaggctgcttttgaaaaattgtctggggagaaaagagctaaagaaaattgcagtactccaggtgcactgccgcacaacgtgcaagtagatctggaagaactggacttggacactgttactgtctctattcttctgcagcctttagtaatgaatttcacgagcactctcctgctgaagttgacaaagtccatggtgttgtccttctcttga

SEQ ID NO: 81531 - DNA, 717 bp, Glycine max
  Peptide Sequence Number=SeqID_198309
atggttttgatgatgggggtggtttattggcagcctcccaaggaagcattggaaaaggtgaaagaacttgtatctgagactttaattagtcgttatggtaacgatgaaggtgcattattcattccaaatcatgaatgcttttgtgctttcaactgtttccctttttgttttgttccgtttttccaacgagtctctctaaagtcacggccaacatcggtagtatatgagttggcaatcgttgatttggaacacactggtttagctccagttggcataatattaattgggtgcttaacatctaaaattagtaaaggagatatgaacgaccctgaagtatttccctttgtattacttgggaacaaggttgatatagacagtggaaacagtagaagggtcaatgagaaaaaagctagagaccgatgtgcttcccggggaaacatacccccttcttttgcaatgattattatattttcatacattgtcaatgagaaaaaagctagagaccggtgtgcttcccggggaaacatacccccttcttttgcaatgattattatattttcatacattgtcactgagaaaaaagctagagaccggtgtgcttcccggggaaacataccatattttgagacctctgcgaaagagggctacaacattgaagaggctttttcatgtgttgccaaaattgcactagaatatgaacatgatcaagacatgtga

SEQ ID NO: 81532 - DNA, 240 bp, Glycine max
  Peptide Sequence Number=SeqID_198310
atggttggagatgaagaccttgatgagaaaaaggatttgaagaattgtttcgaaagaaggaaagcaaagcatcaaatgaatatcaacttgagttttcaaagacacttgatgttacaactaagcgacattgtcctttccaagtggttgaaaagatcaatgatactgcttataaactccaatttcatggcttcccaagttgtcatagtgattagtggggttttatttctagtggaaatttaa

SEQ ID NO: 81533 - DNA, 118 bp, Glycine max
  Peptide Sequence Number=SeqID_198311
atgtctagaaagtatctcgattggatgggaatccatagagaaatactaaatcgtcccatatcgaatccagaatttcggtacttttcaaaatttgtgatatcttatgacgcatataggg

SEQ ID NO: 81534 - DNA, 315 bp, Glycine max
  Peptide Sequence Number=SeqID_198312
atggccaacaaaaacatatcatccaatgaaacataccccctcacagttattcccaaaacaattccaaagctccaaaattccttaagggtaggaaaggggaacataggctcaaaggggctatcaaaggaattaattcaaggtaggctcatttggctagaggcttataagaacaaaatgcctaaatcatctcccaacatgcatgtgaagcaagaagtatcaacaagagtcaagccaaggctattgtgcaagcaatcaatggggcaaaacacaccgaataaaatagatgatgatggctcaaattctcgccaagggtaa

SEQ ID NO: 81535 - DNA, 769 bp, Glycine max
  Peptide Sequence Number=SeqID_198313
cagagggctacacgccctcgccttcagaggattacatgtcctctcctttagagggcttcatgccctcaccttaagaggacttcacgtcctctccttcagaggactacacgtcctcgccattataggactacacatcttcgccttcagaggactacacgtcctcgccttcagcgggctacacatcctccccgtcagagaactacacgtcctcgcattcatagggcttcatgccctcaccttcaaaggaattcacgacctcgccttcagaggaatacacgtccgcgccttaagaggattaaacgtcctcaccttgggagaactacacgtcgtcgacttcagagggctacacgccttcgccttcagaggattacacgtcctcgccatcagaggactacacgtcctcggcttcagagggttacacaccctcgccttcagaggactgcacatcctcaccatcagaggactacataggactacacacgtcctcacctttagagggctacacgtcctcgccttcagagggctacacgtcctcgccatcaaaggactacacgtcctcccgtttagaggagtacacatcctaaccttcagaggactacacgtcctcgccttcacagggctacacgccctcagcttcagaggactacacgtcctcgccatcagaaggctacacgtcctccccgttcacaggactacacgtcctcgccttcagagggtttatgccctcagctttagaggattacacgtcctcgccatcagaggactacac

SEQ ID NO: 81536 - DNA, 334 bp, Glycine max
  Peptide Sequence Number=SeqID_198314
ccgaccgccgatcacccgtgccttcattgaaaagtattgctcgcctaggcaggcacagggtgatgcatcgcaggccacagatgcaccgccaccacctcatcaggctaatcctgctggatcattaggcatggggcagtatctacaacacttggttcgccaacaggaggccaaccactgggggcagtttagggctgaggtcgcatggcccggagattggctcgaggcccaggcaggggaggctcctgcaggagctcccggcgatgtagaggaggcccgcatggacgaggagatgatgaacttgctcgatttcttgggaggaagcggagctacgtga

SEQ ID NO: 81537 - DNA, 765 bp, Glycine max
  Peptide Sequence Number=SeqID_198315
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcttgcgccaatgtggtgaccacatatgcctccatgtatctctgccaacagctgttgtccatcttcccggcgaatacacttcaatttcactccgttgagtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 81538 - DNA, 723 bp, Glycine max
  Peptide Sequence Number=SeqID_198316
atggtgaattcgggagcttcccctgtccatagttttgcttcggcagtggacaatgcgatgggtagtattgatggagatttgggagcatttcacgtgcatggttttgcttcggcagtgaacaatgccatgattagtactagtggaagtttgggagcattgcctgtgtatgattttgcttcagcagtgaacaatgccatgagtagtactagtggaagtttgggagcattgcctgtgtatggttttgcttcggcagtgaacaatgccatgattagtaccagtggaagtttgggagcattacccgagcatggttttgcttcggcagtgaacgatgccatgagtagtactagtggaagtttgggagcattacctgtgcatggtttttcttcggctgtggacaatgctataagaagtagaagtagagcagatttgggacgatccagttcccccgtgcatggttttgctatggaagatgtttgtggttcattcagactggcagagcttgtagcagcaaccaacaatttctcacgtgacaacatgattagccatggcagaattggctttgtgtacaaaggcaaactctttgatggtcgtgaggtggctatcaagagggctggaaccagtacttcaaacattaaggagtttcaaagcattacacttgggcctttattcttgaccaattgtctacaccacaagcacttggttcggcttctctgggttgtgtga

SEQ ID NO: 81539 - DNA, 219 bp, Glycine max
  Peptide Sequence Number=SeqID_198317
atgactcgattagtatcaggaggacatcttagagttggaccgttacgatttcttgaagcaagacttaagagtcaagtatacgaaagtgagaaagatcatgttgaaggaagaggcttagactcaagggtaggcaaatcatgtattctcgatagtcattgtgaactaggattggtggagcgtgaaagtctcgacacttttttttctttcttcctttcttga

SEQ ID NO: 81540 - DNA, 458 bp, Glycine max
  Peptide Sequence Number=SeqID_198318
atgagcgtccatgtggctcagttgatcgctgacgccatttatttatttgcaggtatgccacctaccaggcaccctctagaaccagataagtctaacagggccttggggtttccagcattgatcacgggtctctgccagtcattcggggttcccgtcacacctagtagggtgattcgaccgccgatcacccgggccttcattgaaaagtattgcacgcctagacaggcgcagggtgatgctctgcaggccgcagatgcaccaccaccacctcatcaggctgatccagctgggtcatttggcatggagtggtatttacagcacttggttcgccagcaggcggccaaccacagggggcaggcaggggaggtgcccgcagaggctcccggcaatgcaaaggaggcccgcatggatgagaagatgacagacttactcggtttcttgggagggagtggagccac

SEQ ID NO: 81541 - DNA, 138 bp, Glycine max
  Peptide Sequence Number=SeqID_198319
atggagtcaggtggcaggcggagataccttgtggtcatccgcacctttcgtcaaccgaggcgaactaatccgacggtttttactctagttgtctggaggcattcaagctcgatgacgcacgagattcttctctgttga

SEQ ID NO: 81542 - DNA, 430 bp, Glycine max
  Peptide Sequence Number=SeqID_198320
agtggtacctggagatatgtcgcgggggtcaggagaccttggggacgtcaggcgagctcctggcagtgaaccaataaaagaacaaagaccacaaagcaaggaggcttgtgtggtggctggccagctatggatcttgagtgatatctggaatatggcctctggtaatcgattaccaagggatgttgatgtggcctctgggagtttgggagaccctcgaaggcaatacgaggtgccgattccgtggcacgatccgactcactgctacttcattggtacatccagaggaacccgcacgcacgcttcagcgaactgtggagtggatactacctacacctactccatatcgactagtggagccagtccaagtgatagagagcctgcagtggatgctcttgactttccagagggtgatgaggacccactccctgat

SEQ ID NO: 81543 - DNA, 330 bp, Glycine max
  Peptide Sequence Number=SeqID_198321
atgccgaggcaagctggttgcttctccctcaagtcttataatgggcccaggtgggcccagaggctgaagaatgtcccaaaatggaccattttgcccttctttgagtttcttgcccatttccttccgaaacatcgtgaaaccttacggattgcgcaacaattggaaatgctcttagaggggagaaaagacaatggagctattccaggttcaagggcagcaaatatgtatggctttgacgttctagctgaaggaatttggatagagagtcgtcccttgaaacagtttcccttaaggattgttgaagatttaattgataggagtgctaagtga

SEQ ID NO: 81544 - DNA, 393 bp, Glycine max
  Peptide Sequence Number=SeqID_198322
atggctaatgaattttcttcaagtaatggaagggcaaagttgcgtgttgcttacaagggccttccaggagcatatactgaggatgtagttttgaaagaatatccacaatgtgaaacagtgccatgtgaggactttaagacttcattcaaggctgtcgaatcatggttagtggataaagctgttctaccaatcgaaaattcaactggtgaaagcatccaccataattatgatttacttcttggacacaagctactgaggggtgtgagaaaaaaggatctcaaagttgtaatgagtcatcctcaggctcttgttcaatgtaagaagatgcttattgatttaggtattgccaagattagtgtagatgataatgttgcagctgctaagatatattaa

SEQ ID NO: 81545 - DNA, 360 bp, Glycine max
  Peptide Sequence Number=SeqID_198323
atggatttatttcttttgaagagaggattgaagagtgatttggattggtgcggttgtcagtttctattgaagaaactgaagcttcctttggtgttggatagctatacagccccaagtcttgactggttacatgagtcaatgatttacaccaagaggaacctttatctctccgtgttatgtactgagcatatggagaacgtgaatgtttctctgctaattatggtgtgtggcgttgggaagtcctccaaaccaaaggcttcttaccaatcatgcaccgatgcacgtatgcacttggaagctggaaaagctcctactgattctgcaaatgatgatcgtcccgtgaagaagtattctttatag

SEQ ID NO: 81546 - DNA, 189 bp, Glycine max
  Peptide Sequence Number=SeqID_198324
atggagaattggcgaacagcgctaggcaatgacattcgcggggctccagactcgaagcgcttggcaatgtcattcatggggctccaaataaaagtggagaatggagaattggcgtatagagctaggcaatcacattcgcggggctccagactcgaaggtggaggacacatgaacagcgctaggcaatga

SEQ ID NO: 81547 - DNA, 288 bp, Glycine max
  Peptide Sequence Number=SeqID_198325
atgggatcaagtcaaaagccgtcgtttaaaaagaggttctatcaagtcaaaatcaagagctttagaggtcaccagtttacgaaagttggggcaattaatggggtcaacttcaacagcaagccttccgcaaagcctatggttgtcctctttccgaatatggaagggttagtggacctagcagtgattgacgctttcctcgcctttcatcatggcaaggaaagcccggtcgtcgccattttgaccatgtatgacacgttcgaccggggatgtgaaaagagcgacacatga

SEQ ID NO: 81548 - DNA, 531 bp, Glycine max
  Peptide Sequence Number=SeqID_198326
atggcttccatgatggaggccatgttaggaatgagacaacttatggagaaaaatgtggccactgctgccgctgttagttcgactaccgaagtagacccaactctcctagctaccgcacaccatcctccttcaaacacggtaggacgagaaaggagcacactggggcacaacagcaacccccatttgggatacaaccgggtggcttacccttatggattaccgcctaattacatgccgccagtcatgcatgatgatgcaggtcatgtctcttcccccatccttgaaggggagcctcctcaacagcccgacgaggtccatgaagatcatcaagagtatgcccaaggggatgtcgatttctaccccccgatccccattgaggggccggcgcccaacacattgcctcagcccaacctcacaaggatactaggctgcctcccagctgcgctccccgcttgtccagagctaggcatgggacgacgatccatcgatcatggtcctagcctctactcgcgtccgtccctaagtacctga

SEQ ID NO: 81549 - DNA, 624 bp, Glycine max
  Peptide Sequence Number=SeqID_198327
atgaagattgttatctctattccactaataaattatgattttgctggaggagagcatcaccaggacagttgttacttttattctataaataactttgactggaggcaggaacccgccatgtacaactattatgagaaaggaagagctcctgatcttgaaagtgtattggcagacttcatgacataccaagctagctctaaagattcaatgcaacaagcctttaaaagaactgaaactaagattggcaagttggtagatgacatgactaaagtcgtggtcagaagagaagaagagtatgcaaagattgaagcacatcaagaaagaattcttcaagttaccacaatccatcatcaattgatcaacgaagaagaaaaggatgaagtctccagtactccagaatatccttgcatggcaactgttggctatgttgtagggatagataaaggtcgattggaactcagtgtggaggataagaaaatctcttttgacctctttgaagccatgaaacactcatatatgggtgatgcctattttgaagaagaagaggtggagcaggaaataacatcatcagcttcaaccatgatactacagattcctttggaaaaagagctagttatgtggtag

SEQ ID NO: 81550 - DNA, 579 bp, Glycine max
  Peptide Sequence Number=SeqID_198328
atgaaaatttcagactcattcatgcgtcactttcccaagttgaacaacccggaagtgggagagagacaaagagtgatttttctctgggttccaaccgcacaaaagtcatggctggagaatccgtggttgctattgcttattgtgccatccatatttaatgctggttgtccagtagatacgcacttccggtccccaacagttataaagaatttagcaccacactttaacttaaagatacgctgtccaatgtcccaaaggccaattaattgttatatgattttacataacccatgtaacacgacgagtgaaattggatatgagtgtatgagcaaagccaaagtgatcgtgtggcagagcagcgagagagaaagctcttcttgttctgatgtcggatcatcttccgcgagaagtggtaaccgacatcctctcccggttaccggcgaaatccctactccgattccggtcaacctcaaagtcatggaagtcactaatcgacagccagcacttcaactcggtccatctcagcagatccctgagcttaacctccaacaccaccctcatcctccgcctcgactctga

SEQ ID NO: 81551 - DNA, 468 bp, Glycine max
  Peptide Sequence Number=SeqID_198329
atggatgtttgggtgatgagagagtataaccgtggtgacagctggtgcaagctgttcacgctggaggagtcgcgtgagttgagatcgttcaagtgcttgaggcccttgggatactcgagcgatgggaataaggttctgttggaacacgaccggaagaggctgtgttggtatgacctgggaaagaaagaggttacccttgttagaattcagggtttgcctaatttgaacgaagccatgatttgtttgggaactctcgtcacaccctatttcttacctcgtcaaatttgtcgcaagtcgccgactttaggctgccaacgtcgcagaagcggtggtacatgggggtggctgaaactggctcggcgtgtttgtttagaagttgattcgagccaaagggaggttgaggaaaacgatgaaggtgaagaaagggctggagttcagaatgttgaagatgaagaaaacaatgactga

SEQ ID NO: 81552 - DNA, 531 bp, Glycine max
  Peptide Sequence Number=SeqID_198330
atgcagagggaatcgcctaatagtgccacgtcgatctcgaaccctccgccgactcctccgatcgaaggcgacgatgagatcgggctggtcgggttcgagtttgcgcgtgacgacccagtggagggagttaccgacgaagacgcccatggtgcgcgcgcagcagagagcgtagggcatgctggggagtgtcttccacgcgttggcgcggagcgtgtagagcttgacctgggagtcgaaggagcggtcctgcaagtcgacgaagtaagagatgcggacgagcttgtagtcgggacttgtatggtcgaagccgaagccgtagacgcgggcggcgaagagagtggtgtcggggtggaggcggcggcgggggaggggcaaagagggaagaatacggtgctggcggagggaggggttccaaaaggcgatgtcgtcggcgacgttggatatacagaggagtccgttgcaggaaccgagaagagtgatgttgttgctgtaacacataagagggtggttaagaaaaaggggagggtctag

SEQ ID NO: 81553 - DNA, 495 bp, Glycine max
  Peptide Sequence Number=SeqID_198331
atgaggggcatcatgcatgagcctcaaggtgcacccttgggcactagtaccctcaccttcagaggactagacgccctcgccttcagagggctgcatgtcctcacctgcagaggactacacatcctcacctttagaggactacacgtcctcacctacaaaggactacacaccctcacctttagaggactgcacatcctcaccttcagaggactgcacgtcctcacctttagaggactacgtgtcctcaccttcagaggcctgcacgccctcgcctttagagggttgcacaccctcaccttcagaggactacacgtcctcgccatcagagggctgcacgccctcaccatcagaggactacacgtcctcaccttcagagaactgcgcgtcctcacctttagaggactacacgtcctcgcctttagagggttacacgtcctcactttcagtgggctccatagccacaccttaagagaatttaaggtcctctgcccttaa

SEQ ID NO: 81554 - DNA, 1647 bp, Glycine max
  Peptide Sequence Number=SeqID_198332
atggtcggagaacacggtacgatgtcacttgcctccgatgatcagaaaacaccacttcttcccgtgcacgagccaatggaaggaacacgcaccagcgtctccttcagcatcaaaacaattctaacactggaaaacttgtacgtgattctgggacctatgctgtctcttttcatatgcctcttcgtgaagctcgacgcgccacccacaagccagaaaatgcttggtgtgattgcgtgggtcttcgcttggtgggtcacgcaggccgtgccacttcccgtgacttccatgtgtcctctgtttttgttcccaattttcgggatagcttcagctgatagtgtggcgcactcttacatggatgacgtcatcaccctcgttttgggaagcttcattctcgccctcgccgtcgaacgctacaacgttcaccggagattggccttgaatgtaacactgctgttttgtggcgacccggttaatccagcgctgttactgctggggctgtgcgcgacgatattcttcgtgagcatgtggctgcacaacgtggcgacggcggtgatgatgatgccggtggcgacggggatcgtgcaacggctaccgccggtgcacgagcagtcggaggcggtgaacaagttctgccgcgcggtgattctgacggtggtctacgccacgcccatcggaggaataagcacactaacgggaacgggtgtgaacttgataataatcggaatgtggaagagcctcttccctgaggcaaaaccaataagcttcaacacgtggttcttctatggtttccctgttgctgttctcatcctcatttgtttttggtgcatcatttgcctcctctatgtgccaaaaggttcgggtcgggctttgtctgcttacttggatagatctcacttgaagagagacctcgaagctcttggtcccatggcttttgcggagaagatggtcttgtctgtgtttgggttgctgatcatactttggatgacaagaagaataacagatgacattcctggatggggatctttattccatggcctagttggagatggaagtgttagtgttatggtggctgttttattgttcataatcccaaacatgaagcaagagggggagaagctaatgagttggaatgactgcaaaaagttaccttggaacctcattttgcttctgggagctggttttgccatagctgatggagtacaatctagtggcctagcagatgttttgtcaagagccttggatttcttggaagatgctccatacttggcaattgttcctgctgttagtctaatatgtagcattatcactgagttcatcacctccaatgatgctactgccacccttcttgtcccacttctgtatcacatagccagaactatgcatgtgcaccctcttcttcttatggtccctggaggaatagcaactgagtttgccttctggcttccaacttcaacaccatcaaatgtagttggctttgccactggacacatagaaattaaagacatgctcaaagttggtgtgccactcaaggttgctgggattgttgtgctgtctcttctcatgccatcactaggtgacttacctgccatctctgttttgctagacaaatgctttgagaaaatcaattgggtcgaaaaagaattctga

SEQ ID NO: 81555 - DNA, 450 bp, Glycine max
  Peptide Sequence Number=SeqID_198333
atgtctttaatttctctgtgtccagtggcaaagccaactacatttgatggtgttgaagttggaagccagaaagcaaactcggttgctattcctccagggattataagaataagaggaagtgggacaagaagggtggcagtagcagcattagaggtgatgaactcagtaacaatgctacatattagactaacaacagtaacggtggccaagtgtggggtatcttgcaaaaaatcgacgacccttgacagcacttctgatagacctctagattgtattccatcagctatggcaaatccagctcctagaaacaaaatgaggttccaagcaaaattcatgggacctgcaaacaatcaagagttgcagttccagtctccggtggacattgtagcgttggacggcaagagcaagaataaaggttcccaaaaggaggtgatgacgtcgtccatgtaa

SEQ ID NO: 81556 - DNA, 345 bp, Glycine max
  Peptide Sequence Number=SeqID_198334
atgagacaccactgtctccttctcctctccctcgtcttggtctcctacgctgcccggcggtcggaatctgcgctgggcggctggagccccatcaaggacgtgaacgacagccacgtggcggagatcgcgaactacgcggtgagcgagtacgacaagcgttctggggcaaagctgacgctggtcaaggtatcaaagggcgagactcaggtcgtggtcggcaccaactaccgcctggtcctcaaggttaagaatggatccaccacgaccagttaccaagccaccgtgctggagaagccttggctccatttcaggaatctcacttccttcaaaccccttcgttcttag

SEQ ID NO: 81557 - DNA, 552 bp, Glycine max
  Peptide Sequence Number=SeqID_198335
atgaagggtctcttcaagtccaagcctcgcactcctgcagatgtagtgcgccagaccagagatcttctgctctttgttgatcgcagccccgaaacccgcgaaagcaaacgtgaagagaagttgttcggttttgcgagtataattgagcttgacatgccatcatcaggcattatacgagcagtagtagaatttatgtccgagctatttaaaaatatcagggagctaaagtcaatcctgtatggaaatagtgaatctgaaccagtgtctgaagcctgtgcgcagttgactcaggagttctttaaggaggatacgttgcgactgcttatcaagtgtcttccaaaattgaatttggaggccagaaaagatgccactcaagttgttgcaaatttacaaaggcaacaggttcagtttaagttgattgcatctgattacctggagaaaaatatggatcttatggatattttgatagttggctatgaaaaccaagatatggctttacactatggtgcgatgctgagggagtgcataagacaccagattgttgcaaagtaa

SEQ ID NO: 81558 - DNA, 204 bp, Glycine max
  Peptide Sequence Number=SeqID_198336
atgactcaggtcctccgtgtcggcgagcacctccgccgtgtgatggatagcgacgactgctctcatgactggcgggtgcaattctacgtgtatcctacgcccacacgcgatgttctacgaggacggtgtttcttgaagaagaggatcattggcatggaggaagaatctcaagttcaagaacaaatttcggaagcttttaagtga

SEQ ID NO: 81559 - DNA, 417 bp, Glycine max
  Peptide Sequence Number=SeqID_198337
atgccatatggcgttgtgttgtttcaggagctcttgacaagacataaatctactgtggctgaattcctttccaagaattatgaatggtttttcgcagaatataacactaagctgttggaatcttccaattatattacaaggcgtcaagctgtcaagttgttgggagatatgttacttgatcgttcaaattcagccgtaatgacaagatatgagtcaagcaagagcatacagattgaagcatttcatgttttcaagctatttgctgctaaccaacataagccagctgatatcgtcggtatatttgttgcgaacaaaagtaagatgctgagactgttggaagacttcaaaattgacaaagaggatgaacaatttgaagctgacaaagctcaagtgatgagggaaattgaagctctttaa

SEQ ID NO: 81560 - DNA, 318 bp, Glycine max
  Peptide Sequence Number=SeqID_198338
atgttcaaagctcatgacatcatgctcactatcaaacatagaggaggatcgacggagagagagaggtcacggtggattaagggtggaggagatgttccggtcggagatgacggtggtgcgataattctgtttggtggtggtcggagacacgcgtcgcaaagtgatttgactacggttgcggagtggatctactgcatcgtagatgattatgtggtagaagctgaacccgtttcgctttcaatcgaagggaagaacaaacattcaattcatggcagctgcaaagcttcaagctttatggaatcacccagctgggcctaa

SEQ ID NO: 81561 - DNA, 2100 bp, Glycine max
  Peptide Sequence Number=SeqID_198339
atgacctacccaataagaacagagagttggaatctggtgaaagtcagccactgttcacaccaacggacattattcgacggtgacgatggaaccggcgtcgtcctcgtcctcatcggagcaccaccgaagctactggcggtggagcaagtgcgacttcttccccgagaagtcattcgagaacgggaaatcctaccgcgcagccctggccgccacgtgtccgcgcctcaaggaccggctcctgaaccggtcgagcgacgcgcacgagctcctggtgctcccacgcaccagcgagcaccgcatgaatcgctgcctcacgtggtgggatctgacctggctggccttcgggaggcccgcctccacgccggccctgccatcgtcctatcctacgccgcctccggcttctcggccctcctctccgccctctgctacaccgagttcgccgtcgacatccccgtcgccggcggctccttctccttcctccgcatcgagctcggtgacttcctcgccttcgtggcggccggcaacattctcctcgaagccctcgtcggtgctgccggcctcgggcgctcctggtcctcgtacttcgccagcatggtcaaatccgaccccgacttcttccgaatccacgtcccctccttcaaacccgggttcgacatgctcgatcctctcgccgtcgctgttctcctcatcgccaatggcatcgccgtcagcggcactcgcagaacctccctcttaacctggctcacttccgtcatcaccgtcttcatcatcgccttcatcatcgtagtcggcttcgtccacggaaaagcctccaacttgacgccgtttctcccttacggcgtcgacggcgtcttcaacgccgccgcagtagtgtattggtcctactccggtttcgacatggttgccaccatggcggaagaaacaaagaacccttcgagggatatccctattggcttagttggatcattgtcgatgattactgttatttactgcttgatggcattatcccttgtgactatggttaattacacccagattgacgttgatgcagcttattctgtagcttttgttcaaattggaatgagttgggctaagtaccttgtgagcctttgtgccttgaagggaatgactactagcttgcttgttgggtcaatggggcaagctaggtacactactcagattgcaaggtcgcacatgatcccaccctttttcgcattggttcacccgaaaaccggaacccctgtgaatgccactctcttgaccactattagtagctctgtcatcgctcttttctcaagcttggatgttttgtctagtgttttttctatcagcacccttttcattttcatgctcatggccgttgcgttgcttgtgaggagatattatgtgagggagagtactgccaagagtgacttggtcagagttcttgtgtgcttgtttgttattattggttcttctgttgttggtgctgcactttggcactcagggaagctgggttggatcggttacactgttgctgcttgtgtttggtttttgggcactttgggaatgagttttcttcctaagcagagggctcctaaggcttattggaggttcttaatttgcactgctgttatgtttgtgtactatttttttgtggctgtacatgcaacttatgatgtggaccatcaagataacggtctagaaggaaagaatgatgaaggagtgggagataataataccaatcaagggtccaatgtcactcacaaagtcatcaaccatcgcgatgtcattcaactctccctaagcatcacctttcgcgcggtggagcacaactacttcactataaagaaactcttaatcaaacacgacctaatgaaacgcgagacaatcgtgttctacgattgcctcgaaaccattgacgaaaccctcgataagcttagagaagtacatcacaacattgaactctatcctaacatgaaaactctatacactgacgatctcaaaactctcatcaacgctgccataacaaaccaagtcacgtgcctcgacggtttctctcatgatgacgtagacaagcacgtgagagagacaaatctaagagagaaagtgaggttgtga

SEQ ID NO: 81562 - DNA, 696 bp, Glycine max
  Peptide Sequence Number=SeqID_198340
atgcatggcgatgattgggagcatgaagagattttcactgatgatgatgaagctgttggcaatgatcctgaggaaagggaggatttggctcctgaagttcctgctcctcctgaaatcaagcaggatgaggaggaggaagatgaagataatgaagagggagaaggtctgagtaaatctgggaaagagctgaagaagctgcttggaaaagctagtggtctgaatgaatctgatgcagaggatgatgatgacgatgacgatgatgtggatgatgatgttggtgtccctcctgtcattgctacaaagcaaaaggatgcccttaaggaagaacccattgacaatagcccttcaaagccaacagcaacaggacctgctcgtggaacaccttcttcaaagtcttcaaaggggaagagaaaattaaatgaagaaacaaagccatctaataccgcaactccaaagaaggaaccaaaattgtccgccaaagatgtaaatggatctgcatctaaaagtagtgcacctccaaaaggtacacctccattgtcatcaaagggcgggtcttccacaacaacaacagcttctggaccggtgagtgaggaagaaattagggctgttttaaggcagaagactccggtgaccactcaggatcttgtagctaaatttaaggcaagactaagatgttcagagatgttggatgcatga

SEQ ID NO: 81563 - DNA, 1551 bp, Glycine max
  Peptide Sequence Number=SeqID_198341
atggagatggagggggagataaagaatttcatcatggtatggagcatagcttcagcaacaatgtgttactgccacagaattgggaagctaatcccagaaggcacatcaagactcatagccctattcccagccatagggatcctccttctcctccctctaaggctcatctccgttcacctcggaggcccatctgctttcttccttggttggctttcaaccttcaaactcatcctctttgcctttggaaagggtcccttatcctccaaccctcccctctctttgcctcacttcgtccccatcgcatgcctccccatcaaattcgaacatgacccaaaacaccaaatcccccaaaagaaacacaaatctcccttcagttatgcttcaacctcaatggttattatattggctgctttaattcctctctacgggaaaaaagagtattttcacccaaagtttgtatttttcttgtacggcctccacatgtacatagggttagagttcattttcgccacggtctccgcagcaacgagaaaactcatcggggttcagctggaaccacagttcaaggagccatacctatgcacttcgttacaagatttctgggggagaaggtggaacatcatggtcaaccgtgttcttcaccccaccgtgtacgatcccgtgaagaatctctctgcacgagtccttgggagaaagtgggccccacttcctgcaattctcgcttcctttgccgtgtccgggatgatgcacgagctcgtgttttactacatcaagcgggaaaagcgcacgtgggaggtatgggagccctcgtgggacgccacgtgtttctttctcattcacggggtgtgtgtggccatggaggttggaatcaagaagagtctcagagggaaaaaacagtggcaggtgcccagggtgctgtcgtggatgctaacgttgctgtttgtgctctacacagcgatggccttctttctgcccgcgctagcgcggtgtcgcgtttatgagaaggcaaccagagagttgaccgctttgacccagtttctcatggatgtttacgcgaaagccgagattctgagcgcaaaaccgttccatttcatcgccgccgctctcccgacaaatgctttcttccatgtcggccaagacttcgtcccaattcttcatgggccaccaagtggactcatcgatttgggcttccgaaatagagtccagtatttcctggaggcccacgatcctacggctgactttcctccgggcgtccctgagcgttggatcgattccgggcacggaatccagcctcagcagcagtgccatgagcgcctcgttcattcgcagcttctcgaggtggttggcgcgcacggcgtccaccgtgtcctgccgctggatcaggcgctgcagccgatcggcttcggcgtcgacggcggcgattttcctgtagagggcgcggatgcggtgggcgcggtggaagatgaaaaggcttgtttggaagagggtttcatgggaaaagggtgttttgatagtcacacattgcacacagacacagtgacagttgtgtga

SEQ ID NO: 81564 - DNA, 960 bp, Glycine max
  Peptide Sequence Number=SeqID_198342
atgtcgaccgacctgcaattgaagtcgagttgtagcggatgcggatcaacgacggatctctacggaagcaattgcaagcacatgactctgtgcttgggctgcggcaaaaccatggcggccaaacgcgccaaatgcgttgattgtggcgccaccctcactcgtttgattcgagaatataatgttcgtgcaagttcccccaatgataagaattacttcattggaaggttcataaacggtttgcctgatttttcgaagaagaaaagtgctgagaacaagtggtctctgcagaaggatggactacacggacgccaaattactgatactttgcgggagaagtacaagaacaagccttggctcttggaggatgaaacaggtcagtcccagttccagggtcatctagaaggttcacaatcggctacatattacctgctaatgaaggaaaggaaggagtttgttgccattcctgctggttcttggtacaactttaacaaggttgctcaatataagcaattgacattggaggaagcagaagagaagatgaagaatagaaagaaaactgcagatggatatcaaagatggatgatgaaagcagcaaataatggcccagctgcatttggtgaacatgggaaatttgatgacaacgaaagcaacacgggtggagggagaagccataaaaaaactgatgaggatgatgaaggtcatgtgtctgataagggagaggaggatgaagaggaggaatcagaaaggaagagtagacttggactaaataaaagagctggtgatgatgatgaagaaggtccaaggggaggggaccatgatctagatgacgacgatgttgagaagggtgatgattgggagcatgaagagattttcactgatgatgatgaagctgttggcaatgatcccgaggaaagggaggatttggctcctgaagttcctgctcctcctgaaatcaagcag

SEQ ID NO: 81565 - DNA, 789 bp, Glycine max
  Peptide Sequence Number=SeqID_198343
atggcatccttttctatcactggtcccataaaatgcaaaagaattacctcattttttccactgtccttttctactacctataattcttgtaatatttccattcctagaaacataacaagaaaagttcgtgcacgtagcaataccctatctttattttcataccaatcctcgatgcataggagcttgtattatgagaagcagagaggcctatccctgattgcctttgatggtaataactcagaatcagaaggagaagatggtcatcatggccttgactcagtaatgaaactgtactctgccttcaagaacaaaaaaatacacgaattatctgcagatgaacgccgacgtgtgagcaatttcctctcattcttcgaaaccttccaaggaagaacgcaagtgttggaattcttttcttatctgacaagtatactgggaaacaacattcaaattatatttaaaccgactccccatgaaggcgtaaatgctggtcttcagtggaaattcgaatgggacaagatacaccttcccctttggaagggtttcagcttacacataagccacacttaccacggaagggcagtaataaggaatattgagacgtttatggaaccactgctccacttgagacccttcggactgaaaatgaaaataggccttagagaattcgtggagaagatagcctcatttatggtgtcagaattcgggaataaggctaaaagaattttataccttgtgctggctgtgtcttccctaactgctttcttattcttcatgaaactagctttatag

SEQ ID NO: 81566 - DNA, 294 bp, Glycine max
  Peptide Sequence Number=SeqID_198344
atggatcacacggctgcgttatatacttacttttcgaaagtcaaatttcccaaatctaatgtttacataagaaggaagaggaaactgaaatacagagacaagttctctcatgaaaagagcaatgattcggctgctggagatgataaaaatgaaggagatatgcttgtagcaatggatatgaagtccacgattttagatgcaaaagaaacaaaggcaaagaagaacatgcagaaagtggaaaatagtaaggatgatacgtttgagaagaaaatcaaacgtgaaaacttatggtga

SEQ ID NO: 81567 - DNA, 526 bp, Glycine max
  Peptide Sequence Number=SeqID_198345
atgggttttgatgagaaagtgaaagacaatgatggtgcaggggatgatgatgcctctcatcgggtgcacgcggcaaaagctggtacggatcatgaaagtggacatgaaggaggagggaccttcagcagatacaggagtgagagttccattgctgctaccgaggatgaagatgatgaggaggagaggaagattgaattaggtcctcagtgcactttaaaggaacaactcgagaaggataaggatgatgagagcttgaggaggtggaaggagcagcttcttggaagtgttgacataaattctgttggagaaactctggagccaaatgtgaagatccttagccttgcaattaagtctgctgatagacctgacattgttcttgcaataccagagggaggaaatcccaagggcttatggtttactttgaaagagggtagtcgttataggctaatgttcactttccaggttgagaataacatagtttcaggtctcaaatacaccaacactgtgtggaaaactggtgtcaaag

SEQ ID NO: 81568 - DNA, 390 bp, Glycine max
  Peptide Sequence Number=SeqID_198346
atgtcaatttcatcctttaaaaactatgggtgggtgatggtggcatttgtggcagtggtggttagtgatgaagagacaatggaggaacagctggagattggtcgaagaagaagagggggattggaacttctttgtgattccaagaagattcataatgtcaatattgagcaacacaatggagaagacaagttaatcatgaaagatttgcttgcttgggtacgaaccaacttgattaaggagaggcctgaaatgttcatgaaaggaaatactgtgagacctggagttcttgtccttgtgaatgattgtgattgggagctaagtggtcagctcaacacatcactggaagacaaagatgtggtggtttttatatcaaccctgcatggtggttag

SEQ ID NO: 81569 - DNA, 909 bp, Glycine max
  Peptide Sequence Number=SeqID_198347
atggaggcttataagagatgggtgaggcagaacaaagagtttgtgcactccatggagtctttggccaatggattgacatggcttcttcctgaacggttttctgaatcagagattggacctgaagcagtaacaaccattctgggaatcatcacagctctcaatgaacatataattgatacagctcctaagcaaaatattacaggctctgtcaagccttattcgtttccttatccattatgcttatctgcattaaaggatttggaaacattagttgaagttgtggcacagcaatactatggtgatgataagaaatggaatttccttgctgttactgaagcaaccaaggtactggttcggttatctttgtttcggaagagtggatataagatgctgctacaaggaggggaaactcctaatgatgaggagcattcagatagttttacctcgcaacatcatataggcttaaagcccgatgtgcatcataggcctggttatatgaaaaacaatcttggtgcaaacccaatgaatctggaaggaagagcactatctgctctagttagatttggagaaaaagtgaagggatcagattcagtgtggttacgcagggttgaacaccaacaagcaactatggagcctacaagaaacagtattctttcactgatgacatcgcctgtggctggtgggaaggagcgaatgtttcatctgtctgccccagaaaaggatgaggttaaacgtcgaaagctgctatttgttctctacctaatgagagatccatttttcagcaagcaaagacttgaaagcactgagaaagttttggaacctatacctgtcatgggatttctcacagcaaagcttgttgagcttataattggagctcaaacacgatacacttacatgtcaggatcatga

SEQ ID NO: 81570 - DNA, 696 bp, Glycine max
  Peptide Sequence Number=SeqID_198348
atggactcaatgatgtcaacaaggaccttgggcaccttaaccaatccaccatgccccggaataatcctcttgggtgatggtgtcgatgaagcattctactcagtccctagggggaaggggcattgtggcaaaggaaacaatggaggccacaacaaacgagtgctggaggtgcacaggagagcaagtggaattgcatttggtcgagaaagtggagaatataataggatacgaaatctggaacaagtgacttctagaagaaccattcactcctccttcatcaaaggcgtttctcatgagtaccttgagttcgtcgatgaaggtggacttctagaagaagccttcagtcctccttcattgagggagggtgtttcttgcaagttccttgagttcatcaatgaaggaggaatgagtgaggacttcttctacaagcctcttgcttcggaatttgtagtatgtgatcttctctacatgctcaagaaaatgcaatcccaactctccttcgcagatagtgcaaaggagagagagttggaattgaatttcattgaacaagtggagaatataatacgatacaaattccaaaacaagtggcttctagaagaagccttcactcctctttcatttgagggcttttcttatgagttcatcgatgaaggagtaaggacttcttctagaagcttcttgcttcagaatttgtaa

SEQ ID NO: 81571 - DNA, 696 bp, Glycine max
  Peptide Sequence Number=SeqID_198349
atgacagcagcagaagagttcaccagtggtggaagagaagtgcggaaagatacttatatagagagtgaaagtgagggttattacaaggagttgccaactgtactaacagctggaactaattgggtgttctacctttccaggaaggaagggcaggacactcaggatgaattaaagagaagaaacctacgtgatgaactggaagatcgtgaacgaaggcatttctcatcaaaaaataaatcttatgatgacagggatcacggaaagggtagccatctgtttttggaaggttccaagagagacattgaagatcgcattgttgctcgtagtgttgatgcagatgattctgacgttgaagtcaaaagtgatgatgacagtgatgaagatgatgatgatgaggatgacactgaagcattgctggctgagcttgaacaaataaagaaggaaagggcagaggaaaagctacgcaaggaacgacaacaacaggaggaggagcttaaagtaaaggaggcagagcttctgcgtggaaacccactgctaaataatccaacagcatctttcaatgtgaaaagaaggtgggatgatgatgtggtgtttaagaaccagtcccgtggtgaaaccaaaacagctaagcgattcatcaatgacaccatcaggaatgatttccatagaaaatttctgcataaatacatgaagtaa

SEQ ID NO: 81572 - DNA, 204 bp, Glycine max
  Peptide Sequence Number=SeqID_198350
atgcacaaaccagtgcaagccgtgtgcaaaaggaaatttttgagtgatgaaaacacaagagatgcacggtttcgactagggtcgttgcattcttttggcggaatgattgggtttggacttttgaagggtcgtcacacagaaagcggaatgatcgggtttggacttttgaagggtcgtcacacagaaaacctcttggcggaatga

SEQ ID NO: 81573 - DNA, 549 bp, Glycine max
  Peptide Sequence Number=SeqID_198351
atggcactaataactcaagaaattggagggtatgggataacatcatcaacttgtccttattggcaaattaggagatgcaacagagatcctttcatgttcttgcatagaacggcaccgccaccaacaagagctgcaggaggagttctgagggattggaagggtgaatttattcttggcttttccgatgccttgatcgagtgttcttccgcgttagaggctgaattatgggccatcaagattggaatgcaaacagtagtggcaaggggatacagaaatttaattgtggagagtgattctctaaaagctattcagatcattaatgctcacaagggtgattttcttcgatcttctatccaacacatgactcggatggttgaccgaatttgttggaatcatgtatacagagaaactaattcggtagcagatggttttgctaaacatgggttatccttgtctcaagaccagagcatcagagtttttgactctgctcctgatttcattgagtctcgtttgtatggagatagaattggaaaaatatactgcagatga

SEQ ID NO: 81574 - DNA, 846 bp, Glycine max
  Peptide Sequence Number=SeqID_198352
atggcactaataactcaagaaattggagggtatgggataacatcatcaacttgtccttattggcaaattaggagatgcaacagagatcctttcatgttcttgcatagaacggcaccgccaccaacaagtacgtgtaaatactggatgaatggtaactgcaaattcggtgatcagtgtcggagtttacattcatggtcagatgtggaggcaacttttgttggcacgcagcatgtttttttggtcttttgttggattggtcttggatgcaatgagtttgttgccgagtttattcattttgctaacatgcaaatacttccacaggacgataacccaagacctacaagattggtttggtggaccccacctcccagaggattctttaaactcaactgtgatggggccttcactgtttatggaaataaaggagctgcaggaggagttctgagggattggaagggtgaatttattcttggcttttccgatgccttgatcgagtgttcttccgcgttagaggctgaattatgggccatcaagattggaatgcaaacagtagtggcaaggggatacagaaatttaattgtggagagtgattctctaaaagctattcagatcattaatgctcacaagggtgattttcttcgatcttctatccaacacatgactcggatggttgaccgaatttgttggaatcatgtatacagagaaactaattcggtagcagatggttttgctaaacatgggttatccttgtctcaagaccagagcatcagagtttttgactctgctcctgatttcattgagtctcgtttgtatggagatagaattggaaaaatatactgcagatga

SEQ ID NO: 81575 - DNA, 510 bp, Glycine max
  Peptide Sequence Number=SeqID_198353
atggaccctactgagcccaaccataataactctttttcggctgctggggattttgggctttggtggttggagaataaagaggtgggaaatgctaggtgcacccagcaatattgctgcttcgtcttctcttcctcttccgtgaacctggttcgttcttcttatcttcttcgtgaacttccttcttctccgcgaggcgcgcccaaggcaaggttttcttcttcttctccgcgaacagacccgttaggggttcttccggaagttccggaagaaccttttccggaaagtttccggaagaagtgttcttccggaagtaaccaaacgtctttcggaagaacacttcttctgaaagactcccggaaaacctcttccgggaactttccggaagaagtggttcatccggaagaattccggaagacgcgcacttccggaagacctttcaaagttccggaagacctttccggaagaaccccttcttccggaatatttccggaagaaccacttcttccggga

SEQ ID NO: 81576 - DNA, 1323 bp, Glycine max
  Peptide Sequence Number=SeqID_198354
ctggttgaaagcacattcttatggcagttgcatgatttgcatagcattgaggctactgtatctgatggcattcaacttactcctcccggacttgatagtgtgttaagtgtcaaacgtcagcaatatgccatgcattgcaatcctatacaagaagaaataaaactgctttcagaacccttcaaaatttttgaatttgatttttggaaacggccagagagttctggagaaactgagctgtgtgtaaaggcaactaatgatgggagaattcatgctgtggtctcttggtgggtacttcaacttgatcgtgaagggaccatctattattccactgctcctaggtggataagctcaccaacaattacaagtcctgttggttggtgtgaccactggaaacagtgtgtttggtttgttcctggcagtggtatttccatattcaaaggggaagaaattcatttacatgctactcatactgagacaagtatctcatataatttagatactcaagtacctacatctgagattttgaaccataggtgtatgactggagatttgcagcttgtactgccaccagaaagggttgcaatctatggagacaaaggatggaggctttcaatgttgaaagcagtacaaagcatgggaagagatcacccgttatgcttagttgcagatgatagtgtgtttttacctcttcttgtggcacagctttcagaagcatcacatgtaatgtcattacttccggggcttaaggaaagaggcctacaatatttgcaagcggctgcccatgcaaatggtttgtcacgtaattgcatagaagttcttgaaaaaagggttgatctgttgatagcagaacctttctatgtagggcatgatggcatgcttccatggcagaacctgcggttttggaaggatcgtacaacacttaatgatatcctctctgaagatgctctgataattcctagtaaaggaatattgagagcatgtgccatctctcttcctgtgcttagtgagacatttgatgtgatggagtttgatttttcaaaacaaatatgcctatgtcaaggaaaatcccaggttaagttcaccaagaccggggtatgtcatggatttgtgctgtggattgactgggtgatggatttgcaaaattctgttgtgatatcaactggtccagataggagatattggaagcagggagtaaagcttcttggaacacctagaacagtaggacctcaaagatcaagaaatgtccaagcatgttctgcagttctggaagcttgtttcaatccattacagggggaactcaaaattatacttgatttcttatga

SEQ ID NO: 81577 - DNA, 1170 bp, Glycine max
  Peptide Sequence Number=SeqID_198355
atggacaccggcagcgacttagtctggttcccctgcgccccttttaaatgcattctctgcgagggaaagcccaatgcctctccccccgtcaacaccacccgaagcgtcgccgtttcatgcaagtccccggcatgctccgcagcgcacaacttagcctctccctccgatctctgcgccgccgctcgttgtcctctcgaatcaatcgaaacctccgattgcgcaaatttcaagtgtccaccgttttactacgcatacggtgatggaagcttaatcgcgcgtctctatcgtgacacgctttctctctcttctttgtttctcagaaatttcacgttcggttgcgcttacactaccctcgccgaaccaaccggagtcgccggattcggtcgcggtttgctctctctcccggcgcagctggccacgctatctcctcaactcggaaaccggttttcgtattgtttggtttctcactcgttcgactcggagcgagtgagaaaaccgagtccactcattctcggacgttacgaggaggaggaggaggaggagaaggttggtggtggagtggcggagtttgtgtacacgcctatgcttgaaaaccctaagcatccttatttttataccgttggcttaatcggaatctccgtcgggaaaaggattgttccggcgccggagatgctgcggcgggtgaacaatcgaggcgacggcggcgtggttgtggattccggcacgacgttcacgatgttgccggcggggttttataactcggtggttgacgagtttgaccgcggagtcgggcgagtcaacgagcgcgcgcgtaagattgaagaaaaaacgggactcgcgccgtgttattatttgaactccgtggcggaggtgccggttctaacgctgcgttttgctggggggaattcgagtgtggtgctgcctaggaagaactatttctacgagtttttggacggtagggatgcagcgaagggaaagaggagggtggggtgtttgatgctgatgaacggtggagatgaggcggagctgagcggtgggcccggggccacactcgggaattaccagcagcaggggtttgaggttgagtatgacctggaagagaagcgcgtggggttcgctagaaggcagtgcgcgtcgctttgggagagactcaatcgcgacaaaaactag

SEQ ID NO: 81578 - DNA, 267 bp, Glycine max
  Peptide Sequence Number=SeqID_198356
atggcggttagtttgggagtatgtattcgaggtcgggttcgggaaaggaaacgagtggcgattagggttttggggaacacagaaatcatggaactctatggcagtgtttcaatgacattgggtggtattggcactagagggaaagatccacaaaggcaagattggaacctggagagtgttagtacacaaaatttactagatagtctgagaagggctagggaaaaaacgactcaaactgaaagggaacaaggaaatgaatatggataa

SEQ ID NO: 81579 - DNA, 381 bp, Glycine max
  Peptide Sequence Number=SeqID_198357
atgagctcgtccacccagcgcatgttccagctcaagcttgacccaataacgggtaactctgaatgggtcgtcatcgaagacaacgacgacggagacgaaagcttcgcccataatttccaccaacccctcctcgccacgacgtcgtatctggacatgctcaacgattcccccagaaacactgcgtttcgccaagccattcaaaaaaccatcaccaaaccttgccacgttctcgatatcggtgctggaactgggttgctttcgatgatggctgcacgtgccatgggtgatgaagggagggtcacggcgtgtgagtcttaccttccaatggtgaagctgatgaagaaggtgctgcgaattaatggcatggagggaagagtcaag

SEQ ID NO: 81580 - DNA, 1062 bp, Glycine max
  Peptide Sequence Number=SeqID_198358
atggacagcctagtaactagggttcttggtgttcctaccttggtgagaggtgaaaactcagttatagcctttgaaacttcagcagcacctactgaaacattagccatggtagcatctcgtgaaagaggaggtcgaggaaataaaggaggacacagtagtagaggtggacatcctcaatgtacatattgcaaaaagcctggtcatattcaagaaaagtgttataccttgcacggttatcctgacagcgttgcacctgtcaccaaatttgaaaaatcggaatccaaattttctgatgaggagtatcaagactatctgagactaaaatccatcaatcaagcccaatcttcttcggggccaagtgtctcaacaacttgtatttctcaatctgtgaaaggtcaaaatccatggataattgactcagcaactgggcaaaaccaattgtgtctactgtgcgaactgcttggtcttgcacgttatacatccagctctggtgaatttatgaacaatggtaatggcaagtcgggggagacatgtgctgaaaatactactgatggaaaagttttcaatgaggacacacatgtttactgtgtgaatgatcttgctgtgcaaagtgaaatggatttttcaactctgttagccaatgacatgtgccaacgatttcacccatctcttcccattcctcttccaccatcaaatggaaaagaacatggcatttctggggctgaagcaggacagattgatgaaattttctatcctccaaatggaactcagcagtttagttatgaggatttaaatatctggttatcaacggttctacccggtggtgtggatattgccactagtcctcgctttgtggtgacgaccttgagggggcgtgttgctaatccacattgggtggttaacgaacatgcttttgatctagataatttaatttttgtggaacctaatgatgatgcacaatctgaggaagaccttgatgatgatgatggagatggagatgatgatgaaagtgatgatattcatggagatgatcctattagaggattgaacatgcttctttga

SEQ ID NO: 81581 - DNA, 423 bp, Glycine max
  Peptide Sequence Number=SeqID_198359
atggtcactgctatcggcctcggttacggtttcgtgatccttgatactgcagaaaaatatagagaaaatgggacactcatgcagttgcagttgcagttgcagttgctattgcatgtagtcttgatgagagtgattggttattcggtttgttcttgttgtgaggtgaataagagagaatggagaatggatcaacagcaaggcggaattgaggtggtcgaagagattcgaccaaggtggtgttcacctgcagggattccaacgatcaaatcagaagtagtttggggtgaatgcaaagggaagttgaaaggtttgttcttccgagtcaaggagctgaaggattttggaaacaagaaagaatccaaccttgctgcccttctaagaaatatggaaaatcagcatcaacaaactcaagtagccggataa

SEQ ID NO: 81582 - DNA, 1266 bp, Glycine max
  Peptide Sequence Number=SeqID_198360
atgagcacgcagcagctgaaaaggttcaactcaatggaacgcaggccaagaatgctgaaggacttcctcagcgagaatctgaactcttgctcctcaagcggcttcgaatcacttccaagaaaaccaaccaacaacaacaacaacagcatgcacagcctcatagaaatggaactcaaatcatcatcatcatcgtcatcatcaccctttcaaacactcatcaacaccataagaagcatctctctcttcaccccaaaatcaccctcagtgctttctctacccagaagcctctctcgcaagctatcatcttcaagaagaagaacaagaagaagaagaagccgagtgtgcagcgatgtcaacatcacaacggcggtgaagatcaaggacatcatacggtggaaatcgttcagggacatcgtggtggaaccttctcctcttccaccaccaccaccaccgttggatttcatggtggggtccacaaacaccaccacctgtagtagctgtagcagtggctctagttggattaagagtgattttttaaccttggaagaggcacaaaacgacaacgttgaagcggcgggtaaaaggttttcgtttatttcacaccttcttgtcggcagcaagaactcctgggctaaggaaactttaacttgccaagaagaacaacacagtccagtttcagttcttcaggttggagaagatgaattctcaccttttgatcaaagccttgccaatattcaaaggagaaaacagaagttcatacaaacagttcagaaattggagagtcttgcaaaatttgaccttgcaaacttagaccagtgtctctcattggatgacaattctggctatgatgaagaatatgaagaagatgatgctgataatgaagttgacattgaagaacaagattggattgaggaaaaggcaaagcagctgctgaattgtgttaaagcaagaggttcagcagatggatgtagagactatttggatacacttctgttggatttttttagggaagaactaagtggaggtagaaaccaatacaagaatgaagaggagtttgagttagagacattgagaataactgaggattggataaatgggtcatttgcttttgatgcagggcatgttgacaaacatgcttatattaaggacatggaaaggagagatcagtggagtaggtttgaggaggagcaagaagaattggcctttgaaattgaaacagctatattgcatagtttggttgctgatcttcttgacctggatggttaa

SEQ ID NO: 81583 - DNA, 765 bp, Glycine max
  Peptide Sequence Number=SeqID_198361
atggcatcacggcaattcttgaacagtcgaacttatcctaaagtagccagaccaggggaaatggagagagaaagacagagaaagagacttgcaatttgtaaaacaaacttcttctggggtttgtggcctggtcttggaaattggttttgtgaagtgggtacaatgggtatcgataccaatttggtgaccactgtcattggctttggtttgagtgcaactttcattgtttttgtttgcgcaagaataatttgtggaagactacgagagcgaacacggactatatatgaaattgaagcaataacagatatagaacgggcagaatatcatggtaatgaccctgcgcctgcttttgttgctgcaatccccactttgaatttcaaccatgaagccttcagttcaattgaaactacacagttaagtctagtttctggtctttattctctaattcgtaggtgtgtgatatgcttggcagagtacaaagaaaaagagctattgcgaatcatacctaaatgtggccacacatttcacctttcttgcattgatatgtggctgagaaaacagtccacatgtccagtgtgtcgtttgtcactgcagaatgctcttgaaacaaaacatgtgaggcatgcaacgtttaccatcaggcattctcttgatgagtccaatactgcagaaaggaacacagatagtgatcagaggctagttgaacttgattctagtaacgactcccaacaaccaactttgggagaaccagaagctagacagtga

SEQ ID NO: 81584 - DNA, 705 bp, Glycine max
  Peptide Sequence Number=SeqID_198362
atgtctagttctacatgcttcccttcacttcctcgacttcttcgaccttctttcaccaaaaccaaatcatcacctaagttcagcatgagcatgagcaaggatccggttcgtgagtggattctttctgatgggaaagctacggagataaccaaaattagccctgttggtgggggttgtatcaatcttgctagtcgctacgacaccgatgctggttcattctttgttaaaacaaacaggagtattggaccatccatgtttgaagctgaggctcttggtttaggagctatgtatgaaaccgggactatccgtgtacctaagccctataaggttggaccgctacctactggtggttctttcatcattatggaattcatacaatttggtgcatctagaggctatcagtctgatctagggaggaagcttgctgaaatgcataaagctggaaaatctagtaaaggctttggtttcgatgttgataacaccattggcagcactccacaagtaaacacctggtcatcagattgggttcaattttatggagagcatagattgggttaccagttgaagttggcattagaccagtatggtgacagaactatttatgacaaagtgacaatttcctgttttcacattcttcttggtggagtaaccatagaacaagtgtcttcaagagtcttactggaggtaagaatgcagtacctttag

SEQ ID NO: 81585 - DNA, 177 bp, Glycine max
  Peptide Sequence Number=SeqID_198363
atggaggtgtcgcgtcggagctccggtaatcggagatgggcacgtgggatgcatgtgcctaagaatgacatgttgagaagtggcacgtgggatgcactgaaagagacaacccagatctgggtgtcagagataggtgctgtggtggtcggcggtgctggtgacggtggccggcgatag

SEQ ID NO: 81586 - DNA, 762 bp, Glycine max
  Peptide Sequence Number=SeqID_198364
atggaccctgacatcattgatattccacctccaacgaagaataatgtttctaattccatgaaacagaatgagatgagtaaagtgtgtttcgatggtagcaattctcactgggaaatgtaccttgacaccattgagattccacctctagtgaagcaaaattcttccatttccatgaagcaaaaagagagaattgaagggagaaagaggaagcgatccaatacactcccgaagcctgttcccactgcgccaccaccaacaccatcaccctcacctactaccaccgcggcggcgtgcggtggcgcaccccccacctgctttaactccggcacgctctccgccctcatccggtgcccctccggcgacacgagcggcctcaacttcaacctctacctctcctccctggagggaaacaagtcccaggacgagatcgacttcgagtttctcggccgcgacaggaacatcgtacaaacaaactacttctccgaaggtgtgggaaacatggaaaaggtccacgttttagggttcgatgcttccgatgggtttcatgagtatgggattgtgtgggggagcgacgcgatcgagtggcgcgtggatgggaacctggtgagaaggctatgtttttgtacgcttcgatgtgggatgcaagttgggttaatgaagggaagtggtgtgggaagtactgtgggactgttgttgttgaatgagtcactgcattttttatttgtagttggaaattttactttatgtgttgtttcagtgtaa

SEQ ID NO: 81587 - DNA, 696 bp, Glycine max
  Peptide Sequence Number=SeqID_198365
atgtttcaacatagaaaccatgatgatttcgcaactgtggcagggtttgctttcgtctacatggaagatgaacgtgatgctgagtatgcaatcagaaggcttgatagaacagaatttggtagaaagggtcgccggattcgtgttgagtggactaagcaagaacgtgacagtagaaggtcaggtggtgattccagaaaatcttcatctaattcaagaccatccaaaactttgtttgttataaattttgatcccgttaatgccaggacaagggatctggagagacattttgattcctatgggaaaatattaaatataagaatcagaaggaattttgcttttattcagtttgaatcccaggaggatgctactagagctttggaggcgaccaacctgagcaagtttatggaccgtgttatcactgtggagtatgccataagagatgatgatgacagagacagaaggaatggatacagtcctgatagaagaggccatgactctcctgatgggagatatggtcgtggtagatcccccagtccatatcgtagaggtaggggtagcccagattatggtcatggatcgaatccatcttccagaccagaaccaagaggaagccccaagtatgatcgagctgaaagcccaataaatgggagatatgatagccggtctcccccaccccgagataggtctcgatcttga

SEQ ID NO: 81588 - DNA, 1026 bp, Glycine max
  Peptide Sequence Number=SeqID_198366
atggctggagctgaagctacaaaatatgcttcttctgctacaagtcctacaatcactgcttcaaacaacagcatggctaccaaatcgaacaaaccaatttccgttagaaggttcattggggtgaggcaaagaccctcaggaaggtgggtggctgagatcaaagactcttctcagcacgtgaggttgtggcttggaacctatgatactcctgaagaagctgcaagggcttatgatgaagctgcaagagctctgagaggtgaaaatgctcgaaccaactttgcaccagtgagtcaactagtcaatggccaactgggtcaacaatcagggtttaataataataacaaccttctttcaactgggtctgatattgggaagcatggtttgagctttgcatccttgaaggccaagttgagcaagaatcttcagaacattatggctagggcaagtgatcacaacaacaacaacaacaacaagtcctcaaagagtagggtgagtgaccacttcacctttgccagcatcttccaccgtaggagttaccaaatccctgaaggtgacatgatgaagaacattgagaaagtggtgcagcctagtattattgtgcctcctatggaacaaagtggtggtgattataattcttgtgttgccaactgggaaagtgcttctagtgtctctgattgcagctctgagtgggtagggtttgggaataataattcgaaactcgggttggagtcagacgggtcggagatcggagaggctagtgttggtgatcaagggttcttggagcagttgatggggtgggttgaaagccctgatgttagtgatgagggttcaaggagtaagaggttcaaggtgtcttcttctgtgcttgtgccacctactttcactggctctccttatgattgtggatccccttataccggttatgcctctccttataatagcggttatgcctctccatataacaacaacggttgtgcctccccttgtaatggttatgcttctccttattacaataataagaagtga

SEQ ID NO: 81589 - DNA, 1698 bp, Glycine max
  Peptide Sequence Number=SeqID_198367
atggtggaagctactcaagctagtaaagataaccatgtggttgcatttgaagcccgttccacagaagactggttgttgcatgcacaggaacttgttcctgttgctcttgctaatgcaagggaggttaaggggtttcctggtaggtggaagatgatcatttcaaatttggagcagattccgtcacgtttatcggacttgtcaagccacccttgtttctccaagaatgctctttgcaaggagcaattgcaggctgtgtcaaagacacttaaagaagccgttgaattggctgagttgtgtgtgaaggagaagtatgagggcaaacttcggatgcagagtgatctcgatgcattaattgggaaactggatttgaatttgaaggattgtggtctcttgatcaagacgggcgtgcttggtgaagctactttgccattaacagtgttaggttctatggcagaatcagatattgcaacacacaacaatataagagaactacttgcgcgccttcagattggtcacttggaagcaaagcacaaagccttagacagactctacgatgttatgaaagaggatgagaagaatgttttggctgtttttggtaggagcaatatttctgctttagtccaattgctcacagcaacatctccaaggataagggagaagacagttaccgttatatgctctctcgtggagtcaggaagttgtgaaaagtggctagtttctgaaggagttctgccacctctcataaggcttgtcgaatctggtagtgctgtgggtaaagagaaggctacgctatctcttcagagattgtcaatgtcagctgaaacaactcgtgcaattgttggacatggtggtgtccggccattgattgagatttgtcaaagtggtgattctgtgtcgcaggcagctgccgcctgtactttgacaaatgtatcagctgttcctgaggtgagacaggctttggctgaagaaggtattgtgagggttatgatcagtcttcttaactgtggaattttattaggttccaaagagtatgcagcagaatgcttgcagaatctcactttaagcaatgagtatctgagaaagtctgtgatatcagaaggcggtgttaggagtcttctggcttatcttgacggtccacttccccaagaatctgcagttggagctttgaaaaatctgattggatcagtttctgaggaaactttagtttctcttggtttggttccctgtttggttcacgtgctgaagtccggatcattgggtgctcaacaagctgctgcgtctatcatctgccgtgtttgcagctcaatggagatgaagaaaatagttggtgaagccgggtgcatccctcttcttataaagatgcttgaggctaaagcaaataatgctagagaggttgctgctcaagcgatttcaagcctaatggttctgtcccagaatcggagagaggttaagaaggatgataaaagtgtgccaaatctggtccagttgcttgatccaagcccccagaacactgcaaaaaagtatgcagtttcttgccttggatcactttctccaagtaagaaatgtaagaaactgatgatttcatacggagcaattgggtatctgaagaagcttacagagatggacattccaggagctaaaaagctgctagagcgattggaaagagggaaattgagaagcttgttcagcagaaagtag

SEQ ID NO: 81590 - DNA, 315 bp, Glycine max
  Peptide Sequence Number=SeqID_198368
atggctcatttggtgtacatgctcaaaacacttgaaaggtaccaaaagtgcagctatggtgcagtggaagtcagcaaacctggcaaagagcttgagagcagctaccgtgagtacttgaagctgaaagcaagatttgaatctcttcaaaggacccaaaggaaccttcttggtgaagacttgggcccattaaataccaaagatcttgagcagcttgagcgccaactggattcatctcttaagcaagtgaggtcaacaaagaaaattatacatagaaagctcattaaagtggtacttataagttgttgcattgactga

SEQ ID NO: 81591 - DNA, 471 bp, Glycine max
  Peptide Sequence Number=SeqID_198369
atgtattatactatttttgtccataacagattccacacagttgcttatcttcaacaaatttggtggcttgaagtggaagatgatgttgattttcaatttccacctgggaaatacagtgtgttttttagactccagcttggcaggtcatccaagagattgggtcgtcgtgtttgtaagacggacgacattcatggctgggatataaaacctgtaaaatttcagctaacaacttctgatggtcaacgtgctgtatcccaaagtcatttggataatcccgggcactgggttctctaccatgcaggaaactttgtttccaagagtcctaatgatctgatgaagatcaaattttcattgactcaaattgattgcacgcataccaaaggcggaaggaaatctgtatatagtggaaatgagctgaggcacctgagtcctgagttgacttttgtcatttgggttacaggggggagttaa

SEQ ID NO: 81592 - DNA, 219 bp, Glycine max
  Peptide Sequence Number=SeqID_198370
atggggttgagattgaagaagtgggatgggataggaaagttagacaaagaagtaaggtccccgactttgactttccaacatgtacccgtattcgtccccgatacccgatgggttaaaatttgttatctcattcccgtaccgtcgggtatcagggatgtgtatgggaatgagtatgagatgggtagtgacatccccgtccctaaccctgactctaattaa

SEQ ID NO: 81593 - DNA, 1113 bp, Glycine max
  Peptide Sequence Number=SeqID_198371
atgggatacaatgattttggagagttttactatgctcatggtcaattgggggacgcttttaaaagttatgtccgtactcgggattattgcactacatcaaagcacattgttcatatgtgtatgagtgcaattctggtcagcattgaaatgggtcaatttcctcatgttacaagctatgttagcaaggcagaacagtcaccagatgcccttgaagcagtaacagttgcaaagctacgatgtgctgcaggattggctaatctagaagccaaaaagtacaagcttgctgcccgaaaggtctgttccttagcactctactttctcagtcagtctagactagatccatctagcatggtctatgaaattcctgatttggaggcccaacgatgtgaattggatgttggatcctttttgggtgtgaattgcaaacggatcgcttgtatcattccagaatcgcatgaattgccagttgtttttgaattgtgtgtgtctggcgcagcaactgatgaagcaggtcacgtccccaaaacagggttgggtcatgcacggactaactgtgtaacagcagtgcgcaatttcattttctgctttgacctccctgttagtgtttgcggcgctgcaatctctcaaggagttaggattccaggagacaaattgggccattttctagaaacaggacctgaactgggaagtcactataatgacgtaattgcacctcaagatgttgcaacatatggaggactttgtgcacttgcaacatttgatcgggcagagttaaaggcaagctctccattatattgttgtgatgacaattccaacttccgcaatttcttagagttagtacctgaagtaagggaactgataaatgatttttactcaagtcactatgcttcatgtctggaatacctcgggaacctcaaagcaaacctattgcttgatatacatttgcatgaccatgttgagacactttatgatcaaattcgtcacaaagcccttatccagtacacactcccatttgtgtctgttgatttgaacatgatggctaatgcattcaagacaactgttgcgggacttgagaaggaactagaagcattgattactgataatcagatacag

SEQ ID NO: 81594 - DNA, 834 bp, Glycine max
  Peptide Sequence Number=SeqID_198372
atgccgtgcatttttaagaataaaataaaagtgaaggtatgggggaggaaatatggaggcaatctaaatgaagctattaatgcccattttcttgaggtggataggcacatgtatggcaatgtggattcatctgatggtgggcttcctcgaggtcattttcagcaagaagatgatgatttggctcatgcacttttgttgtccttagaggtttttgaatattcattttattttgacaattcaatttctccttttccagtctttctgaattttagttgcattgaatttagactgcagagcaagaggccaaatagaggtaagtggggtggtatttcttctgaagagcttaatgaagcattgttcgctgaaactgcactttttggtgaaatttccaatcacagttctcaccatatttcatccttgcctaatctgcaacatcatccagaacaaaatgtggatccgaaggcacaatgtctgtccacttctatgtcacaattattaaatgactctcgcttgctgaaacaacaacaggtttggattctggcctgtgatggctgtgtgatcaaggattctgaatatctagagtcactacgagctgataaacaaaaggaattgagttctctcaataaagctgaaagccattcctcaaaggaacaagagtcatacaaaaaaatgcttgtaaaaaaggaattgaggaaaattcttgacaagaaagaagttaggctttccaaagaaccgccgttatctgatgaagtaattactatcgttgttcgaatgccagttgacaaactagaggtaaaattagcgttagaatatgatgaaatccttacagcataa

SEQ ID NO: 81595 - DNA, 258 bp, Glycine max
  Peptide Sequence Number=SeqID_198373
atgaggccattggttttatcgggtacaagttctattgaaaatgctacttatttcgttggtgtttgttcaagcgacaaatctaatgcctttacccaaaaagctaaaaatgattattctttgcagacgaatgaaaaacttcaaaggacaaacaaaacaagtggtgggagaaaaggaatggctggtgatggagatatggacacttcttgtggtcctcaatgccctcttctttctattctcatttttcacatatccaactaa

SEQ ID NO: 81596 - DNA, 1341 bp, Glycine max
  Peptide Sequence Number=SeqID_198374
atgccatacaacaagattgctgacaggaaaggtcaccaaggatggatgaagcttgaaggtcctcactttatattccctggaggtggcacaatgtttccagatggagcagagcagtatattgaaaaacttggtcaatacattccaataaatggtggtgttctgaggactgctctagatatgggatgtggggttgccagttttggaggatatttactagctcaaaacatattaaccatgtcttttgctccaagagattcacacaaatcacagatacaatttgcacttgaaagaggagtaccagcttttgttgccatgcttggtactcgcagactcccatttcctgcatttggctttgacttagtccattgttctcggtgtttaatcccttttacagcctacaatgtatcttatttcattgaagtggacagattacttcgccctggtggatatttagtcatttctggtccccctgttcagtggcctaaacaagataaagaatggtcagatctccaggctgtggcaagagctttgtgttatgaactgattgctgtagatggtaacactgtgatctggaaaaagccagcagcggagatgtgtctccccaaccaaaatgaatttggtctagacttatgtgatgattcagatgacccaagttttgcatggtacttcaaattgaagaaatgcgtcactaggatgtcttctgtcaaaggtgaatatgctattggcacaattcccaagtggccagaaaggctaactgcttctccactgagatccacagtcctgaaaaatggtgctgatgtatatgaggcagacactaagcgatgggtaaggagggttgcacactataagaactctctaaaaataaagttggggacttcagcagtacgcaatgtcatggatatgaatgcattttttgggggatttgccgcagcactaaattctgatcctgtgtgggtaatgaatgttgttccatctcacaagccaataactcttgatgcaatctttgacagaggtcttattggagtttatcatgattggtgtgaacctttctcaacatatcctcgcacctatgacctgatacatgtggcaagcatggaatcacttgtaaaggatccagcctctggcagaaacagatgtacccttcttgatttgatggtggaactcgatcgaattttacgcccagaaggcactgttgtggtgagggatacccctgaagtaattgagaaagtagctcgggttgcacatgcagtgaggtggaagcccaccatatataacaaagaacctgaatcacatggcagggagaaaatcctagttgcaaccaagaccttctggaaaagctaa

SEQ ID NO: 81597 - DNA, 270 bp, Glycine max
  Peptide Sequence Number=SeqID_198375
atggggagaggaagggttcagctgaagcagatcgagaacaaaatcagccgccaagtgacgttttccaaaaggagaactgggctgcgaaagaaagctaatgaaatctctgtgctctgtgatgctcaagtggcactgattgtgttcaatgctaaagggaagctttttgagtattcttctgaatccagcttgcttcaaagtcaaaataaaatagtactcaggaatgttttaaattgtgcggccgtgattacaatttcgtcgcaatctttgtga

SEQ ID NO: 81598 - DNA, 354 bp, Glycine max
  Peptide Sequence Number=SeqID_198376
atggatttggagatagttcaagctgatgatatacaagatgatgaagactcaaaattttcaaaaataattcaagactccattgatgatgagattgttaaagattccatggatacaaaagatgatgaagactctatattttcaaagatagttcaagattccatggatttaaaggtggttcaagactcaatagatgcagaagatgaagcctctattgatattttaaatcttcctacagattgtggattcgctttgaacaaatttcctgatgatgatgatgatgaaagttcagatgaaaagggccttaaagtagaagtaagggctctgataaagatttatcttccaaagttttattaa

SEQ ID NO: 81599 - DNA, 312 bp, Glycine max
  Peptide Sequence Number=SeqID_198377
atggcgacagaggaagcacacgaagatctaaaacccatcattgtcgcacttaggaagccattgccaatgggtgatccaatggagatgatgggtggtaaggcgaaggatgagtttggtgtaaggatcgtcaatgatggtgttgggctattgaggcttgggtcgatggtggtattgggtggaggtgggacctgcttgggagaagtaggagtatttgtgtttgttcaggtctcttgggtggttcaagaaacaaaaagtgaggtgcaggaagcatatgccttaacaatggtagctagagttggttcgtatcattag

SEQ ID NO: 81600 - DNA, 747 bp, Glycine max
  Peptide Sequence Number=SeqID_198378
atggaaaggctaaattttattaaaaatggagtgagtagattgcctccaggttttcgtttccagccaacagatgaagagcttgtgtttcagtacttgaaatgtaagatattctcgtgccagttgccagcttcaatcattcctgagattaatgtcagcaaaaatgatccttgggatttgccaggaaattgtgatgagcaagagaggtactttttcagctccaaggaagccaagtatcgaaacggcaatcgtatgaaccgaacaactaactctggctattggaaggcaacaggatcagacaaaaaaatttcatcatcaataagtaatattggttttgcggggcttagaaaaactctagtattttatgaaggaaaatctccaaatgggtctcgaactgattgggtcatgcatgaatatcgactcgtcagcttagaaactattccttccaattcatcccagaactatgcaaacgagataggggattggattttgtgtcgcatattcatgaagaaaagaagtatagaaagtgataacaacaatactgctcccagaaagaacaatgcagtgacgaattatgctcaggtggctcagccaagattctttgattttttgagtgttcacaattcagctcctccggttcctatacaatattcttctacatcctcatcctgttcaagttccaataacgttgtagaggcttcttcccctaataaccacgaagaaacaagcagcggctatgctcatttttaa

SEQ ID NO: 81601 - DNA, 588 bp, Glycine max
  Peptide Sequence Number=SeqID_198379
atggactcagaggagatatcaatttggaaagcaatgatcaaaactcctgcttccattgcactaataatatactccttcatttctgtctggtttgttggtggcctcactgttttccacacatatctaatcagcaaaaaccagtcaacatatgaaaattttagataccgttatgaccaacaagccaacccttatgacaaaggagtagctgcgaacttcagagaaatattttgctccagcattcctccatccaagaacaacttcaggtctaagattctgattccaaaggaaccatcagaatcatctagaagaagaactgttgaatccctgagccctatgatgagaaaaacagcaggagaccttgaactaggaaccaccccagggtacaatgaatttgaggaagaggaggaggaaagtgattatgcagatgagtttaccaatgatgaggaacatggaaaggttagtggaataggtgatgatatgtctgtggatttgaccaggatgcttcacacagaaggggggcagagagaagttgcttcacttctaaggcactcgctgtgggaaagaagcagcaaagaaaatgggacataa

SEQ ID NO: 81602 - DNA, 237 bp, Glycine max
  Peptide Sequence Number=SeqID_198380
atgcaggaagaacaacaaagagccatggttaatgaaatggtggcaaagctaacgagtgaatgctgggacaaatgcatcacgggtacacctgggaataaattcagttccagtgaatctaattgtctttcaaactgtgcacaacgttacttggagatgagcatgcttatcatgaaaaggtttcaggagagaaataaagctgttcgtatggttatggcggatgacttatggcttatgtga

SEQ ID NO: 81603 - DNA, 546 bp, Glycine max
  Peptide Sequence Number=SeqID_198381
gtggtggtgcggcgtcatgatgagggtgcatgcgatggacaacaaggttgttgccatcgtgagaggggtgaaggaagtggcactatgtggaggacgaggtcgttaccgtcgcattttaagggggtgccatcacaagagtatgcttgtgagggaggtgccgtcgtgggtgttaggactacaattagtttgaaggacaaacaagcaaccactagaagaggttcagatggtgaacatatcacacccaaaactgccttagaggatccaattgaaggtataggacttgagtcccatgttggaaagtgtggggtttataaggccttgggctctctaactacaaaggctagttatgtgatgtggttctcccaagcagatattgcagtattcgtctacgagtccaagactaatcaaagggttagtgcagagccaacccacgtgcacattggagctgtggagtgtggtgggatgttaggattcatttgtaaggtacgtaactcgagtctcacattggaagtacgtgattctagtatgggttttatacagccttag

SEQ ID NO: 81604 - DNA, 666 bp, Glycine max
  Peptide Sequence Number=SeqID_198382
atggtgatgtgctacatagatgcatccataaagaaatattgggaatgtatcaattattcgtcaatattccgtagaggggatgctcattcaattccttcgtctattcaaggggcagcatctataacttcagcagcatcactcgataattcactatctgacatgtaccgctctcctccaaggccattaccatatgatgcagaacccagatattttcgctcacaacgtgatggactagtttcaaggcgtgagaagggttcaagtcattcaaatgaggaaacagaacctctaagaagtgatgcagatctggatccagagtctttaaattcaggagacaaatggaatgaaagtgcctgtgaagctgggtcaaaggaataccattctaagtcctccctaagacttcaatcaacaaaatattcaactggagtgggccttgtctatgcatcatcagaggaggaggatgtttgtccaacttgtcttgaagtggaaaacacactattaaaggagcaggatctttggagattcttactttctaaactgtttttgcttgcagaatacactaaagagaatccaaagataatgacaaaatgctctcatcattttcaccttggttgcatttatgagtggatggagagaagtgacaactgtccagtttgtggaaagcaatga

SEQ ID NO: 81605 - DNA, 520 bp, Glycine max
  Peptide Sequence Number=SeqID_198383
gttgggagaatgcacaagaatcggtggtaagaccccttcgagcttgttctcgtataaattcaacgacctgagtgacaatttgcataactcggtcggaatcatcccagttaactcgcataacaggaggttgcagccagtgaggatcaacgttttgagtgaggttgctgaaggaagatggtattgttccggtgaggaggttaagcattttgaggcgagagagggcggcaagactttgttgatggattggcaagctcgtcaaaatatcgtcggagaggttgaggtgttagagcatgacgattccaacaaaggaggagacaatgcggcagaggatgacgagaaaggggttggagaaggaggcaaatgggaggctcccgacggtaatcgtgacggtgaaagggtcacaagtgatgccgtgccaccgacatgggttggtggcagaggagtcccagttggagaaggcatttttcggattgaaaaactaccgttttgcttcgaggaggaagagagtgtcttgggttag

SEQ ID NO: 81606 - DNA, 129 bp, Glycine max
  Peptide Sequence Number=SeqID_198384
atggaagtcactgaggctaagtctcacccaagtgtggggaagaatgaccctcccaagataaaaggcattccaaaaaaccttgcatggaagaatattaaaagtgatggatttatgaagcttggtgagtaa

SEQ ID NO: 81607 - DNA, 2601 bp, Glycine max
  Peptide Sequence Number=SeqID_198385
atgtttgtccccttaggactgattaaagcaagcttagtccaattattgagaatcccaaggacggtttgggaagaaaggtttgggatttctgtgaatgagtcccatcccatggatctgatggcgaagccaccctatgattacgacaaatcaggtagtggcggtgccagaatcaacaatttttcagatattccttacaataacaacaacgttaccaacaccaccaccaccaacaacaacaacaacgatagaatgccctttggtgcaatctctcagccacgcctcgtgaccacaactcccactttagccaaatccatgttcaactcaccagggctatctctggcacttgtgagagatctccagcaaacgagtatagatggacaagaagatgtgaatagaatggctgagaatagcttcgaaccgaacggtttgagaagaagccgtgaagatgaacatgaaagcagatctggcagcgacaacatggacggcggttccggcgacgaacacgacgccgccgacaaccctccgaggaaaaaacgctatcaccgacacacccctcagcagatacaagaacttgaagcgttgttcaaggagtgtcctcatccagatgaaaagcaaaggcttgaactgagtagaaggctgtgtttggaaactcgtcagacccagttggagcggcacgagaacacgttgctgaggcaagagaacgacaagcttcgagcggagaacatgtccataagggacgcaatgaggaaccccatgtgctccaattgcggcggcctagccatcatcggcgagatttcgctggaggagcagcacctccgcatcgagaatgcgcgcctcaaagacgaacttgaccgcgtgtgtgcactcgcgggcaagttcttggggcgccccgtttcctccctgccgagtctagagctcggcatgggaggaaacgggttcgcaggaatgcctgcggcaacattgccgctggcacaagatttcgcaatgggtatgtctgtgtcaatgaataataatgcgttggctatggtgtctccaccgactagtactaggccggccgcggccggattcgataggtcggtggagaggtcgatgtttctcgagctagccttggctgctatggatgagttggtgaagatggcgcagactggggaacctctttggatgaggaatgttgaaggagggagggaaattttgaaccatgaggagtacgtgaggaacttcactccttccattggtttgagacccaatggttttgtgtctgaggcctctagggaaaatgggatggtcatcattaacagcttggcacttgttgagactcttatggactcgaatcggtgggcagagatgtttccttgtatcattgccagaacatccaccacggaagtgatatctagtggaattaacggaacaagaaatggagcacttcaattaatgcatgctgaacttcaagttctttcgcctttggtgccggttcgtgaggtgaatttcctacggttttgcaagcagcacgcagaagggttgtgggctgtggtggatgtgtccatagatagcatcagagaaagttcaggagcacccacttttgtgaacggtaggaggcttccttctggttgcgtggtgcaagatatgcccaatggttattccaaggtgacatgggtggagcatgcagaatacgaagaaagccaagttcaccagctctataggcctttgttgagctcaggcatggggtttggtgcccaacgttgggtggctacccttcaacgccaatgcgagtgccttgccattctaatgtcctcagcagcaccctctcgagaccattccgcaataacagcagggggaaggaggagcatggtgaagctggcgcagcggatgacgaacaacttctgcgcgggggtgtgcgcctcgacggtgcacaagtggaacaagctcaacgccgccgctaacgtcgacgaggatgtcagggtcatgacgcgcaagagcgtcgacgaccccggggagccgccggggatcgtcctcagcgccgccacctccgtctggctacccgtctccccccaccgcctcttcgacttcctccgcgacgagcgcctccgcagcgagtgggacatcctctccaacggtggccccatgcaggagatggcccacatcgccaagggccaagaccacggcaacgccgtctctctccttagagccagtgcgataaattccaaccagagtagcatgctgatactgcaggagacatgcatagacgcagcagggtcgcttgtggtgtacgcgccggtggatatcccagccatgcacgtggtgatgaacggtggcgattcggcttacgtggcgttgttaccttcagggttcgcgatcgtccccgatgggcctgggtctcgtgggcctcatcagaacgggcccacttcctcaacaacaacaacaacaaacggcggtgataacggcgtgacgcgcgtgagtgggtccctcctaacggtggcgtttcagatccttgtgaatagtctccctacggcgaagctcacggtagagtccgtggaaaccgtgaacaacctcatctcctgcaccgttcaaaagatcaaagccgcgctacactgcgaaagttaa

SEQ ID NO: 81608 - DNA, 783 bp, Glycine max
  Peptide Sequence Number=SeqID_198386
atggccattaaccatgaaacttgggctttcgttttcggccttctaggcaacgtgatctcctttatggtgttcctcgctccattaccgactttttaccaaatctacaagaagaaatctacagaagagttccaatcactaccttatgttgttgcattgttcagttcaatgctttggatctattacgcactcgtcaaaaaggatgctagcctccttctcattactattaactcctttggatgtgtgatagagacgatataccttgcaatcttcctaatttacgccccaagcaaaaccaggctttggaccatcaagcttcttctcatgttgaatgtttttggattcggagcgatgcttctttcaaccctctaccttacaacaggatccaaacgtcttactgtgataggatggatttgccttgttttcaacataagcgtttttgctgctcctctatgcattataaaacgtgtcataaagacgaagagcgtggaattcatgcctttcagtttgtccttctttttgactataaatgctgtcatgtggttcttctatggccttctcctcaaggactattacgtcgctctaccaaatacgcttgggtttctattcagcataattcagatggtgttgtatttgatttatagaaacgccaagacacctgatctgccaatgaaattgcaagaactaaatagtcatactattgacgttgggaagctgagcagaatggaaccctctgagccgaatcatctaacaaaaaatggtactttaactgaaagagaaatctga

SEQ ID NO: 81609 - DNA, 1230 bp, Glycine max
  Peptide Sequence Number=SeqID_198387
atgggctcgtcgggatatggtaggtatgcctcaggcttgtcaggatttggtgggtgcgcgatggaattgtcgaggtttggtgggtgcacgacggagttatccgaggtttggtgcatatgcgacgaagttgttgaggtcgctaacgatggtgtgccaccttgcagatctatgttgaacctcattgtacgagacaaagaaaaggagagggaggttgtgtcgtttgatgattggggaggtggtagaggcaagttcgatgatggtattgccagtgtgtgcgacagaggagaggaggaagcaccatttcattgtaggcttgaagaccaatctatcttattgtgctgcaagttctttgtctctgaatcacgcaacaatgccactctcaatgcaatagaacgagctgcaaggtcaaacccagaaactgtgattgtgaacatgtttcatgatcgagcttataacagggcaaggtacgaccttgtgtcgtatgttttgcatgactgcacaggaaatcccatatacagccccttgcatcaaactgtcatagccatggctgaggctacattcaatgccgtcaaccttgaattccatgaaggtgctcaccctcgcttgggcgcagtggacgacattgttttccatccacttggtcatgcgtcgctcgacgaggcagcgtggctcgccaaagcagtggcagcagacattggcaaccgattcagtgtgccagtgtttctgtacgctgcagcccacccaacagggaaggaacttgacgccataaggcgagagcttggatattacaggccaaattctaggggcagccaatgggccgggtgggcaatgcccgaaacgcttcctctaagcccagatgaagggcctaacgtcgtttcaagagctaaaggcatcacaatgattggtgcacgcccttgggtcacactctacaacgttccaattttgtgcactgatgtgtcagtagcaagaaggattgcaaggaaggtgagtgctcgtggcggtggcctccccactatgcaaacgattgcgcttgtccatgaggactcaactgagatagcctgcatgcttttggactccaagcaggttggagcggatagggttcaaaatagggttgagatgctggccgcacaagagggactggacatagaacaaggttatttcactgacatttctccagaaatgatcgtagagaaatacatgaaattaatcaatagtgctaacaaatcgtga

SEQ ID NO: 81610 - DNA, 158 bp, Glycine max
  Peptide Sequence Number=SeqID_198388
atgaaggaaggacaagccatcaaagttcaaagtatgaaagtcactgtagggcaagagagtccgatccacacacatgttgccttaacgatatgtgtgttgaaaaacaagattggaatggttatcctgcgaatgatagaagcatacggatgcaaaaagag

SEQ ID NO: 81611 - DNA, 966 bp, Glycine max
  Peptide Sequence Number=SeqID_198389
atggcagctttttcataccaataccatccttttcttgttgaccctgcattctttcccaacaacttaaacactcctaactctcctcctcctcctcttccttctcagtttcaacaactccctcatgaaacatcatcttttaatgtcacaaaccaggagactagctgtgttgaccagagctccaagatcaccatcagtgacaatgagccttctgtcactaaaaaccttagccctcagtcctccatggtagtcgacaagcttgaaactggggagcaggtcactcagaaggtgaacattcctgtggacaagaaaaggagaactagaaatggttcttccttcaccagtaacccccaatccaaggatactgcaacagaagggaaaaacaagaaacaaaggaagaacaatggtgggttgaaagaagaggacaaggcaaaagaagagaagaaggatcagagaaagtgtcctgaagagcccccaacaggctatatccacgtcagagcaagaaggggtcaggcaacggatagccacagccttgctgaaagggtgagaagagagaagataagtgaaaggatgaaggtgttgcaacggcttgtgccaggctgtgataaggtgactggaaaggcccttatgttggatgaaataatcaattatgttcagtctttacagaatcaagttgagaaactaaatagcatggcatcaccatcaccactaccatcaatgtcacattgcaacagccccaacaaccaagccacaacttttgctgatacaaccaccatgacccccaccaacatcttccacactactagtgactatcttttggataattcagtctcattttttcttcaagggcagaggccaaatgtgttatctgaggaggataccggtagtcatttctgggacgcagaggaccagcgacaaaagtttcttcatccatatggattcagcaacaacttatgttcctttcattaa

SEQ ID NO: 81612 - DNA, 138 bp, Glycine max
  Peptide Sequence Number=SeqID_198390
atggctccgcacataagacaaaacaccatgttttggatcacattcttatcttcaatgggacgcgcaaaggaagtaggaggggggagaatgcttagcggcatcgtgactcgtgaggaggaggtcgcaaggctgtcgtga

SEQ ID NO: 81613 - DNA, 1008 bp, Glycine max
  Peptide Sequence Number=SeqID_198391
atgagcattgaggatgatggttcaaactccaatgaatcatcaagttatagattaactgtaattggaacaactggtttcaccatccaactaggatacgagagtggcagggagagtgtgcagcaagcatgtgtatctgttggtttcccaattgtacaaagtgttactgatgttattgagatggaactggtcatgactgagaggagagtgaggttttctattgaagatgagcctgagagtgatgcaaggtctgagataagagtgcaaatgcaggaagagttggaagatctttatgctgctcaagaagctgggattgccttcattctagggcattctcatgtaagagcaaagcaaggctcatctgtactaaaaaagttggcacttaactttggctacaatttcttgagaaggaattgtagaggccctgatgttgcacttaaggttcccccagtttctcttttggaagttggcatgattaggaggtacactaacaacagtttctcttcaaagtcaggaggacttttacatgacaccaccaatcacagcaaggttaatagaagcatgaaattcagagtttcagctaaacaagagaagcaagaagagaagaaaaagcaatctttgttcaacagtgtgactaaagctcttgatttttctcaagtgagatctgctgaggatgctcagcttatagaagaggctagagaagctacaagatcaggtgaaaggatgagtagggaacaatatggagctcttagaaggaaaattggtggtacatacaaggattttttcaaatcttacgttgaaggattaaaatgttggattttgatcttacccaagcctaaagaaaaagtggaggctcgagtcagtgatcgtgaatatcaagctacattccctcacacagcttctatgattgacttggcagctaagatgataagggaaggccgaggtttagagttaatgccaatggaagtagatcctactgcccccaataactgtctattggtgagtgtatag

SEQ ID NO: 81614 - DNA, 213 bp, Glycine max
  Peptide Sequence Number=SeqID_198392
atggtggcagcttcggcttcagaaacagaggcgtctcaaactctaatcaaaatctgggcgaggcagagaggcggtggagagtttcgcggtcgatccaggcttggatttcgtacccgatttcgacgacgacgcgtgagagggagtgtgtggagaggggcacgtgaggaaggatcggaggcccttagagttgttgagggagtcgacgagggttga

SEQ ID NO: 81615 - DNA, 525 bp, Glycine max
  Peptide Sequence Number=SeqID_198393
atgggggcaagctcgggtacagtactagagatcacagttatatcatgcgaaaaccttcgtgtcacggaggatccgtacgttgtcgttagggcagagtccttaaagtgttgcaccacgaagatggcgaaagatagtgggagcaacaaaacgggtttgttttcgtggaacgagaagttgatgctgaacatgcccatgcatgcaaggtccatcacgttcgaggtgcaatgcaacaggttcaagggtcttcgacccgtcggggtggcaagaattgcggtttccgattttctcggcggcgctgccgtgtcggaaaattgcttgcatgagttgagttaccggctgagggactgggaagggaagggaaacggggtgattcatttcggggtgagggtggtgccgccggaggaacgttcgaatgctgccgtgaaaccggtgaagggaatgacggtgagtaaggattccggtgattataagtcaaatgaagttgttggtgtcccgttttggtggaactaccctaacgttatttga

SEQ ID NO: 81616 - DNA, 543 bp, Glycine max
  Peptide Sequence Number=SeqID_198394
atggaggcaaaaccacaagcacgaaccctagagatcaccgttatgtcgggagaaaacatatgtgtggatcgaagttctggggcggagaacgtgtatgttgttgttcgtgccgaatctctaaattcttgcacgacaaaaacggtgaatgaagataagggagtgcatgcatggaatgagaaactcttattagacattcctacacatgcaaggtcggttacgtttgaggtgcaatgcaagaaatataaaggggttcgccctataggggtagcaaggatagcactttcggattttcttagtaacgatactaagattgtgtcggaaagtgtgcctcaaatgtattgttacggattgaggaattgggaaggtcgacaaaacggtgttattcatttctcagtgaaggtggtgtcactagctggcgataaatatttgtgttcagagacaaaacaagaaaaagacataataggaattgagcattccagtttggtggagttaccaaagtgttcctgtttgaagttttttttccccatttttagatggagataa

SEQ ID NO: 81617 - DNA, 576 bp, Glycine max
  Peptide Sequence Number=SeqID_198395
atggaggtaaaaccacaagcacgcaccttagagataacggttatgtcgggagaaaacataagcatggatcgaagttcggtggcggagaacgtgtatgttgttgttcgtgccgaatctcttaactcttgcagaaccaaaatggtgaatgaagaaggtggagtgcatgcatggaatgagaagtttttattagacattcctttgtatgcaaaatcagttacgtttgaggtgcaatgcaagaaatataaaggagttcgccctattggggtagcaaggatagcactttcggatcttcttagtaacaatactaaggttgtttccgaaggtagtgtgcctcaaatgttgtgttacgggttgaggaattcggaaggtcgaccaaacggggttattcatttctccgtgagaatggtggcaccaagggataatttgtactcactaacaaaacaagaaaaagacatcacaacgatgagttctaaaggaattgaacatgaggttatggggattcaggtggacccaaaaatttcacctcatgttgccattggcattccagtttggtggagttaccaaagcgttatttga

SEQ ID NO: 81618 - DNA, 336 bp, Glycine max
  Peptide Sequence Number=SeqID_198396
atgctgtacatctcagaacaaactgttgatcgatctgttaaagggttgagtgctgatagatcagctcgcatttctggtgtttcactgacatcaaattttaatgaaaaagtgctcaatgaatgtgaagaaaattccaatggagactttggcatcgatcccatgtgtacaaattgtccaaatttggcacccaaaggatcttcttgtggtcaagccttttcattattgcatcacagatatgatagtgatgaagaaggtctgtggctacattgtattcgttactctggacctggatggacgtatgagtgtccatatcctgattgggcaaaacttggctag

SEQ ID NO: 81619 - DNA, 519 bp, Glycine max
  Peptide Sequence Number=SeqID_198397
atgaagagaaagagagaaggcaaagagggcatggataatatcgtgtggcagactccagcgaatcccccgcaccctaacgattacgtctttcgaaacgggattcgatacgttagaccatactacttcgaattcatcgctcatgttaaaaatcggtgggcagggaaaaccattgtggatttgttcgctgaggaattcaaaggtcgaccttatgagtattatgttagtgcagtgaaatgtggaaggattcaagtggatggtgagatggtaccggtttcatacatagttaaatcatctcaaaagataagccatttcttacacaggcatgaaccacctgtgatggcttgtgaggttcctgttcttcaaaaagatattgatgtgctaactgtttgtaagccagcatctgtcccttttgctctaaatttcatatatgctaaagctgtgaattttagtaggtgcacccatgtggtcaatatcgtaagaacactgttgttggcattcttcaagctgagcatgggctga

SEQ ID NO: 81620 - DNA, 1347 bp, Glycine max
  Peptide Sequence Number=SeqID_198398
atgccgtcctatttgaggcactgttttgcgttcttttctctttatcctaaagattttggctttaccggtgctcttattgctaatctttgggcagcacttggattgcttcgatctccagttggaagtcagaagatggagaacattgcaagacagtatgtagatgagttacactcaagatcatttcttgaggattttgtggatttaggtcacttttactatttcaaagtacatgatttggtacatgatcttgccctgtatgtttcaaaaggagagcttctagtggtaaactaccggacacgaaacatacctgagcaagtaaggcatctatcagttgttgaaaatgatccacttagccatgttgtgtttcccaagtccagaaggatgagaactatattatttcccatctatggaatgggtgctgagagtaaaaatcttttggacacatggataaagagatacaaatacttacgggttttagatttaagtgattcctctgttgagactctacctaattcaattgctaaattgcagcatctgcgagctcttcatcttacaaataactgcaaaataaaaagacttcctcattctatatgcaaactccagaatttgcagtacttgtcactcagaggatgcattgaacttgaaacattgcctaaaggattagggatgttaatcagccttcgaaaattgtatataaccacgaaacaatctattctctcagaggatgattttgcaagtttgagcaatcttcaaaccttgagttttgaatattgtgacaatttgaagtttttgttcagaggggcacaactcccttaccttgaagttttgctcattcaatcatgtgggagcctagagtccttacctcttcatattctccctaaactagaggttctgtttgtaatacggtgtgagatgctaaatctgtcgtttaactatgaaagcccaatgccaagattcaggatgaagtttctgcatcttgagcattgttcaaggcaacagacattgcctcaatggattcaaggagccgctgacactttgcagacattgttaattttacactttcccagtctagagtttcttcctgagtggctggcaacaatgactcgtcttaagatactccatatttttaactgtcctcaactgttgtatcttccaagtgacatgcttggcctcactgcccttgaaagattgatcatagatgcttgtcctgaattgtgtcgaaaatgtcacccccaatttggtgagtactggtccttaatagctcacatcaaacacatttccattggagaaacaaaagcaaggcaacgacttttccgaatacagtcccagctgcggttgagattgtga

SEQ ID NO: 81621 - DNA, 534 bp, Glycine max
  Peptide Sequence Number=SeqID_198399
atggacaaagaagaaagagaaattctatctaatgaggagcaaaaactatatttcatattgaacgttggaatcatgaaaggctacaaagatatccttttgcaattcttggaagaagaggaagatgttatggagggggttcaagtgaatgtgtatgacaagttcctggaagaagaggaagatgttatggaggggattcaagtgaatgtgtacgacaagggtaggcacaggttcaaattgatgctcaacaaaatgatacaggttggacttgtcactggtgagttgagtcctgtatggcatactcaactcactttttcatgtgaggaactcacttggtggcaagacccctcctcacattcaagttcagggagggataagtacttggccaaagaagagagagaacttctagttgaacattggaattggaaaagattgcgagttgagtatttccttgaagatgaagatgttatggaagggattcaagtgaatgtgtacttcaagggcgggcacgagttagaaatgattctcaacaaatga

SEQ ID NO: 81622 - DNA, 1072 bp, Glycine max
  Peptide Sequence Number=SeqID_198400
atggccgaaatttatgtctccaatattgctgcatcactgttagggaagcttgcttctcacgtttatgaagaagcttctcgggcctatgttgtgtatgaggatctgcaagggatcaaagactctttgtcaattgtcaatggtgtactattgggtgctgaggagaagaaggagctaaggcaagggcttcgggaatggctgaggcagattcaaaacgtctgctacgatgctgaagatgtgttggatgaatttgagtgccaaaaattgcgaaagcaagttgtcaaagcttcaggcagcaccagcatgaaggtaggacacttcttttcttcgttaaatcctcttgttttccgtcttagggtgactcgtcgaatcaaagatgttagggagagattggataagatagcagctgatggaaacaagtttggtcttgagaggattggtggtgatcatagacttgtgcctaggagagaaatgactcattcccatgttgatgcttcaggggtgataggaaggggaaatgatagggaagaaattatcaagcttttgatgcaacctcaccctcatggtgatggtgatggagataaaagtctttgtgttattcccatagtgggtattggaggcttggggaagaccacacttgcaaagttggtcttcaatgataagaggatggatgaacttttccaattgaagatgtgggtgtgtgtttctgatgattttgacattaggcagatgattattaaaatcatcaattctgctgcttatgcttcagctccagctattgctacccaagaaaacattagcagcttagatattgagcagctacaaagtcgtctaagatataagctttcgggtcagaaatttttactagtcttagatgatacgtggaatgatgatcgggcaaaatggacagagttgaaagatttaataaaagttggtgccgcgggaagcaaaatcatagtcacaacgcgaagtaactcaattgcttcaatgattggcactgttccctcatacattttagaaggtctttccattgagaattgtttatctctgtttgtcaaatgggcatttaaggaag

SEQ ID NO: 81623 - DNA, 177 bp, Glycine max
  Peptide Sequence Number=SeqID_198401
atgtcaccccaaatcgcctccaacgactgcgcatggcggacaatggctccgacaaaggagtttagatcagatcgttgggtgaatgacatgtcgccccaaatcgcctccaacgactgcgcatggcggacaatggctccgacaaaggagtttagacagatcgttgtgagttcaaagtaa

SEQ ID NO: 81624 - DNA, 480 bp, Glycine max
  Peptide Sequence Number=SeqID_198402
ggtctccacgtaaggggaaagcccacgcccaacatcaaagtgttcgcggtggttcgcgcggagtcaataacgagccacaccacggccatggtgacgacgacaacgaccaacgggagcgacaacggcttccagtacttgtggaacgagaagttctgggtggagcttgggcctcgcgcaaggtgcgtgacgattgaagtgaagtgcaggacggaaacgggagtggtgagagacgtcggcgtggcgagaattgcggtttcggattttcttggagggtcgtcggtgcctgatcattgcttgcagtctttgtgttacaggttgagggattgggatggcagagaaaacggagtcgttaatttctccgttagggtggcgccgcctcctactccgccgccacctccgccgccgccgccgccggcggaaggtgctgaaatttattgttcgtcgtctacttcgggtactggagttgttactggcattccg

SEQ ID NO: 81625 - DNA, 400 bp, Glycine max
  Peptide Sequence Number=SeqID_198403
atggctcttttagtgtccgattttggaccaagaatcactattaaaatagtggagaatttgcgtgaggatatattttcagggaagcttaaatcagggaatgagataaaggaagcactgaagaggaacgttttggaattattaacttccaaggggagtaaaactgaacttcaacttggatacaggaagccagctgtaataatgatagttggtgttaatggtggagggaagactacatctttgggaaagctggcctatagattgaagaatgaaggggctaagatattgatggcagctggtgatacatttagagcagctgctagtgatcagttggaaatatgggccgaaaggactgggtgtgagattgttgtggctgaatcagagaaagcgaaagcatcatcag

SEQ ID NO: 81626 - DNA, 1995 bp, Glycine max
  Peptide Sequence Number=SeqID_198404
atggaagggttactgaattctttgcttaaccaaagttgcttaaaaccctttggtttcactccaagacttggttatactttcccggtgatcacaagaacggggaatttaaatcgaaaacccgaatcctgcaccctgagaagttactgcacacaattaggtagagacagtactggcactagctccagaggggctagtgttgctgcattggatagtgatgataaaggagaggaatctagtacggactgggaattggagttcctcggggaacttgatccgtttggttaccgagctcccaagaaaagggaaaaagaacagaggtcaaagttgcttgaagccactgacggaatggactggtgcgtgagggcgagaaagaaggcacttgaatcaattgaagcgaggggcatggctcatttggtggaagatatggttactgttaagaagaaaaagaagaaggataagaaaaagttggaaagcaagaagaaagtagttaagaaaattgagaaaatagaagatcttgactttgttttggaggaagacttgctacagcctatgaaacctgagattgatgttggtgatttgaaaaggagagtgagtatgtttaatgatggaatgtttatagaaaagaaggagaaaacaaaggaagcatttgtcaataggctttctcagttctctggaccatccgatcatagaaaagaaatcaacttgaacaaagcaattacagaagcacggactgcagatgatgtgttagaggttacttatgaaacgattgttgcagttgcaaagggcctaagtccctcacctctatccccattgaatatcgccactgctcttcatcggattgctaagaatatggagaaggtttctatgatgaggactcgaagactggcgtttgctcgccaaagagagatgtctatgcttgtgagcattgcgatgacagccttacctgaatgctcagctcaaggagtctctaacatatcttgggctttgtccaaaattggaggcgagctgctttatctttcagaaatggatagaattgccgaggttgcgctgaccaaggttggggaattcaactctcaaaacattgctaatattgcaggtgcttttgccgcaatgcagcactctgctcctgatcttttctctgttttgtcagaaagggcttcggacataattcacactttccaagaacaagaacttgctcagctattgtgggcttttgcttctctatatgagcctgctgaccctatatttgattctttagacatagtcttcaaagatcatagccaattgagaggttgtacaggtgaaaggacatcaaataatcatgaacaaatcagggtagatagaagtggtgcctcaaatggatctcctgtactaactttaactagggatcagcttgggactatagcttggtcctatgccgtctttggacaaatggataggagtttcttctctcatgtctggaaaactctcagccattatgaggagcgaaggatttcagagctgtatagggaggatatcatgtttgcttctcaggttcatcttgtaaaccagtgcttgaagcttgaattcccacatcttcagttgtcattatgtggcgaccttgaggacaaagttgctcttgccagaaagactaaaaggtttaatcagaaaataacttcatcgtttcagaaagaggttggacgccttctccttagcaccggccttgaatgggtcaaagaatatgttgtggatggttacactttggatgctgtgattgttgataagaagcttgctctggagattgatggtccaactcatttctcaagaaatactggtgtaccgttaggacataccatgttaaaacgccgttacatcactgctgctggttggaaagtcgcatcagtatcctctcaggagtgggaggaacttcaaggagcattcgaacaagtagagtatcttaggaaccttctcaaaaatcatctagaggaaggatatgccaaaactacatttgactga

SEQ ID NO: 81627 - DNA, 482 bp, Glycine max
  Peptide Sequence Number=SeqID_198405
atgtctagaaccgtggagatcacagttttgtcggcagagaacctccaaatgaacaaaaaacccattagagggaacgcatttgtgacggttcaatccgacgctagcaacgacacaagtgccacaacagtggattctgaaggagggagttacccttcctggaacgagaagcttgtgatggacgtgccattgcatgcaaggtttataaccgttgaagtgaagtgcaagacatcatcggcggggtcgaacagtatcggagtggcgagaataccggtttccgatttcgtcggagggttgtgggacggtaaagttaggagaaacggggttgtaaatatttcggtgagagtgaaagtggcacaacaacaacaacaacaacaacaacattcgtgtaattcgaattctatgtcgttgtcgtcggcggtaacgggtgtgccggtcgccggtaatggatccaccggagttgtgacggggattccagctatttg

SEQ ID NO: 81628 - DNA, 468 bp, Glycine max
  Peptide Sequence Number=SeqID_198406
atgaaaacgacaatcattcattgcattgcattgcattgcattgctccatgcatttctgttgtgttcttcaccggtaaccgtgtcgtttgcgttttaagggaaagacgagtgaggagagggaacaggtttgggtgtgaagcgaccaaggtggcagagaatcgtcaaaagaaaaccaggctcacacacactagagagaagagagagagaatagtaactacttactgttacagtggtggtggcgtggatatattctgcggagacgctgtgtttatgcctttttctgtgtcggggaggttttatgcatacggtctacatgtcagtgtcgctgcgctagctgggtttggaggactttggttgagtgaaccatggttagagttagtcattgcatttgcacgtggggttcttaaccctggtcctgggatatcactctatgatatgattattatcattctcattctcctttcttaa

SEQ ID NO: 81629 - DNA, 369 bp, Glycine max
  Peptide Sequence Number=SeqID_198407
atgaaacgaacacatactgagtgcgagggagaagacggttatggttacgaagacgacgattcgccgaaccgaacgcggttccatgaaactaacaagacggctcgtcgttgggaagttggaggttggaagtatctaagcagtcacggcatggaagaggtggtgaaggagagaaaaaagagaggagtctttttagttttcacagatctgcagaagaagaagaagaagaagaagaaaaaggaagggtcacattcatataaagacatcacatcatgtgaagaaaggagtcaacgaggcacgaatagccgtcgattcgagaaaaagacgaaagaagaaagggaaaatgaagtcagtgtcacggggctaaggtga

SEQ ID NO: 81630 - DNA, 117 bp, Glycine max
  Peptide Sequence Number=SeqID_198408
gctgtgtgtctcttgatttatgagtttcctgaacacaagagaaatggatccctaggtggttcacaagttgtaaaagaattttacaaggataatggaaatctcaaatgggttgcttaa

SEQ ID NO: 81631 - DNA, 176 bp, Glycine max
  Peptide Sequence Number=SeqID_198409
gtttacacactaattacagcctaatggaagagttgatttcctgtaaaaagtctgttgctaaagtcgttcctggtgcacctaatgttttcatgtgtcgtgaatttttcggagattctactggttctggatgggactaccggtttgaatatgttgccacaagcgagagaattcaatga

SEQ ID NO: 81632 - DNA, 219 bp, Glycine max
  Peptide Sequence Number=SeqID_198410
atgaattcacttttcatgaatcgctatggaactctgcatggaggttctgttgggtccttggttgagattttatcgaatgcttgtgctagaactgtagttgccaaggacaaggaactttttcttggggaaatcagcatttcttacctctctgccactccagcaaatcagagcgaagctgaggacgttagaaagcaagctgcttcaacttcaaccaattag

SEQ ID NO: 81633 - DNA, 615 bp, Glycine max
  Peptide Sequence Number=SeqID_198411
atgttctattactgtccgagtactggaaaacgcttctattcctactctgatctgatgtgttatgtgaactatgctaagaaaacaaagcttggtctctatgcactggcctgggatttcccagctatttttgtgaatgtttcttgcgttgtggacattttctgcctctcctgctgcattagtgcagttactgcagtagaaggtacggaattacttaaaaggaagaggaccgagaatgataccacccctgtccccgaacccaagaagacatcaactatcttgtcacttccaaaggattcaaaatgctatagttcatcaggtgacgattcatcaagtgacgatttgttgagtgacgattcatccagtgacgattcgtccagtgaagattcttcgagtgatgattcatcgagtgacgatttgtctagcgatgattcatcgagcgacgattcatcaagtgatgatgacagtagtgacccttctatttcaaatgaaagcattaagaaggatgaagattatgcagagtcagttggtagttgttcggttgagtcagtgggtagctgttcggttgattcggaaactagcgatgctacatctggaacgactcaggtcctaaagtaa

SEQ ID NO: 81634 - DNA, 753 bp, Glycine max
  Peptide Sequence Number=SeqID_198412
atggtgtacagcagcatcagaactagcacagtggagacagacaagctaggaagagtcgtagtgaacaatatcagtggttaccttcctggacgaattgtctttttcttggatagtgaaatatttatatttaatagggtggggttaggatttcttgaccagattaaggtaaatacacatcttacaccacgcccaattttacttacccgacatggggaaagtcaggataatgtgagaggcagaattggaggggatactgcaataagtgaggctggagaactttattcaaagaagcttgccaagtttgttggaaagcgtctcaaatcagaacgggctgcttctatatggactagtacactgcaacgaacaattctgacagccactccaattgttggatttcccaagatacaatggcgtgcacttgatgagataaatgcaggggtgtgtgatggtatgacatacgcagaaatcaagaaaaacatgccagaggagtatgaatcgcgcaagaaggacaagcttaggtatcgttatcctcgtggtgagtcatacttggatgtcattcaaagattagaacctgtaattatagagcttgagcgccaacgagcacctgttgttgtgatatctcaccaggttgtatgcaagtcattaagctacattcatgcttgtaaagactttatatggttgactgttctaatccgtgagttggagaaatcttcacttttggtgaatgatgatgaatatgctgaagatatctaa

SEQ ID NO: 81635 - DNA, 1521 bp, Glycine max
  Peptide Sequence Number=SeqID_198413
atgagagcctttagtgaagcagtcaaccaccacgagattggggctagagtaagcctgttggcttcttggtctcatattggtttgttggcagatgagacattgggagacgaacttgcagacatattgcttcatggtggtccaaaacaaggaaatgaagttgtgattgtaggcaagccaaatcttctgcttatggaaaatgagaccgcgtcaaactccaaagtcgggggacttacaaagttgttccaagaattcgaagttaggcataaaaagagaataatggtgacctgtattgacattgatatgcgacaagtcatagcccagaagcttggcgaggtagtgttgttgttccgatgtttggctgacctaagacataagatctttaaggctcttgtgatcagtaatgattatgaaggaacaactcccatggcaatgcctgacatgttagtctccaggatgaatggaagcgcaaaattggtagaaaccaggacgggggcttccttcatagcctcattgagatggaggaaggctagttgggcatccgtggaccaggggaggccagtcaagcatggcattaatcttaatgggatcggtggtgacgccggtggaaaagaccatatgtcccaggatgtcatcgaagacgaccgctatgaatctacaaagttttgggcacatcctcgatcgccatgcaaatttgatggaacccttgtcggaggtccagtttcaagaagcagttgtcatctttcttcttcaccaaaaggacaagtgaagagaacaaactctggcgcaattgaatcaaccccgtctacaacatgtggatgtggtgggagatggggcgggggggagggagctcgattggctcctggaatagttggttataacaggataaaagtgattacaaccaagaagttatacccacttcttgcaatgaatcccaaggaacattggtcccttgtgtccagtgataataaccaagaagttatacccactttttgcaatgaacctaaaagcgtgataacaacaaagaagttatacccatttcttgcaatgaacccaaacgcagttagtcttttgagtccagtgatcaaccaagaagcaaattctgcttcttgcaatgaacccaaaagcgttggaacagagtcgaagctccttggggttgcaccagacgatgcacttggtgggatgaggctgaagtgggctggagtgccattggacgcccaggacgatgttcgatccactaaggcccaacataaacaggtatggcgtaaattagtggtcctggatagcgagtggagtatgagggcaaacacgatggccgagaagagtgtcatcatcgctagccatgacctgaaggggattaatggctatggtgggcatgcccgacattacattgaggctcaggtgaggggattcaaaggccaaagtaacccacttctcatcgcagtggtaacacagacccctatccctgtgtcggcagctccaggggagcagatggtgaaggaagcaaaaaccgattggtcgtga

SEQ ID NO: 81636 - DNA, 597 bp, Glycine max
  Peptide Sequence Number=SeqID_198414
atgtgggaccaagttgaggatgagtacctcgtacacccagaaaccaacggccagactgagccatttcaagccacctatggcaaggcccctccttctatacctcagtatttggaaggttctttcaaggttgaggtcatggatgaattaatgacgacaagagcccaacttcattttgactttctgtgtcgtctctctaaggcccaggctgccatgaaaaggatcattgattcacatcgtcgcaacgttgtttacaatgttggcgactggttttcatccaaacatgggaccaacccccctgaactgcatcctctaccaccactacattcagagaaccaacatgtggtcaaaccactgtcaatcttggactggaaattggacaatgacaacactccaccaatccagaaagtcttgattcagtgggccaacctagcatcgaaagacacctcttgggaggagtggaatactcttcacacctcttacaaccttggggacaaggttattctgccagaggaaggtgttgatagcaatcccaacccaggaaggagcaggtccaagagggtgcacaaaacaccaccatatctccaggattatgcttga

SEQ ID NO: 81637 - DNA, 417 bp, Glycine max
  Peptide Sequence Number=SeqID_198415
atgggaacgggtgcatcgaaggacgcagatgaagggagcaaggaagagcgtgagaggctcgaccatgcaggtggccaactctacgtgtctctcaagatggagaatcacaagctcacaggggaccttgttcctcacgtttatggctctgttcctctcgtgggttcttgggatccttccaaagctgtaattttgatccctaaccttttcttcctttggttcgtgtgttactggcttttcatggagcgggaatcgatgtcaatgtgggaacttagctttgttgtcccacctaatcacgcttatgtggaaaaaaggaaggaaagtgtggctcttggcaatggctttgttgccttcaccatgaggagggtgtctggtattgaggtgtcttggcaattttgtgaaaggaatggagtttggtga

SEQ ID NO: 81638 - DNA, 231 bp, Glycine max
  Peptide Sequence Number=SeqID_198416
atggaaaaatccgacaagatgaatttcaaagagaagaaagaaaagaaaggatatatcacttgggaagataatgtcataaattattcaagtgattcagagaagaaaatcataagtttgggtatcatgatgaaagactatgaaaatggagaagaacaaagtcgatacattgatagcaatttctccaaacacatggcatgcatcaaagtttattcatatttctccccaagataa

SEQ ID NO: 81639 - DNA, 180 bp, Glycine max
  Peptide Sequence Number=SeqID_198417
atggagattaattccccaaagctaatgaggaaacttggaaaaggaatccgaaaagcttttggaggggtgggaactaggaagttccctgcagtgcaaatgatctttaagaaggaactactgctgggaagtgttcactgttcatcgttagggcgaatgtcaataaacaatgaaagacccatg

SEQ ID NO: 81640 - DNA, 444 bp, Glycine max
  Peptide Sequence Number=SeqID_198418
atggaccttgcaaagggaaagtggaagcaaaacatgattttcaaggcgtgggagcgttgccgattaacttcaaggccacacttgaaactaaaatcactgtcagagaatgatgatgatgatcatcatgagaagaagaagaagaagaatagtcaaatagcccctcatggttgtttttcagtgcatgttggaccagagagaaaaaggttcgttgtgaagaccaaatacgttaaccacccactctttcagatgctgctagaagaagcagaacatgaatatgggttcgagagtgatggccccatttggcttccttgcaacgttgatttgttctacaaagtgttggctgagatggatggagaagagaatcataataataataataacatcattttccatggttctcgaagaagcttcactaccatggctaagaatatttctggcttgtaa

SEQ ID NO: 81641 - DNA, 273 bp, Glycine max
  Peptide Sequence Number=SeqID_198419
atgagtaaggtgaagattttggttgtgggagggacatgttacttgggtcagcatctgctacaagtctatgcacatgccaatgccaatgccaatgccaatattagtggaactccttttgttttcgatctcgctttcacccatcactcctctcctcctccccaccctctcttagatgccattccttcctcccttcctttccaagtggatttgaaaactggccttggatttgaagccatttccaacacttttggccaggttctgttctcaccttaa

SEQ ID NO: 81642 - DNA, 531 bp, Glycine max
  Peptide Sequence Number=SeqID_198420
atggttcctcgtgcttgtgaaatcgatcctgccactgcacatgctattaacttgccatcatctcttgtaaaatggttgcaaagctttgaaaagagaactactcttctcattcatctctccacagatcaagtttatgaaggggagaaatccttttacaaggaagaagacattgctgttccagtaaatgtttatggcaaaactaaagtggcagcagagcagtttatttcagaaaattgtccaaactttgcaattttgagatgcagtatcatctatgggccacaaacagtctcaccagttccaaaatctcttcctaatcagtggattgatggtgcccttgctaaagtagaaaaagtggagttctttcaagatgagttccgttgtccaatttatgttaaggatcttgtaaatatcatactagctttaactactcaatggatatcagagggcaagcaaatgcaattgttacttaatgttggtggagctgatagggtgtcacgtgttcaaatggctgaggctgttgcacaattttga

SEQ ID NO: 81643 - DNA, 789 bp, Glycine max
  Peptide Sequence Number=SeqID_198421
atggcagagctcccggcgccggaggcgcagctcaacggcggagccccagcaacgacggcgaattcctcggagcccatcggatcgaagcggcaacggcggccgagtgtccgattgggcgacatcggcgaccagccctacgactcccacccccgccgcgccgccgcgaaaacgtggcgcctcgccttcgaccacccccgccactcctcctccgccgccgccgccgccaggccctccaagatccgccccctcacgaacctcacccctgccgccgccgtcgccgagttaggcgaaaccctagagagcgacggcaacgtggatagcgttctaatcggaagctggaaggtgaaggactccaagaagcgcggcggcggcgctaagcgtatcagatcgaattggatttcgcgaatcgacggcggcgaagacgacgatgacgacatcatcgtcgacgaagacggttaccaccaccgagacttctccgccgaacactccgaaagccccatgagggaggagcatagccctatcatggagaatttgggcgtggacgaagaacgagaggtgcagcattaccacgaaagaaatggtaattctggaagcggagacggtgttagggtttggctcaatggattagggttaggtcgttacgctcccgttttcgaaattcacgaggttgatgacgaggttttgcccttgttaacgttagaggatcttaaggatatggggattagtgctgttgggtcgaggaggaaaatgttttgtgcgattcagaagcttgggaaagggttctcctga

SEQ ID NO: 81644 - DNA, 264 bp, Glycine max
  Peptide Sequence Number=SeqID_198422
atgaaggagggggaaggtggggtcatgaggagggtgcaagggtttgcacaatggacaacgaggttgctaccattgcaagagtgtgaaggaggtggcacaatgtggagggcgaggtcacaatcaggtgaaggagcaatagtcacaggtgccatcattttgcagcagaagtatgcaaagctattacagctttcagtgttcagctgcgtcttgggccctatacaaagcaaattcttctggggatttccgggcaaagcagggtactaa

SEQ ID NO: 81645 - DNA, 555 bp, Glycine max
  Peptide Sequence Number=SeqID_198423
atgtcatcttttgttgctcttcagggcctgcatggctctcttctcagctcccagttcctaggccaagacaccctcactcatttccaccctcgcaacaaggcttcttccaccattcaaaacaagccaacaacagcacaacaaccaagtgccaaatttgacatgctgcaaatcgtaggaggaagaggactatgcaatggagaagcaggcctaaaacaagagctgaagaagcaagttggtgttgatgaaaaaggacaaacttcagcaacaagtggcaaagagcaagaagaggaggaggaatcaacaagtgaaaaccctcctcctctaaaacgaagtcaaggtagcaaaaacctgaaactagcattgtccaagaagcctaagccaccagaattgcctctgttgctgccagggatgattgccattgtgaagaacccaaataacccgttttacatgtactgtaagattgtgcaaagaatcactgatggtaaggcaggggttctccttgaaggagggaactgggataggttgatcacgtttacgttggaagagcttgagtaa

SEQ ID NO: 81646 - DNA, 511 bp, Glycine max
  Peptide Sequence Number=SeqID_198424
tggtcgtgttcaatatcatgacttcttgagggttttaagacttaaggcttgcccactatctgcaaagatattttcattcattgatgtagagaagagtgggacaattacgttcagacagttcttgtatggatctgcccatgtcatgtcacaaccagggttccatcaagcctgtgaagaagcctttgctggctgtggtggtgcagtaaaggcctatgttgttgaacaagagttacgagatttcatccaacctgttatcctcaactggagtgaggatgaggtccatgagctttttatggtatttgacaatgataatgatggaagaattgacaagaatgactttctttcatgccttagaaaaactcctcttctcatagcattttttacacttcaactgcagcaaaaggaatttgaagctaggtcagttttgcatagttggatgtcagttacctgggcggtgttcaccccgatccaacagcttgagttttggttcagggaccatgctgacatttag

SEQ ID NO: 81647 - DNA, 337 bp, Glycine max
  Peptide Sequence Number=SeqID_198425
atggacagtcttattgggcatatgcgcaatgatgtgttcaagttcctcattcacgctgcaatcaccaatggaagcaataacaaacaacaaaagggacatagaccttacctcgatgaagaacagaagagcaacacctcgcgggagaagaagcgcactcaaaggagggagaagcagcagcttgcgcggaagaagaacaaccacctcgtgctggagaagcaaaggggctcgcagaagaatgaggaaggaggaagaaaggaccgccggtggaagaaagaaacgaagaggctcaaggaagaaaggagaagaagaaaggctcgtgaaatagggaagaagaaaa

SEQ ID NO: 81648 - DNA, 369 bp, Glycine max
  Peptide Sequence Number=SeqID_198426
atggaaggaattggcatacaagatgcaacatgtcgcggctccaccagagggtttcttctagacggtcagtgccaaggaccaggttatgtgaccttcaaggtttatctcactgagcaaaaagtttgttgtagcagtttggacgttccaagtagcatgtattatttcttgaaagacaaaggctggactcatttgcacttgggagacgttgcagaatgccgactcgtgttcaatcactggagaaagtcactgaaaattgaagccgagtggaaatatttatgcgagacgttttcgttcactgttgacatggagatagtttttgaatttattgatcttgatgttaatcgcgtgctttactggccatgtttataa

SEQ ID NO: 81649 - DNA, 453 bp, Glycine max
  Peptide Sequence Number=SeqID_198427
atgccgtcttcgcacaccctacaccagaaatcgaagaaaagaaagcagattgtcgacgacctcctttcctctactcttaatgccaacgtcgacgaggctctcacaatgatcctcgaggatttcctcatcaaggtcgatgttgttaaagaggaggatgtcagaggggttcttccccacaagatcaggccacgaaaaccccacccgcaagatcaagcaccgatagcagcagagaacactgccttgcagctaggaaataaggagaatgataatgtttgggaagaatcatggttgaggcacaagggttatgcaatgattcgaacactaccagtaaatggcttgaaggatttgaaagtgggagttttgatggataaagaggctttgctttggaactacacactccttgagcaaatctttgaagtggaggatgttgagaccatcttgagaacacattga

SEQ ID NO: 81650 - DNA, 969 bp, Glycine max
  Peptide Sequence Number=SeqID_198428
atggcttcgcgtttagagactgaaactgagacgctattttcgaggagaaggccgctgcggaagaggatgtcgcagtcgctgacgtggcggtcgagggtggcgaggagggaatccaggtcgctttgggttttgagttttccgtttgggagggtttcgggttggcatgttttggagagcgaaacggcgtcgttgagggtttgggagattgagtggaggaggtggagggagagggggttcgatgtggaggcgtttgggaactcggcggagaaatcggtgagggggaaaaagcttcatgctgagaaagtggtggaggctaggatactgagaacgcacaaggcttgcgcattgccagaactgcacttagatggtgtcggcatcgcaatggatctcgtcgccttcgacttacctcaaagtttgtgggataccgtgaaaaatggaagtaacccaactccattacttggaaacccgacaatagctcaaatgaggaatcagaatgacgaagtggcaaaggaaagcaatgcacttgtcattatacaaacagcactacatgatatttttatcaagattctaaaacttgagaccacaaaagaggcatgggatcagttgaaggaggagttccaagggagtgaaagatcaaaaagaatgcaggggcaaaatttgagaagggagtttgaggatgtgaagatgaaggagaatgagtctggaacaaaaaaggaggagaatggaaaaaacttccaccttgtcctcattgcaacaggaacaatcatcctaaatattttggttggtataggccaaatatcaaatgtagagtctgccatcgatatggtcatgcagagaaggtttgtaaaaataaagcaaaccaacaagtacaataagcctaagctgttgagcatgaagaacaaaatgaagagcatttatttgttgccacttgcggtccaacaagtgataacagagaagtatggctcatag

SEQ ID NO: 81651 - DNA, 261 bp, Glycine max
  Peptide Sequence Number=SeqID_198429
atgggctgtagggcagaagctgaaaatattcttggtatccatgaggattcacagaacaagggaaagattgttgaattgcttaggtaccactccaccaagagtggtgatgagatgacaagcctcaaggattacgtgactaggatgaaggaaggtggcagccacgtgattcgaggatttaaaatacaaagacggtctaatccacagacccgtctttgtattgttggtggtttcacgtgtaggccatgtgatttgaggcgttaa

SEQ ID NO: 81652 - DNA, 396 bp, Glycine max
  Peptide Sequence Number=SeqID_198430
atggtgaaaccctatcaaattgctgattatccttcgtggttgtgtttttcaggaaaagatgtgataggacttgcccaaactggttccggtaagactggagcttttgctcttcccatattgcatgccttattagaagcaccacgcccaaaagatttctttgcttgtgtgttgtctcccacaagagaacttgctattcaaattgcggaacagtttgaagctctaggttctgaaattggtgtcaagtgtgccgtgcttgttggaggaattgacatggtacaacaatccatcaagatagcaaagcagcctcatattattgttgggactcctggacgagttatagatcacctaaaacacactaaaggattttctcttagtagattaaaatacttggtatga

SEQ ID NO: 81653 - DNA, 1116 bp, Glycine max
  Peptide Sequence Number=SeqID_198431
atgcagtctctttgttcagcaaagacaaataaatacacttacgagaaaacgttaaacgcgacggtgccagcaacaacagcaaactcttctcagagaaagccgaagagaaaacgagcttcagctagaagcgatcccgaactcgaccgtctcgacgcgcttccgtggaactccgctcttcctcctcaaaacgacgacgacgacgacgctttctccttgttcattggctccaacgaacttgaaggaggttttctttcgctcgaggaggttgatgaggctgagtatggtttgagtattcctgaacctgaagttaacaagaggaagacgaaaaagaagaaatctgaacagaacgaaaatttgaagaagcagcagcaggatggaattgatggtgcttgtagcaatgcggtggtcgaagcagagttggatgagagtgtgaagtctaaagagaagaagaaaaagaagaataagacaacgaacaagaagaaggatgccacagtagaccagacagttgagcagtcagatgctggcttagatactaatgtgaaggatgatggtggggaagaggatgttgatgaaactgaatgttatgcatggaatgagttgaggcttcatccgctcctaatgaaagcaatatgcaagcttggcttcaaggaaccaacaccaattcagaaggcttgtattccagctgctgctcatcaagggaaggatgttgttggggctgctgagacaggatccggtaaaacacttgcgtttggtttgcccattttgcaacgccttttggaggagagagagaaggctgcaaatatggatgaagaaaggggtgaagaacctgaaaagtatgctcctactggttttttgagggctcttattattgctccgactagagaactagcacttcaggtcactgatcacctgaaagcagtagccaagcatattaatgttagggtgatccctatagttgggggaattttagcagaaaagcaggagagacttttaatagctaagcctgacatcgttgtcgggactccaggaaggttatgggaacttatgtcagctggagaaaaacatctagttgaggtaattgttaacgcgatgcattatgaatttgggtatcaatga

SEQ ID NO: 81654 - DNA, 363 bp, Glycine max
  Peptide Sequence Number=SeqID_198432
atgattgctgggggttcaggcataactccaatgtttcagctcataagagccattctagaaaaccctaaggacaaaacgaaggtgaaccttgtttacgccaatgtaacagtggacgacattctgttaaaagaagaactagataattttacaaacaaatttcctcaaaggtttgaagtctatcatgttcttaataagcctcctgaacaatggaatggtggcattggatttatatcgaaggagattattaaatcacattgtcctgaaccagcccacgatattcaggttgaattaactacgaactatagcatgccaattaagaatagaatccacattttttactcttgcgttgaccacattacttga

SEQ ID NO: 81655 - DNA, 1155 bp, Glycine max
  Peptide Sequence Number=SeqID_198433
atgagaccgaatgctgcaattattgatcttactaatccgtctatattagcagctaagcttgaggagtcatttattgaatgcagagaagaagataaagatgcctatttgtattatattttgactgtccatggacaaggccgcacaatagttttctgtacgtcaattgcagctttacgccatatttcttccatttcttggcgtcaatgtttggactcttcatgcccaaatgcagcagcgtgcacgtttgaagatgtctatctatgcaaacttcatgcaataaatggtctgggcatgtgcggggggtgggggatatgtctatctatgcaaacttcatgcaataaacggtctgggcatgtgcggggggtgggggatgccatggatcgctttcgtgaaaatgaaaatggcatacttgttgctacagatgttgctgcaaggggtcttgatattcctggtgttagaactgttgttcactatcagcttccacattcagcagaggtttatgttcatagaagtggaagaacagccagagcttctgctgaaggttgtagtattgctttaatatcatcaagagatacatcaaagtttgcttcattgtgcaagtcattttccaatgataactttcagcggtttcctttagagaactcttatgtgccagaggtcctaaaacgattgtctcttgcacgtcaaatagacaagataacaaggaaggaatcacaggaaaaggctgagaaaaactggtttgatcggaatgctagctcagtggaattagtcacagaaaattatgacagtgaagaggaacaagtgaacaaacataagcaaatgaagatcagctctagacaattgaagaaattgcaggaggctggtgtcacacccctcatgcaggagcaattgcaacaattagcaaggcaaaaattaagtgatcaccagggttcaggacttggcaaaaagggaaaattggtagtgattggtcaagattgtgtggacgcacttcaggcacttcgaagtgcaggtgaagaggtgcgaatggatgtcaaagatttggcaggaaaacagagaaatatgcagaatttaaaaagaaagcgaaaagaggagaaaaagcgtttgcgtgatcagcgtagaaagcagaagaaaaagctaaaatacgggaatgaatag

SEQ ID NO: 81656 - DNA, 369 bp, Glycine max
  Peptide Sequence Number=SeqID_198434
atgaagaggaacctggtgtgcatcaacacgttgattgttcttatgcctacaatacttcttaggagtggtcagtatagggttgggaagatagatttattaatgcatggaagtcaccatcatgaattgactaagtcattagttggacatccatatgctggtcgactgacttcggatgagaagattattattgttgatatgacaaagtcaatggtgaaaccaagaaatattcttctaacgttgaaggagcacaatgccaacagttatacaacaatcaagcaagtatacaatgcaagaaatgcatatcgttcgtccataagagacagtgatattgaaatacaacaactaatgaagcttcttgaaggggattag

SEQ ID NO: 81657 - DNA, 453 bp, Glycine max
  Peptide Sequence Number=SeqID_198435
atggatgttgttttgatgaaagggccttatacaatcaggaatatgcctttgattttgcaggaatggaggccggattttgatctcaagaaagacatgttgagcaccatccctatatgggtggaattgccaaaacttcctttgcatctatggggagaaactagcctaaacaaaatcggtagtgccattggaattcctctggtgacagatgaatgcactacacataggcttagagtttcatatgccagaatattggtggaagttgatattacccagaagatgcttgatgaaattactattacagataataagggtttaaaaagaaagcaacctattgaatacgagtggaggccaaaattctgtgagaagtgccagacaattgggcatcaatgtgatggagctactaagcataagatttggaagcctaagccgaagaaagttgatcctgataaatag

SEQ ID NO: 81658 - DNA, 348 bp, Glycine max
  Peptide Sequence Number=SeqID_198436
atgtcctttggactcaacaatgccggggcaacttaccaacgggctatggtagccttgttccacgatacgatgcaccaagaaatcgaggtctatgtggatgacttaattgccaaaactaagactgaggaggaacaccttatcaacctgcagaaattgttcgaaaggcttaggaagtgtcgcaacgtgccctttcgcgggcgagcgagggcgaggctcacgggtgcgctttccaaaggaggaaagatgcgcggagtcgccaccaacgtttatttgtggaaaacgtcggaaaaaccgaaggaaaccggtcaaaatgaaaattctaggttcgggagttgtatttacgtttga

SEQ ID NO: 81659 - DNA, 391 bp, Glycine max
  Peptide Sequence Number=SeqID_198437
atggtagccataacccctgctaggtttcctcaacctccattttcccgaggatacgactcgaacgcaatgtgtgcttatcatggaggagctccggggcattccattgagcattgtatgaccttgaagtgtaaggatggacccctgggtactagtaccctcgcctttagaggactacacgtcctcgtcatcagagggctgcatgccctcacctttagaggactacacgtcctcgccttcagaggggtgcacgccctcacctttagaggactacatgtcctcgtcatcagaggattacaagtcctcgccatcagaggattacaagtcctcgccatcagagggctgcacgccctcaccttcagaggactacgcgtccttgccattgttggatcga

SEQ ID NO: 81660 - DNA, 165 bp, Glycine max
  Peptide Sequence Number=SeqID_198438
atgaaaaggagcaagatagaagctgagaacgcggtgggacttgtgagacaacaaaaactgtgccagggcaaaaatcccctacctgaaactcggcttcgagtcgaacagaggcccacaaggagcctacctcccatcactttcacagatgaggattttgagggatag

SEQ ID NO: 81661 - DNA, 342 bp, Glycine max
  Peptide Sequence Number=SeqID_198439
atgtatacttctatgccattaactcgagcgtcagagtatttttgcaagaaaacttctcctttgaccactacatcatcattgattgcgaacaacgaagacaccaacattatccttcaaggaaatcaaccatgtgagcaggaatccaccataaaggggatgcctgtcgtgggtgcctctgaaaaggggaacccgacaaatgtggcaaagatgcactccttgaagcaaagaaatgccaaggagatggaagatcttcgaaaggagaatgtcacttgtagagagaaatatctaaagattcaagaggaccaaaacacaaactcaattgtgatagcgacaacccactag

SEQ ID NO: 81662 - DNA, 462 bp, Glycine max
  Peptide Sequence Number=SeqID_198440
atgttgggaatcaaccctaagttccactgtcataggctagccatctgttcgaaggctagaccagtcgcagaaagaaagaggaaacttggctctgaaagggaaaaagctatggatgaagaagcaaagaaactcttaagtgtaggattcatcagagaagtacaatataccacatggttagctaatgtggtaatggtaaagaagtctaatgggaagtggaagatatgcaccgactacacaaacctaaacaaagccttccctaaagactcgtaccccatttcgagtattgattacctagttgatggggcatccatattccccatgcttaatttcttagatgcatattttggcattgtccaaattcctgctaagagcagcttacacgaccaaacctttcttcaatctactgaaaaagtaggagggaacaaagtggaaggaggaatggatgattttgagacttcctag

SEQ ID NO: 81663 - DNA, 264 bp, Glycine max
  Peptide Sequence Number=SeqID_198441
atgaaggacaccacggccggcgccgccgtggagaccgccgcaggctacggcatcaagccgtcgagctccgatggcagccaccttttggtgagaagggccatgcaattcaccatgttcgttgttgggtttgctgtgttgtggatgtttctctataacactgcctctccctttggattccatggcttctcgcattacttcattgatgagtcagcaaaattgtgtgctttgcatttggaattagtggtggtgaatggaggagaatga

SEQ ID NO: 81664 - DNA, 330 bp, Glycine max
  Peptide Sequence Number=SeqID_198442
atggatgaagatcaacagaaccgaaagaaaatagcgaacacaatgataaaaattaacaaaaaaagcaaaggaaatgttcaacattattcatattatggatcaggtgaaaagatgaagaagaataagaaggttgcagcagctggtgtctcgctaagcgaggcatatgcgcttagcgagttaggagaatctggaagaaaatctgtcattcatgcacgcgcccagcgcaccatcggctcgctcagcaagtcatttatctcttctcgcgttcagcgtgcccagctcgctaagcgaaaatccactaactcgcgcttagcaggaaaatggagctaa

SEQ ID NO: 81665 - DNA, 180 bp, Glycine max
  Peptide Sequence Number=SeqID_198443
atgggcacgtcgcggcgcgaggagttaagtcacagtgagagagcgagagtaagagtcatgaggaggaagagaatgagagtggtgaagtacatgttaatggagcaagatcctacgcctctagatgaagtgtttgtgcctcacgacactatagcacaaactcaagttatttgcattggttga

SEQ ID NO: 81666 - DNA, 1010 bp, Glycine max
  Peptide Sequence Number=SeqID_198444
atgaaggatacctctgccggggacaccgtggagaacgctgctggcgacggcatcaaggcatggagttctggtagccacctttgggtgagaagggtgatgcatgtaaccatgttccttgctgggcttgctgtgttgtggatgtttctctataactcagcctctccctttgaattccctacctcctcagattactttagtgctgagtcatcaaagtttggctctatgcatcaggctgattatgatccaaagctagagagtgttctggcaaatgcatctatgaaggataagacagtgataatcacaattttaaatgatgcatgggcagagccaggttccatgtttgacctctttcttgagagctttcgcctagggaatgagacacaatggcttttaaatcacttggtggcaataacttgggaccaaaagacatatgctcgttgccttgctatgcacaaacattgttaccaacttggaactaaaggtggcaatttcacaggtgaagtatttttcatggccccaaactacctacaaatgatgtggagaagaactgagttccttggttctgtccttgagatgggatacaactttgtgttcacggatactgatataatgtggcttagagatcccttcaaaatattttacaaagatgcagatttccaaatagcatgtgatgttttcaatggcaattcctcagacttaaacaactttccaaatggagggtttaaatatgtgagatcaaataaccgaactatttggttctataagttctggttctactctaggaatgtctaccccgggcatcatgagcagtctgtgctcaacaatatcaaaatgcaccccttagtttccagaatgaagctgaagatgaggctccttagcactagttattttggagggttttgtcagcttgcagaggatttcaacagggtctcaacaatgcatgccaattgttgtgttggtttagaaagcaaagtcaatgatcttaaaattttgcttgaggattggaagaa

SEQ ID NO: 81667 - DNA, 219 bp, Glycine max
  Peptide Sequence Number=SeqID_198445
atgcactggatgctgttgctctcaatcgtggagaacataatgttggagtggctgaagatgatttgcatccagttaatgttttcttgcaatcaatccgaatgcaaatcccatggttgttggcactttattgtgcaagagaaattaggagaaagtagagagcgggaaagaggtaactcaggtcctctgcagtaccccattgatcgcttctctccaccatga

SEQ ID NO: 81668 - DNA, 225 bp, Glycine max
  Peptide Sequence Number=SeqID_198446
atgaagaagaacacctctgcggtgaagaatgccggtggcatcaaggcatggagtttccgtagccaccagcttttggtgagaagggtgatgcaattaaccatgttcattgctggacttcatgtgtgttgggtgtttctctctaactctgcctcttccattgaattccataccttctcacattacttcattgctcagttaacaaagtcacctttgttgctgcagtga

SEQ ID NO: 81669 - DNA, 1210 bp, Glycine max
  Peptide Sequence Number=SeqID_198447
gtgacaatttcaccggtgaagcatttttcatgactgcagactacctacagatgatgtggagaagaattgaattccttggtacagtccttgatatggggtacaactttgtgttcacggatactgatgtaatgtggcttagagatcccttcaaactattttacaaagatgtagatttccaaatagcttgtgattttttcaatggcaattcccatgacttaaacaactttccaaatggagggtttaattatgtgaaatcgaataaacgaactattttgttctacaagttctggttcaactctaggaatgtcttccccaagttgcatgaccaggatgtgctcaacaagataaaaaaggactcattcgtttccaacatgaagctgaagattaggttccttagcactagttattttggagggttttgtcagcatgcagaggacttcaacaaggtctcaacaatgcatgccaattgttgttttggtttagataacaaagtcaatgatctcaaaaatttgcttgatgattggaagaaatatgtggcattgcctgaaaatgagaaaaatcagtcgcatccttcttggagcgtaagttgcagggcgtcggttgaacgtttcaaacaaaggaagcagaagaataaagggaggtttcgacgacaggcattggctgtaacggagcaagctgcagacatgataagccctaacagtattgttcattgttcagggtttcttcccgtctttgattttgacttccaagatatgacagaacataaattttacaaagatgttgatttccaaatagcatgtgatgttttcaatggcaattcctcatacttaaacaactttccagatggagggtttaaatatgtgaaatcaaataaccgaactatttggttctataagttctggttctactcgaggaatgactaccccgggcatcatgagcagtctgtgctcaacaatatcaaaatgcaccccttagtttccagaatgaagctgaagatgaggctccttagcactagttattttggagggtttcgtcagcttgcagaggatttcaatagggtctcaacaatgcatgccaattgttgtgttggtttagaaaacaaagtcaatgatcttaaaattttgcttgaggattggaagaagtacatggcaatgtctgaaaatgagaaaaaacactctcatccttcttggagcgtaccacaactttgcag

SEQ ID NO: 81670 - DNA, 438 bp, Glycine max
  Peptide Sequence Number=SeqID_198448
atggcaaaagaatggagaccaacgctcaagatgttgatcttcccattggatggtcagtggaactataattcgtggttcgaggcagaccattttgtcgacaatgagccacatattccatcgttttattttgatttacctctagtacttactcagtatctagtgctcagttacatgtgtgttccatcgactctattttcttcactttcttgctcttcatcatcgacatcgtttatgatcgatattgcaatgatagtggaggagatatttgctcagccgattgtgagggaatacattttgccatctcccggcaatgagattcccttgttagcatatccactatacaatctagttatccaaaccgaattccttttgcccagacatccgattgattggtcatccatcttggaggactacactgatggtgccaatgacgagtag

SEQ ID NO: 81671 - DNA, 441 bp, Glycine max
  Peptide Sequence Number=SeqID_198449
atggagggtagacataaagatgagaggttgatagagaagttgaaagcccacatagagctgagtcgacaaccatctccgattgagccaaatgtaccttttctcgatacccatgtgagcacaaagggaagttgtgttgataattggtatggcttgtacattgatgagcattgtccctatctagtggcccttggaagagtttatgtagggaaatcaaccttacacaacatgcttctaatcgatgatgtttggaaggcgggggttgaagaagttcatgatgctactgcttcagcccttattcctattgaagagtttaagttagtagagcaaaccctcaacaccttcgttgcatggtcgagatgcttagtgaagcctgtttcattaaaggattcgcttggaccgaagaaattggtccatcatatctcacttaaatccaaagagtga

SEQ ID NO: 81672 - DNA, 450 bp, Glycine max
  Peptide Sequence Number=SeqID_198450
atggaggccgagaataagggtggtgaagtgaatggcaatgagaaaaatgacacagggatgcttaatgtttactctgctgagtctcatagttggagacatctttgcgagcctcctagcctttttgccaacagcttgcacagttattcaggagttgtggtcgtgctaggcttccacacttcttctgttgcggtgggaaaccaaatcagggtaatactggtgaacagaaaggtagtacaagctaatcaagctgtttgcgatgcaccagatgttggttcatgtggaggaccacccgtaagacctaggtctgtagccacaaatactattctcaatcagcagggacaaaatgctattgatcaaaaaacatcttctttggcattagacatgtataccttacaagaaagaggagcaatagaaccatgcaatcgaaaattacaatacttgctggattaa

SEQ ID NO: 81673 - DNA, 219 bp, Glycine max
  Peptide Sequence Number=SeqID_198451
atggccccagattctaaaaatgacttgagaagaaagggtgtgcaaaacctaaggaaacccgtgggaagtgagcaaagcattttatcaggcaataagctaggctcacctgaggaggccattggaacttgcattttaactttaagttgtggctttattttaaaattagaaaggaccttttatgtaccaagttttttctcgaaactttatttttgttcctag

SEQ ID NO: 81674 - DNA, 435 bp, Glycine max
  Peptide Sequence Number=SeqID_198452
atggaaactcacgaattgcgcaaaaacgcctcttttcgatttccgccacattacggaatttcacggatcgcgcaagcctgcttccttttgatttctgacacgtctcgggacttcatttactgtgcatcaaaggatgccaagtatctcaaagcggctaaccaaaggttgcatgtcatcaagtattgtaacttcaatgatatcatcattatcatcaacttctggtctgatgaaattattatcatttatctcttcaactcgtccacatccatcacccaacaacaggtggctgagataattggaacccttgaggaagaatggaggaatgagctggaagaagaaaacaaaatggagtctagagagaatgaaataggagttgaaggaggccatcaaaacggagttatcccaaaggggatcgcagtactctcccccaactga

SEQ ID NO: 81675 - DNA, 420 bp, Glycine max
  Peptide Sequence Number=SeqID_198453
atgtcttcattggtgatgtgggcaaatgggaaaatgagaggtggtgttagggccttagttggagaagagcttggttttgttgggagttgccggaggtgcaaaagtttttggaggagattaatggggtggtgcttaattatgagcaagacaagttgttgtggaaaaatgatcaacttcggtcaaggaggcttatcatatcctagactgcaaccaaattttcatcataagtatggaataaatgttgtggttgggttcagatctctacttcacaacctttggaggtcgtacaacactttaaaccaacatcactacactagggtaggaaggttcagaacatggtctggaagtctatttgatgttttgttgtatggacaatatggtgccatcgaaataagattgtgttttgagaagaagttttag

SEQ ID NO: 81676 - DNA, 1539 bp, Glycine max
  Peptide Sequence Number=SeqID_198454
atggcactttcaacctttccaacggtgaacaagtgtacctctattggtagggaaaagcacacggtggttgcggacatggatggaactttactcataggtcgaagttctttcccttattttgctctcgtggcctttgaggctggtggaattcttaggcttttgttctatgtcttggcttcccctattgctgccttgctttattacttcatctctgagtccgcaggcattcaggttctcatctttgcctcaatggctggcatgaaagtgtcgagcatagagtcagtggcacgtgcggttcttccgaagttctacgctggtgatgttcaccccgagtcgtggcgcgtgttctcatcatgtgggaagcgttgtgtgctcacggccaatccgagggtgatggtggaacctttcttgaaggaatttttgggtgcagacatggttttgggcactgagattgcgagctataagggaagggcaactgggttgatttgcaagccggggatacttgttgggaagaagaaagccgatgctctaaagaaggcttttggagaggagaagccagatattgggcttggagatagacaaacagatgctcccttcatggctttatgcaaggagggttacatagtcccacccaaacccgaggtgaaatcagtgtcaacagacaagctgccaaagcccataatcttccacgatggaagacttgtccagaagccaacacctctcattgccctcctcacaattctctggatgcccatagcctttcccttagcatgccttcgcatggccgcaggttccctcctccccatgcacttggtctactatgccttttgggcccttggcgtccgtgtcataattaagggcaacccacccccaaaagtcacaaaatctaaccctaaccctaaccctaacaacaacaacgattctggggttctctttatatgctcccaccgcaccctgcttgaccccatcttcctctctgccgccctcggccgccccatccccgccgtcacctactccgtctctcgcctctctgagatcatctcccccatcaagaccgttcgcctcaatcgcgaccgtgcaattgacgccgccatgatcaagaaactcctccaagaaggcgacctagcaatatgccctgaagggacaacttgtagagaaccatttcttcttagattctcagctttgttcgccgaactcaccgatgaactagtccctgtggccatggtgaaccgcatgagcatgttccatggaacaactgcacgagggtggaaagggatggacccattttacttcttcatgaaccctagtcctgcttatgaggtcacttttttgaacaagttgcccaaagagttgacttgtggggcaggaaagtcaagccatgacgtggccaactacattcaacgggttattgccgcgactttgtcgtacgagtgcactgggtttacgaggaaggacaagtacagggcacttgctgggaatgatggggttgtggttgagaagggccatattttgaaggccaacaaagttatgggttgctga

SEQ ID NO: 81677 - DNA, 324 bp, Glycine max
  Peptide Sequence Number=SeqID_198455
atggctaaacacaaaagtaaaagcagatccaaaaatccccagatctcgttggtgagagtgtcaattagatctcgtcggtggcattgtcaatccagtttcgttggtagtggcattggtcataatcttgtcgatgttgttgttgttgttgtggagtgtgatggtcgacaaattgtggaactggattttcatggtgggagcgtgcacaaagttgcttccattataagtgaaatgccagatctagagtgtggtgatggtgttgcttctcatcacagtgaaggcattaacggggctaaaatccaaaatctaaaaaagttcaaggactaa

SEQ ID NO: 81678 - DNA, 318 bp, Glycine max
  Peptide Sequence Number=SeqID_198456
atgaagttcttttttcttcggctcaccagtgtgaaaggtgtgcatgagtacataatgcaaatgcgatatattttagctcaacttaagaaactagaggttgacatgtttgaatccttcctgcaagaagaaaggcttttaatggagatgggtgaaagtgcattactgacaactacttatgggaaggacaaagcaactgagtccaagctaatcaaatgtggaatagtaaaaataccacctcaagcttatattaagaaggtggcaaagtgtttattctgtaagaagaagggagacatgaagaagaattgccccagattctag

SEQ ID NO: 81679 - DNA, 255 bp, Glycine max
  Peptide Sequence Number=SeqID_198457
atggatccagggagtttttcagtcccttgtactattgccacaaacaagataaagactattgtggctaagtctcacccaagtgtggaaaaagaagaccctctaaaaaggaacatcattccaaaagatcctggaaagactatgatgagtatgaaaaagggagttggcaccaccattcaagctcttggctatgaagtgggtgattatactagagaatcattgcaaaagggaaaatcaccatgttcaagggtggtttag

SEQ ID NO: 81680 - DNA, 414 bp, Glycine max
  Peptide Sequence Number=SeqID_198458
atggacacatccacacctaccacaagtgtggtagggaggtgcaaagttagaaacctaagactaggtcttcatcaaagtcttaatctgcttggacaatgcttgaatatgttgtcaaagggcaaaagtaattgctttagtttccacttggttgatcgacctcttcatgattctcctattcctataattgttgtagggattggagcacatgtcccttatcatcttgatggcatcagtcttcattacagagaagcacctttgaagagaggggctggaacattgggcccaattagtgatggtgttctttggaagtacatcaatgccttcgtattgcagactacaaagcggatagttcctttccaatttgttaggggagacagggtgatattagtttcccctccattgaggattgcatga

SEQ ID NO: 81681 - DNA, 1630 bp, Glycine max
  Peptide Sequence Number=SeqID_198459
ggtggatgcttctgcttgtggcttctctcaattggaatggcttgttaataagtttaggaaagatcattcaacttatgggaactgggatatcttgccactagagattgttgttttgtttgatttgaagggctttagccaagtagtgtgctctggaagtgaagtgcatgagaagggagggggagcgataacatccccttcaactacttctaccagttcaagaagcagtgatttagcacgtttccattatggaaactcaaccgcttcgcctctttcaggccttaattctaattcatttcctggattaaatcatggtgacaagtttccccatgctgtgaattcaaagcttaatgggagtttggcagcttcctcgtatgaagccttgccaagttttaaagatgttccaaattcagagaagcagaacttgtttataagaaaggtgcaaatgtgttgttttgtgtttgacttcactgaccctacaaagaacctcaaagagaaggacattaagcggcaaacattagttgaacttgtggattatgtttcttctgctaatagcaagtttacagaaataatgatgcaagaaattgtgaaaatggtatctgtaaatttgttccggacgtggacctcccccctccgtgaaaacaaagttctagaagcctttgatgtggaagatgaagaacctttgatggaccctgcatggcctcactttcaaattgtatatgaactccttctaaggtttgtcgcatcacctgagactgatgcaaaattagcaaaaagatatgtcgatcattcatttgttctcaaactattagacctatttgattcagaagatcccagggagcgggattacttgaagacagttcttcatcgtatatatgggaaatttatggtgcaccgacccttcattaggaaagcaatcaacaatatattttatcagttcatttttgaaactgagaaacataatgggattgcagagcttttagaaattttggggagtataatcaacggatttgctttgccactgaaagaagaacacaaattatttcttgcgcgagtgctcattcctcttcataaaccaaaatgcataccaatttaccatcagcagttatcatactgcatcacccaatttgtggaaaaggactgcaagcttgctgatactgtcatccagggattactaaaatattggcctattacaaacagttccaaggaggttatgtttctaggtgagctggaggaaatcttagaagtaactcaacctgcagagtttcaacgttgtatggtagcagagagggctttgttcttatggaacaatgatcacattgagaacctaatcaagcagaactgcaaaattattcttcctattgtattgcctgctctagagaaaaatgctcgaaaccactggaatcaggcagtccaaagtttgacaataaatgtacgcaagatctttgctgataccgatcctgaactcttggaggagtgcctgcgcaagttcaaggaagatgaagcacaagagaaagctttgaagttgaagcgagaggctacatggaagcgcttagaagagattgcagccatgaaagctgcaagcaatgaaccagttcttgtttctcccagaacggcgtcttcttctggctag

SEQ ID NO: 81682 - DNA, 273 bp, Glycine max
  Peptide Sequence Number=SeqID_198460
atgttgcagggctttgtgaaagtatgggatttgaacgatgccagaggcgtgtttgacacaatgcctgagaagaatgttatttctttcaccaccatgattgatgggtatgccaaagcaggtgacatggcgacggtaacaaaccaccatgagccaagggaaggaggagctcaacaaagtaagaagaaattgaatggtgaagaaaaactcgtgagaaagatgatgttgtttcgcaaaacccattcacagggcccagcgaatgggctcacttcttag

SEQ ID NO: 81683 - DNA, 1434 bp, Glycine max
  Peptide Sequence Number=SeqID_198461
atgccgtcattgacatcacctgcaaatgtatttacctttggcaacaattcaaatcaaaataacggacctgctgcttcaagccctacattttcctctccattcccccctctgacaaacaattttacgggtcagaatatattcagtagctcatcccttgcaggaagcatcagcagcgttagtgcaaatgtaacctccactagcactgacacggcaactagcacccctgctgtagttgctgccagcaatagcagttcctccactcaagtctcatcttcatctcccacaacttcatttttcaaatttggatctaccccttcagcaccaacaagtttacttgtgtcatcttctggctcagaaccgctagaaaacaagagtggcacagggagtgtcatttttggaagctcttctgctgcaattggaagcacagggagtgacatttttgggtttagtaccccagcaatgaccggaaatagccagtctctgggttctgtctttggcactacaagtgggtctgtccctggtactcaggtatcttctggtactagtggtttttccacttcatctgagagtcagtcggtggcatttggttcatctgcatcagcctcattgtttgggttgactgggagcacaactttttcttcagggagttcattgttttcttcttcaagttccgtcccaaacaatttcaatgcgggtacaacttctgggcaaagtacccctgctgcttcttcagaaaccaaccctgttagctccagtagtggcatgagttcttctgtgtttgggctttcaagttggcagcccagcaagtcttcatttggttcttcctttagttcatcatcatcaccttcctctgggttttcctttggttcttcttttagttcatcgtcttcatctaccccggggttttcctttggaggaacatccacatcttctgttacttcttccagttcccccatgatgtttggatcatctgctgttgcatcaactcctcagttttcattcacttctgctacagctactaccaacacacagcctgcttttggaagttctactcctgctttcacatttggtggttcagctctagctcctgttaataatgatcagatgagcatggaggacagtatggcagaggacacagttcaagcaactccacccgcaactcccgtatttggtcaacaacctgccccacttcaatcaaattttgcatttggagcattagctccaacaggagtgagtcctttccatttcgcaactcaacagaacattgctccacagaatccatctccatttcaggcttctggcagtcttgagtttaatgctggagggagtttctcattgggcactggtggggctgacaaggcgggtcgaaaatatgtgaaagttaggcataatagaccgcggaagaagctgcacttcattaatgctactaattaa

SEQ ID NO: 81684 - DNA, 207 bp, Glycine max
  Peptide Sequence Number=SeqID_198462
atgcctacgtctcttactgataaatcttctgaggctaaaaagatttctcatgatcatgaaagtgccatggattttctacaagccgttggtgagaaattcatgacctttgacaaggaacataaaagtctttttgagaagactaaatatgatggcactagtgtctcgtggtgtacacgaacacatcataaagttggtgcattattataa

SEQ ID NO: 81685 - DNA, 720 bp, Glycine max
  Peptide Sequence Number=SeqID_198463
atgaacaatattacaacaataaagttcaatagtaacgggttgaccctgttcgagaaggaggtggtgaaggtggagaagaaggggaccgagtgggtggttgagtggaaaaggaagagtcagaagggtgactcactgagtcgggaggggctcgacgcagcgattgtttgttcggggcactctgcggaacccaaactggcggaggtccttgggattgacacgtggcacggggtccacatgcactcgtataactacagagttcctcaacctttcaacaatcaggttgtgattttaattggtctctttgacatatcaagagatatagcacatgtagcaaaggaagttcatacagcaacaagactaaatccagatttagcgggaatgaagtttggagattatggcaatataatgttccacacaacgttcgtcttagtcactcatgtattcactttggcacgccgccgtcaccatcgtggcaaggccttcgtcacgaccacatttgtgcgtcctctgaccctcattctcatgtcctctatgaagcccacacgctgcactggccttcccttggagcataatcatcatcaacaacaacacgacaaacactccaacgctaacactgaagacaacacgcgtgttcccaacccttatcaatcccacgcaacacaattggctaacaaatttaaagttcaaggagacaagcttgttttgggaaaggtggactaa

SEQ ID NO: 81686 - DNA, 843 bp, Glycine max
  Peptide Sequence Number=SeqID_198464
atgccaagtgtggctgtgaagctctacagcgtgttcttcaagttcctcttgaagcaccgtctgcacaaccgaatccaaaccacttccgaaccctccgacccgttcggcgtcacgacccgacccgaagaatccgtcgctccagcgaacccttccttctccgacggcgtcgccactaaagacatccacatcgaccccttaacctctctctccatccgaatcttccttcccgaatccgccctcacccctcccgagcctcactccaaccctaggtccgatcccctgcctcgatccgcgcgtgccgaccccgtttcgcggcggagtagctacgggccgccgctccgggaggagcaccggagcagcagctttggagggagctccggcgtggaggggttgaacctgatgtcggatggggtgtaccgggggtacgcgccggggaagcggggggagcggcggaggctgccggtgatgctgcagttccacggtggcgggtgggtgagcggcgggagcgattcggtggcgaacgacgcgttctgccggcggatcgcgaaggtgtgcgacgtggtggtggtggcggtggggtaccggctggcgccggagaaccggtactcggcggcgttcgaggacggcgtgaaggtgctgaattggctggcgaagcaggcgaatttggcggagtgtagcaagtcgatggtgggtgggaagagtggagggcataatgttggtggggagtttaagaaatcggattcgcataagcatattgttgattcatttggggcttctatggctgagccttggttggctgctcatgctgatccttcacggttgttactattttctgatgattgt

SEQ ID NO: 81687 - DNA, 528 bp, Glycine max
  Peptide Sequence Number=SeqID_198465
atggcatcgagttgtggtgccaatattgcagactacgtggcacgaaaagctgtggaaggaggcaaacttctggaccctgtcaaggtggtagcacaggtcctgatgtatccatttttcattggaagtgttcccacacgttctgaaataaaattggcaaattcttacttttatgacaaggccatgtgtacgcttgcctggaaacttttcctacctgaggaggaatttagtttggaccatccagctgctaatccccttgtcccaggccggggtcctcctttaaagttgatgcctccaacattgacagttgtggccgaacatgactggatgagggatcgtgccattgcttactcagaggagctccggaaggtgaatgttgatgcacctgttcttgagtataaggatgcagtacatgaatttgctaccctggacgtccttctgaaaagccctcaggcccaggtttgtgctgaggacattgccatatgggcgaagaaatatatctcacttcgaggtcatgaattctcatattga

SEQ ID NO: 81688 - DNA, 249 bp, Glycine max
  Peptide Sequence Number=SeqID_198466
atgaggtttgtggttgcattcagagaggaattctataagctgtacttgccgactttgggtgacatcaaggaaagggcactgactatacttgatgaaattgaaggcaaagtcatcaatacagattcaatagagtcagagcaactagagtcaagcgaaaagcattatagagtagctacagtcaagtctgtaattgcaagtacaaggaaaagcattatagagaagctagagtcaagcgaaattgatgactga

SEQ ID NO: 81689 - DNA, 675 bp, Glycine max
  Peptide Sequence Number=SeqID_198467
atgagaaaggcttccactctgcaatgctcactttggcgcttcggtgtttcgctattgctggttgccagcttcatttgtgcttcttctgttatggcaacatctgaagtttcagggaatgaagtggataccgatgggaagcttgtaaatgaagagccagcaaaaacaagccttcaaggatatgatgaagaagaaaaatttaaagggctttttccaaaatctattcctatagttaagcctatcccaaagttagttaaacctattcctattcccgtgtataagcctataccaaaaccaattcccttggtgaagcctatttcaaagccaattccaattataaagtcaatttctaatgaagaagaaaaatttaaaggacttccaaaacctattccagtaattaagccgattccaaaactaattcctgttgtaaaacctattcctgttccaatatataaacctacaccaaaattaattcccatcattaaaccaattccaattgttaaacctgtaccaaaaccttttacagtgcaaaaacccatccccgctattgacccagagtcttttctaaagccgaagcctttctttgagaaacctattcctaaattgccacttgaccctaaattcaagaaaccacttctgccacctttcccaattcaaaagccaatttcaagtccataa

SEQ ID NO: 81690 - DNA, 339 bp, Glycine max
  Peptide Sequence Number=SeqID_198468
atggacctaggtgttgcccagtttcatcatacctttgtaggttttgatgatgccaaagtagaatcaaacaaggttgcttataaggttacttcaacaaacattcaaaggttaagcgcttcaagattaattcaaggtcaaacaaacaagatcaagaaaaaagataaggcctcaaataatctcattggtgtgaatgtatgtatacatgattttgatgatgtcaaagaagaatcaaacaaggctgcttcaaatgataaagcatttgcttcaagaataattcaagagtgcttcaacaagcaaagccatgtttcaagattcattaaagaccaagccttgccttaa

SEQ ID NO: 81691 - DNA, 399 bp, Glycine max
  Peptide Sequence Number=SeqID_198469
atgacactcttgccacccttaccaagccctccactattcatcattctcttctcctgtcgtaatctaacctttttccgcgacgcacatcctcctactggcctccgtcaagaccagctgggagtttatgccgtacatggcatcctccgcatcccttctacttatacaattaacttcaccctgttaccgaaattcctttcactgtacggaaaaagtcacgagagctggttgaaagaaataaaagagtcaccatctgtgtatgtcaccccttcgttgatattaaaacacattttcgataggaatcctcctcaagcaggtgcaattatattacttgtaagcttatttaaagtgggaaatggtgaaagtaagccaccaaggctgaaatgtgatatgacgaactaa

SEQ ID NO: 81692 - DNA, 351 bp, Glycine max
  Peptide Sequence Number=SeqID_198470
atggtattactgcatgtgttagagctcagaacagaactctggcttccagggccagaacctcctaagcaaataagaaacggagaagctgaagaaatgaaatgggaaaaactaaatggcagacaagatgaagttgaggcagaaaggattgccagctcagcaaccattccgttagacaaaatctctaaggtatgcaggggtagtgatctgcctcttaggccttgctctggcttgtgcttgcatatcgtgattgctatcagcatggcagtacggcactatggaaccccgtggttatctttcatccccacccccttgcagattttattcctcgacaagggaaacctaccactgtaa

SEQ ID NO: 81693 - DNA, 1164 bp, Glycine max
  Peptide Sequence Number=SeqID_198471
ggtttcatctttcagcttcgatttcgcgcatccatggattccatctacgcgagctcgtcgtgcacggttcctcaccttctccgtcgggagactctgttctcgccgcgagcctcgaattcggttctgctccggcgagcgaagaaggcgcggcgagagagggtttcgtgctccgccgcgacaacggggagcggcgtcgggtcgaacggcgccgtttcgagggcgttgcagggactgagcaataacagtaacactgcgctggagcagctcgacatcgagcgtggcgtatgcatccctttccgcaagtactcgcccgagatctgcctaagcatctacgacactccgtgtattcaggctatgcttggattaaagttgggaaaggatgaagaggttgttccgtatcgtgctcgacagcttaggaatctcttgtgtgatctggggccttcctttattaaagctggtcaggttcttgcaaataggccagatatcattcgagaagattatatgaatgaactgtgcattcttcaagatgatgttccttcatttcccaatcaagaggatctgggtcaaccccttgaagctgttttcagcaaaatctcatcagggacaatagcagctgcaagtttaggtcaagtttacagagctacattacgtgcaactggcgaggatgttgctatcaaggttcagaggccagggatagagcccattatttatcgagatcttttcctattccgcactttggcttcattcttaaatggcattagtatacagaaattgggatgtaatgctgagctgattgttgatgaatttggtgagaagcttttggaagagcttgattataccctggaagcccgtaatcttgaagactttcttgagaattttaaaaatgaccctactgtcaaaattcctcaggtttacaaacaattttctggtcaacgtgtgctggtaatggaatggattgatggtatcaggtgcaccaatccacaggccatcaaagaagccggtattgatgttgatggatttttaacaattggagttagtgctgccctacgacaattgttggaatttggattatttcatggagaccctcaccctggaaatatttttgccatgcgtgatgggagaattgcatatgtggactttggcaatgttgctgttctcagtcag

SEQ ID NO: 81694 - DNA, 753 bp, Glycine max
  Peptide Sequence Number=SeqID_198472
atggagaaaattgtgagtccttgtgggtgcaattttgctccccacagacaaagcaaggatagtatcgttattacccaggaagtgatccactctatgagaagtagaaagggtggtaagggattgatgaccatcaagattgatcttgagaagatgctttggagaggagaggcgttggaatctttcaatccttcaagagttatcaggcaaggagatcctatttctccttacctatttgtcttatgtatggaaagattgagccaaatgataaatgttgcagtggatagtaatctatggaaacctattcaattagggaggaaagggcccaaactttcccatttggtctttgttgatgaccttatcttgtatgttgaggcttttatgaatcaagtggagattaatgttaattggaatgttcgtgaagagattagccaaggtcctgggtttcaacaaactgataacttggggaaatatttagggattcagctccaccacaagagaaccgacaacgttatgggtacaagttttgagagccaaccaaatatggttgtggtgatgagtgtatatgttgttaacaaggagaaagctggatcgaatctctggtcagggattaaggttgtttgggattcctttattgagaatgcggattgcgtccatgatccaagtgttcctttcaatttttggtatgggaactgtttgaccccgtatggccagttggataggtgggctactcgtgaactcactcacgatgattga

SEQ ID NO: 81695 - DNA, 504 bp, Glycine max
  Peptide Sequence Number=SeqID_198473
atgaataatgaaggagtttggttggataatccggatgagcttgagaagatggtcactaaattctgtagtgatttattccaagagaaggatgttcatgaggagttttgcttgaaagggaggtttccaaagttggatgagtcagaggtggaaatgctaaggtgttctatctttaatgaagaagtcaagaaaactatctttcatatggagagctttaaggctcgtggtgaggatgggtttcacaatgtattttatcaaagccagtggaaagtggttgaaccttccttgtgcagtattattaaggacttattccataatccttctagagcgttatgcaagagatacgctaagactcaatcttatatgcaatgtggtaccatgtcagtgaaaaacctcgccgagcgcctaggaatacataacaagacagatgacacactggtaagtcaggtcactttcactaggcttaaaggacccctcaaaccgggtgtatttgcccacaaggcctag

SEQ ID NO: 81696 - DNA, 273 bp, Glycine max
  Peptide Sequence Number=SeqID_198474
atggacccttcctataatcatgcaggatggaagcaggaaagggataaaggttacctacctagctatactgatatcagatacaatgaacaaatggaagatttgatggatcaagcttatgagcgatttctgatcagaaaggaaggaagtgcaaaacagaggaagctaattaaaaaatcctatgatgcaaaggcccaacttttggaggagattaggaaaatgagagattataatgtgattctacaaacatccatgaacaacgctaccgataattga

SEQ ID NO: 81697 - DNA, 639 bp, Glycine max
  Peptide Sequence Number=SeqID_198475
atgaaatcagaggttagtgcagttacaagggtggtggataaaaataagggcattgacaaagggaaaggtgttacctgggctgtttctgtttctgaaaaagattcattttcttccacaaaggctgcacctttttcaagatggaagaagggaattgcggtaacagatttcgtcctacgacttggtgccatcggtgcagctatgggtagcgctgttaccatgggaaccaacgaagaacaactaccattcttcacgcagttcctccagttccatgctcagtggagtgattttcccgtgttccagtttttcgtgtttgcaaacggagtaatcagtggatatgctatccttagccttcccttttcatatgtgtgcattgttcaaccacatgcagtaaggccaaggcttcttcttatgaccttcgacacagtgatgatggggctaatcagtgttgcggcggcaggtgcagctgcgattgtgtacgtaggtcataatgggagtcaagacgcgaattggatggctttttgccagggattcaccaacttttgtcaagctgctagtgaggctgtggtcctttcatttgttgcagctgctttcttcttgtgtttggtccccctctccgctttggctctcaaaagcaattga

SEQ ID NO: 81698 - DNA, 459 bp, Glycine max
  Peptide Sequence Number=SeqID_198476
atgaagtcagataacctggacaaaaatgcaataagtgagaaggaagccaccaagactaacttacacaagttggacaagaggcacaacccagacaagtgccaacctctcccaaaaaggcctagaagactgctaggtcctaaaggacaagatagggagcttatacaagctaggtacctagcccagtttgtcaaaaggctagacaaccaccaagtagaagcaagacctggaggacaccaagaggagcaatacaccaacaacaatggtgtgagcgacaacctccacaagaataggaacccgcccaacagattagagggtatcaacctcgtcaaccaagatgaccccgtggttgtctccatcatcattgcaaacttcatggtttccaaggtcctcatcgaccaagccagttggaagcttgcttgtggggcttctatggaggctggatctttgagcttcaatgag

SEQ ID NO: 81699 - DNA, 165 bp, Glycine max
  Peptide Sequence Number=SeqID_198477
atggagcaacatggcaaaggattcaacaagaccatcagtctcttttaccctttcaaggatgtgaaggatggtgctcttcttggcaaggagtacattactatagaggaggaggctgttgatgaggagcagggtgctgcggagcaaggcgatgatgcctatgtctag

SEQ ID NO: 81700 - DNA, 324 bp, Glycine max
  Peptide Sequence Number=SeqID_198478
atggaccaagatggcaaccaaaaccatgtttgttactgccatggagcttggtttgtggttaaattgaatcttcaagctatagttcacttttttcttgctttcctttcaaatgtcgagaacccctcccacactgtcgtgcagaagcttgaaggcacagtcctcaacatggtcatcttcattgtcctcattgcgctcatcacctttctcctccactccacgtgtgcttctccgcctttctcttcctcttcaactttgtcatcattggcgtccttagccgcaataaggagttgccgacattggtttatgacgtacgtccaacggtga

SEQ ID NO: 81701 - DNA, 222 bp, Glycine max
  Peptide Sequence Number=SeqID_198479
atgtgtgatggtatcatcgacacacttcttaacattcaaggaaagacaaaggatggtttgaatactcgtcaagatctaactgagatgggtatacgtgaccagttacatccaaggtctaatgaagaagttattgaattttgttcaaagtacattgaaaaggagaaactagttgggctttccaagtctcggcatgacgagaaagtgagaggtaagggttcatga

SEQ ID NO: 81702 - DNA, 326 bp, Glycine max
  Peptide Sequence Number=SeqID_198480
tctcttctacctcaaatgttttttatggcctctcacaaatgtttgtcaccacttccaacactccaccatctgcatataatctagcactaccgagttcttgttatcgtccatcattatctactcaaatgcgtgacatgggtcatgaagatgaggaggaggaggatgataacaacaataacaacgatgatgatgataacaacggtggtggtgatcatgttcctcaacaacaacacacaattatacgtgagcatcctagaacaagaagaggtagagatcatagaccaagaggacaacaaacacagacaaattcaggtacaacaagatga

SEQ ID NO: 81703 - DNA, 330 bp, Glycine max
  Peptide Sequence Number=SeqID_198481
atattgaggccgggacggtttgacacaaatgatggaggtcgttatccttatgtccatgaaaagccagaagaggagaacagcattgggtcaaaattgatcgccaagaaaaattatggtgtggtgggagggacatcacatgcatcattgtcattaaaagcagacaacctagctagcctgcactacatgcagcttttcaatgcagtcagtaccttgaaaattatgatggctaaagctgcctctcacatgtgtcacggttgctttccaagagctgtgattccaaatcccaagacaagagaccaatcagtggttgttgttggtgctcatttttaa

SEQ ID NO: 81704 - DNA, 810 bp, Glycine max
  Peptide Sequence Number=SeqID_198482
atgccaaatacatatttcccactaaggtgggagagcactggggaccaatggtggtatgcatcaccaatagattgtgctgctgcaaatggccactatgacttggttcgtgagctgctaagaattgacaacaaccaccttttcaagctcacttcccttcgccgaattcgccgcctcgaagtcgtgtgggacggtgaagaagaacaacagttcagtgatgttgcaaagtgccgctctcaggtggcacagaagctgcttcttgagtgtgagtccaagagagggagcagcagcagcagcaagaactctctcatccgtgcagggtatggagggtggctaatgtacactgctgcatcagctggggacttgagttttgtgcagctacttcttgagaggaatcctttgttggtgtttggagaaggagaatataatgtcactgacatcttttatgctgcttcaaggggcaggaattgtgaggtttttaggctggtttttgattttgcagtttctccaaggtttatcactggcaaaggtggggttttggaggagcacgttggtggggatgttcctcctgtttacaagtgggagatgagtaatagggctgttcatgctgctgctagagggggtagtgtggagattttggtggagtatcttgctaattgctctgatgttttggcttatagagatgctcagggatctactctcttgcattctgctgctggcagagggcaggttgaggtgttgattgaatataagatgctttggatgcatgctgttacaaacacctggcatagaatactctctctgattacctga

SEQ ID NO: 81705 - DNA, 1282 bp, Glycine max
  misc_feature (3)..(3): n is a, c, g, or t
  Peptide Sequence Number=SeqID_198483
ggnccaattagctgcagttgagactatagtttctgcatctcctgcattgatttctctgcaaaacaacgcaggagaaactttcctccataaggccgtgtctggttttcagtctacctcattcagaagattggacagacaggttgagcttttgaggcagttagtaagtggcaaaaaatttcacatagaggaagtcatcaatgcaaagaacactgatggaagaactgcactccacattgccacaatagggaaaattcacactgatcttgttaagctcctgatgactgctccatcaataaatgtgaatgtgagtgatgctaatggcatgaccccacttgattaccttaagcaaaatcccaacccagcagcatcaaatgtgctaattagaaaattgattgctgctggtggaatgttccatcatcacagttcaagaaaagccatagcctcacacatgaaaatgcatagtattggaggcagtcctggaacatcattcagaatctcagacactcagatatttttgtacacaggagttgagaatgcatcagatgcaagcactgatcagggaagtgcaggaatgagttcaacttcatcagaacacactgcatatgactcagcagcagagaacagaccctcaacaacaagcaaaaggccttcagtggccgccggattgaaacgagtccttcagtggccactggtgaaggacaagaaatctgagggtatcaggaaatcaatcgatgagggttcattggactcatgcaggaaatgggacatcagtgatgaaattccaaccccacttagacaaaaattctttaggcattcagcacttcctaacaacaaaaggaacctttctgtgaggagttaccagtcaagtccaaatgctaagaagagatttgcttcaggactggtacatgtaaaggtttcaagaagatcaagctctagttccttttccatatcctcattttcatcacctagatcaatagataataagcaaaagggtttttgtgttgacaatgatgttgctggaccatcttgctcaagtcataaaaatgataaatcaacaaattcagggaagagagcttctgttagcaaaaagctaaggggccattatttctgtttctccaaagcctcagtggacaaggagcaagaaagccactgttacaaggatcatgatgtttttgcaggctattgtcaaatacagaagaggaaaaggtgccgcatcaatgcaaaactacactgtagggatttgagggcgtctagtgcattcattgtttgcaagtttttttag

SEQ ID NO: 81706 - DNA, 867 bp, Glycine max
  Peptide Sequence Number=SeqID_198484
atgccaagtgtggctgtgaagctctacagcgtgttcttcaagttcctcttgaagcaccgtctgcagaaccgaatccaaaccacttccgaccactccgacccgttcggggtcactacccgacccgaagaatcggtggctccggcgaacccttctttctccgacggcgtcgccaccaaagacatccacatcgatctcttaacctctctctccatccgaatcttccttcccgaatccgctctcacccctcccgagcctcactccaaacctaggcccgatcccgagcctcgttccgcgcgcgccaaccccgtttcgcggcggaatagctatgggccgcctcttcgggaggagctccggagcaacagcttcggagggagatccggtgtggatggattgaacctgatgtcggacggggtgtaccggggctacgcgccggggaagcggggggagcagcggaggctgccggtgatgctgcagttccacggcggcgggtgggtgagcggcgggagcgattcggtggcgaacgacgcgttctgccggcggatcgcaaaggtgtgcgacgtggtagttgtggcggttgggtaccggctggcgccggagaaccggtacccggccgcgttcgaggacggcgtgaaggtgctgaattggctggcgaagcaggcgaatttggcggagtgtagcaagtcgatggggggtgggaagagtggagggcatggtgttggtggggagtttaagaaatcggattctcataagcatattgttgattcatttggggcttctatggttgagccttggttggctgctcatgctgatctttcaaggttgttacttttttgtcatgattgtgttagttattttgattctatttga

SEQ ID NO: 81707 - DNA, 171 bp, Glycine max
  Peptide Sequence Number=SeqID_198485
atgacggctaaggatgatggcaagggtgacgagaaaggacttagtggccagccacttggtaggggcccaaagcaattggaatgggccaatagccactccccgagattagcccaaataaatagtcatgcaaggaaacgagcaaagactgtttcttcatataacacagtctaa

SEQ ID NO: 81708 - DNA, 612 bp, Glycine max
  Peptide Sequence Number=SeqID_198486
atggtggtgggagccttgtgccctagatgtgttcttcttggagcgagttgtggtgccaatattgcagactatgtggctcgaaaagctgtggaaggaggcaaacttctggaacctgtcaaggtggtagcacaggtcctgatgtatccatttttcattggaagtgttcccacacgttctgaaataaaattggcaaactcttacttttatgacaaggccatgtgtatgcttgcctggaaacttttcctacctgaggaggaattcagtttggaccatccagctgctaatccccttgtcccaggccggggtcctcctttaaagttgatgcctccaacattgacagttgtggccgaacatgactggatgagggatcgtgccattgcttactcagaggagctccggaaggtgaatgttgatgcacctgttcttgagtataaggatgcagtacatgaatttgcaacccttgatgtccttctgaaaagccctcaggcccagctgtgcgggttctatgagactatgactgctttcaaggtactaatatgcaaagcagaactctgtccattgagaactggtctccattttgccgggatcttcattaccacaaattatgtgtaa

SEQ ID NO: 81709 - DNA, 168 bp, Glycine max
  Peptide Sequence Number=SeqID_198487
atgaccacgacgatgccttcgaaaaccgtggtggaaaaaggggaaagcagccttcaaaaacggtgttttctaccaccgtcgttgttgaagaacatggtaattacaaaaatgccaccgataaagcaacaacgacggattctcaacaccgatgtagaaggtgcgtcataa

SEQ ID NO: 81710 - DNA, 471 bp, Glycine max
  Peptide Sequence Number=SeqID_198488
atggataagcctcctatccaaactgtccaagtcctcgacgattctactgaccctgccattaagttaaacaattgtcctgccattatgttccctaaggacaggattctatggacccaagatgaacttctgcgatctcagtatcagctgggagcaatgatggacagtttcaagcacatgggaatcagctttgggattgaaaaagggaaggtggacaacggaggaggaagaaattttgaccaagtacattatggccaatggagaaggttcgtggagatcattgccgaaaaatacaggattgttgagatgcgggaacagttgcaggctaaggttgagaagaatttgaagcagcttcagaagctgtggaaagaaatgaagacaagaagggtagcactggataaggggcttattgatagggccatggcaggtataatggttggtgtattctctaaagatgtcgggttgcaaatttag

SEQ ID NO: 81711 - DNA, 396 bp, Glycine max
  Peptide Sequence Number=SeqID_198489
atggaaggattcaagttggttagtgaagttgttcccgatttcgaaggtttaatcgtcaaggtgaagggacaaaggattcaaggaacaatccctaaacactttctcaacgtgttctcatcctatatcagtgcttatgatgactttgtgcctaatgttggactgcttttcaagaactgtgttgatattgttcgtagtagacaacacactaattatcttatagatgttgttggcgccataacagcagtttcaaacgagagggagtatgcatttgcccatgaagtcagaaaatttataacgattgaacttattgacatgaggtttacatttatacccaccatgatgttttcactactacaaaagcgcgtttttacaacgctatttctaagacagttctaa

SEQ ID NO: 81712 - DNA, 303 bp, Glycine max
  Peptide Sequence Number=SeqID_198490
atgagagaggaatggcgtgacggagttggcgtcacggagaaggaaaaagaagaagtggtgttgacgaagaagaagagtaagagaaatgagaggcaatttggaggctttctattgctctcacacgacccaaagcaatttggaggctttttattgctctcacacgacccaaagtgtagaagaatcaaaattgtgcaagcacatggggataataaggttgaagaggataattatcttgattcagacagttctgcacttataattgagacctttgacactagtacacaacaggtcaaatgcatataa

SEQ ID NO: 81713 - DNA, 177 bp, Glycine max
  Peptide Sequence Number=SeqID_198491
atgccgcctagtcgtagaaagggtagaaagaaaagcaacagcgatgccgccgcctgccagcagtttaagctcggcgatctcgtgctcgctaaggttaagggattccctgcttggcctacgatgaataacagaacactctcttggattgcatgttgtactgattttcctctgctatag

SEQ ID NO: 81714 - DNA, 900 bp, Glycine max
  Peptide Sequence Number=SeqID_198492
atgacattggagggtgaagatggggaatatagtgaagatgttgatgactgtgaattgttgggttttctgtccgaaaggatcacatattctgaaacattggtggggaagttgtggagcagacatatgtttgctcacgagttggttttagaactgaatgagggccaaggttggagaagcgaaaacgactatcgaagaatgtatcacggtgtggttgtgaggcgatgtgtcgtgtgcatgtggatgtccagacttcgagatgggtttataaggaaggatattcataatcaacaagctaggatgaggaaatggaaaacaacacatgtgggtggtgcattaaagtacctaagtctattatgtcaaaaggatccaattatggttgtaacttactttgatgaaagggaacgactgcaatatttgttttggtgtgatgctgaaagtcagatgaactacaaggtgtttggtgatgtcctcgcatttgatgtgacctacaaaaaaaataagtacttatgtccattcgtaatttttttgggtgttaaccactataaccataccatagtgtttgttgttgttgttgttacgaatgagatggaggagatatatgtgtggctgttggagcagttccttcaagctatgaatggtaaagctccttcgccagtaattaataatggagatgttgcaatgaagaatgccatcaagatagtgttcccgaatgttgatcacaggttatgtgcatggcatctgatgcgcaatgcagccaaccacgtaagggacaaaggtgtcttaaaatatttaaagagttttatgctcagtgatattgaagtcgttgaatttgaagaaaggtggacagacatggtgggcaaatatgaattacaagatggagtaaactttgttcactactag

SEQ ID NO: 81715 - DNA, 537 bp, Glycine max
  Peptide Sequence Number=SeqID_198493
atggtgatcaatgtgacctcgacggtgacgctgaaatccctgccgctgctggcggtttataccggcagcaaagcggcagtcaacgcctttaccgagtcgctggcgctggaactgcagccctttaatgttcaggtgagactggtattacccgggctggcacccaccaccgactttggcaaaaatgcccggccgcgcatggaaaacaccttgctcgagccttaccagccgatgtttgatggcatcatcgccggcatgcagcagccccagccaaccactaaagcacaggacgttgccgctgccgtgtggcgtgccgcgaccgatcccgccgcaccgatgcgcatcccggccggagaagatgccgaagcctcgatgaagcaatacgtgccgccagaccgtcgcgcgccagccagctttgcagcggggcaaacaacggttcaggcagcgcctcaggcgcgaaccagtgccagcctgcgcacttatccggttcccgcagctgcggctcgccgctggcgtccggcgccaccatcagcagcgtaa

SEQ ID NO: 81716 - DNA, 636 bp, Glycine max
  Peptide Sequence Number=SeqID_198494
atggcgagttcggtagagttcacggggtaccgcagaaggttcagactgggatataagcctacatgcgccgacgtgaggaggattgccctagaaaagaggggaagatacatgggtcagccacaagggctgcaagtgaaaggggacccagacgttaattttaagcagctggtaaatcaagctgaggaaggggaagatgaggattgggggcttcccccagagctaaaaataatggtcgaacaagaagatagggaagtgaagccacaccaacaagaaacggagattgtaaacttaggtgtgggtgaagaaagaaaggaggccaaggttggcacgggcatgtccacacatatccgagatgaattagtggctctgctacgagactaccaagacatctttgcttggtcataccaggatatgcccgacttgagtctcaacatccaaaagctaaggaggatgaagcccaatatgtccttgaagataaaagaagaggtgaaaaagaaatttgacattggcttcttggctatggctcaatacccggaatgggtcgccaacatcatgccagtccctaagaaggatgggagggaaggtgcgaatgtgcgtggactatcgggatctaaatcgagccagtccaaaggataa

SEQ ID NO: 81717 - DNA, 174 bp, Glycine max
  Peptide Sequence Number=SeqID_198495
atgacattatccgatatggctgaagaagttcacgacaaagctagagagatcggcattgtggtagttggtggaggtgctgctgaggcaacattatcagttaacttggagttccttgctacaactttaggatctcaagagcggttggctatagcaaaatttgttgagtcatgttaa

SEQ ID NO: 81718 - DNA, 333 bp, Glycine max
  Peptide Sequence Number=SeqID_198496
atgttctcgggatcccaattcgacgccaccaccgccttctccggaggcggtttcacgtcctcccagccgtctaccctcaacgattcttctcccgcgccgtcaaacagccgcgaaactccgggtttggtgccggtgacagtgaagcagataagcgaggcctctcaatccggtgatgaaaagtcgaatttcgtgatcaacggtgtagatctgaacaatgtaacactggttgggatgatgtttgagaaagttgagagaaatactgatgtcagttttgttttggatgatggaacaggacgaatcaaatgtcgaagatggtatttggtgaaatattaa

SEQ ID NO: 81719 - DNA, 447 bp, Glycine max
  Peptide Sequence Number=SeqID_198497
atgattattttgcttgaagattggtggcctgtgacaaattttgatgagatcccttttcactttattgattgcatccataaccatcttcgctccaaaataaaggtggaaggaatcacttctgcaaatccttcatctggctcatctttggaaactcctgtcaaaagtgcaccaaatagatctcaggcatcaaatccagtatgtgcacaacatagcgtggatggacttaagggtattgataaattggttatggactacctggagcagcattcagataggcgagttacacatccaacattctatttgtcagatggacgtggaatacatgttgatgaactatcacgggagctcaagcttccaattgaaaagatcaagttgtcgctgaagactcttgcagatgatggtgaaatatactccaccatagatgacgaccattacaaaaaagcctga

SEQ ID NO: 81720 - DNA, 430 bp, Glycine max
  Peptide Sequence Number=SeqID_198498
gacggtgcgggtgctctgttgagtcgcgttatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaccccgatgagtaggagggcgcggcggtcgctgcaaaacccagggcgcgagcccgggcggagcgggtcgtcggtgcagatcttgggtgggggaaaggttccatgtgaacggcactttgcacatgggttagtcgatcctaagggacggggggaagcccgtctgatagcgctctgtgcgcgtactccgaaagggaatcggcctgcccaccctggaaacggctcagtccggag

SEQ ID NO: 81721 - DNA, 273 bp, Glycine max
  Peptide Sequence Number=SeqID_198499
atgaaggaggaaggaataaaagctgatttggtgacatggaatagtttagttttaggttattcaatgacctgctacagtgaggaagcattggctgtgataaatcggatcgagagtttgggattaactcctaatgtggtgtcctggactgctatgatatcaggctattgtgaaaatgagaactacatggatgccctacagtttttcagccaaatgcaagaagaaaatgtttcaccattgtcaagagtggcatctgttgccttcaacaacaaatga

SEQ ID NO: 81722 - DNA, 162 bp, Glycine max
  Peptide Sequence Number=SeqID_198500
tcatgccctgcccaagtagtcatctctacacatagactattggtgcctgaaaacattgcaaaatctgatgataagggtattcctcattgcacttttcttggattaggagatgctgctggtgacaggttccatagaggaggtgaatcaatgttgtgtgcacaa

SEQ ID NO: 81723 - DNA, 1089 bp, Glycine max
  Peptide Sequence Number=SeqID_198501
atgccaactacatatttcccactaaggtgggagagcactggggaccaatggtggtatgcatcaccaatagattgtgctgctgcaaatggccactatgacttggttcgtgagctgctaagaattgacaacaaccacctcttcaagctcacttcccttcgccgaattcgccgccttgaagtcgtgtgggatgatgaagaacaacaacagttcagtgatgttgcaaagtgccgctcacaggtggcacataagctgcttcttgagtgtgattccaagagaagaagcagcagcaagaactctctcatccgtgcagggtatggagggtggctaatctacactgctgcatcagctggtgacttgagttttgtgcagcaacttcttgagaggaaccctttgttggtgtttggagaaggagagtataatgtcactgatatcttttatgctgcttcaaggggcaagagttgtgaggtttttaggctggtttttgattttgcagtttctccaaggtttgtcactggcaaaggcggggttttggaggagcatgttggtggggatgttcctcctgtttacaagtgggagatgagtaatagggctgttcatgctgctgctagaggcggtagtgtggagattttggtggagtttcttgctaattgctctgatgttttggcttatagagatgctcagggatctactctcttgcattctgcttcagggagagggcaggttgaggtggtcaaatacctcacatcatcctttgacattataaactccacagatcatcagggaaacactgctttgcatgtggctgcttacaggggccaattagctgcagttgaggctttagtttctgcatctcctgcattgatctctctgagaaacaatgcgggagaaacgttcctccataaggccgtgtccggttttcagtccacctcattcagaagattggacagacaggttgagcttctgaggcagttagtgagtggtaaaaaatttcacatagaggaagtcatcaatgtaaagaacactgatggaagaactgcactccacattgccacaatagggaaattcacactgatcttgttaagctcctga

SEQ ID NO: 81724 - DNA, 663 bp, Glycine max
  Peptide Sequence Number=SeqID_198502
atgagttctacttcatcagaacacactgcatatgactcagcagcagagaacagacccccaacaacaagcaaaaggccttcggtcgctgccgggttgaaacgagtccttcagtggccattggtgaaggacaagaaagctgaggggataaggaaatcaattgatgagggttcattggactcatgcaggaaatgggacatcacagatgaaattccaaccccacttagacaaaaattctttaggcattctgcgcttcctaacaacaaaaggaacctttctgtgaggagttaccagtcaagcccaaatgctaagaagagatttgcttcaggactggtacatgtaaaggtttcaagaagatcaagctctagttccttttccatatcatcattttcatcacctagatcaacggataataagcaaaagggtttttgtgttgacaatgatgttgctggaccatcttgctcaaatcaccaaaatgataaatctacaaattcagggaagagaacttctgttagcaaaaagctaaggggtcattatttctgtttctccaaagcctcagtgaacaaggagcaagaaagttattgttacaaggatcatgatgctattgtcaaatacagaagaggaaaagatgctgcacccatgcaaaactacactgtcaagatttga

SEQ ID NO: 81725 - DNA, 174 bp, Glycine max
  Peptide Sequence Number=SeqID_198503
atgggaggaaagatacaaactgaacataatgatggtggagggcctcctcaatttgttgttaatggtcaaaattatcatggtattggtaatttgctacatattccaggagaaactcccaagtctgtcaactctatgtttatgatacccaaaatgaagttcaaagcagtcagatga

SEQ ID NO: 81726 - DNA, 675 bp, Glycine max
  Peptide Sequence Number=SeqID_198504
atgggtaacctggaaggaagacatttgttgtgttgggttgtgagatgggtgacaaatataggcgatacaaaatggatattgacaaaaccactaggactagaaaatacatatcctgatgcggtaaaattgttgaatgcatttgacatagtgttcttgatggatagtacttacaaaaccaatagacatacattgtcattgcttgatattgttggtgtcacatctattgggttgaatttttctatagctttgaatgtcaaagcaaagttcaaaacatatgtaactcctaaagaggcatgggaccaagtgatggatgcatggggtagtgttatgaatagtcctatagagtctgactatgaagactatgtaacaaagtttgacgttgtttgtgaatcatggtgtgagtttattaaggttaagtctgtgcattggaccttaaagaggttgctccaaactagcatgcgagacttatatgagctcggtagatcaatgtttattggtttagacactcttcattatggatgcattttaaaaactacccatggtttgccctatgcctatgaactagatagatatgctttatattgcataccacttcaatcaattcatatgtgttggaccacactaagtttcaatgacatggggtctaatgaccaacatgaagagttgtcttactag

SEQ ID NO: 81727 - DNA, 666 bp, Glycine max
  Peptide Sequence Number=SeqID_198505
atgaatgagggcaaaagtgttgccgactacttcactaggttgttgaccgtcacaaactatatgaaaactaatggtgaacaactgacaactctgatgattgttgagatcaaggccatgagaaccttgaccccaaggtttgatgatatcctggtggcaatagagcaggccaaggatcttgaagaaatgcaagtgcaggagctacaaggtgctcttgaagcacaagaaataagaatggatgaaagaaacattgaaagattcaatactgagcaagccttacaagcacaagcttccaaaaagaatgatggaggttgttcaaatcatatgtcagggagaaaggaatggttcattaaaagcaaggtgaagtttggtggcaactcagtagttattgctgaaggtgaatatacttcgcacgaatctcttaatgattatgatgaagaagggatgcttcatgaagtaactgctccttacacatacctcaacataataggtcctataagaggttttgaagagataactccaaaagaagcttggtctagaagaaaacctgatttgtctcatctcaagatctctggcttcttatgttatgagcatgttctagaacaagtgaacaagaagttagatggtaggactgattcaatgatcttccttggatatcatccaacataa

SEQ ID NO: 81728 - DNA, 1305 bp, Glycine max
  Peptide Sequence Number=SeqID_198506
atgactgaagaagaattactgagacagaaggcaattaatgattggcttccaattacttcttcaaggaatggaaaatggtggtactctgccgtccacaatgtcactagcatggttggggctggtgtccttagtctcccatatgccatgtctgagctaggatggggtcccggtgtaactgtgctagtcctgtcatggatcattaccttgtacaccctatggcaaatggtagagatgcatgaaatggttcctggaaaacgttttgataggtaccatgaacttgggcagtatgcctttggggagaagctaggactttatattgtggtgcctcaacaacttgtggtggaaattggggtcaacattgtctatatggtcactgggggaaaatccttgcaaaagttccatgacaccgtgtgtgacagctgcaaaaagatcaagttgaccttcttcattatgatctttgcctctgttcactttgtactatctcacctgcccagctttaactccatttctggtttatctctggcagcagcagttatgtccttgagttactctacaattgcctgggcagcttctgcccataagggtgttcaagagaatgtacaatatggttacaaagctaagagtacatcaggaacagtcttcaacttctttagtgcccttggggatgttgcttttgcctatgctggacacaatgtggtgatggaaatccaagcaacaattccatctacaccggagaaaccatccaagggtcctatgtggagaggagtggttgttgcttacatagttgtgggtttatgctacttcccagttgcccttattggttactggatgtttggcaattctgttgaagataacattctcatcagtttagagaaaccaaaatggcttattgcaatggctaacatgtttgttgtgatccatgttattggtagttatcagatttatgcaatgccagtgtttgacatgattgaaactgtgatggtgaagaagttgaacttcaaacctagtagtacacttcgtttcattgtacgcaacgtgtatgtggcattcacaatgttcgttggtattaccttcccattctttagtggtctcctaggattttttgggggatttgcttttgcaccaacaacatactttctcccctgcatcatgtggcttgcaatctacaaaccaaggagattcagcttgtcttggtgggccaactggatctgcattgtgtttggcatattgttgatgattttatcaccaattggaggtttgaggtcaatcataattagtgccaaggactacaagttctactcataa

SEQ ID NO: 81729 - DNA, 318 bp, Glycine max
  Peptide Sequence Number=SeqID_198507
atggctaagcaattggcagaacaaccaagtgcaaatttctctggaaacgcccaaaccaacccaaaggaacattgtcaagccattacaacaaggagtggtaggatgttaggtgaggtaagtgatgaaaataaagatgaagttgaagaagaaaaagatattgaaaaagatagtggggaagaaaatagagaaaaatatgagagaaaagatgaaaatgataaagaaaaggagaagctgaaagggaaaaggatgagtgagaaaaatctttctaacgtgaggtttccatatatcctacatgggaaagaagaaagggaagcgtga

SEQ ID NO: 81730 - DNA, 282 bp, Glycine max
  Peptide Sequence Number=SeqID_198508
atggaaccaactcagaaaaatatgtgcaaattggaaggcatgcttgcatctaatatgcctgcggagccttcaacgccagaacatggtcctggaaattggagggcagttcttgccaaaacagggttttcaagatgcagcaagagttgcagacttagatcaactaattacctgaggccaggaatcaaacaaggcaacttctcagaacaagaggagaagatgataatccatcttcaagatcttttaggaaacaggtacaaatcaatcttccaagcacctacttag

SEQ ID NO: 81731 - DNA, 786 bp, Glycine max
  Peptide Sequence Number=SeqID_198509
atgtatatatgcagctactcaaccattgcatgggtggcttccgtggacaagcgagttcataatcacatagatgtggcggttgagtatgggtacaaagccagtacttcagcaggaacggttttcaattttctcaatgccttaggagatgttgcttttgcctacgctggacacaatgtggtgttggagattcaagcaaccatcccttcctccccagagaagccatcaaagggtcctatgtggaggggggtgctaatagcatatttagttgtgggcttgtgctacttccctgttgctcttgttggctattgggtgtttggcaattctgttgatgacaacatcctcatcaccctaaacaaacccacttggcttatagtaactgccaacatgtttgttgtcatccatgtcataggaagctaccagctatatgcaatgcctgtttttgacatgattgagaccgtgatggttaaaaaattgcatttcgagccaagttggctgctacgatttgtcgtgcgcaatgtttatgttgcatttacaatgtttgtgggcattacgttccctttctttggtgccctcctcggattttttggaggatttgcatttgctccaacaacatactttctcccctgtattatgtggcttgctatttacaaacctaggaagttcagcttatcttggatcaccaattggatctgcattgtacttggtctcctactcatgattttatcaccaattggtggattaaggagtatcatactcaatgccaaaacctacgggttttaccaatga

SEQ ID NO: 81732 - DNA, 261 bp, Glycine max
  Peptide Sequence Number=SeqID_198510
atgaaggttgtaggcctagaattttcaattcgtaagaaattagtaaaccaacaaatgaaggatatgacacaactagccaaaaaagttaaaagttgcatcttgatgagaatcatgaaactggccaaatacaggctaaaggcccaagtggagaaggacgaaggcctaagtggagaaggacaaagcccccgagtggagaaggatgaaggcccagaggcagaaacattatcaagactattaattgttgctgaaggcccaaactaa

SEQ ID NO: 81733 - DNA, 381 bp, Glycine max
  Peptide Sequence Number=SeqID_198511
atgtctgggttggaggaattgagaaaaaagcttgcacctttatttgatgccgagaagggtttctcatcaagttcaacattggacccttgtgattcttacacattctcggatggtgggactgttaacttgttgagtagatcatatggggtttacaatatcaacgagcttgggttgcagaagtgcacatctaggtccgtggatgaaactgatcacagtgagaaaacgtataagtgttgttcccatgagatgagaatatttggagcaatagggagtggtgccagtagtgttgtgcagagagctatacatataccaacacataggattctggcattaaagaagatcaacatcttcgagaagactgatatagaaattattccttaa

SEQ ID NO: 81734 - DNA, 345 bp, Glycine max
  Peptide Sequence Number=SeqID_198512
atggatggtacacaagactcgggtaataccgatcgtggagaaatcagagcaagccttcatggtcttacgcaatatatggatgacaattgggatgacacttcacatgttggtataggacatgatgctctttttctagcatatattactcacgacatcctattccaaagaactagttctcacacagttcttgtcttgggcctaacactgccactaagcctcttaagccttcatggtcttacgcaatatatggatgacaattgggatgacacttcacatgttggtacaagacatgatgctcttacaaaccatggatacaactctgctctagtcaagaatgtcaagtaa

SEQ ID NO: 81735 - DNA, 549 bp, Glycine max
  Peptide Sequence Number=SeqID_198513
atggatctgcgatggatcagcgatttagaagtgagagaagatggggttgtcgttcacgaagctgttcagcaggttgtttgcgaagaaggaaatgaggattctgatggatttaatgttgagactgtggagtacaagaacatcagcttcactgtgtgggatgttggtggtcaggacaagatccgtccactgtggaggcattatttccagaacactcagggtctcatttttgtggttgatagcaatgatagagatcgagtggttgaggcaagggatgagctgcacagaatgttgaatgaggatgaacttagagatgctgttttgcttgtttttgccaacaagcaagatcttcctaatgcaatgaatgctgcagaaataactgacaagcttggacttcattcactccgtcaacgccactggtatatccagagcacttgtgcaacttctggagagggtctctatgagggtttggactggctttctaacaacattgccagcaaaataatagaattgggagaagacgagagtgtaaggaagaatacgggtaaatag

SEQ ID NO: 81736 - DNA, 1095 bp, Glycine max
  Peptide Sequence Number=SeqID_198514
atggatggaggatcgcttgcagatattttgcgaatgcatagaagaatacctgaacctattctatcttccatgtttcagaagctcctgcatggtctaagctatctccatggagtcagacatctagttcacagagacataaagcctgccaatctactagtaaatcttaagggggagccaaagattactgattttggtattagtgctggcttagagaattcagtggcaatgtgtgctacatttgttggaactgttacatacatgtcgcctgagaggattcgaaatgaaaactattcttatccagctgatatttggagccttggtcttgctctttttgagtgtgggacaggagaattcccgtatactgcaaatgaaggtcctgtcaatcttatgttgcagatcctggatgatccatcaccatcaccattgaaaaacaagttttcacctgaattctgctcctttgttgatgcttgcttacaaaaggatccagataccaggccaacagcagagcagctgctttcgcacccctttatcacaaagtatgaggatgccaaggtcgatttggcaggatttgttcgaagcgtttttgatcctacacaaagaatgaaggatttagcagatatgttgacaatacattattacttgctatttgatggacctgatgatttgtggcaacatacaaggaatttatatagcgaaagctcaattttcagtttctctgggaaacaacatcgtggtccaagtaatatctttacatctctatcaagtattagaactacattggttggtgactggcctcctgaaaagttggtgcatgttgttgagaggctccaatgccgcactcacggtgaagatggagttgcaattagggtatcaggatccttcataattggaaatcagttcctcatatgtggagatggcattcaagtagagggcttgccaaacttcaaggatcttggaattgacattcctagcaaaagaatgggtacatttcatgaacagttcattgtggaaccaacaagccttattggatgcgaaccaactagccttattggatgctacaccattgtcaaacaagagctatacattaaccagtaa

SEQ ID NO: 81737 - DNA, 372 bp, Glycine max
  Peptide Sequence Number=SeqID_198515
atgattaaaccgccattctcgcaaaactcaggagtgcttgctcagtgcgaagttagcgtgaaaaacaaccttgagaagtttgatgaaaaatcaaacaatgcaatttttcttggttattctctatcttctaaaacatatagaatctacaatttgagaactcaagttataaaagaaagtatgcatgttttgtttgatgaacatactaatacacctgagaaaagaaagattgcaaatctagaagaagaaatacaaaaaacaaagatcagtaagcatgctccgaacactgcacctagctcagaaagcccaaagaaaagtgatgaagaactttctaaggaagctcaaaatggaaaagttcagaaaggcaagacttag

SEQ ID NO: 81738 - DNA, 498 bp, Glycine max
  Peptide Sequence Number=SeqID_198516
gtcgactctagaggatcccacgagggctacacgccctcaccttgggtactagttaccctcaccgttgaaaggactacacgtcctcgccttgagaggactacacgtcctcaccatcagagggctgcacgccctcacctccagaggactacatgtcttcgccttgagagggctgcacgccctcaccttggagggctgcacgcccttacctccagaggactacatgtcctcgccttgagagggctacacgccctcaccttgggtactacttaccctcaccgtcagaggactacacgtcctcgccttgaaaggactacacgtcctcaccatcagagggctgcacgccctcacctccagaggactcatgtcttcaccttgggagggctacacgccctcaccttcagaggactacttatcctcacctttagaggactacacgtcctcgccatcagaagactacatgttccccattttcaaaggggggcatgccctcacctttag

SEQ ID NO: 81739 - DNA, 534 bp, Glycine max
  Peptide Sequence Number=SeqID_198517
atgcataaaagatgtctaaaattttgtgatgatttactagatcaatctcaacatattgagaaagtatttgacaaacaaagtgctgaaattatagcaaaaaatcgcttacgactaaagacttctattgatgtagttcgatggttcacatttcaagcatgtgcttttagaggcaatgatgaaagtcttcagtcactaaatagaggaaattttattgagctagtaaatcttatggcgtcttatagttctaaggttgctaatgttgttcttgaaaaagctccaggaaatgctcaatatatctcaccaagtattcaaaaagagatattgtatatttttgctagaaggaaacaaatttcaagtgttctttctcgccattgtcttgatattcaaaatcttcatggccaagggtataatggagctagcaacatgcgtggtgaatggaatgggttacaagctttattcttgaaggattgcccttatgcattatattcattgtcttgctcatcgcctacaacttgctctagttacagctgctag

SEQ ID NO: 81740 - DNA, 390 bp, Glycine max
  Peptide Sequence Number=SeqID_198518
atgacaaaaatttacctaacaatttctgtgcagaagcagcacatccctcctcttccattccctccaagagcagtttccaacaaaaaaatggaagaggcagagaaagagatcttggagacattcagaaaagtagaggtaaacatacctctgctggatgcaataaagcaaattccaaaatatgccaaattctcgaaggagctgtgcactaataagaggaagcttaaaggaagtgaacgaattagcatgggcagaaatgtctccgcattgattggtaaatctattccccaaattcctgaaaaatgtaaagatccaggtcccttgcagtcaactgatgtggtaattcatttagctaatagaagtgttcatgggaaccccttgatcactatttga

SEQ ID NO: 81741 - DNA, 351 bp, Glycine max
  Peptide Sequence Number=SeqID_198519
atgcaatgcattaggatagctagaggagaattaggtttaggtaacgttgagaaaaggggcttagagaaattgcagaatgatatccactctcctcatgttacaatctatgaatcattgctctactcagcaagggttcgtttatcgcttgaagtcaattctgaaaccagaaagatgttcattgaggaggtcatggagctggtagagttgaacttactgagggaagctttgcgcaagagactaactatagcagttgaggtagtggctaatccctctataaaattcatggatgagccaacatctgggttagatgccagggctactgcaatagttatgaggacagttagaatttag

SEQ ID NO: 81742 - DNA, 861 bp, Glycine max
  Peptide Sequence Number=SeqID_198520
atgcacaaccattttatgttcaatgcaaagcctgcctatggaaacaacattggtcttgctggcgcaaccctccgtatactaacgttcactacattcttagctttgatgtttgggacaatgttctgggacctgggatccaaaacaataaggaaacaaaatctgtttaatgttatgggttccatgtacaatgccattctcttccttgggatccagaatggcttttctgtgcaaccagtggtggccattgaacggacagtcttttatagagaaagaacaggtggaatgtatttagccatcctctatgttgttgctcagttctgtatctcaaatcctattaatataatgcaaactaatgcaccttttacttcttcggttgtcatagagctacaatatattgttgtccaagctataacatatggcatcatagtttatgcaatgatcagatttgaatggactgcttcgaaattcttttggtatctattcttcatgtacttcacatttttaaacttcgccttttatggcatgatgactgaccgtaacaccaaaccgacacattgcttcaattatggctactgcattgtatggagtttggaacctgtttttgggatttgttgtcccacgacctatggtactattgggcatgtcctgttgcttggagctgtaacatcacagtttggagatgtaacaagtgaagttgagttaaatgagacagtgaaagagtttcttagaagatactttggttatagagatgattttgtaggagttcctgcaggtgtagttgttggattagcagtgctatttgtcactatctttgctttttctgtaaaggtcttcatgattgtagatcatggtttggtatga

SEQ ID NO: 81743 - DNA, 471 bp, Glycine max
  Peptide Sequence Number=SeqID_198521
atgacacagagcaaaaactccattacaagtccgagtggcatcgctacaacctcaagcccaagctgcggtctctgtggaaaggattataaaagttctaaagctcatgctgagcaccttaaatcacgtggtcatatgatgcgggcctctgaaggaactagccatgcagatgagaaggcaataattaagccacttccacaacgtgttgtgaataggcctcctcctagaagagaggtagataactctgaaaatgaagaatgtgaagatgaatgggaggaggttgatcctgaagaggatttggttgatgaagcacgtgctgccaagtccttgactgatttgaatgtgaatgagcatggtgaaaatgttgatatggaggaagatgctgatgattttgaggagttagacccctcatgttgctttatgtgtgatcaagagcacaaaacaatagaagactgcatggcacaagcatcatga

SEQ ID NO: 81744 - DNA, 249 bp, Glycine max
  Peptide Sequence Number=SeqID_198522
atgaagaaaggagaagattcctccttagcccgaaaatgcaatgaatgcgatcaacctgagtacttgagatttgattgtcctgtccttaaaagaagaatggaaaaatccgacaagagaaatttcaaagaaaagaaagaaaagaaagcatacatcacttgggaagataatgacttggattcttcaagtgattcagaaaatgaaatcataaatctgggtctcatggcgaatgactatgaaagcggagaagag

SEQ ID NO: 81745 - DNA, 480 bp, Glycine max
  Peptide Sequence Number=SeqID_198523
atgaaaataaaacatcagtccaaagcactaaacttagtagtagcttttgatgttgtgaacaatgatgatgaaatttctgaggaagatgaagaagaactggcattcttaaccaaaagagtaaaaagactactcataaaaagaaaagggctaagaaggaacttctctaaaaaagactttcgacaaggagaaagttccaaacatgtaagatgttttgagtgcaataaaccttgtcacatcaaaactacctggcctttccttaagaaaaatttcaagagaagtgatccaaagaaaaaggccatgatggctacatgggattatacagactcatcatcatcagagaaaaatgaggagcatgcaaccaacctgtgccttatggcagacttagacaaagatgagaaatgtgcttatttgaaagggctgctttttgatgctcagaaagaaaatgagaagcttagatggataatgagaatttttttatga

SEQ ID NO: 81746 - DNA, 741 bp, Glycine max
  Peptide Sequence Number=SeqID_198524
atgatggaagcaatgatgagcatgaggaatatgatggaagtcaacgctgctacaagtgtcactgccagtactactactaagagagactcgactcacctgcccagtttcaatcaagtgagccatctgatctcagatgtagtaggtcaaggagacgaggcggtggaaaatgcatatgggcttcattatgtccaagtccagagcaagtcttgttttccaccatatggtttgcctcccaattatacattgcccactgttgtatatgctcctagtgagaatatcagtaattctgcacccatattcattaagagtcaacaacctcaactcaatcatacctttgcccatgtctatcaatccatgggagaaacacatgatgctccccaagaccacactttgaccgatttcagagtttatccgggatataccactgaagggcatgcactttctagtgtccctgtgccaaatgctctgagggtccctcagtatcaaccaccatcacaacctttatgttttgccatggaagaaggacctcctgttgtagtcaaaaatgaaaaatttaatcataccgaggagaggctaagggtcattgaaggaggaggaaattatggctttgctgacatgtcagaattgtgcttggtgcccgacgtggttattcctctaaagttcaaggtgccagattttgataaatacaaggggactagttgcccgaagaaccacctgaagatgtattgtaggaagatgtga

SEQ ID NO: 81747 - DNA, 357 bp, Glycine max
  Peptide Sequence Number=SeqID_198525
atggatgccaacaatgacttctttatggtgaattttgacatagaagaagataagatgaaggtttatctgcacttatcaaggatacaaagggagggggctcctattaaatctcacttactctttgcatatgatagatacctatttttcaaagctaatgatagtgaggcaatggtggtcaagaggattcttcaagaatatgttgttgcatcagaacatttgaaagtgaatgatttaattgatattccaaatgcaaaatggaatctcagattacttaatcaaattcttgacatgagagatgtgcaagctgtcttactagtccctatgatggatatcacaagtcatgatgctatggtctga

SEQ ID NO: 81748 - DNA, 312 bp, Glycine max
  Peptide Sequence Number=SeqID_198526
atggatgctttgcatgaccaccaccataaaggaaaagtcatttgggatttttcacaacaaatgatggttcattcatccaaagcttcttcctccaagtcaccatcacctttttctctctctaatgagtatggattggttatgagtgaatatcatagggacactaatcagaagagtgtgcaacaaaagatgaaggtactaaaggttaatatggatatcaacattacaaatgataacataatcaaagcacagtggactccagaacaggacattactcttttggaattggtgaaccaattcgggctaaagaaatga

SEQ ID NO: 81749 - DNA, 2427 bp, Glycine max
  Peptide Sequence Number=SeqID_198527
atggctgccacagcaactgtgtctttgatgggtccgaggtatgcaccaccagacccaacactccctaaaccatggcggggtcttgtggatggcaagactgggtatctttacttttggaatcctgagactaatgtcacccagtatgagaggccatcctcaagctcagcttcccagtcaaagttttcttcagtgcccagctcttctgtccaggttcaacaatcatctcaagggtcgcaacgtggtcgtagtcctgatttcagtgataggtatgatcgaaatggcactggtgggtcaaacgacgctggatcccggaacaatcagagttccaaagggggaagttatacttctcatgatgtttcaaatggaacaaatgttgctggcaatggtaattcttctgtcagaggtcatggggcttcagatgctggagctggactatctgctgagtcttatcgacatcggcatgaaatatctgtgactggagacaatgtgcctccaccgcttgcatcatttgggtcaactggctttccatctgagcttctgagagagtctgccacttggtctgtacggaagaagaggcctctcctcatgcgctaccttgcatcagcaagcattggtggcttgcatatgagggatgatgcttcttccgacattaactcctctataaccccaactccaattcaggcacagtcatggcccattgctcttcaaggtagagatatagttgccattgctaaaacaggctcagggaaaaccttgggatatttaattccagcatttattcacctcaagcgctctggtaataactccaaaatgggccccactgcattggtactttcaccaacaagggagttggcaacacagatacaagatgaagccatgaagtttgggaaatcatctagaatttcatgtgcatgtttgtatggaggagcaccaaagggtcctcaactgagagacattgatcgtggagcagatattgtggtagccactcctggtcgcttgaatgatattcttgagatgagaagaattagtcttaatcaggtttcttacctggtgctagatgaggcagacaggatgctggatatgggttttgaacctcaaattaggaaaattgtgaatgaggtgcccaatcgcaggcaaactctaatgtttactgcaacatggccaaaggaggttaggaaaattgcagctgatctgctagtcaagcctgtccaggtgaacattgggaatgtagatgagcttgttgctaacaagtctattactcagcatgttgaagtattgccaccaatggagaaacaaagacggctggaacatattttgcggtcacaggatcaaggatcaaagataattattttttgttctaccaagaaaatgtgtgatcaacttgctcgtaatctgacacgtcatttcggagctgctgctattcatggggataaatcccaggctgagagggatcatgtgttgagtcagtttcgaactgggaggtctcctgtgctagtggccacagatgttgctgctcggggactggatatcaaggacattagggtggttgtcaattatgacttccctacaggagtggaagattatgttcataggattggaaggactggaagagctggagccactgggctagcttacactttctttggtgaccaggatgctaaatatgcttcagatctcatcaaagtcttggaaggtgcaaaccagaaggtacctccagaacttcgtgatatgtcatcacggagtggtggtgggatgggtagatccagacgatggggttctgggggacgaggtggacatggtgattctggatatggtggaaggaataatgactctggatatggtggaagaggtaatgatgcaggatatggtggaagaggcagtgattctaattatggagggagggggactgctgcttctggcagaggtggaggccgtgggtttgaccatgactcccagaggaatgataggggtcggagcccagacaagggatctagttggagtgatcgcttcaaaagcgtcaaccgggatcgcagtcgtagtcctgacagggctgcactacctcaacattcccaaggtggcagctttcacaaggcaatgatggaacgtggtggtggtggtggtgatcgcaataagagctttaaccgggaccgaagccgcagtcctagccctcatagacaggagaagtgcccagcggttcgagatcgttccccagtttacagttttcatcaatcaatgatgggacgaggtcagtcatccccttcatctcaacggcagcgtgcacgcagtcctcaccgaaactcacccccctcccagggtgatggaagatatgctggatctcattcatcttacaatggagaagtggaggaagggatgattcccgaggaagaaggaatgattggtcaagatgatcccgtaaatgtcaattag

SEQ ID NO: 81750 - DNA, 459 bp, Glycine max
  Peptide Sequence Number=SeqID_198528
atgcctactttctgggtggtttcttcccttgtaccagtagtaggtggagtggcactggcatcaatgactgaagtctctttcaattggattggattcactactgctatggcatctaacgttactaatcaatcgcggaacgttttgagcaaaaaactgatgactaatgaagaggcaagtcaagggctgaatgtcagagagctatgtgtcagatcagttcttgctgctttttgcttccatgcataccagcagatacgcttaaaatttaaactaaatcacttctttaatgttaatgatataataacctcactaggtgcccaaactagtcacattaagaactgggcttgcacttgttggagttttcttgtactcaagggcaaagaggatcaagtcagtccaaaagacaaattgaggctgcataacccttcaaaaaagaaaggaaacaggcagagggaaaagtaa

SEQ ID NO: 81751 - DNA, 2820 bp, Glycine max
  Peptide Sequence Number=SeqID_198529
atgaggagaacgaacacactcctccgcaccttgccgcacttcctcacatggcgcgccttccgcttccgcaccttcgccaccaccaagcacctcgagaccttcacggagcaattcgaaatcggctcgagcgtgatcacgctcgagaccggcaagatcgctcgcttcgccaacgccgccgtcgttttggcaatggaaaacaccaacgtcctctccaccgtcaccgcctctaaagccaacgacgccgttcgcgatttcttacctctcaccgtggattatcaagagaagcaattcgcgcaaggcgtgattccgacttcgttcatgcggagggaaggtgctccgagagagcgtgagctcttgtgtggtcgaatcatcgaccggccaattcggccgttgtttccaccgggattttaccacgaggttcaggtaatggcgagtgttctttcttccgatggaaaacaagatacggatgtgttagcagctaatgcaacttcagctgctcttatgttatcagatattccttggggtggtcccattggaatggttcgaattggtaggatatgtggacagtttatagtaaatcctaccatggatgagcttaagttaagtgatcttaacttggtgtatgcttgtacaaaggacaaaactttgatgattgatgtgcaagctcgtgagatatctgataaagacctagaagctgggttaagactggctcacccagaggctgttaagtatattgaacctcaaatcagacttgctgctaaagctggcaaatctaagaaggaatacaaattgtcaatgctgtctgacaatacaatggagaaagttcgtaatatagcagaggcaccaatcgaagcagtttttaccaatcctagctatggaaagtttgaacgtggagaagcattagaaaatattgcacaagatgtaaagagagtgctcgaagaagaaggtgatgaagaaagcttaaaagtcttgtcaaaggcagtagatactgtgaggaagaaggtggttcgtaaaagaattattgcagaaggatacagacttgatggaagacagctcgatgaagtaaggcctttgtattgtgaagctggatatgtttccatgttacatggatctgcactattttcccgtggagagacacaggtcttatgtacagtaacacttggagcacctacagatgctcaacgcttggaatctgtagtcggtcctccaacaaagcgatttatgcttcactatagttttcctcccttctgcataaatgaagttggtaaacgtggtggtctgaacaggcgtgaagttggtcatggaactcttgctgagaaagctcttcttgctgttttgccccctgaagatgattttccatatactgttcgtgtcaactctgaagtcatggcttcagatggttcgacatcaatggcaactgtatgtggaggtagtatggctttgatggatgctggcattcctgtacgtgaacatgttgctggggtttctgtgggtcttgtcagtgagcttgatccatccactggcgaaatagcagattatcgtatcttgactgatattctgggcttggaagaccatctgggtgacatagacttcaagattgctggaactcgaaaaggagttacggctattcaattggatataaaaccagcagggattcctctggatatcgtatgtgaatgtttagaacctgcacacaaagctcgtcttcaaattcttgatcacatggaacaagaaatcaatgtacctcgtaacaagaatgacagtacttctccacgactagccaccttaaagtacaacaatgatgctcttcgtcgcctaattggaccaatgggtgctctaaagagaaaaatggaagaggaaacaggtgcacggatgtctgtaggtgatggaacacttacaatagttgctaagaatcaatctgtaatggacaaaatactagaaaagattgattttattgtgggccgtcaaattgaagttggaggcatctacacaggtattgtcaccactataaaagagtatggagcttttgtggagtttaatggtggccagcagggcctactccacatttctgagttgtcacatgaaccggtttcccaagtttcagaggttgtctctgttggccagaagctgtctttgatgtgcataggccaagatgttcatggtaacattaaattatcccttaaagcaacttcgcctcgtcctggaggattggagactaatgatgcagttgaagaatctgttgcatctgcaaaagaaacagccaacatttgggcaccagttgggaatgtgtctagtacacaagaacaaaattctgctcatgagttgtctttaggcaatcttgagttgggtaatgcaaaatcccaaacctcccaagttccggtaattttaatacgcagtgctgcagagtgcgatgaagaggagaaatcatccagcttgaatctgtcttcaaaaagtcctcatgtagataatggggtacaattggatcgcaagtcaaaatctcgatctcaaaatgcaaaatctcgtagatctcaagatgttgatgctccatcttctcattcaggtcccttgccttataagaagtcgaaaccttcaatgcagaaagagtcaaaatctgatattcaaaagccaaaaggggatgcgcaggaacctaaagataaggtaactgcagaagatctgaaactcggaactcaagtaactgccaaagtctctcaaattcgtgcacatgggttagtgttggacttgggtggaggacttcgaggaatgtaccggtttgaggtaggagtcatgtttgtatcctcttttctcatgatttcatgttga

SEQ ID NO: 81752 - DNA, 300 bp, Glycine max
  Peptide Sequence Number=SeqID_198530
atggtgggaaattgcgaaaaggttgctggtaggcctgagaaaaccattaagaatcattggaacaccaccaaggggtgtgatgagcttgctatgatcactgctcactctatgtgttcaatggaagtagcaacagctatgcgccaatgcaagacaatggactctagaaggagacagtgctcttttgaattggtgaaccaattcgggctaaagaaatggtcccaaattgcaaagttactgtccagcaggactgtgggaagcagtgtcgtgaaagatggcacaatcatctcaagccaaatatga

SEQ ID NO: 81753 - DNA, 817 bp, Glycine max
  Peptide Sequence Number=SeqID_198531
atgggtcgccattcctgttgtttaaagcaaaaactaaggaaaggcttatggtcccccgaagaagatgagaagcttttcaactacataaccagatttggcgttggctgctggagctccgttcccaaacaagccggactccaaaggtgtggaaagagttgcagattgagatggataaactatttgaggcctgatttgaagagaggaatgttctctcaacaagaggaggatcttataattagtcttcatgaagttctaggaaataggtgggctcaaattgcagctcaattaccagggagaacagataatgagattaagaacttttggaattcatgtttgaagaagaagctaatgaagcaagggattgaccctgcaacacacaagcctctcctcagtgctcaagaacacataattataaaggaagagaaggaaaccattttggagacaccaccacctatgttattaccaatgtctcaagggattttagcttcctcacaagagtcaccacttgtagtgaacaattcaagttactgtgatggtggattaaatgtaacagaagctgcttcaagggaagttttcatgagcaagaatgctgctttagaccctttgtcctactttgaattccaaatgggttacaacccaataagacaatttgatcagaaccatgtggggaccaactcaagctatggattctcctcattgccgtgtctgaatagttcttctgatcacgggaacgtgtcggtggcggcggagttttcagataacaactcagcttcaaaaatcagttctttgatgaaggaaagttccagcaatagctcaa

SEQ ID NO: 81754 - DNA, 237 bp, Glycine max
  Peptide Sequence Number=SeqID_198532
atgacattaatgatcccacaacttttcctcaagcctatgcaggtgttgtgggatgcaattgtgtttggggtgtacaatgataatgtccctttgtacataaagcatgaagatcttggggaaataacacatggtggtcgatgtttgaacgtcgttattatacaattatggattatgcatatgaatgagttaagtatgcgatcagggaatgtctctatgtatggattccttgagccatag

SEQ ID NO: 81755 - DNA, 666 bp, Glycine max
  Peptide Sequence Number=SeqID_198533
atgtctttttcaggagatgagggtgatgaccaacgcattcatccctccatgagtagggtcaaagcgccattggatgctgatgttgacccgtccttttcgtcattagcgactggtcatttggaagcttctatagaaccgagggcttatgcgggtgacccttatgtcattattcacgactcttccaccgaaattatcattgtagcgagctgtgaagagggtgggggtatccgacatagaagaagaaaaagagaggtgcctaatggaggaaccgtggatgagagcgataccttagtgggtgaggaggatgttggtaatagggttgaaagggaagttctcgctaaccccgagtatgattgggtggatgagaaggcccttgcaacctataaagatcattgtagaagaacgtttcatggagacctagaaaagaaactgatcgccaagcttgatatgttgcactcttctaatatcctttgtagtgcccttctaaaggttcgcaatgatgattctggtaactctattatgatcaccgaggaccatctttgtcatggttacaaacaaggggtaaagttgcatgctaatgcatcaagtaaacaactcgcagaagaatcacccaatctgccttctggtggtgcttctaaccctatcttcatggcgcctggtcattga

SEQ ID NO: 81756 - DNA, 354 bp, Glycine max
  Peptide Sequence Number=SeqID_198534
atgttggtccttttagtgaggatgatgaagaagtcatatgaaaccctgatgacaatgaagacgaaaatgacgaggacaacaatagggtgcaacctattgattaaccatcaccaatacaacttgcctacaatatcccaacacacatgtctctacatgttaaagcatcaacaggggcacaaactaaaaaacaatgggagatcaaattacttaagaaggacattgttaacacgggctatgccaaagtctgcttattactacaataatctccaagttgaacatccagaagcggcaaactggcttggtgaaatccctaaagataaatggacaattgcattttcctcaaggcaatgttag

SEQ ID NO: 81757 - DNA, 1278 bp, Glycine max
  Peptide Sequence Number=SeqID_198535
cctttcttggagaaaattgaccaggaagtgattttgcccatgctaaaggtattagccaccgatgtctttgatggcactcaagaccttcaagaacattttcagacattcagaactcagttttcctctagtaaaagtaaacgacgcaaggtggctggcttgcttgatgttaagcaacaaaaggaaggcctattggtcgcgacatttttttactctttggtgttgagaagaccatggaatatagaggagatatgtgccagagtcgagaagcacatagaaatggaggaagatgcagtcgtgcccaaaatattgcctaagaacgaggagactgccttcaccctaaagccaaaccttggtggggtgcggatggagaacataggagaaactgggtcaatcctcaatttcactcaactcaaagcacaaagaggtggccttccaaaagcctatgatcctttgaatgagggtacacatcaaacatctctcatggtgatgacaattgacaaagagtgcattacagatacatccccaataataactttcacgacaaaggatgcagagagtattgagcctcatgatgatgacccgatggatgggaatgccaaaagaaaagctacaatcatattcagggtcgctgacacttgccctccgatatatggttgtagacgcaataacttcatacaacatgatcatgggaagactgaatttaaatcacttatggcaatggtttctacaccatgcctatgtatgaagtatcctatggatcaataccgaattggtggggaagttccttggattcatatcgacaaagagggaattgatgctaatcccaataaatgcaatgctatcatggaaatgagaagtccaaagacgattgagaaggcgttgtcaggagccgagttaaggtatcagaagataaagaaggcagtgttggccatagtgggtaggcattattttggaaggatcaatgggcttatgttagaagaatccttaacgtttgacttcaaagccaacaacaatcaagcaaagtatgaggcactattggttggaatgagacttggattggatgtgggagccaaaaacctgagggccaaaagtgactccaccatactagctagaataaagaaaccagggaacaacaagttggtcatccaagaaaccattagttgccccaacatcgatgacttgaaggtgtgtatgatcatagaggaaaaatcatggacgacttctataaaagcttatgtggaagaaaatttctttccagaagagcctgatgaagcttaa

SEQ ID NO: 81758 - DNA, 543 bp, Glycine max
  Peptide Sequence Number=SeqID_198536
atggagaggagtatgattgatgctgtcagtggtggagctcttggtgatatgactcctgttgaggctaggaatctgattgagaagatggcttccaactcccaacaattcagtgcaagaaatgatgttattgtccttagaggagtccatgatgtggccacggattcatcttcatctgctgaaaataagaagcttgagggaaaacttgatgccttggtcaacctagtaactcagcttgccataaatcagaaatctgcatctgcacctattattgttgcaagagtctgtggtctatgttattctgctgatcaccatacagatctttgtccttctttgcaacaatctagagtcaatgaacaacctgaagcctatgctgcaaacttttataatagaccccctcaacagcaaaaccaacaacaacagaataattatgatctttcaagcaacagatacaatccaggttggaggaatcatccaaatctgagatgggcaaatcctccacaacaacaacagcagcaacaacagcctgtccctcccttccagaat

SEQ ID NO: 81759 - DNA, 131 bp, Glycine max
  Peptide Sequence Number=SeqID_198537
tttctcatgaggaggaatacttgtacttgagggcatgtcactcggtttggaactcccttgagactcaggctgattctcatggaggggagttgccagtgcataactgggtgacctcgacacttactgcctag

SEQ ID NO: 81760 - DNA, 303 bp, Glycine max
  Peptide Sequence Number=SeqID_198538
atgagcaaagaaacaaatgaagaggaagcaattcatagtgtgagttttgacttagagggatcaagttccgccacaagaaaaaacattcacccaagtaagagtggagagaaagaagggatgatttcctcaatgaaagaagtaaccgagtcattgaaagaatttgttgaaatgactaagaagaagatgaagaacaaaaaaatggagataaaagaagctcaagaagtggtacatgaagtggtgagtgagctagataatatacctaattttaatggtgcacttcgacatagagcaatcgattgttga

SEQ ID NO: 81761 - DNA, 201 bp, Glycine max
  Peptide Sequence Number=SeqID_198539
atgccggaagtcgaaagggagcattgtcgcgcaatccgtaaagttccgcaacattccagagtaaaaaagggtgtgcaaatagcaaccagacccacttgggccttccagggtgttccaacagaagtcggtgccttttggtggaaacaatccagctcgcctaggcgagctgggcggcaaccacctccctcttttcccctataa

SEQ ID NO: 81762 - DNA, 518 bp, Glycine max
  Peptide Sequence Number=SeqID_198540
ggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacggggcccttcggggccttcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 81763 - DNA, 210 bp, Glycine max
  Peptide Sequence Number=SeqID_198541
atggtgcagttatggtttgggaatagggtgaaacacttgcctgtgtggaaaaaaaccggtggaccattcggtcctgccaactaccttcaattcggagcctctatgaaattgatttgtcgttccgatgcatcctcccccaacgagtttggagccatgcgtagtgattgcctagtgcaattctccattctcgccttttatggagccccatga

SEQ ID NO: 81764 - DNA, 824 bp, Glycine max
  Peptide Sequence Number=SeqID_198542
atcctctaacggggcttggtagagtggcggtaactgcagccacaattaatgaattctacaattgggcaatgtttgtgctgctgattccttttgccactcatagtgaaaaaccctgtgtcagtgatgttgactatgatctttgtcattttttgctactatgtgttgcgcccttcacttacccggttgatagagaaataacggacaagaatgagtgggacaactacaagttatcctatgtgttcataggcattatgttttgtgcacatattactgaaatgttaggcactcactccattgttggggcattggtgtttggtttgattcttcctagggaaaaatttgtggacatgttgatggaaaggtcagatgatcttgtctctacgtatctggaacccttgttgttcattggctgtggtgtaagattcgacttcacaactttcaaaaaaagaaagttgcgtgatgccatgataatcacgctcttgtcatgctgcacaaagattgtaagcactgtgatagccactggcttctatcgtatgccttttcgagatggcgtggcacttggagagcttttgaacaccaaaggcctcttgccattagtaatgctaaacatattgcaagtgacagactgttttcattatatgcgtattgatgattgctttcgcaaacttgacatctccgtcaccgtcaggaggttctcgagtatggtatcctttcccgtctctgctatggagtttcaagttctggcttccgagcatgtttttcggaagagccccttcaaggagcatgaaattgacatcggtaacgacaacccaacagcgtcgtaa

SEQ ID NO: 81765 - DNA, 525 bp, Glycine max
  Peptide Sequence Number=SeqID_198543
atgatcctgagttcaaccttagcaaagacgtttttgactcaacttcaactagagcattttcattgtcaaagttacaatgaagaaaatgaagaaggcagaagaagcatcaaattaacaaattccaaaaaagaagaaaaggaggaagaagaagaaaaaaaatgtggatgtggatactcgcacgagcaacacgagttgttgtcgttgtcgttgcaacaactattcaccaacgcatttgtgaccctatctttctcaaaatccccaaatcaacttttttcccaaattttcaatagccctcgatttttggacacagattccacctccaacctcgacaatgagtgctcactagattctttagtgaatgattgcgacaaacaactcgcaaaagaaggagacacatatgcagagggaggagacacattcgtagaagaagaagaaggagacacgtacgaggttgattttgacaagttggagtgtgctacgttttctccaaaccaggtgctgcattggccaccgaccagggagtaa

SEQ ID NO: 81766 - DNA, 900 bp, Glycine max
  Peptide Sequence Number=SeqID_198544
atggctctttccctcatcaatagttctttatgggtagtgctagcttatgatactgttgcattgtgttttagggccaaagtaatttctaggaatacggactctgatagttcttctgatagtgaagctgatgatgttaaagcaagaccagcaaatgcagcaaaggcaccagaaaatctgggttctgaagctcagttggatgaaatgaccatggctgctgctagtcttgaaagaaatcaatctgttagtggcttagatcaacttgatgataactctcagcataagccaagttcttttgattctgattgccaacaagatggggacagtgctgcaactgagagacagttctcccctgataaactttatcgagctgctgtattgaagaaacgatttcttgataccatcttgaaagctcgagaaaagacactgacacagggtgaaaagggggatcctgagaaattgcgccaggaaagggagaaactggagatggagcaaaagaaagaaaaggctaggctacaagcagaagcaaaggcagctgaagatgctcgaaagcaggcagaggaagaagctgctgcagaagccagacgaaaaagggagcttgagagagaagctgcacggcaagcattgctccagatggaaaagactgttgaaatcaatgagaattctcgaattcttgaagatttggaactgcttagagctgtacccactgagcaattgccaagttctgtagatgagacgagtcctgcacactctcaggatggtctgggtagtttcaagtttgggagtagtaaccccttggaacaactaggattatatatcaaagccgatgatgaagaggaggaaggagagccaccctgtattccaaatcctgtaaatgatgtagaagagggtgaaattgattaa

SEQ ID NO: 81767 - DNA, 1417 bp, Glycine max
  Peptide Sequence Number=SeqID_198545
atggcaaagagtaggctgtctgggggctattttggaaatgcactagatactgctggtgaatctgagggttctggtagctcgggaagaatagatactgaaattacggtttcggaggattcgagtatccccgcgaggaaatgtattagtttgaattcgagtcgccacgatgtgtttggtgctcccgtgcaagttgttcccttgtcgaatatgccactctctcatagaaaagatctggggcaaaggttgaggtccgagcttgagcagattcggctgcttcagaagaaaattgaacagcagaggacgactgctgttgtgttgtcctcctccagtgatattcttagctgtagtaatgggaataatgggcatcgagtggaaagggataaaaagccggcgatgtccagttctgcaccaaggaataaagcgaagccgggtaataagaatcagaagcctcgtggatggaaccggggttcttctgggaagtttgagtctgcggtccagtctgcttcaccatccactgcgaatgctatgttgatgaaagattgtgagttgctgttgaaacggttgatgaatcaccagtatgcttgggttttcaacacccctgtggatgtggtgaagttgaatcttccagattatttcactattattaagcgtcccatggatttgggaacagtaaaaaacaagttggcttctggagaatatgctggcccactggaatttgctgatgatgtgaagcttacattttcaaacgcaatggactacaatccatctgggaatgatgtccatctcatggctgataccctcaataaatattttgagttgagatggaaagcaattgagaagaaattgcaaaaaagtgattttctgccattacctgcaaaccctgacaatagtgaaggtgtaaaaactaaaagacaagcacctctttcaaaaaagaggaaaattgcctcattaccccctcaacctgaagttatgccacctacaaagaaggttatgtcggatcaagagaagcatgatctaggtcgagaattggaatctcagctgggagaaatgcctatgcatataattgatttcttaaaagaacatagttcaaatggtagagaatgtggtgatgacgagattgagattgatattgatgatctcagtgatgataccctattcacattacgcaagcttttggacgactttttgcaaaaaaagcaaaagaacaaagcaaaagttgaagcgtgtgaagtagaggtgttgaatgattctggaccaagcaattcctcattgcaaccatttaaaggtaatgatccagcggatgaagaggtggacattggtggaaatgagccccctgtgtcaagctatcctcatgtggagattgaaaaggatacaacttatggaatgaacaaaagcctaagcccaggcagctcaaatg

SEQ ID NO: 81768 - DNA, 4656 bp, Glycine max
  Peptide Sequence Number=SeqID_198546
atgggttcagcttctcttctaaatccttctcaaccaggcgttaagaagaatgacaagagcaaacagaaatcggtcgtttccaaaactgaagaggaagttatgtttaaagataaacaaaagaaacggagtttgtcggagagcagtgagcagactgctgctatgcgcaaaatgccaaaacgtgctgcggcatgtaaaaatttgaaggagaaatcctttttgatatatgagaagtcctgcctcattgaaacagagaaggatcatattgtagaagaagaaagtctggctgtccgcatgacagctggacaggataatggttgtccaaataggcgcattacagagtttatccttcatgatgaaactggtaaatcccagccacttgaggtgctggaggttgatgatttgtttatcactggacttgtattgccacttgaagccagctctggcaagaaaaaagagaaaggtgttaagtgtgaaggctttggtcgaattgaatcatgggatatatctggttatgaagatggctctccagtgatatggctttctactgaagttgctgattatgattgccagaaacctgctgctagttacaaaaaagtttacgatcttttccttgaaaaggcccgtgcatgtgtagaagtatacaagaaacttgcaaagtcctctggtggtgaccctgatataagtcttgatgagttacttgctggcatggtgcggtctatgagtggtagcaaatgcttttctggagctgcatctataaaggattttgttatttcacagggtgagttcatttataagcaacttgttggtttggatatgacatccaaggcaaatgacaggatgtttgcagatattcctgctcttattgctcttagagatgagagtaagaaacaagtacatgcacaggtaatgccctcaaatgggagtttaaggattgattcaggagttggagatgaagaaaacaagaatcagatggattcagtagcttctgtaaacgaggaagatgaggatgcaaagctggcacggctgttgcaggaagaagagtattggcaatctatgaaccagaagaaaaactccagatcagcctctgcatcgaacaaatactatatcaaaattaatgaagatgagattgccaatgattatcctctacctgtttattataaaacctcccttcaagaaacagatgagtttatagtttttgataatgactatgacatatatgacactcaagatctccctcgaagcatgctgcataattggtctttatacaactcagatgcaagattggtttccttggaacttctgcctatgaaaccttgttcagatatcgatgttgcaatctttggatcaggtataatgacttcagatgatggaagtgggtttcatcttgatactgaggctggcaaatcttcttccgttggttctggagcacaggttgctgatggaatgccaatttatctgagtgccataaaggaatggatgattgaatttggatcatctatgattttcatatccatccgaactgatttggcctggtatagacttggcaaaccagcaaagcagtatgctccttggtatgacacagtattgaaaactgcaaggcttgctataagcattatcaccttgctgaaggagcagagccgagtatcacgactttcctttggagatgtcatcaggaaagtatctgagtttgataagaaagacggttcttacatttcttctgatccattgactgttgagagatatgttgttgtccatggacagataattctgcaactgtttgcagaatttcctgatgataagatcagaaagtctgcatttgtgacgggtcttacaaacaaaatggaagagcgccaccataccaaatggttggtgaagaagaagaaagttgtgccaaggagtgaaccaaatttaaatcctagagcagcagtgggtcctgttgtatccaagaggaaagctatgcaagctacaacgacaaggctgatcaatagaatatggggagagtattactcaaaccacttgccagaggatgcaaaagagggaattgctagtgagttaaaggatgaggatgaagtggaggaacaagaagaaaatgaagatgatgacaatgaggagacaatacttttggagggaaccccaaaggcacattcagcttcaaagcaaaccaaaaaattttctgctgaaacagaaataaggtgggaaggggaacctgaagggaagactagttctggatatcctgtttataaacaggcaattattcgtggggaagttatttctgtaggaagatctgtgttggtggaggttgatgaaacagatgaatttccagacatatattatgttgaatatatgtttgaatcaaagatcggaagaaaaatgttccatggtaggatgatgcagcgtggttgtcagactgttcttggcaatgctgctaatgagagagaggtgtttttgactaatgagtgcagggatttgggactgcatgatgtcaatcagacagttgttgtaaatattcaaaataggccttggggacatcagcatcgaaaggataatatcattgcagatagagttgacagggctcaagcagaagaaaggaagaagaaaggactacctactgaatattactgtaaaagcctgtactggcctgaaagaggtgctttctttagccttccacttgatactttggggctagggtctggtgtttgcccatcttgcaaaatacaggatgctgaaaaggagaaggatgttttcaaagtaaattcctccaagtctggtttcctattgaaaggaactgagtattctcttaatgattatatttatgtaagtcccttcgaatttgaggaaatgatagagcaaggaactcataagagtgggaggaatgtggggttgaaagcttatgttgtgtgccaagtgcttgagattgttgtcaaaaaggaaattaaagaagctgaaataaagtctacacaagtcaaaatcaggaggttcttccgaccagaagatgtatcaaatgagaaggcatactgttctgatatacaagaggtgtattacagtgatgaaacacatataatctctgtagaatccatagaagggaaatgtcaagtcagaaaaaagaatgatattcccgaatgcagtgcccttggcagaatgttccaaaatgtttttttctgcgagctcttgtatgatcctgccactgggtcactgaagaagttgccggctcatgtaaaagtaaaatattcaagtggacaaacatctgatgctgcagctagaaagaggaaaggaaaatgtatagagggagatgatgttttagagtccccaaatgaaggaaaaacattaaatgaaaaacgtttagcaaccttggacatttttgcaggttgtggtggcttatcagaggggttgcagcagtcaggagtttcatcaactaaatgggctattgagtatgaagaacctgctggggatgcatttaaagctaatcatcctgaggcattggtgtttattaacaattgcaatgttattcttagggctgtaatggagaagtgtggggacacagatgattgtatctcaacatccgaagctgcagaattggctgcaaagcttgatgagaaggaaataagtagtttaccaatgcctggacaagttgatttcatcaatggtggtcctccatgtcagggtttctctgggatgaataggtttaaccagagcagttggagtaaagtccagtgtgagatgatattggcattcttatcctttgccgattatttccggccaaggtatttcttgttggagaatgtgaggaactttgtgtctttcaataaagggcagacattccgtttaactttggcttcacttcttgagatgggctatcaggtgaggtttggtatccttgaggctggagcatatggggtttcccagtcaagaaaaagggcattcatatgggcagcctctcctgaggatgtgcttcctgaatggcctgaaccaatgcatgtcttttcggcccctgagttgaagattacattatcagaaaatgtccagtatgctgctgtccgcagtactgcaaatggtgctccattacgttcaataactgttcaagatactattggtgatctcccagctgttggcaatggagcctcaaaaggaaacatggagtatcaaaatgatccagtctcatggtttcaaaagaagattcgaggtgatatggttgtcttgactgatcatatatcaaaggagatgaatgaattgaacttgattcgatgccagaaaattcccaagagaccaggcgctgattggcgtgaccttccagaagaaaagataaaattgtctactggacaagttgttgatttgataccatggtgcttgccaaacacggctaagcggcacaatcagtggaagggactgtttggcaggttggattggcaagggaatttcccaacttccattactgaccctcagccaatggggaaggttggaatgtgcttccaccctgaccaagataggattcttactgttcgtgaatgtgctcggtctcaaggcttcccagatagctatcaatttgctggcaatatcatacacaagcaccggcagattggtaatgctgtgcctcctcctctggcatctgcattggggagaaagctcaaggaagcagtggacagtaagagctccacttag

SEQ ID NO: 81769 - DNA, 858 bp, Glycine max
  Peptide Sequence Number=SeqID_198547
atggctggaggtgttattcagcagatattgaggaggaaactacaccctcggtttactaactctcccttgttgtcacccatcgtagccaagaaagatgatgctggctcttctggcagtcagtccttaagagcacttgcattaattggagctggtttatcaggccttttcagtttttcaacaatggcagcagctgatgaagctgagcatggcctggcatgtccaagctatccgtggcctcacaaaggaattcttagttcatatgatcatgcttcgattcgtcgtggtcatcaagtttatacagaagtctgtgcttcctgccattctatgtctttgatatcgtatcgtgatttggttggtgttgcttatacagaagaagaggtaaaggctatggcagctgagattgaggtggttgatggccctaacgatgagggtgagatgtttacacgccctggtaaactcagcgatcgttttcctcagccatatgcaaatgaagcagctgctaggtttgctaatggaggagcttatcctccagatctaagtcttattaccaaagcccgtcacaatggtcagaactatgtttttgcccttctaactggttatcgtgacccacctgctggtgtttcaataagagagggacttcattataatccttactttcctggtagagcaattgccatgcctaaaatgcttaatgatggtgctgtggaatatgaagatggtacccctgctacagaagctcagatgggatttaaatggatatttgtactgtcactggcactacttcaggctgcctattaccgccgcttgaggtggtcagttctaaagtctcgcaagctggttcttgatgttgtcaactag

SEQ ID NO: 81770 - DNA, 168 bp, Glycine max
  Peptide Sequence Number=SeqID_198548
atgtcttccctgagtcggcaatcccacacgcgatttcgctgcttccctcagtcacatgacacacttcccttatcaccctctaagtgtgacggtgaccaagatgttttagaatacttattccaaaacatatttcgaagtaaccattctgagatggaatactcattctaa

SEQ ID NO: 81771 - DNA, 951 bp, Glycine max
  Peptide Sequence Number=SeqID_198549
atgattattcttagatttcagttttgtcatgaacacaggaaaaagaaaaaagttggcatgacagggattgaacttctaaagagacatgcaaatgaaccttctaattctttacattttgtgggttctgagaaccaatggaccactagctggtgggagcaattcatggttcttcttaagaggggtttaacggaaaggaggcatgaatcttatttgggcttaaggattttccaagtcttgtctgtctcaattctctcaggacttctatggtggcattctgatccctcacatatacacgatcaggtaggcctgctattcttcttctccatcttctgggggttctaccctctcttcaatgccgtcttcgcttttccattggaacgaccaatgctgatgaaagaaagatcatcaggcatgtaccatctctcctcctactatgtagccaggatggtaggggacttaccaatggaatttgtgcttcccaccatctttgtagccatctcttattggatgggtggactcaagccatcgttggttacatttgtgttaaccctcttgatcatgcttttcaatgtgctggtctctcaaggaataggccttgcacttggtgccattctaatggatgtgaaacaggccacaaccttagcttcagtgactatgttggtgtttcttttggctggaggttactacattcggcatattccattctttatagcttggttgaagtacatttctttcagtcactattgttataagcttcttgtaggagtgcagtactcagtaaatgaggtctatcagtgtagacagggattgcattgtaggataagagatttccttgccattaagtgtctaaggcttgatagtttgtggggagatgtggctgttttggctgtaatgttgattggatacagagttgtggcttatttagctttgaggatggggctgcatcattga

SEQ ID NO: 81772 - DNA, 1503 bp, Glycine max
  Peptide Sequence Number=SeqID_198550
atggctctcatattccaagccaataaccccaaaaaaccaatggcatcgctaacagcggggtttcaccgccacaacaaccaccgcagccattcttcttctgcgtccaaaatcataatcttcttctgcctctctgcctttctcggcctcgccatcatcgccaacctcttccgcgcctccctctccactcactatctctccatcgccaccaactgggtcgacaccaacgcacccgtcctcatcctgaaactcgccgccactcctcacaacagcaacaacaagcttaatccaaaagttagcttacaggttgaggattgtttcgtgttaccactcaatataggatttccagtgttaatgagtgtaaagtttgagcatttacggggaaaagatgggaagattgcacaaaggatgggtccccagagattcctttcggctacatttgcggacttgcctgctccagaatggcaatgggagcagatgccgtcggctccagtgcctcggctagatgggtactctatacagattaagaataccttttatgtgtttgcaggatatgcccatcttgaccatgtgcactcgcatattgatgtgttcgatttcagcatcaacaaatgggtagatcagattaaaatgccaaatgaaatggctcattcacatttgggcatagcatctgatggcagacactgcaacaaagaaatggaaacctttgccaccattgccagcccccagacaaatgcagttgatgcgaccatagttgtggtcgtaatgtggtatgctcctgcaactcaattatggaaaggaagactccatgtcatgggtggtagcaaggagaatcgccatacacctggaagagatcattggagtttggctgtgaaggatggtgaaacattggagcaacaatggcgggacgaagttcccattccacgtggtggaccacatagggcttgcattgcagtcaatgatcgactttttgttattggtggacaagaaggtgattttatggccaaacctggttcgcctatattcaagtgttcacgcagacatgaagtggtctatggagatgtttatatgctggatgatgaaatgaaatggaaaattttgccacctatgccaaaaccagattctcacatagagtgtgcatgggttattgtcaacaattcaataatcatcactggaggtaccacagaaaagcacccagtgacaaaaaggatgatgctgaaatggtcagtgatcggaaagcttccttaccgcataaaaaccacattaactggtttttgggatggatggctatactttacatcaggacaaagggacagagggccagataacccacaaccaaaaaagggcaaagttggagtggagcgtaaggattacttatcgatgagttacaaagcgagttggggtgtggggacaaaaccttacggaatgcgtaatatttcattgatcctagaagcaagcacaattgattttgagttctcgaaaagggctacctacggagggttctga

SEQ ID NO: 81773 - DNA, 201 bp, Glycine max
  Peptide Sequence Number=SeqID_198551
atgattaaagatggctcaaagacagggcagggtcgacggggatatttagaggaaggtgcatgggatgctatacatgttatagagatgagtatgaagctatcagttgctgatggtcatctttgtaacatgggaaggatgattgaagaaatggagagtaagctgaggaactcactagatcaggttatcgtgagcaaggaataa

SEQ ID NO: 81774 - DNA, 327 bp, Glycine max
  Peptide Sequence Number=SeqID_198552
atggcacgtgcagatcgcttgctattttcagccaagataatgtacaagttagggatatcatcatcaaagatcaacttgttgcttcccatcctcaaggaatttgctaagattacaagggaaggatctttggcacttgtagcacttccatttgatggcatacttggacttggattccaggatacttcagttggaaaagtcacaccagttgtgcttgaagcatggtttaaagaaagatcaaatatgctaacggaatgctcgaaatgcaagttgtctgaagaatttgaggctaatggctacaaggttagagcaaagaggaaggctcggtag

SEQ ID NO: 81775 - DNA, 396 bp, Glycine max
  Peptide Sequence Number=SeqID_198553
atgagcttgatgaagctgttaaggggaggagtgagattgaggaggtcaagtgttgtcggagacggtggtggtcatggagaggttcagcttgaaggtgatgctgggcgccgtggagaggaaggaaacctaagaggctttcaatgctatgttgcccaacgtcctcgtcatccaggtaaaagatacagatacaagaggagtttcgggagccccattgtccacattttccaagttattgctgcatcaataaagaaaagaaagatgcaactcccatacaatgttggttctttgtatgaggacactcccgaggcttcaagaatagagcacaccgaacagttccgtttcttggagaaagcagccattgtggctattttattccctagaaagcagggctactaa

SEQ ID NO: 81776 - DNA, 699 bp, Glycine max
  Peptide Sequence Number=SeqID_198554
atggcaatgttggatccctcagggagcggcaagaccaccttactcaccgccctcgccggccgtcttgacggaaaactctccagcgccatcacgtacaacggccaccctttctccagctccatgaagaggaacatagggtttgtgtcccaagatgacgtgttatatcctcacctcactgtgcttgagagtctaacctatgctgtcatgttgaaacttcccaagagtttgactagagaagagaaaatggaacaagttgaaatgatcattgtggacctagggctgtcccggtgccggaacagccctgttggtggtggagccgccttgtttcaggggatttcgggtggggagcgaaagcgggtcagcatcgggcaagagatgttggtgaaccccagtttattgttgctggatgaaccaacatatgggttggattccaccatggcccaacgcatcatggcgatgctccaaagcctcgcccgagcttaccggaccgtggtgactaccattgaccagccctcaagccggttgtattggatgtttgataaggtggtgatgttgtcggatgggtacccgatttttaccgggcaaacggatcaagtcatggattatcttgagtccgttgggtttgtacccgttttcaatttcgtgaaccccactgattttctgcttgaccttgctaatgtgacatgggaggaagtttag

SEQ ID NO: 81777 - DNA, 426 bp, Glycine max
  Peptide Sequence Number=SeqID_198555
atgggtgaagcagaggaggtgcaagagaagatgaaggccgacatggaggccatgaaagagcaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatgcacgccttcccgccatatggcttgcctctcaactatacaccacccaatgtggtgtacattcccaatgaggatgtcaataactccactcccatactcattaagagccaacaacctcaatctgatcatgcacatgtctctcgacccatggaggagacacatgaaattccccaccacgatctagcccatttccgagccttgcctcggatatgctgctga

SEQ ID NO: 81778 - DNA, 958 bp, Glycine max
  Peptide Sequence Number=SeqID_198556
gcgtaatctacacaaaggccttgccaatctccaagatggaagtatagatgtagctgtggtgaaggagttttatgctaatttatacaccacagaggagcaagcacccaagcaagccaaagtacgaggacacttgatcaaaatagatgcagacagcctgaatgagttccttcaaacgccagtgggccagccatggaagcttcttagaaaagatttgatgacactggcccagacatggagtgtcttcttttactccaacctagctcccacatcccacacctcagatctaaatatggatagagctaggttggtctatggcttggtgactaagatggatatgaacatcggagcccttatctcaggtcagatttcttttattgctcagagtaactccactaggctcagatttccagccttgatcactgccttatgcagagttagaggagttacctctgacagtctgacctatgagaacctgagcccgaccattaacttggcctacattaagaaaaactgttggaatgtggatgatctaacagttaacttcagaggggtgaggaaggcaagggtaagaccagctgatgttccttcttctactactctaccagctccttccacttctgctactcctacaccagctcctccaagctcatctactcaggactctcagtggtccattctattggtagagcagttcattgagaaggtatcctggcctagaaccttgtcttctgttatgagagaaggtgagggtcccagtgctcagggcataggtaagacaggatgctgctactccagggagatctccatagatttcaccaaatccaccctctctagtggtggatcaatcttctcttcaacagtagcagatcctcctacactagtgcttgatcttccagtagacccacctacaccattacttgagattctagaggagggcactcaggaccaggagacctag

SEQ ID NO: 81779 - DNA, 1254 bp, Glycine max
  Peptide Sequence Number=SeqID_198557
atgaaaccgttcctacgttcaatattcctattattccttatccttctcgaccaatccatttcggcgagtgctttttttaatggattgctaaacattgaaaagtggccctttagcgagaaaagtttgaagtggggaaaggtagggaaggagacgatagatagtatcaatgactatttaaaaaaagagcttgagtcccctcccgcactaccgaagcaaatcaatattgaagttgaaggcctgtctgtcgtcaagtattacttatctgactacggctacattgaatcctctgggccatttaacaatattttcgaccaggaaacaatgtcagccattaagacctaccaggaattttccaatcttccagttaccggcgttccgaacaaacagcttaagcagcaaatgttgtccctacgatgcggtgtccccgacgttaacatcgactacaacttcaccgacgacaacacttcctatcccaaagccggacaccgctggttcccaaacagaaacctcacatacggttttcttcccaaaaaccaaatcccagacaacatgactaaggtgttcagagattcctttgcccggtgggcccaagcctcgggaactttgagtctcacggagacaacctacgacaacgccgacatccaggtagggttctacaacttcactgccttgagcattgaagtgcaggtgtatggtggcagccttatatttttgcaaccggattctagtaagaaaggggtggtacttatggacggtaacatgggctggttacttccaagtgaaaacgcctcactgtctaaagatgatagagttttggacttggagactgtggcgatgcaccagatagggcatctacttggacttgatcactctcccaaagaggactctgttatgtatccttacatattgtcatcacagtcacagcaacgaaaggtgcagctttccgattctgacaaggccaacattcaccttcagtttgctaactctgcaagccacgcggtgctgcgaaagaagaaaaaactccggcgggtgcccactggttgtctgcggtggagagaaggagtgttgtgcggaagaaaagaagaggggcaaacaaggaaagactggaagaaaggaataaaagaaaaaatacgaaaactaaaccaagtgtcaagggaaacgaaaagcataatagcaggagtcaagttcaaaaattatacaaagtttcacaaagaagatccatatatgtttcaaatgctagattccttcgaatag

SEQ ID NO: 81780 - DNA, 219 bp, Glycine max
  Peptide Sequence Number=SeqID_198558
atggcgagtttggtgtcactgagcaagtcgcttatggcactggcgatatccatagggaaccgccagtcaaactggcgagttccatggtctgacgctgcagctacgccttttccagttgcaaggttgcaggaggtgacagaggttgcaggagctttaaaggggagttgcaactgccattggcgagttgcctggaagttgcaactcccattggcgatttag

SEQ ID NO: 81781 - DNA, 315 bp, Glycine max
  Peptide Sequence Number=SeqID_198559
atgtcttgtaagagtttcaccaacttcagagaacacagcaaccatgatatctgccatggccctttaattaagccccccattcatcctatggtcattgaaaagcttgacacagtgaacaccataattgtgtcgtacttgatcatttacctcaccaacaaccaaggcctctcacaagctaagatatatagctccggagcagcttccggtgaagtacggtggactaagcaaagatggggagctcgaaaataccgatgctgtcacagaaatcatagtgaggccggcagcaaaacatacagtggaattttcagttactga

SEQ ID NO: 81782 - DNA, 333 bp, Glycine max
  Peptide Sequence Number=SeqID_198560
atgggggactggttttgggttgctggctgcggtttagggcttggagtcatttggcaacttgctctcgttcttggggagtggcgacaacttgtagataatagttcatatgcatgcactggcatgggggactggttctgggttgctggctgcggtttagggcttggagtcatttggcaacttgctctcgttcttggggagtggcgacaacttgtagataatagttcatatgcatgcactggcatgggggactggttctgggttgctggctgcggtttagggcttggagtcatttggcacttgctctcgttcttggggagtggcgacaacttgtaa

SEQ ID NO: 81783 - DNA, 1317 bp, Glycine max
  Peptide Sequence Number=SeqID_198561
atgaaaccgtacctacgtgcaatattcctagtattccttatccttctcgaccaatcatccatttcggcgagtgcttcttttaattttaatggattgcgaaacattgcaaagttgccctctgtcgagaaacttttgaagttgggagagccagcgaaaaagacgacagatattgccaatgaaattttaaagaaactgtttgagtattataaggacgatttaccactaaagtcccctcccccaccgccaatgtaccgtttacaaccaaagtccgatctcccagcgccaaacgcaccaccgaagcaaatcaatattacaggcctgtacatcgtcaaagattacttatctgactacggctacattgaatcctctgggccatttaacgattctttcgatcaggaaataatatcagccattaagacctaccagaatttttccaatcttcaagttaccggcggcctgaacaaagagcttattcagcaaatgttgtccatacgatgcggtgtccccgacgttaacttcgactacaacttcaccgacgacaacatttcctatcccaaagccggacaccgctggttcccaaacagaaacctcacatacggttttcttcccgaaaaccaaatcccagacaacatgactaaggtgttcagagattccttcgcgaggtgggcccaagcctcggggactttgagtctcacggagacaacctacgacatcgccgacatccaggtagggttctacaacttcactgccttgggcattgaagtggaggtgtatggtggcagccttatatttttgcaaccggattctagtaagaaaggggtggtacttatggacggtaacatcggctggttacttccaagtgaaaacgccacactgtctaaagatgatagagttttggacttggagactgtggcgatgcaccagatagggcatctacttggacttgaacactctcccaaagaggactctgttatgtatccttacattttgtcatcacagcaacgaaaggtgaagctttccaattctgacaaggccaacattcaccttgagtttgcgaagcatgactcggatctgacttctccaaactcgcatgactctgcaagccacgctataaactcggttttgtgtaagttcatttactttcttgaggagtctaaggtaggaaagagaaacacctcttccaattcatttgagcggtgctgcgaaagaagaaaaaactccggcgagtgcccactggttgtctgcggtggagagaaggagtgttgtgcggaagaaaagaagaggggcaaacaaggaaagacaggaagaaaggaataa

SEQ ID NO: 81784 - DNA, 147 bp, Glycine max
  Peptide Sequence Number=SeqID_198562
atgcatgcatgttccaagcaaactgccagaaaccgccagtttgactggcgagttccactaggtagggcttcagctttgcaacagggagctcaggagctcaggcttttgcaggatgcaggcgtgacagggaaatcgtcactcctatag

SEQ ID NO: 81785 - DNA, 417 bp, Glycine max
  Peptide Sequence Number=SeqID_198563
atggggtcctttttaaagtttttccgggagggggctgttatttacatgttttgcatgcatgcaccacgcaaatcgccagtggaactagcgagtttactctccgtgaacaaatcgcaagtagcaatggtgatactgtcatgcatagggaaccgccaatttgactggcgagttccactaggtaggctcaggaggtccagctttgcaggagtcaggccatgcagctttgcaggagtccgtcaggccatgcaggtgtgcagggttcagtggtcagcagtgcaggagggaaccaccaatagggatggcaatttgcatttgacggaaatcgttagcgtggctggcgagttgtggacagtgctttgttcttcctattacgtggtttctctcctcttcctattacgtgatttctctgttagttag

SEQ ID NO: 81786 - DNA, 423 bp, Glycine max
  Peptide Sequence Number=SeqID_198564
atgggatcaagtcaaaagccttcgtttaaaaagaggttctatcaagtcaaaatcaagagcttagaggtcactagtttacgagaggttgggcaattaatgggtcaacttcaacggcaagccttccgcaagcctatgtattatgaccagcccctaaggtgcttcacatttgaggacttccagctagtgccgactgtgaaagagtttgaagaaatccggggatgcccactgggaggaaggaagccatatcttttctctgggttgtatccctccacgacaagagttgccaaggtagtgaaaatctcagcacaagagttgaaccgtgtaaagcaaaacagaaatggagtagtcggagtaccaaggaagtgtttggaggaaagggcaaagaccttggaaaatcaaggggattgggctttcttttattga

SEQ ID NO: 81787 - DNA, 456 bp, Glycine max
  Peptide Sequence Number=SeqID_198565
atgtctttttcagcagcacaggacgtatctgtatcaatatcttttgtaccagcagccgttggagtaatagccagacaaatcccgtcgtggcttagacttatcagagcaagtaaatttttttccaacatgttgaataaattcaagtcattcttcaatatgttcaaggaactaaagctcggaaacatagccaaaggggtgtctaatgtgaaacaatatttagacctcttcggatacttaaactctacgttacattcaaatttcagtgacgatttcaccctcgatctccaatccgcaataatcaagtaccagaaaaatttcaatctcaacgtcacggggcaaatagacaggaaaacatataacatcatatcacaacaacgatgcggtgttcccgacatcatcaacggcaccaccacgatgagcatgggcaactccaacaagacgccgttttacgccgtg

SEQ ID NO: 81788 - DNA, 301 bp, Glycine max
  Peptide Sequence Number=SeqID_198566
gataacgtttctggagttggatggaaaaggtggaacggtgggaggtgccgatagaaactatagtttgggtgttgggagcgtgtatttggactcggaggaggagtgggtggtgcgtggtgagaacgaggagggtgacgtggacttggaatctgtggtgatgcacatgattggtcacttgctagggttagggcattcttctgtggaagaagctgttatgtacccgatcgtgttgccggaaaagaagacggagttgtcgtacgatgacttgcagaggattcaccaaatatatcacgtgaaataa

SEQ ID NO: 81789 - DNA, 279 bp, Glycine max
  Peptide Sequence Number=SeqID_198567
cgcgagattgtcgctaagacaaattcacttactcgcgctaagcgcgagattggcgctaagcgcgacgtcaagatcaggaagccctttttaagcttgatttgcacagaattgagagggagtgaagagaactattcactactcagaggcctgaagagtgtgaatttcagagagcgtagagtagagcaaggggccaagttttcatcttttagggagattagtgagtttttgagtgattgtgagattcctagaggtggaggagacatccccactcctttgtaa

SEQ ID NO: 81790 - DNA, 668 bp, Glycine max
  Peptide Sequence Number=SeqID_198568
atgaaaaattatttatcaaaaactttaagcctattcagcgtcttgctttttctaggcagctgtactccgctaaaaaccgcattgaataaaaaatttccgcctgtttctaccatcgaccagcaatatacctcggttgaaaaaaacctttctgagcttactgatttcagcccccatataggagtaaatatagatagggatatcattctgcaatatttacctcctgagatcaaaaaagcagcggaagcgataaatgatgagaacatcctggtacaaaatgtaactccaaaactatcctttgataaacagggaatatttgtagaagctgatttttcagtcaggtttcctaaatatagtatagaagccaccgggaatttcaaaggggttactgctgtttctagcaaatcagattctttatacctgagaagtgctttaacttctttaaaaattgaaagcattcaatttttgaaacatcccaaaatatcacaaaaggtattggcaaaattactttcccccattcttaaaaattatatcgacaatgtgaacggacaaatttttaaaaagccaacaattattaatattggctggggacaatcttatcagcttagcctaaaggaaatgtttaaaaatccggatactgaaattatcgctgactccataagaatatcacg

SEQ ID NO: 81791 - DNA, 306 bp, Glycine max
  Peptide Sequence Number=SeqID_198569
atggcaatccaaggagatgatagtgaagctggacaaaagatggagaaacataaacaaaagctgacgcctaaaccaacacttgaacctgtttttgattttgtagaacatgaagagattaatgaggagactgaagatgataaggaagaagagacaccaataaaagaaaaagaaaaagaaaaagaaaaagaaaaaaagttgaaaaatgaaaaacaaaaggaggaagttgttgatgatgaaatgaggaaaggcaagagtgaagcaaacactgaaaagaagaaggataattatccaaatgaaggcaaggaa

SEQ ID NO: 81792 - DNA, 310 bp, Glycine max
  Peptide Sequence Number=SeqID_198570
atggcggttgacgaattcgccgatcggtcgggcagcgaacatcatcacgccgacggcgatcaccactgccgccatcatgatgaacagatggtcggaaaggcccacggcggtaatcaccgaatccaggctgaagataatatccaacagcatgatctgcacgatcgcgccgaagaagctgtgcaccttggtgtggtgctcttcttccgacccttcgatggtttcgtggatctctttactggctttccagatcaggaacagcccgcccagaagcaggatcagatcgcgagcggatacgctgtgctccatcacg

SEQ ID NO: 81793 - DNA, 252 bp, Glycine max
  Peptide Sequence Number=SeqID_198571
atgctggcgctggcgttcctgatcctggtgggcttcacgctgatgctggaaagtttccaggtgcacgtgccgaaaggctacatctacttcgccatgttcttctcgatgtcggatccgcaggatgaaaaagtgggtaatggcagtgtctgcgctggtgatggtggctggcctggcggggtgttccagcgactacgtgatggcgaccaaagacggcaacatgatcctgacgcaaggcaaaccggagatcgatga

SEQ ID NO: 81794 - DNA, 204 bp, Glycine max
  Peptide Sequence Number=SeqID_198572
agccatgttcaaagcggagggtatgagtgtggctactacgtgatgcattggatgtggaacatcgtcagtgggggtttaaagaatgattggagcatgtggtttcttgatggaacggcgttagacaacgaaacaattacaacgattcgccagaaatgggtagcatattttcttaaagttcaaagcaatcaatgtacaaagtcttag

SEQ ID NO: 81795 - DNA, 519 bp, Glycine max
  Peptide Sequence Number=SeqID_198573
atggctctcgaatttgatctctacttctctttcacaatggacatgctctttgactccttcatcatcgtgcgtctcccttccgccgtctacatcacagcaacgccatctctggtggtagtgggctgcagtccattccgattctttattttaacttatggcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 81796 - DNA, 240 bp, Glycine max
  Peptide Sequence Number=SeqID_198574
atgcaatgtcaccggatgcaagggatcggagtttcaccacctgccacatcagacagcgcatatcgattatttgaaaatgaggcgtctcggcgattctatcaccatattctccaagcacacaaaggggaacacagtataacgagaatctcaaagatcgagggctcatccatctgttgcctcgagagacaattagggctgagttcagggatgctgccgcggttgggtcttctcaggggctag

SEQ ID NO: 81797 - DNA, 354 bp, Glycine max
  Peptide Sequence Number=SeqID_198575
atggccccgaggaaacttgcctcaaagagatccaggaaagataaagcggccgaaggaactagttccgctcccgagtatgatagtcaccgctttaggagcgctgaacaccagcagcgcttcgaggccatcaagggatggtcatttctccgggagcgacacgtccagctcagggacgatgagtataccgatttccaggaggagatagttcgccggcggtgggcatcactggttacccctatggccaatgctgttcatgtgtcctccacttttgagtttggagcagtgcttcatgattgcctaagtgcggaccctcaaggcaatcctctattctccccctttttcggagccccatga

SEQ ID NO: 81798 - DNA, 260 bp, Glycine max
  Peptide Sequence Number=SeqID_198576
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggagccattccttccaggcctctttgttgggacgctggaggatttcaaagtcccacacgtgaaccac

SEQ ID NO: 81799 - DNA, 195 bp, Glycine max
  Peptide Sequence Number=SeqID_198577
atggtgcctaggaaactactaccagagagaaatgtagtagtatattacactgagtttgatgagttcaaggaggaactcgagagaagacactgggatgaggagctgactagttttgttgatggcagcatcgatgttgccattgtgaaggaattttatgcgaacctctatgaccctgaggataaatcacctaagaag

SEQ ID NO: 81800 - DNA, 522 bp, Glycine max
  Peptide Sequence Number=SeqID_198578
atgagaggccctctcaaagagtcagcctcttgctttcttgtaaggttaaagtcctttggtacttgtacctattggctcgccttcagaggactgcatgtcctcaccttcagagggctacacgccctcgccatcagaggactgcatgtcctcaccttcagagggctacacgccctcgccatcagaggactgcatgtcctcaccttcagaggactgcatgtcctcaccttcagagggctacacgccctcgccatcagaggactgcatgtcctcaccttcagagggctacacgccctcgccatcagaggattgcatgtcctcaccttcgtagggctacacgccctcacctttagaggatcacacatcctcgccaacagagggctgcacgccctcacctttaaaggactacacgtcctcgccaacagagggttgcacaccctcacctccagaggactacacatccgcacctcacctttagagggctacgtgtcctcattttcagtgtgctccatatccacaccttaa

SEQ ID NO: 81801 - DNA, 459 bp, Glycine max
  Peptide Sequence Number=SeqID_198579
atggttaacgaaaccgggatcgtagttttactgagaccattttgggtttctgcgggaaaagagaaagctacggtgcgaagggtatttctcttagctctgatttattttgcaattcccaacggcgagaatgctcgaaattgggttgcgaacttggttctcaaatttcacgatgatccaacggtgaatgagttcgagatcatcgtttttctgagacaggttttgtgggctgcgggaaaaagaaagggttttggagaggagaagagggaaaacgaaaatgagggaaagaagaggcatcgtcagtctaaaactgacctaacatcgctatttatacctaaggagggcattcctaatcagcttcagcgactaatgtgcgaattggacaacacccccaacaatcttggatgtggtcgcaaagaagtgcaccacacacgcatcatcgggatcaccttcgagatttga

SEQ ID NO: 81802 - DNA, 1012 bp, Glycine max
  Peptide Sequence Number=SeqID_198580
atgaggtcgtcgccaccaccattgtgtagatcagtggacaacgatgctggtggttgggtcaccagccggaaaggcaccgtagctctagcaacagctaccagaaaatgcagtagattcccggcagtcaaattagacaaagctgggataagtgctagtggtgctgcaaggacactaggggttgccccagcaatggcaaaggagcatctcttgtctgctgagagcaaagtcgttggtgcctcctctgttcgtgcctctgtctgcgtcgtgccatcagttcgtgcccccactgtagacatcgacttgtaccaccgtaagtccctttgtgacttccctcttgttctttcggttttggcgatgattatgtttagagccagaggattgagtcggactttaggcaaggttataggaagaaccttagggagagaagttgttgaacatgtggatcatgcaactgacgaggtccatgaacaacctaaagagggaactgttgatgatgcccagggccccttccatagctttaaggctctttatgtggacgaagttgtggatctattagtttacttgcttgaagttaattcagaaaaagcaagagctgagacattacaatatcgttgcacactctttgctaacaagagtgtcacacacgtgtatgtggtatttttcaatgcattttgtgacctcagccaaactggaagctatgcatggagagctgttgcacttgtccatatgtatgagaaattgaatgatgcatccaagagaagaactagacaacttgcagaatatatcatcacactttacagtgttggatctataagcattttcctactattgcttcttttattgttgttgaagattatcatgagaggaaaccatgtgcttgttgttggaagtctgggaaggcattaccaatgtcgacgtatcaccattcctccagaccctgctactccatctctatgtatagaggatattgatgatagatggattcgattttctgaataccttgcactgatgg

SEQ ID NO: 81803 - DNA, 165 bp, Glycine max
  Peptide Sequence Number=SeqID_198581
atggtggtggcgacgacctcatcggagctcaaacgctctctcacgcacccatctattgtgcgccagacacacggcatctatggaaggggggtgttaggaagtcccacattgcctgcctcagttcttggggtgcagcttatatatctgttaggcaactttacttag

SEQ ID NO: 81804 - DNA, 576 bp, Glycine max
  Peptide Sequence Number=SeqID_198582
atgtggaaactcgtgcgatacgccgccgcctccaacctcgcccgatcgcggcggttctccgccgcgattcccggtccgtgcattgttcacaagcgcggtgccgacatactccacgatccctggttcaacaagtgttttatcttagctgaaactacacagcttctaacagtttatttactggatactgggtttcctttgactgaaagggacagattggggcttcggggcctcttacctcctcgtgttatatcctttgagcagcaatatgatcgctttatgaattcattccgatctttggagaataatactcaggggcaaccagataaagtcgtttccctggcaaaatggaggatcttaaatagactgcatgacaggaacgagactctgtactacagagttcttattgataatattaaagagtttgctccaataatatatacccctacagttggattagtgtgtcaaaattattccgggttatttaggcgtccacgtggaatgtattttagtgccaaagataaaggagagatgatgtcaatgatctataactggccagctcatgaggtattgcattag

SEQ ID NO: 81805 - DNA, 468 bp, Glycine max
  Peptide Sequence Number=SeqID_198583
atggctgaggcggtttcggtaattccaaatcagtaccgaaagctacacacaactagatcatgggactttatagggttacctttgactgctaagagaaaactgaaatcagaaagtgacatgattttggctcttttggatacaggtgccaaatacttcaagaatggtggaagggctgatccatctgacatattatctcccatagatatggttggtcatggaactcatactgcatcaacagcagcaggtaatcttgtcccagatgcaagtctcttcggaatgaggtgccatcggccaggttggcaagtggaggggatccaaactatgtgcatgactctaggaattggagcatttcatgccatgaggaaaggcataatcactctagtggcattgattgatagggatttccggagcactattgagttggggagtggaaagaatgttactgtaagttctgagtatggcactcac

SEQ ID NO: 81806 - DNA, 1017 bp, Glycine max
  Peptide Sequence Number=SeqID_198584
atggcggacgactccgacctcacctccccgctcctctcctcctcctcctcctcctcctccgaccacgtcgtcgtcaccgtccacccctccgcggcgccccccagaaaccccttccgtgtgctcggcaccgacgacgacgacgacgacgacctctccgtgccgccgccgtccaccctggacccgttccgcaaccgcacgccggcgattgaggggctctacgagtgggccaagacggtgctgtgcctgccgctggcggcgctgcggctcgcgatcttcgggctctgcctcgcgttggggtacgtggcgacgaaggtggcgctgcaagggtggaaggacaaggagaatcctatgcccaagtggaggtgtagggttatgtggatcacgcgcttgtgcgccagatgtattctcttctcctttgggggaaaaggggacagctatcagtggataaaacggaaaggaaaacctgcaccaagggaaattgctccaataattgtatctaaccatgtttcttacattgagcctatcttctatttctatgaattatttcccaccattgtggcagctgagtcccatgactccataccttttgttggcaccattattagagcaatgcaggtcatatatgttaacagattcttaccatcatcaaggaagcaggctgttagggaaataaagaaatctgctttcaaggaactgaataacagagaagggcctcttgcaatagatttcctcgagtactattatttcccgagggaacaacaacaaatggcaggaaccttatctccttccaacttggtagaatatcttcctgtcatttatcccctggatgataaggaaactgctgtacattttcgggagaggcaactaaaaataagaacaccaaaccaggaatcactttataaagcccaaattgcagagtctaggtctctaggatccatcttgcaaagtgatggcttgattaatggggatgttgcacataggattcaggctggtggatggaatggaggattgctttag

SEQ ID NO: 81807 - DNA, 1593 bp, Glycine max
  Peptide Sequence Number=SeqID_198585
atggacaattatggttctttacaacatccatatgggtatccaaaccctcctcatgatctatatgcacaaccaccatatccatatccatatccaccaaaccctccttatactaacaactttaactactcataccccccacctcctccaccaccacactcctcatctccttattctagccacatagactattcctcataccctcctcctccatctacctcatcacatggctcctttgactatcctatgcctcaaccacctcacacttatctttaccctagtgatagttatgaccttcctcactcttcttctgcttaccctactttggatgatcgcatgaacaatgaggatccttctagagtttcagataattctgatgactcagtgcatagtcagagtttgcagattgtgccggctcagctcaaagggtctctgagagttatgctcctccatgggaatttagatatttgggttcatggagccacaaaccttcctaacatggacatgttccacaagacgttggaagacatgttcggtaggttgcccgctgaagttcattttgttgtcaaggacagtgatgtggtgggttcacagctcattggcgttgtggcaattcctgtggaacaaatatactcgggtaaaggtggaacggttactctatatcaagatgctcatgttccaaatggttgcctccctaatgttgtgcttgaaaatgaggagggagtaagagtgcttctccttgtttgggacgaccctacatcaagaaacattctaggttacaaagtggatggtgtgatggcaactcgtgatgaggaaactagacgatttttcaagcactcttctatgcaggtgctgctttgtcctcgcattgctggaaaacgaaatagctgggtcaaacaacagaaaactgtaattgtggatgctgatgctggaaataacaaaagaaaaatagtagcatttgttggcggacttgatttgtgtgatgggagatatgatactccccaccatcctatgtttaggacacttcagacactgcataaggatgactatcacaaccctactttcacgggtaataccggtggttgtccacgggagccatggcatgacttgcattctaaaattgatggtccagcagcttacgatattttgaaaaactttgaggagcgctgtgcatctaatgctcctagtgtcggtgatgataatcctgagtcatggcatgttcagatattccgttcaattgattcaaattctgtcaaggggtttccaaaggagccaaaaaatgcatctagcatggcatttagtagaaccaatccacgtttcatgatttatgttcattcaaaaggcatgatagttgatgatgaatatgtcatattggggtctgcaaacatcaaccagcgctctattgagggaacaagagacaccgagattgcaatgggtgcctaccaacctcatcatacgtgggcaagaaggcagtattatcctcgtgggcagccttacccttgcatatgcaaagaggctgtttccggattcgaacccatgaccaacaagtcaccaagacacaactttaccgctgcaccagggctcgccctcagataa

SEQ ID NO: 81808 - DNA, 2265 bp, Glycine max
  Peptide Sequence Number=SeqID_198586
atggtgacaaattcagtagctgtcatgaacaagcagacatacataatacacatggacaagaccaagatcaaagccacagttcattcccaagacaagacaaaaccttggttcaaatcagtcattgatttcatctctgaagcttcatcatcatcagaagaagaagaggcccctcagcttctttatgtttatgaaaccagcatgtttggttttgctgctcaactttcaaataaacagcttgagtacttgaaccaaatagatggtttcctttcagccataccagatgaactattaacccttcacacaacatacagcccccattttcttggcctacagaatggaaaaggactttggagtgcttctaacttggcctcagatgtgatcatcggagtccttgatacaggaatatggcctgaacacatcagtttccaagacacaggtttgtccaaagtaccctctcgttggaaaggtgcctgtgaagtaggcaccaacttctcttcctcatgttgtaacaagaagcttgttggtgcaagagtttttctccaagggtatgaaaaatctgctggtagaatcaatgaaacattggactatcgttccgcgagagatgcgcaaggacatggaacacacacagcctcaactgcagctggtaacatggtgagcaatgcaagcttttttggcctggcaggcggttcagccagtggaatgaggtacacctcaagaatagctgcttacaaagtatgctggcgattaggctgtgctaactctgacatattggctgctatcgatcaagctgttgctgatggtgttgatgtgttgtcactctcattaggtggcattgcaaaaccttattacaatgacagcatcgccatagcctcgttcggagcaacgcaaaaaggagtttttgtttcttgctcagcaggcaattcaggcccctctagttcaactgctggaaatgttgctccatggatcatgactgttgctgctagctacacagacagaagctttccaacacaagtgaagcttgggaatggaaaggttttcaaagggtcatcattatacaagggcaagaaaacaagccaattgcctctagtttatagaaactcctcaagagcacaaaggacagcacagtattgcaccaaaggttcacttgatccaaagcttgtgaaaggaaaaatagtggcctgcgaacgaggaataaatagtagaactggaaagggagaggaagtgaagatggcaggtggggcaggaatgatactactcaactcagaaaaccaaggagaagagctttttgctgaccctcatgttttgccagccacatccttaggttcctcagcaagtaaaacaattagaagctatatttttcactcagcaaaagcaccaacagcttcaatttccttcctagggacaacatatggagacactgcaccagttatggcagcattttcttctagaggaccaagttctgtgggccctgatgtgatcaagccagatgtaactgcacctggtgtgaacatcttggctgcttggcctcccacaactagtccaagcatgctcaagagtgacaaaagaagtgtactatttaacatagtctcaggtacctcaatgtcttgtcctcatgttagtggcatagctgcactcattaaatctgtgcacaaggattggtcacctgcggctatcaaatctgctctcatgactactgcttccacatcaaacaacaaaggtgctccgatttctgacaacggttcaaacaattcggcatttgctgacccttttgcatttggttcaggccatgttaaccctgaaagagcttctgatccagggttggtctatgatatcaccaccaaagattacttaaactacttgtgcagtttgaaatacacatcctctcagattgctatactgtcaaaaggtaattttaaatgtgccaaaaaatcagctcttcatgctggtggcttgaactacccttcatttgctgtgctatttgacacaagtgctagaaatgctagtgtgacatacaagagggtagtcacaaatgtagggaacccctcaagttcttatgcagtgaaagtggaagaaccaaagggagtatctgtcactgttgaaccaaggaatattggtttcagaaaaattggtgacaaattgagttataaagtttcttttgtttcatatggaagaacagcagttgctggaagttcatcatttgggtcacttacttgggtatcaggtaaatatgctgttagaagtcctatagcagtaacatggcaataa

SEQ ID NO: 81809 - DNA, 525 bp, Glycine max
  Peptide Sequence Number=SeqID_198587
atgagccatagagtaaacaaggaggcagaatttgcatatggtgctggtgaagtgaaccctacaagagctatgaaccctggattagtctatgacatggatgactttgcatatatccagttcttatgccatgagggctatgatggttcctctctatcagtgttagttggttctcctgtgaactgcacctctttgcttccagggcttggccatgatgctatcaactatcccaccatgcaacgaagtgttcaaaacaacacaggcacaacagtaggagttttcaggagaagagtcaccaatgttggtcctgctccgaccgccttcaatgccaccatcaaatctcccaaaggggtggaaatcacagtgaaacctactagcttcaatttctctcacaccctgcagaagaagagcttcaaggttgtggtgaaagcaaaacctatggcaagcatgcaaattatgtcagattcccttatttggagaagcccacgttacattgttagaagccccattgttatatatagtccataa

SEQ ID NO: 81810 - DNA, 141 bp, Glycine max
  Peptide Sequence Number=SeqID_198588
atgatgcatgcacctaactcaacactcagatgcaatgtgggaactgtgctgagtttgtcgagaccacccggttgtgcacgtaacagcccccctcccataggtgatcagcctgggagcccaaaggtgttccctaccaggtga

SEQ ID NO: 81811 - DNA, 599 bp, Glycine max
  Peptide Sequence Number=SeqID_198589
gggagcacccgacggaagaaaagcatgtctcctttccttgtgagggatctcggcgcacaaaaattcccaagactatacaaagaatccataaggcatgggaaaccccgtttagattggctcgccaagttaaaagtcgtcagcgaagagagttttgaagcaccggaagaggacgaagaagtccaaactctcaaaagcgagttaggaaaggcaaaacttgccaaggagaagttcaagttggccgctacacacgttcggaaggagtgtgtcgggttacgggaagagaatgcaattactgcaagagcccttgaacaagagaccaagagggctcgcaaggaagagtatggccggaacaaaattcgcggagctctatggggtagcaatagtgaactcaagttgcgaagggaagaaagagaccagtcgcgagcacatagcatgaccaacatgctagctatcatcgccaagtaccaagaagagttaggtctagccacggcccacgagcatagaatcgcggatgagtatgctcaaatatatgcggaaaaagaggctagaggaagggtgatcgactctttacaccaagaggcaaccatgtggatggaccg

SEQ ID NO: 81812 - DNA, 701 bp, Glycine max
  Peptide Sequence Number=SeqID_198590
atgtccgccatggatatgattaagtccctttccagtaagcctgaaaaatttacgggtgaaaattttttctgttggcaacaacaaatgaaattctggcttactgaattggatttatactctgtgatttctaaaagagaaataaaaacttcaacttcctctactgatatagttcaaactgatgcaaccattaagcatgatgtttctgataaagatattttatgtcatggacgcattttaagtgctttggctgataacatatataagattttttgtcataccaaaacttctgttgagttatgggaagcacttgaattgaaatatggatctgctgaaaaaggtttaagtcgttactcttgtgaaaaaatgattgagtttcaaatgattgatggaaaatctatttcagatcagatccatgaatttgaaaacattgtttatgacatgaaattgaaaggaattgttttgcctgacattatgcttgtggctttcatgatatcaaaattgcctccttcgtggactgattttgctcgaagcttgaaacataaacatgaaagttttacctttgatgatttgcttgtctgtctccgcattgaggataaacatcgttcatctcaaaaacacttgcaaaaatctgattctcactctaaggcctatcttgttgagagctctagcaaacctttctctaagtccttcaaaaggcatgg

SEQ ID NO: 81813 - DNA, 336 bp, Glycine max
  Peptide Sequence Number=SeqID_198591
atgcatattgttgtggtaaaacaggggcaggatcatcttgagctaccttctggggtagagacaaaacatgaacggcagaaaccaatcaaggtacttaaggatggatgcaagtggggatggggtcacgaccgaccgatcgttgcccctttctctgcgcgaaacaagcagagaatgtcgctgcaaggcagccccgtatcctttgttagctcgcctgggcgagccacccctgcaccaaattataagaatgacgaaagggggggcgtttttacattcaaaaacttcttttcccccctttcaaaagccatacccacgggattgacgaatttgcagccctag

SEQ ID NO: 81814 - DNA, 166 bp, Glycine max
  Peptide Sequence Number=SeqID_198592
atggagcttgcatcattatgtctccaaatcaaacatccgtttgagaagataggaccatttgaatttctcgacggtttccgttgttctatttcgagcgtcacgatatataatgaccccgaatcggacatccgtgtgaaaagttatgaccatttccatttctcgagag

SEQ ID NO: 81815 - DNA, 240 bp, Glycine max
  Peptide Sequence Number=SeqID_198593
ggagtgcctgttgcccccagcaaggtcatcaggccccctactaatcgagctttcatcaagaagtactgcgtctccaggcaggcgcagggcaaaacaccacagcagcctggggatggccgacagcgggcaacagacgcaccgccatcacctctaaagttcacctctggtcatccacaaaaaggtttgagtattgcctacaccacatggccggccaacaggcgaccaagtccaaagccaaag

SEQ ID NO: 81816 - DNA, 255 bp, Glycine max
  Peptide Sequence Number=SeqID_198594
atgatattgcacgagaatagaaggcctaactctctaaaaatagtccccagtggagtcatcgattgtcgcaacctacccttcggcgggaaggcgatgtggggctcacgggcgcgtcttccaaggaaggaaggcgcgtggagtcgccaccaacgtttattcgaggaaaacgttagaaaaaccggaaaagggaaggtattagcaccccatgcgtctgtcacaagggacgacaaccttcaatcaagtgtgcaaatatga

SEQ ID NO: 81817 - DNA, 330 bp, Glycine max
  Peptide Sequence Number=SeqID_198595
actaccattctgtgcacgaaccgtccttgcaagacgagcattgtttttgtgcacgacaagggaacttcgatgctcttcaaagttctttttgtgttcacgttttgcaacatcaatctaacaaagatcgagtcacgaccacatcggaaccgtccgattaggcttgtggatgacacaaacgtgggaacatcaaagcacctcgaatacttgttctacattgattttgaggcctccatggctgagggcagtgggaaaggaaaaagggaagatgcttggactcaagagactttaggagatagggtttcagagaagaataaggtagcgcgtaagtgg

SEQ ID NO: 81818 - DNA, 467 bp, Glycine max
  Peptide Sequence Number=SeqID_198596
cagaactggcgatgcggaatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccggcaagggaagtcggcaaaatggatccgtaacctcgggaaaaggattggctctgagggctgggcacgggggtcccagtcccgcacccgtcggctgtcggtggactgctcgagctgcttccgcggcgagagcgg

SEQ ID NO: 81819 - DNA, 1296 bp, Glycine max
  Peptide Sequence Number=SeqID_198597
atgaaacttaagcgtaaacagacggagtgcgagatgaacaccacttttacctcagaacaacaacccgacgattttaaacagcatgtgcgcctgatgaagcaggcgctcagagcacagattggcgatgtcgaaggcctgtttgagcaggtcagaagtaagattgtcagtgaaatcgcggccgcgcgcgccgaagagaagcagcacggaacggcgtggccgcaggtcagcttcgtggatctggccgccggtcgcatcagcgaacagaccaaagatcacatccgccgccgcggctgcgtggtggtgaagcaaaccttcagccgcgagcaggcgctggcgtgggatgctgacatgctcaactacctcgacgacaatgattttgaccgcgtctatcaggggccgggtgacaacttctttggcaatctcgatgcctcgcggccggagatctaccccatttactggagcgatgcgcagatgtctgcccgccagagcgaggccatggcgcaaacccaggcgttcctcaatcgcctgtggaaatttgaatccgccggtacgcgctggtttgatccggacgtgagcatcatctatccggatcgcatccgtcgccggctgccgggcaccacctccaaagggctgggcgcgcacaccgactccggcgcgctggagcgctggctgttgccggcctatcagcaagtgttcagcaagatcttttctaaccagttcgatcagtacgatccgtgggatgcggcgcaccgtacggacgtgcaggagtatcagtctggcaccaccaccaaatgctcggtgttccgcaccttccagggctggaccgcgctctccgacatgcaacctggtcagggactgctgcacgtggtgccggtgccggaagccatggcttatctgctgctgcgtccgttactgaaggatgtgccggaagaggagctgtgcggcgtggcgccgggcaaagtgctgccggtatcggagcgctggcatccggaattaattgccggcctgtgttcgatcccggcgctgcaggcgggcgattcggtgtggtggcactgcgatgtgattcatgcggtggcaccggtagaaaatcagcagggctggggcaacgtgatgtacattcctgccgcgccgatgtgcgataaaaacgccgactatgcgcagcaggtggcgcaggcgctggcgaccggtgtctcgccgggcgatttccccaaagaggattacgaagccagctggcgcggccgttttacgccgcaggatctgaatgaaaacggccggcgcagtctgggattagcgtga

SEQ ID NO: 81820 - DNA, 342 bp, Glycine max
  Peptide Sequence Number=SeqID_198598
atgagaagtggtgtaagacagtatttagcaaaatcatcacagctcattaacaaggctgcggataaaccaaacaggggttcccgcaccgggagcagcgaacggaggtgtatgtggagagtggcgatatcattctgggtctggattccggcacctcggtggttaaagcggtggcgtttgatctggaagcgtaggcggtgccgcccagcagtcaatgacgcaaacctggcaggatgcggtcagtgcgattcacaagctcggcgatcgggtggagaatctgggggcgcgcgtggtggccgtgaggctgaccgcccagggcaacggcagctgtctggtcggtgctga

SEQ ID NO: 81821 - DNA, 480 bp, Glycine max
  Peptide Sequence Number=SeqID_198599
atgaacatcgtcgctgtgcatcctgagaggtcacgttatgtccgaggtctcaatcttaacgcagcaactggcacgcaaacgtcggcggcgctacacgctcagcggtgtggtgatcgtggcgctggtggctgccatggcgctgaataccaaagtggtgcgcatcggttcggcggacgacgcgcgtcagcagggcttctccgcagacagctacgggcagaaaacctttcccggcatccagcaggatgtcgaagcgcgcgcggtggatgccgccacgctggcggccgcactgaacagcgatcggcagcaggcggtggccagatacggtgtcggctcgccgctgccggtgctgccggtcaaactgcagggcgtggtgcagccggggcaaatgggtgtattcccgttacaggtcgccggtctgccagcgggcacgcagctgcggttgcaaaccggcccggcgatcaccggcaccgatttgcgtga

SEQ ID NO: 81822 - DNA, 471 bp, Glycine max
  Peptide Sequence Number=SeqID_198600
atgaggctactacccccaagaagcaaaaaggaaagaataaaaatctacccccaagatgaaggacaacctttaatggttaaggaggagtgtaaggaggtaagtgtctcctccaaaaggttagctaagaaggaaagtcattttgcaataaagataaacattaaagaagcttcccctcctagacaacctccacatcttttcctttgtaaaaagacacttgttagcactgtcacacctcttgggcttgagattattgctcaactaaaagagttgttggatgagggtttggttcgtaagagcttaaatccttgtgctttgttggtgcccaaaatagatattatgaggcatcaaatccctatgataggtggtgttgagggaaaaagcccagagtttcaagaacctctggatttgaggtcaaatccttttcaagggggagggaatgatgcaatcctacctcccaagggcattggatag

SEQ ID NO: 81823 - DNA, 363 bp, Glycine max
  Peptide Sequence Number=SeqID_198601
atggctaagcgagcattcgctaagcgcgacactcagtggctaagcgcgaggaagaatccagaagaagatgagctgttaggttccctgagcgtaccgctccaggtcatcaagcgcaccgcttcagctcatccgctaagcgagagaagcgcgctaagccaaaatccacttatgtgcgctaagggattcagatttgcgccaagcgcgcgagcaacctctgcatgcacaagagtctggccttggcttgaagcttttgcatgtttaggaagttcaagagagagaaaggtccaagttccagagagttttgagaggttttgctatgtgaagatctgcagagacgagagttcgaagcggaagccgttctga

SEQ ID NO: 81824 - DNA, 196 bp, Glycine max
  Peptide Sequence Number=SeqID_198602
atggggctccgaaaaagggttgagaatggagaattgcataaagcaatcactacgcatggctccaaactcgaaggtggaggacacatgaacgaaaacacaattcatggggctccggaaaagggtggaggacgcatgaacgaaaacgcaattcattgggctccgaaaaaagggttggcaagaccgaacgatccaccgg

SEQ ID NO: 81825 - DNA, 423 bp, Glycine max
  Peptide Sequence Number=SeqID_198603
atgaaaattgagcttgtctcatcagtggtggtggtgtcattctattggatttggctttgcaacaacatccttgtggtttctggcctctgtcttgataatcagaagtctttgctgctcgaatttaagaacaacgtcacattcgtagacacggttgacagaaatagcagcaggctgaattcatggaaagcgagtaatgattgttgcaagtggatgggagtaacctgtgacgaggatgggcatgttatcggtcttgatctcagtggagaactaatctctggtggattcgacaattcaactagtcttttcgattccctctggattcaacaagttagagaaattaactcacctgaatctgtcagaggcttcctttatgggacagattccaatagagatctctcagttgataaggttggttactcttga

SEQ ID NO: 81826 - DNA, 297 bp, Glycine max
  Peptide Sequence Number=SeqID_198604
cacacccacaccagagtgaagcctttaccaacaaccctcaagtatgcttacttgaaggacaaggaaaaatttccagtgatcatctctgcctcccttgctgctgagcaagaggagaagttgttgctagtgctcaagaagcacaaaaaagccattggatggactttagcagatatttatggtattagcccatctacctatgaatccttgattcaagatttcttcaagatcaagccttgcctcacaatgaaaggtttcaagtcattcaaggcacatgtaattgattaccaatacatgtaa

SEQ ID NO: 81827 - DNA, 567 bp, Glycine max
  Peptide Sequence Number=SeqID_198605
atgacagatcttgtgagcgcggaagatgacgtaaatctccgcgtgtcaacggggttgtcggccgcgattgacgaacggtgcaggagacgacatagcaaaaaggtttataccgataaccactcgggtatttccgcccgtcagcgtgactcaaaagtcagtatgccatatcttgtaagcgcggaagatgacgtaaatctccacgtgtcaacgggcttgtcggccgcgattgacgaagggcgcaggagacgacatagcaaaaaggtttatacggataaccactcgggtatctccgcccgtcagcgtgactcaaaagtcagtatgacagatcttgtgagcgcggaagatgacgtaaatctccgcgtgtcaacggggttgtcggccgcgattgacgaacggtgcaggagacgacatagcaaaaaggtttatacggataaccactcgggtatctccgcccgtcagcgtgactcaaaagtcagtatgacagatcttgtgagcgcggaagattatgtaaatctccgcgtgtccacgggcttgttggccgcgattgacgaagggcgcaggagatga

SEQ ID NO: 81828 - DNA, 306 bp, Glycine max
  Peptide Sequence Number=SeqID_198606
atggttatctgcacctttcatcaaccaagggcaaacgagcccgctgacacgcagactaacatcgtcttctgcacctttggtcatccagggacagcgagtcaggtggcaggcagagataccttatggtcgcccgcacctttcgtcaaccaaggcgaacgagttcgacggtatcaggatgatgttggtcgtccgattctgattattttcaaaatttttgcaagtttttactcttgtcgtccggagacattcaagcccgacgatgcacgagattcctctctgctgggcagggacgatcaagttcaatag

SEQ ID NO: 81829 - DNA, 405 bp, Glycine max
  Peptide Sequence Number=SeqID_198607
atgaccactttgacccagacgtggaagacactggtgctcagcaatgttttgcctagggatcataactcagatctccctctgcctaagtgccagttggtgtatgccatcctgacacggatgagcgttcacgtggcccaggtgattgctgatgccatttatttgtttgcagccttcatcgagaagtactacacgcctaggcaggcgcagggtgatgcacatcaggccgcagacgcacaaccaccacctcggcaggccgatccagctgggtcactaggcgtggagcgttatctacagcatttggttctccagcagtcagcagggcagggttctaccccttttgtatgccctaccccggagcagtttggggctgaggttgcatggcctggagactggctcgatgcctag

SEQ ID NO: 81830 - DNA, 228 bp, Glycine max
  Peptide Sequence Number=SeqID_198608
atgaacacattggtctctgcttgtcaatcggacttggggtctccgaatgacgagactctcgggtcactggataacaaagggcgtgtgcgggttaccgtcgggtgtctccgcatgccaccagattcttgggtcacgataacaaaaggtggggtggtcgacaaaagcaaggcttttgctcctacgtatcctcaatttgtgatgaggaactcagacctacgtagttcttga

SEQ ID NO: 81831 - DNA, 477 bp, Glycine max
  Peptide Sequence Number=SeqID_198609
atgggtgacctagaggaagtgcaggaacagatgaaagccgacatgttgactttgaaagaacaaatggcttctatgatagaggtcatgctagggatgaaacaactaatggagagtaacgcggaaaccgccgctatcgctagcacggctgtagaggcagacccggctctctcgactgctgtgtaccatcccgttccaaacatggtgggacgagagagaagcacaccgaggcatatcaacaacctccatccgaggtacaaccgaggtgcttacccctacggtttaccacccaactacacaccaccagccatgcatgaagatgtggatcacgtttcccccctcatcctcgaaggggagcctcctcgacatcctgacatgatccacgagaatcctcgagagcgcgctcagggagacgtcgactcctactccccgtttcctactaaggggccggtgcccaacgcactacctcaaccctgttag

SEQ ID NO: 81832 - DNA, 480 bp, Glycine max
  Peptide Sequence Number=SeqID_198610
aaagcgcgctttgcgcagaaactgcagatgcggttccctcgagacacgatcatggcggcgatgtcgcttcacaagggcgatctgtccaatatgctttcggtcgttggacgcattccagaggatctggtcgatctcataggccccgcacccactgtcggccgccgcaactggatggatctagccgaccagctttcctcctcacaggtcaaggaggcggcccgcgcatatgtcagcgaaccggcggttgcctcgcttccttccgaagaacgcttcaaggcgcttctggactttttgaagccaaaggcacaggccaagaaaaccggcgtatggtcttcggatacgggccgtcgcctggcgaaagtggtcgagagcgaccgcaagctggatatatcgatcgacaagaacgaagcaccggaatttgccgaattcgttctggaacatcttcagacgctgtttgccgagtatcggtccaagcagtga

SEQ ID NO: 81833 - DNA, 588 bp, Glycine max
  Peptide Sequence Number=SeqID_198611
atgaacagcacatgtgtaacgacgccctttgggcggcgagcgatgtcgtttggcgtgctcgcaacccagtttgccgcgcagaaaaacagaaaatgcgaagcagtcgacaaatggaaactctatcggtccgtctgtgaagcaagaccgctgctcggcgtaaccgatcgctcgcttgccgttctgaacgcgctcctgagcttttatcccaaaaatgagctttccagcgaagccggattggtggtgtttccatccaatacgcagttgtcgctcagggcacatggcatggcggaacagacattgcgtcggcatctttcggctcttgtcgaagccggcctcatcatccgcagggacagcccgaatgggaaacgttacgcacgcaagcacaggggtggcgagatcagcgaagcctacgggttctcactcgcaccgcttcttgctcgtaaaacggaaatagaggaactggccgaacgcatcattcgcgaacggcttgatcttcaacggcttcgcgagacgatcagcctctgccggcgggacatcccagaaactctgcgaaatgattgctgccagcggccagatcgagatctttga

SEQ ID NO: 81834 - DNA, 225 bp, Glycine max
  Peptide Sequence Number=SeqID_198612
atggagaatggagaattggcgaacagcgctagggaatcaattcgcggggctccagactcgatggcaatcaatttgcggggttccagactcgatggtggtggacacatgaacagcgctaggcaatcaattcatgggtctccgaataagattgagaatggagaattggcgaacagcgctaggcaatcaattcgcggggctccagactcgatggtggtggacacatga

SEQ ID NO: 81835 - DNA, 156 bp, Glycine max
  Peptide Sequence Number=SeqID_198613
atggttgctgagttagggcaacaaacagtggagctatccaccctcatcacacatgccgctaacgataagtcctctaatttgtttttacaaaactggccagaatgcaatttcatagaacatttattagatagctacctagctagtgttctcttgtaa

SEQ ID NO: 81836 - DNA, 276 bp, Glycine max
  Peptide Sequence Number=SeqID_198614
ggcagacaagccagcaatagaagctatgccccagcttttttacccaaccagacctaggaccagcaatgcctgtcaaagaaagaagtacagcgagtcaatgtcggataatctagcaagagcttctagcgcaagggagtaccagatagagcttcaacaagtgggaatcaatacagcaacaagtccgatgttgaatgagatagctttcatcttccaatctttccgagctaagaagtttgaaaggggcagtcttccatgtcactcggaaggcagatcaag

SEQ ID NO: 81837 - DNA, 219 bp, Glycine max
  Peptide Sequence Number=SeqID_198615
atggcgggttccctcaaagctttgcggatttggtcttcgccgacgaaaggatcaaagtgggcctggaaagagggtgagaatgaaggagaaacccatgttgcgactaccattcctatacggccaagtttcccgccaacccaacgatgtcattacttagccaataacaaaccttctccttacccaccactcagttatccacaaaggccatccctaaattaa

SEQ ID NO: 81838 - DNA, 391 bp, Glycine max
  Peptide Sequence Number=SeqID_198616
ccgccagctcgtcggtgaaggccttcagctgctcggcgctcgggcgctcgccgttgatcagcaggtaggccacttcgacgtagctcgacttttccgacaactgttcgatcgggtagccgcggtacagcagcacgcccttgtcgccgtcgatgtaggtgatggcggacttgcagctggccgtcgcggtgaaaccggaatcgtatgtgaaataccccgtttccttggtcagcttcgcgatgtccacgcaatcgttgccaagggtgggtttgatgacgggcagaacgaccgacttatcgccggcgttgagcgtgacctgatcaagatcggacactgtgtgcgctccttcatgggaaggcgcctgcccaagcgcattggtcaggcacgtgaatga

SEQ ID NO: 81839 - DNA, 540 bp, Glycine max
  Peptide Sequence Number=SeqID_198617
gacgccgagaagtggctgcaggccgattccgatcgcgcccgtttctacgagttgatctcgcgcaagacccgtggcctgtccgaagacagcaagggcgggcgctggtacaccgccgacgcgctggccatggcctgggcgctgaacccggaagggcagctgcaggtggaatcgcgtccgctgaacgtggaactgaacggtacgttcagccgcggtgccaccatcgtcgactggaaccgccagaccggccagccggacaactgcgatctgctgatggcctacgaccagcagcgtttcgaggccctggccgatatccatccgaactaccgcgacgtcgtcttccatgacgtcacctccgatttcaagatcctgacccgctcgaccatggcgacgaaggaaaccatcaagtgggaagacggcaacgactacccgctggtgaaggttgaaatttcctcggcttcgcacccgttctacacgggcaagcacaaggtcatcgacacctcgggccgtatcgacaagttccagaagcgctacgcgcgctga

SEQ ID NO: 81840 - DNA, 1033 bp, Glycine max
  Peptide Sequence Number=SeqID_198618
taaaggatttgtagatattttagctgccgaacagaatgttgaaaatgagagttggtaccagggtacagcagatgcggttcgtcagtcgatgaaacaccttgaaaaatatgattatgattatattcttatcctttcaggagatcaactttatcagatggacttcagggaaatgctggattatcatattaaaaaaggaggggatgtaactattgcgactattcctgtaaatgccaaggatgcaacaggatttggtattttgaaatccgatgatgaagggaatattacttcatttgttgaaaaaccagggatggatattttaggagattggaagtctgaagtttctgatcataacaaacatgaagggaaagaattccttgcatctatggggatttatattttcacaaagagtattcttaaaaagatgtttgatgaaggtgcgggggatgatttcgggaaagatattattcctaattcaataggaaaatatgctacattaagttatcagtatgaaggatactggactgatattggaacaattgagtctttttacgaggctaatattgatctttgtcaggattttccacagtttaatttattttcatcgtcaccgatttatacgagagccagaatgctacctccatccaaaattaacggatcttacgttagtaaagctgtttttggagatggatgtattattatggcggacaaaattgaaaattcagtgatcggaaacaggacccgtatcgataaaggaagtacgatcgtaaattcttatgtaatgggatcggatttctatcagaatactactgaaattgtcatgaatgaccggaatggtcgtcctaacatgggaatagggaaatactgttatatcgaaaaagcaattctggataaaaattgctatatcggagataatgtaaggattatcggagggaagcacttacaggatggcgactttggaacccactccgtgcaggatggtattgttgtggtgaaaaaaggagctatattgcctccgggaactcatattggataa

SEQ ID NO: 81841 - DNA, 99 bp, Glycine max
  Peptide Sequence Number=SeqID_198619
atggaggtcacccgcacttcccaatgcttcgcctccctgacctaccatatccgaggctgggcgatttacttggttgaggccagatgggacattcagtaa

SEQ ID NO: 81842 - DNA, 408 bp, Glycine max
  Peptide Sequence Number=SeqID_198620
atgtcattgcctagcgctattcatgagtcctccacattggagtctggaaccccgcgaatgtcattgccaagcgctgttcgccaattctccattctcccctttattaggagcccccatgaatgtcattgcctagcgccgttcatgtgtcctccacctttgagttgggagccccgcaaatgtcattgcctagcgccgttcatgtgtcctccacctttgaatttggagccccgcaaatgtcattgcctagcgacgttcatgtgtcctccaccttcgaatttggagccccgcaaatgtcattgcctagcgctattcatgtgtcctccaccttcgagtctggagccccgcgaatgtcattgcctagcgctgttcgccaattctccattctccccttttttcggagccccatga

SEQ ID NO: 81843 - DNA, 132 bp, Glycine max
  Peptide Sequence Number=SeqID_198621
atggggaaagggaaggttcccaaagatcaatcaaaacaagatcaaaaggtcatcctggctagaactccagaggcccaatatcaacagaaagttctggaaggagaaatagcgaaaattgaagatataagctag

SEQ ID NO: 81844 - DNA, 129 bp, Glycine max
  Peptide Sequence Number=SeqID_198622
atgggaagcaccggaatcaggataccaagtctgagtttagctggagaacaacatactaaggttgagaagaaatcaagagggattgctaaggaatggcaagaacatattgaattggttgagcaaatatga

SEQ ID NO: 81845 - DNA, 120 bp, Glycine max
  Peptide Sequence Number=SeqID_198623
atgtcacaaaacattcaacaagtgacaccttttgcgggacctagccaaatcaccattggtaatggtcaaggtctcaacattaattcatcaggactcttgggaaatgatggtgtctattag

SEQ ID NO: 81846 - DNA, 1023 bp, Glycine max
  Peptide Sequence Number=SeqID_198624
atgggattaatccctcatcaactaggaaacctctcaaacctgcagcaccttaatctgggatacaattatgctcttcagatagataaccttaattggatatcaaggctatcttccttagagtaccttgatttgagtggttcagaccttcataaacaaggtaactggcttcaagtactgagtggacttccatctctttcagaactacacttggagagctgtcaaattgataacttaggaccaccaaaaggaaaaaccaacttcacacatctccaagtccttgatctttcaattaacaatctcaatcagcaaatcccttcatggctatttaatctcagcacaactcttgtccaacttgatttacacagtaaccttttacagggacaaattccacaaataatatcaagccttcagaacataaaaaatctagacctgcagaacaaccagctcagtgggccacttccagattcattaggccagcttaagcatcttgaagttctaaatctcagtaataatacctttacttgtccaattccctcaccatttgcaaacttgtcattcttgagaactttaaacctggctcacaaccgactgaatggaaccattcctaagagttttgagctcctcagaaacctgcaggaactacgtttgtcttggacaaacttgttcctcagtgtcaactcaggatgggttcctccttttcagcttgaatatgttttactgagctcctttggaataggtcctaactttccagaatggctaaaaaggcaaagttctgtgaaggttttgacaatgtctaagacagtgctgaatgttgccaataactcaatttccggaacaatttctccctttttatgtggaaaggaaaatgctactgataagttaagtgtgcttgatttttcaaataatgtcttatatggtgatcttggtcactgttgggtgcattggcaagcattggtgcatttgaacttgggtagtaacaatttgtctggtgttattccaaactccatggggtatctatcttaa

SEQ ID NO: 81847 - DNA, 807 bp, Glycine max
  Peptide Sequence Number=SeqID_198625
atgcctcacgctttgttttatccagtcggcgaatgtgatgagccaaacaggagatctatccagcaaattcaacagatcaagcacggaggtggagcaatgcgtgaatgcactcttttaattctggacgatgatgccaatgctgccaagatcatcgccagtgaagctcaaagcctgggatttgaagtccgcatatttgatgatgccacgcagttcatcgaagcgtccctgactgaaaaaccctctcatttagccatagatatcatcatgcccggcgttcaaggcatgagtctgctccagaccctggcccaaaatgcctgccagtcctccattatgttaaccagtggcataggctcagacatcttaccggcagcgcaactcgctgccatcgaacagaatcttaatatacgcggtatattgcaacgcccttttcaccagcacattctcagaaacatgctgtcggatcaggtatccatagatttgcatgctcataccagcaatgatgctagccaccaatcttttattgtggatgccaacaccatagatgaagctatccgcaatcatgaattcgaagtgttttatcaaccacagatagacctggtcacaggcaaggtgatgggatttgagggcttattgcgctggcggcatccggggctgggaatcaaactgcccgaactgtttattccgattgcagagaaaaccgggcagattgagcaattaacccaaattgtcgttgagacaggctttcactttattcgctcacttgggaagtcgctctcgttttccttgaacattcacccaaaaccttaa

SEQ ID NO: 81848 - DNA, 618 bp, Glycine max
  Peptide Sequence Number=SeqID_198626
atgcaggtggctcaactgaaggagctctcaaaacggcctgatatatatgaaatactgacaaattcattggctccaaacatctgggagctagatgatgtgaaaaaaggtcttctttgtcagctttttggtggcaatgctttgaagttagcttctggtgctaactttcgtggcgatataaatattcttctcgttggtgatcctgggacaagcaagtcccagttacttcaatacatacacaaactatctccacgtggcatttacaccagtggaaggggaagttcagccgttggattgactgcttatgtgaccaaggaccccgaaacaggagaaactgttttagagagtggtgcccttgttttgagtgaccgaggtatatgttgtattgatgaatttgacaaaatgtctgacaatgcaaggagcatgttacatgaggtgatggaacaacaaaccgtttcaatagcaaaggcaggtattattgcttccctcaatgctaggacttcggtgttggcttgtgcaaatccaagtgggtcaagatataatcctcgcttgtctgtcattgacaacatacaccttcctcccactcttttgtccaggtttgatattgcacaaaagctgtga

SEQ ID NO: 81849 - DNA, 1134 bp, Glycine max
  Peptide Sequence Number=SeqID_198627
atgatgggtagacttgcaccattatcagaagaacccatcaatgaagaaaacgaaggctacaacaatagtaactcaaagaaatgccttcagtcatggaggaactggaattggatcaagactcatttttcccttgccttcaacaaaaagtccaacctcaagatcctccttagtgtcttgggttgccctttatttcctgtgcctgtgtcatcttcggcacagtatatcatacaacacttcagggctgcaacagggtgtaggaagttggaggggacagtgaagaatgtgttcacaacagggaaagtgacaatggatgtggtggatgagcttggatccacaagtggtggcattaatttggagaaagggtgctttgttatgtggcaaatggttcctgataagtggcagatagagctggttttgggtggccaaaaggttgtggctggtagcaatggtgccattgcttggcgccacacgccttggcttggcgtgcatgctgccaaaggtggtgtccggcctcttcgccgtgctcttcaggcaaactttattagcctacagggtccactctgcagtgagactgaattgatctgcacccataattgtatcttgggactagaccctttggcagtgtctgctgtattctgtgcagcacaatacatgggggagaaagaaatctcaggcatggattgctttgtgctgaaactctcagctgatcagaaagaccttgttgagcgcagcgacaacacggccgagatgatcaagcatgccatatttggttacttcagccagagaagtggccttttggtgtacctagaggactcttacctgaccaggattcaggcaccagggtctcaccccacatactgggaaaccacaatgtcaaccaagattgaggactatagaattgtggatggtgtgatgattgcacatgctggctcatcgaccgcgttgatcaccaggtttggggacaacctgaaggctggaccatccatcacaaggttggaagagtcatggaccattgatgatgttgcattcaatgtgccagggttgtccttggactgcttcatacctcctcaggaactacagagagattgttcttcagatgatgagctagattggagatcattcacccttgcatag

SEQ ID NO: 81850 - DNA, 1728 bp, Glycine max
  Peptide Sequence Number=SeqID_198628
atgggggtcttgtccataggttattctttttcctcaagtttactcaccaaactcatatttggagtgccacaaaacaatgagcggtgcccttcaaggaggaaggcatgtgttgtgtattgccaagggggtgggaatgtaattaagtcctcctcaggcttgtcttctgtgttgacagaaagatcagcattggttggcacagatcatgcagctgcagttctaatggatgcaggaagcttggtcttgtcacaaaatgggaaaagccaggcagagattttggtgaaggatttggtgccttatgatggaccaacaacattgataggggtggaagatggaataggcattgtcaagtttcttggagggaaaaagtttttcattactggggcaactgggtttctagccaaagtttttattgagaagattctaaggacagagccagatgtggggaaaatgtaccttttgatcaaggcaaagaataagcaagctgcaatggagagattgcaaaacgaaatcataaacacagaacttttcagatgccttcaagaaatccatggaaaatcataccaagcctttatgttgagcaagctagttcctgttgtaggcaatatttgtgaacataatcttggactagatgagggtatatctgatgttatagcagaggaggtagatgtcattgtaaattctgcagctaataccacatttgatgaaagatatgacactgctatcaacataaacaccatagggccatgccgccttatgaacattgccaaaaagtgcaagaagctcaagctctttctgcatgtttcaacagcatatgtcaatggacaaaggcaaggtaggatcatggagagaccatttagcattggagagtgcatagcaagagaaaaatatatatctgaagtttccccaaaataccttcccacattggacattgaaggagaaataaatctggtttcaaattacaaaggggacattgaagacaacttactagctcagaaaatgaaggagattggtctagagagggccagaagatatgggtggcaggatacatatgtgttcacaaaggctatgggagaaatgatgattgacaaattgagaggggatattccagttgttgtaatgcgaccaagtgttattgagagcactttcagtgaaccatttcctggatggatggaaggaaataggatgatggatccaatagttctctgctatgggaaagggcagctaacaggttttctggtagatccaaatggagtactagatgtggtcccagctgacatggttgttaatgcaaccttagctgcaatggcaaggcatggagtgagccaaaagccagatatcaatgtgtaccaaattgcttcatctgtggtgaaccctctagttttccaagacctggcaaggcttctctatgaacattacagctcctcaccatgcattgactcaaagggtaggccaattcaagttccactgatgaagttgtttagctccacagaagaattctctggccacctgtggagagatgctattcagaaaagaggcctcacagctgtggcctcctcaaaggggaagatgtctcaaaaacttgaaaacatgtgcagaaaatcagtggagcaagcaaagtacttggccaacatttatgaaccatacacattttacggtggaaggttagatactcatttaatttcacactcttcaactagtggcaacaatagtagctcaagtttaatttaa

SEQ ID NO: 81851 - DNA, 129 bp, Glycine max
  Peptide Sequence Number=SeqID_198629
atggctgcaatctttgcttccagatgctctcgtgacaaattacttaagtgcattaactacatctggcactggctatgtgcctggaatgagtattgtagccatatggaagtacttgtgcatcataagtaa

SEQ ID NO: 81852 - DNA, 1089 bp, Glycine max
  Peptide Sequence Number=SeqID_198630
atgggcattgcgaagactctggctcaaatcagcgacaactttacctggtcaggcatcaaggatgacgttaggaattttgttcttacttgtgttgactgccaacagaccaaatatgatcactacaaacaacctggtttactatgcccccttctgataccgtctcggccatgggaagatttacccctagacttcattgggggattaccggctttccgaggacacacggtggtgttagtagttgttgatcgctttttcaaaggaatccatttgggtactatgcgcctcatcatacaaccttcaatgtggtcgcaactctttatggagattgtgagcaaacttcatggtatgccacacaacctagtctcagatcgtgatcctctgtttataagtcgcgtctggcagaagttatttaaactgagtggcacgaagcttcgaatgagctcggcctatcaccctcagtccgatgagcagactgaatggtcctataacaccttcactcattcaggaatccagatgactctgtatgagatcactttcggaaaatatcctcccactattcctcagtatattgtgggaacatccaatattgacgttgttgatgaacttctggtcaatcgagaagagatgtttgctagtttacgaaagaagcttcttaaggctcagcaaacaatgaagcactttgctgatgataaaagacgtgatgttagctttcaggcccctgacatacttaatttaatcgcagagctaccatcttcatccatcaacaatgaacccattgtatcgcctttagtaatcctcaacactaaatgggagtccttgaacaacacacctaagcttcgggtcttggttcagtggaatggattgcttcctgatgatgcctcgtgggaatcctgggacgacctcaaagaaaagtatcactttgaggacaaggtgcttttcgaagggcatgggaatgttatggaaggaaaacaacaagcttcactagaaatgcaacaagcagaattacaactagaatcgcaactagcagacatgaatcaaaggccaaagagggtggtgaccaagccacaatacctgaaagatttcgtgtaa

SEQ ID NO: 81853 - DNA, 1018 bp, Glycine max
  Peptide Sequence Number=SeqID_198631
ttttcctcataatacttggagaaatgattctacaatttcatctgtgaaccattcatcagatgttttgtatcctcctacttcagttgctactcactgtcccaggaagaccattcgttacccaacatcaactgctcatcctcatcctcattctcgttctccatacgcttcagtttcccccattatcaaaccaccctctgccatagatagtggttgtagaaacttatttaaagtcactgacagagtgaaatttgatgatatgagtgccagagtgcatcatccatgcaccaattccaggaaaagaccctcaactagttttgttgatcctgcaaaacctaacaagttacctaatatagaagtgaagaaaaacttaactggcatggctgtgcagcaaaacacaagagaagttgaacttgatctccaagtgggtgcaattggtaaatgttgtcagaatgaggctcagaatctaaatccaagaggctttgattcttttaacctggatggtgtggtaatatcaggtcctgtgaaacttagcccaggtgctaagcatattctgaaaccctctcaaaatcaggataactcaacaccggtccattctgccattcctattgctgtgactactgattgtgtcttcctcaaggatgcagatagcaggactgcagatgaaggagacgacatgaatgaggggatcagaacattgcctgatgctcttggatgtgcagctttgctctgtcagatcattcacttcattgaaactttgatgcctcatcaccgaattgaatcagaggttcagcagattaagtcagttgttgatggaatcatgcaaagagttcaaaattataactccctaaatcaacttttttctaaaaaggacaaagcagtgatggagggaccagcagagcgcattgtcatctctgtggtgggaatgagagggttaggaaaaactactcttgccagcagagtatttaacaatgggaaggctggaaaagttgatgagagacttgttgaagaagttatttga

SEQ ID NO: 81854 - DNA, 756 bp, Glycine max
  Peptide Sequence Number=SeqID_198632
atggctaaatcaactcgttcgaaatccaacatggagcgtattgaagaggcaattgccaaattggcttccaatcatctcaatgtctccaacaaacttgatgaactcattcaatgcatctcgatcattgaggcaaatcaacaccaaccctcatccccctcttcctcgtccaccattccctcacctgtaccttccacttcccacctacccaaaatgaaatttgatgttccccgcttcgataggtctgacccttttgggtggatgttcaaaatcaaccagttcttcacctaccatataaccccagaaacagatcgcctcattattgcctctttcgtcatggaaggtccccccattgcgtggtttcagtggatgatgaggagtggtcaaatcacattgtggcataggttccttcaggctcttgaagccctctttgcttccttgcaatatgaggaccctaccggacgatttgccgcaaacccatcatccttgtttccaaccacatcaccttcgaccctacttccaccaccagcaaaactgcctccccttcctcttaaacgattgtcactggaggaaatggcggtccaccgcgaaaatgggttgtgcttcaattgggatgagaagttatctcgaggacaccgatgttccttcaagttcttccttctcattgtagatgccgaagatgtggccgtaggcattaagcctatcgaggaagagctttctccttcaaatgatatttctgacctgcccaggcctaaataa

SEQ ID NO: 81855 - DNA, 1953 bp, Glycine max
  Peptide Sequence Number=SeqID_198633
atgtctcagggagatgcttacaagcgcaagttgcagaattcagtacatagtttcacaaagcaaggcactgttgggaataaaaaggttaaacttgacgacattgatgcttcttctgctcttgaaaagaaattgggtttaaagacattatcagaagaaaataaggaaaaagtgaaaaactgggactcagttggaaagcaacaaaaggtagtagtgtctcccattggcggtattcttaagaatcacaaacacatttatggaagtacttcaattggtagtaatattcaagatggcactgaggaaacccattgtgatgttcaagtgccaccatcagacaagcatgtgagattttctgctgaggattctgtgcttggtccagaaaagagaagctcatttgatgaaaccgtgttcagtttatcttcagatatgccggcttcttcatttggagaggagaagctcactggaaatgatgaaggcactgtgaacttggaggaaaacagaaatggcaacactgccattaacacagataagagaaaggaggtttgtcctatggttgaaagtaaacaattttctaatactctaggacttgttgctgtacaaaatttgttaaagccgtgtaccagtgaagagaaatcaaagcacttagaagagaagtctgaatcattatccaatgtgacgatttgtgataataataatttagaccggtttgatggaggcaacacaactacagtgcatgtttcttcatatggtgacctttctagatctctttcagaacttcaaggggggcaaagttctggtataagtacacaaccgtgtgaatctgaagcttttagttacactgggaagttcattgatcatttgggaggtccaagttttcagtctacaaatgcacacacaaggacatatttggagccttcaccctcttattctgcttcctgtaacgaagtaaataacagacctgaatttccattgcacacatatggaaacgatgataataatggccaagctttgggtgacaggtcgttgtcaggcacgttttctgctgatatgattgataattcgtttctcttgcctggctgggggagaggaagtataaggaataactgcatggagcagaacttttatggtttgccactcaattctcatggtgacctaatcaactttagttcaagtggaaaaattgggatgaaccagcctgagacatcatgtacattaagaagttctttaagtggcttacctgtgaacaatgttatccatcaaagtagccaggaatgtttaagcattggtaagaggcatgttgttcagaagacacttcaagatagcgtaaatccatttcctcactattcaggaaggttaggtgttagagagttacatggaagggagagaggagatatctaccagcataattctggttggtgttcaaatcactatgtccagccacttgattcagagttgaacctcatgagaaaccctttcattgaacagaatcagaatcagaatcaacttgaaaaggtgccaaatcacgaggaatatggaatggtttcaccaagaggaagctcaggtcttgtttcaccaagttgcagccaaccaacaatgaggttgatgggtaaagatgttccgattggtagaagcagcaaagaaaagcaacaatttgtgggaggagttctttgggctgaagaggaatccagaaggcattattctgtagatgctgctagggacaattctttgttaggaagatgctacatgccagattcagcatctggttctcaattacagagacaaactgagaatgtgtttcaatcagtgaaaattctaagcaaacaggcattacaaagtaccttgttgatgaatggtccaaactctgaatttcttaaccagcgaagtaatcatatatctcaaaatggaagccttggagtcagcagaaatgctagtactaatttgcatactatttcccaa

SEQ ID NO: 81856 - DNA, 795 bp, Glycine max
  Peptide Sequence Number=SeqID_198634
atggcaccgcattctaaaaaaccgcagaagaagaagaagaagaacgactctgtagacaagccgaaaatcgataaagcctctaagaaaatattcaaaccaaagaagagggaacaaaatgacgccgtcgtcgcagctaagtccgaagcactctctctgcagctagaagacgaggttcccgattttcctcgaggcggagaattttccgcgaagggaaggagtgattacgacgagtttagcgccgaggatccctcgaggaagacgaggaagaagaagaaggggagaagtgcgtcgagtaagagtaatgaaggcgcagatgactggggctcgctttctggcgacggcatcaccggaaaattgccgcggcgtgtgaatagaattactctcaagaatataactcctggaatgaagctttggggagttgttgctgaagtaaatgagaaagaccttgtagttagtttaccagggggtttacgtggtttagttcatgcttcagatgcagtggatcctatttttgatgacaaaattgagctggtttcttgtgttgtactgagattggatgatgacaagaaagagaaaggaagcaggaaaatttggctttctttgcgtctttctttgttacacaagaactacaacttggatgttgttcaggaaggcatggctgaaaatatatatattttattaaaaggtaaaccagtaccagtggtaccaaagattaaaattacaaagcaccaaggtgctatcctccaagaaaaccatcaacaaaagcaaaaaacaaccaggcccaaacccaactag

SEQ ID NO: 81857 - DNA, 1078 bp, Glycine max
  Peptide Sequence Number=SeqID_198635
ggactacacttccaagatgaggtccgtcgacgttttcaaatgctggccattccccgcagccggactcagccgcaaccaggtcgagtcccggttgcctcctatgagtactccaaagttgcggcggtggtcggatgagctcgccgaactgagatccgacctcgctggcgctggaggaaccgaagaaaggttgaatcaacggtacgagagcgaatccgagaaagaggaagaagataaggtggagcttgtttgccccgtgtgccaagatttcaacgcttcgacactgactgcggtgaatgcgcatatcgacggttgtctcacgcgaactgtgagggaggagcggcagtggatgaggaggtcgaaatcgaaggtgccgaagaggcgctccatcgcagagattttcgagctaaaagaggacatggaagaggagaaaccgctgctgccggagatcgatacggagcttaaacgtttgccgtttgatgaggtttcgatcatggtgacaaagtttcggtggctctcggagcggctcgagaccttgagatccaacggaatttcgttcgattcggtgaaatccgtcgtaggaaactcgaattccacagcagaagaggaggaatcggagatgctttgtcctgtttgtagggttttcaactccgcaacggtgatggcggcgaacacgcacatcaacggttgccaggcaaccgcgatgaagaataatgagttgtgggggaaaccgagtttaaataatccaaagccgaaagagccgaagaagcgttctctcgccgatattctcaccgtcacgccgcaaatcgacggcgacggaaaactcttggtggaggccgagaaagacgacgaagagatcggagaagagttcgagaaacacggtttctccggtgctagaatcaagagcaagaagagtacgaacaacaacgtgacgaagaagagaaagttgaagaaggttattatgaggaagaaaaacaaagtggaaaagtgtggtgttgtgactctaaacgaggaaagtaagaagataaacaaaaagaggaagaagaaaaaaaagctaaacaaggagttcactgcgaagaag

SEQ ID NO: 81858 - DNA, 369 bp, Glycine max
  Peptide Sequence Number=SeqID_198636
atggcggtcgtggcggttatggcggggtggcggaaaatggcgttttttttttgctttttgtccgcggtaggagttgggctgacccgacccaaccctacccgaacaaccttccatctaagagagaacccaaccgcgagcctcccctgcaccagccgcgtccctcccgcaccccacacgcgcacccagccgcgacacccgcagccgcacgcgcacgcagccgcgacgacctccggcagcgacgcaccggcacaaacggcggcgacgagctccggcagcgacgcacctgtcacgaacggcggcctgcagcgagaagttctcgcggagaagacgaagctgtcgcgaagaagaagaagacgcaggttttcttag

SEQ ID NO: 81859 - DNA, 801 bp, Glycine max
  Peptide Sequence Number=SeqID_198637
atgaatgatatggaaatgaagaaattagtcaagagtaaaagaattgaatatggaactaatcaattgggttgggtgggggatattaataaatgctcccaaaatttcttcatcgaggacaatgtagcgacaaacaagcttattgaaagatgcataccgattggagcaaatccaagaaggtgtcagatgtgggatcctctaatcaataagtgtgagagaaaattagcaagatggaaacaaagacacctgtctttcagggggagagtgactctcatacaggttcccaagaaggtggtggacaagctagtatgcttacagagaaaattcctatggggaggaggtgctgatcataacaagatagcctgggtcaaatgggacacagtgtgcttcccaaaggacaaaggagggttggggatcaaggatgtgaacactttcaatcttgcgttactagcaaaatggaagtggcacttatttcagcaccaagggcaactgtgggctagggtattggagtccaaatatggtagatggaggggtctaaatgaggcacctagaagtagcacagaatccatatggtggagggatctgaagatggtatcccatcatccagagcatggcgaagcattacagaggagcacggcctggagggttggatgtggtgacagaattaagttttgggaggatgattggatcagagacaatagagcactagtagcaaaatatcctaggttgtacctcatatccaatcagcaaaatcatactattcagcagatgggaggacataaggacaaagggtgggaatggtag

SEQ ID NO: 81860 - DNA, 768 bp, Glycine max
  Peptide Sequence Number=SeqID_198638
atgctggtaaatgcccgtgtgaagtcaatccttgagaatggtgttatgttatcatttctcacatacttcactggaactgttgatctgtttcatttgcaaaatatttatcctggaacaaactggaaggataagtgcagtgaatctcagaaggttgtttctcggatattattcattgatccatcaagtagagctgttgggttgacgctgaatccacatcttgttcagaacagggcccccccttctcatgttaaaattggagatatatatgacaactcaaaagttgttagggtggatagaggattaggactattgcttgaagttccatcaattccggagccaactccagcttttgtcagtatatctgatattgctgaagaggaggtccaaaaacttgagaagaagtacaaggaaggaaatcgtgttcgagttcggattcttgggttacgatatttggaaggaattgctacaggagttttgaaggttgtcattgctagtgctttagaagaggaagtgtttactcattctgatgtcaagcctggcatggtggtgaaggctaagattctttcagttgacagctttggtgctatagtgcaaattccaggtggtgtgaaggcactttgtcctcttcgacatatgtctgaattggaaatttcaaagcctggaaaaaaatttaaggtgggagctgaattggttttccgtgtgcttggttgcaagtcaaaaagagtgacagttacacacaagaaaacgcttgtatgtttctacatgtga

SEQ ID NO: 81861 - DNA, 270 bp, Glycine max
  Peptide Sequence Number=SeqID_198639
atggctaattcatccatgaagtttctcaacatgatagttatctttcttgtccttatttctcaaggcaatagcattactgaatgcaccttgagaagtctctctgtaagtcaatctatgacaggagttaaagtgcagggaaagccagaatggagtgtttctatcaccaacacatgtccatgtgctcaaaggatggtatacttgaattgcaccgattttcaaaccagtgaacctataactccttctgtcttgactgtctcacctaatgcctga

SEQ ID NO: 81862 - DNA, 261 bp, Glycine max
  Peptide Sequence Number=SeqID_198640
atgttggatgctcctgaacccctgaaactcctgcgtcacatgacagtcttaaggcgatctggccctccattgcaatggaaagttgaaaccctgaatcctgctattggtggaaaaggcgttgttcaaccatggtacgattttcttgaagaaatggactttgatgatggagatgaaatctctatttactatagatattatgaaaaaatttgggatattataattaaaaggcaagagaattgggaggatagtgacaacaactag

SEQ ID NO: 81863 - DNA, 2181 bp, Glycine max
  Peptide Sequence Number=SeqID_198641
atggggacaaggtttgatgtggagaagtttacaggggaaaatgatttcagcctgtggaggatcaagatgcaagctcttcttgttcatcaagggcttgatgatgcactacaaggagcctctaagcttccatctacactgtcagacaaagagaagaaagatttgctcaataaagctcacagcacaatcattctttctcttggtgatgaggttcttcgagaggtagctgaggagaaatctgcagcagggatttggctgaaacttgagagcctgtatatgaccaaatccctagctaacaagttgtacctgaagaaaagactacatcagctgaagatggaagaaggttcttctatcaaagaacatgtttctttgttcacaaaggcagttcttgatttgaaaagtgtagatgtgaggatagatgaggaagatcaagcagtaatgctattacgttctcttccatcatcctttgaaaatttggtggacactatgctttttgggagagatacactcaccttggaggaggttaaaactaccctgaattctcgagaattaaagaaaaagataactgaaaataaaggtgaaggtggagatcccgaggcattgatggctagaggaagattagaaaagagggattcaaagagcaagaacaagaggaggtccaaatccaggaacaagaaggcctgctactactgcaagaaagagggtcatttcagaaaagaatgccctgaaaggaagaagaagaacaatggtaaatacaatgatgaatctgatatagcagtggtggctgatggatatgaaagtgctgaagtgctctccatctcaactaaaaagcacagtgaggaatggattctagactcgggttggtcattcaatatgacacccaatctggaatggttcagctcctataaggagatagatggagggaaggttctcatgggaaacaatatggcatgtaatgtcattggcattggaactattaaattgaagatgcaagatggatctgtaaagctgctccctgatgtgaggcatgttcctaagcttaaaaggaacctgctctctttgggaatgctagatcaatctggatgttcattcaaaggagaaggtggaactttaaaggtattcaaaggttcattacaaataatgaagggtacaaggcagaatggcctttacaaactgcaaggtaacactatcttgaactcagctggcctagtttctatctctgaaccaaatgcttccaagctttggcattatagattaggtcatgtgagtgagaaagggctagaagaactacataaacaaggattgatcggtaatgggaattatcaaaagctaagtttttgtgaacattgtgtatatggaaaacaaaatagagttagtttccataatgcaactcacacaactcagggtatcctagattttgtacactctaatgtttgggggccagccagggtaccttcattagaaggagcaaaatatttcataactttcattgatgattggtctaggaaagtctggacttatctgttgaaacataaaaatcaggcttttaagtgtttcaaacaatggaaattgcttattgagaatcaaactggtaggcatgtgaagctgctcagaactgataatggccttgaatacttaagtgaggaattcaatgaattttgcaaagacaatggaataagaaggcacaaaactgttagattcacccctcagcaaaatgaccttgctgaaaggatgaacatgaccattttggagagggtgagaagtatgttgtccaatgcaaaattggcaaagattttttggggagaggctgtgaatacaacatgttatctaataaacagatgtccttcaagtgcaattgaattcaaaacaccagaggaaagatggacaggaaaagctccaagctatgaaaacttaagaatttttggatgcactgtatatgttcattctaatgaaggcaaacttgaacctagagctaagaagggaatcttcttaggatatctggaaggagtgaagggatataaagtgtggttattggatcctgcaggtcccaaatctattatcagcagagatgtcttgtttagagaagaagacatgatagcagattatcaacagaagtctgattcagttcaaaagggtgttcaagctgagcaaaacagacactctgatcaaggaattaggttggag

SEQ ID NO: 81864 - DNA, 375 bp, Glycine max
  Peptide Sequence Number=SeqID_198642
atgcaagcgcacacagcaagaatgctaagaacagaggtggtaaagaaagagcaaaacaacaagaatattatcgtggttcagggcaatttgagacccctacatccacattgtagccgattctttcttcattacttgatcacaactacacagcatacaacagcaaaacttctagggaaactgcctgatcatcaagttattctaaagaagggtgttcttgttatgtttgagaaaaatctagatatttcacttggtctttgcaatggaacaaggcttattgtcaatgaattagattttgtggcaatgaatatttgtgcaatcaagacaagtcatctattgatggttacttatattgattatatgcaatgtttactatga

SEQ ID NO: 81865 - DNA, 527 bp, Glycine max
  Peptide Sequence Number=SeqID_198643
atgctgcggtggtttccggccatgggactgtctcaaccccgttattctcacaaaatggacaagtattttacttcctaaccctagaagcattcagtgtaggacgcaatagaatagagtttggaagccctagatctggtggaaagggaaatatcataattgactcaggtacaacgctcactgttttgccaaatggtgtttactcaaagttggaatcagcagtagcaaagacagtgaaattgaagcgtgttagggatccaaaccaagtgttgggtctttgctacaaagttacacctgataaactagatgcaagtgtaccagtgatcacagcacattttaggggtgcagatgtcactttaaatgctatcaacacctttgttcaagtggccgatgatgtagtgtgctttgctttccagccaactgaaactggtgccgtctttgggaacttggctcagcaaaacctcttggttggctatgatctccaaaagaacaccgtgtcctttaagcacacagattgcactaagcaatga

SEQ ID NO: 81866 - DNA, 1914 bp, Glycine max
  Peptide Sequence Number=SeqID_198644
atgaacagtaccattttggagagggtgagatgtatgttgtccaatgcaaaattggcaaagagtttttggggagaggctgtgaatacaacatgttatctaataaacagatgtccttcaagtgaaattgaattcaaaacaccagaggaaagatggacaggaaaagctccaagctatgaaaacttaagaatttttggatgcactatatatgttcattctaatgaaggcaaacttgaacctagagctaagaagggaatcttcttaggttattcggaaggagtgaagggatataaagtgtggttattggatcttgcaggtcccaaatcaattatcagcagggatgatttgtttagagaagaagacatgatagcagattatcaacagaagtctgattcagttcaaaagggtgttcaagctgagcaaaacagacactctgatcaaggaattaggttggaggtggagaagcttgcacaaacatcaagtccagtagaggacagaaatgaagcatctcatgatgaacctatgatttcatcaattcctaaacctgttgatacttcatataacctgccagcaaagcagaaagttgtagggtgtaaatggattttcaaaaggaaaccagaagaaacaggaatggatagctacagatacaaagcaaggcttgtggctaggggtttcacacaaagagaaggaattgactataatgagattttttctccagttgtgaagcatacaagcattagaatcatcttggcactagttgcagttcacaaccttgaattggagcaaatggatgtaaaaacaacttttttgcatgggaatctagaagaaacaatctatatgagtcaacctgaaggatatgaggtaaaagggaaagaagagatggtatgtttgctgaagaaatctctgtatggactgaaacagtccccaaggcagtggtacaaaagatttgactcttttgtagtgtcaaatggtttcagcagaagttcctatgacagttgtgtctacttcagaaggttaaagcctgattgttttatctacttattgctctatgtagatgacatgttgattgcaagtgcaaatatggaagccatcaaagaattgaagaatctgttgcaattcgagtttgaaatgaaggatttaggggctgcaaggagaatactaggaatggatattatcaggaaaagaaatgaaggtctgttatatctatctcagtcaagctatgtgcagaaactattgagaaggttcaatatgcttgattcaaaacctgtatcaacacctattgctggacattttaaattgtcaatcactcattctccacaaacagaagatgaaatcaaatatatgagtagaatcccctactcgaatgctacaggttcacttatgtatgctatggtttgtacaagaccagatttagcatactccgctagcattgtaagtagattcatggaaaatcctggaaaacaacactggagtgtcgtaaagtggatcttaagatatctaaagggttcaaagtctattggtctggtctatggaagaaattcagaaagaatcaatggtctgtcaggctatgttgatgctgattatgcaggtgacattgacaaaaaaaggtccttaacaggatacttattcactttgtatggaagtgtcataagttggaaggctaatttgcaatcagttgtggctctatctaccactgaggcagagtatatagctctcactgaagctataaaggaagccatatggcttaaaggtcttgttcatgagctcgaaggaaagactgttcctgttgaagtatggtcacaaggtgaagttgaagtgaggaaagtggctggagcaaacaatcctgcagacatgttgacaaaagaaggagagcttgctggtcctaatattgaagatccaaggtggagattgttatga

SEQ ID NO: 81867 - DNA, 333 bp, Glycine max
  Peptide Sequence Number=SeqID_198645
atggagcaagagagtctacttaaagcttgggaaagattgcaagagatgatcagaagctttccacaccaaggcattactcaacaaaggcaaccgaacaaccttccttcacagcttgagccaaatcctaagaaggaggatgtcgatgatgtgatgactagaagcaagaggattcaagaggactctgaggagaaggaaggttcttcttcaaaagttgcagatgacgtccttactaaagaggaccaaacacttgagaaaattgaggatcctactaatgggaacccaataccaaagaaggaaggggaagaaaaaggaagagatactaacatctcctaa

SEQ ID NO: 81868 - DNA, 648 bp, Glycine max
  Peptide Sequence Number=SeqID_198646
atgtcacgctcttcatctctggctcttgttttgctgtgtctttacaacctctctttcttagaggcaatcaatggtgggtttagtgtggagatgatccaccgtgactcatcaagatcaccattctttcgtcccacagaaactcgattccaaagggttgccaacgccatgcgtcgttccattaaccgtgccaatcatttgaaccaatcttttgtctttccaaactcacctaagaccactgttatatcagctctaggtgaatacctcatgagctattcagttggaaccccatcactccaggtctttggaattgttgatacgggtagtgacatcatttggctccaatgccaaccatgtaaaaaatgctacaaacaaatcactcctatatttgattcttcaaaatccaaaacatacaaaaccctaccttgcccttctaatacatgtcaatctgttcaaggtacctcttgctcctctaggaaaaattgtttatatagtattgattatgcggatgggtcacactcacaaggagatcttagtgtggagaccctcactttaggctccaccagtggctctccagtccaatttcctggaactgtgataggatgcgggcgtgacaatgctattggctttgaagagaaaaattccggcatc

SEQ ID NO: 81869 - DNA, 1365 bp, Glycine max
  Peptide Sequence Number=SeqID_198647
atgtcggttaggattcgaaagtgtttttttggtctatgtctagaccaggaggttttaccaagcatggagcttcctacaactgatgtggaccttgagcctaagaagattgaacctgagaaaaacgaaggtcccttgttccattgtgatttttgtgatacagaagtagttcacaagctggctcaaatgttcctgccaggactagcctgtgcctgtgttgataacaccacaggcggtcccttcaagacccctggttcagtggctgttgatctgagaaaggaaatgatagaatttgtcacccaaaagagcgaatcgtttgttgctgagtctgttatcttagagggtggtcctgatggcggagcattggaacacccttttgatatcatttgctattttgttgatgagtttgttagttcaaagaggaatttgttgagccaggtttcggggtggctgctgagtgataagagagaggacaaaatagacgattttgttcaggagatggaaatgaatggtttttggccgctggatagaagagaaacacttgcaaaaactttgatcaagaatgttgacgtgaagagctcgtttcattgcagcatgagttttaaatcggcacgagatcttgccaaccatgctgacgatggttgcaacttcaggcctgtgatctgccgaaatgaagggtgcgacgccagattcagtgctggtcatttgaaggagcatgattcagcttgtgatttcaagatagttccatgtgaacagaagtgcacagatagcattttgagacgcgagatggataggcactgcataactgtttgcccaatgaagcttgtgaattgccctttctatgcagtgggttgtagatctgctattgcacaaagtatgattagaaaacattgttcagatgacatcgagtctcacctgttgctcatgcttaaaggcatccaccaggaggcatcaggcgaagatctaaaacgacgtgtggagcaaattttacagactacttcatttttaaagctaatcatgagctataatgaatcaaaatctgttgcttggttgactggtatggcgtcatcaagaagcaaattagcagaggctcgggatgtgagatcttataaaaatattgtcaaggaccttgaagttaagctagggcctcttgaagtgattgccaaagagaaaactagtgcagaaactgttgccgagaatgaagatagtgaagacaatagaaccaaaacaaaagacaaggagcagcacacacaaactttgaattcattggataaagctgaagtgagtgccatcttggaaaagacttgtgcagggaatgctgtcaataaagtggatagtgaacataaggaaaatggaaagcaagggtag

SEQ ID NO: 81870 - DNA, 369 bp, Glycine max
  Peptide Sequence Number=SeqID_198648
atgcttcgatattgtgcatctcaagtcactcgcattgaagcaagaagtgaaaagtttgacatgtttatgcacctggacattaattccgagatatatccgttaaaggttggtcagaagtttgctcttgtgcttgtttcaacacttaatcctgatggaactccagacactggatattatacccagtttaccatttcgttaagctttttctgtgactgggagcttttatccttcatcatcagcttggaattcaaattagaacttgggttaatggtgagcatagacatggttgatgtgacaagcctcaagagtggtgtgattcaattcatatgtggaccagtggttatttgcagtgaaatgacactagcttaa

SEQ ID NO: 81871 - DNA, 195 bp, Glycine max
  Peptide Sequence Number=SeqID_198649
atgcttgccaacactgaagagtacattgagggacaatttactggaaatttgggagagattttgaacagttctatttttactcttgcctctacaccatactttgttagcggattgctagaagagttaggcattatatttcttagtgatataagagacccgaccatcgaaaagtgcaataacatttcttcagactaa

SEQ ID NO: 81872 - DNA, 300 bp, Glycine max
  Peptide Sequence Number=SeqID_198650
atgtatcaactgtatgattttcttgagttgatccgttcactaacgtctctacttacggatcaacataatacccaagcggatcaacctaactccggcaacaatgaactaaaagacatggttacaacgcttacctcgacagtggatggtgacgaagctccctcgacggtgaatggtggcattactcttcacggaaacctcctcaatgcacctcacggaaacctcttcacgacaagctcctcttcacaacaacaatggtggctgaagaagaagaagaacctcttcccggcaacctcctcttaa

SEQ ID NO: 81873 - DNA, 253 bp, Glycine max
  Peptide Sequence Number=SeqID_198651
gtgcggtgaaggtgaagctatcgatgttgagcgttgcggtggtcgtcgctagcatacgagatatgcagatggtggtgtttgacggccgagaggatgttttgcggtgggctcaatccgttgctcatgaaaacagatttgtggtggtgattgtaaggaaaaaagaatttatcagagacactgggactaagaaatgtggttgtcccttcaagcttcgttgcaagccagtggttggaggagaaggctggatgatgaa

SEQ ID NO: 81874 - DNA, 771 bp, Glycine max
  Peptide Sequence Number=SeqID_198652
atggattgttttcagctcgctaacatagtatggggtgaggcgggtgagagtgatgatcatattgtgccttatccggaggcaagtgaagatcttaatgacaagaaagaatggaatcaggaagcttctgctactaaactgattgagcagaggagaatagaggctaaaactgattttcatcaaggaaagctaggaagcagttccaaacttgatattattgagggatcttctgcctcagaatctggcacaaagtcatggcctgacttatctttatccaatgcagctaaaactgatcagggttccctgggtgcagaagtatctaaaaatttagaagagactacccagcttgaaaaggatgtagaaaagcaaggtgattttgtcaactatgcctgggataacataggaagctttgatgatcttgatcgaattttcagcaatgatgaccctatatttggccatgtaagtcttgagaattctgatgagctgtggtcttccaaagacgtgagtaacagtgcagtacccatactcttggaagctccaaacccaacaagtgctttaagcaacagatctgagcctttggaaattaaagcagaatatgttcaacagaatgatcaatcattttcccctagatttaagaagattggcaattcttcatctcatgatattgcgaatgctcctgcaaacacattcaatgtaggatatgatagagatagaattgccccagctgataaggagcaacaggtatgtcaagccatattggagaatgaccagtga

SEQ ID NO: 81875 - DNA, 609 bp, Glycine max
  Peptide Sequence Number=SeqID_198653
atgacttataagagagagttctggaaggaggatgttgattgggttgatcgcattcaagattttcaagaagctcttcacaaatgcaataaagaagtccttggtaacatctttaaccgcctcaatgatactcttatttctctcatcccaaagatagaccctgtggtgaacatgatgcattttaggcctatcaatttatgcaatgtctcgtataaaacagtgacaaaaatcctctctgcaagactgataagagttatggaagaattggttgacccttatcaatgtagtttcataccgaatagacatattgggaataacatcagcattgctcaagggataattggattgccagaaatttttattagcatggtgctttggaatggagaggctcttgaaaaactcattccatctagaggagttaggcaaggagatccaatctccccctatctctttgttctttgtattgaaaggatttttcacttgattaactatgatgtgaaggaaaaaatgtggaagtctattcagttgtcaagaagtgctcctaagctatcgcatctagcctttgcaaacgatcttctccagtttcgcagaagctattgtggaacaatttga

SEQ ID NO: 81876 - DNA, 852 bp, Glycine max
  Peptide Sequence Number=SeqID_198654
atggtagaagaatccggttctgtgaggattattgggtccctggttgagggaatcttagacaacaatctggtgcgcttttttgttaatgcaaatggagtctggaatgtggagcagttatcttctgaactgcctctagacatagttcagaaaattctgattatgaaacctccttgtagctctaataatgattattatttggaatggaatgattcttctgatggaaaattctcgactcgtgagacttatatcggcatattgaatcgttgttgcatgctctgcgagattgtaattactgggcaaaacaagtgtggttatcttttagtatctctgataactctgtttttccagaacaacttggacaaaggtgatatgaatctgaatgtggagtctaactgtcttgaggcggtgaagctcttggatgatgtgagcttttctggaaaccaatttgaagagcttctgttggagatttcgaaagttaaagctccattcaagcagtgtgttatagtgcacatcagcaaagaagctagtcatttagcttattcttttgccaaatttggcttatctgagtcttctgatgtttgcttttgtaattcagtcccttcctttgttgtgaactccttaatggaggatgttgatgtaataaactcccaattggagagatgggaaattgggttggatgtttggcctccagcagtggcgagggacggcgacttggtggaggcaaagatggttttgcactgcaaccttggtcgggcggatccggacgccattatacagtcatacccttgcatatgcaaagatgtttctggatttgaatccatgaccaaccggtcaaaccagaaacatacataa

SEQ ID NO: 81877 - DNA, 1746 bp, Glycine max
  Peptide Sequence Number=SeqID_198655
atgacaaatgatttttacatgtttcttggtttgagttgtttattttctgcgtgttctttcaatagaaatacacttctgttgtgtcgtcctatcctatggaatgattttgggcaaaataatcagttgaaagctcggaaaaaatcacaaggtaaacaagaggtaaaagcattgcaggagttttatggtagctggtctccttcatcaactacatgtggacaatttcagaatcagcagtcttcagtcatacagtcttctccctcttcaattcttgggaaacggaaccagcttcaaggacctgagacactataccaggacatcagaaatacatatgtgacatcctctgcatatgagaaccttacaaatacatattcttctatgtcaacgctaccacaagcacagtcaggagttcttatgcgacagcctctgctttctgggtatgaagcatctcttggtgttatgaatcctgtgagcaagtctgtggacttagttaagcctcttacaatgactccccaggaaaaaattgaaaaattgaggaggcggcagcaaatgcaagcaatgcttgctattcagaagcaacagcaagaattcagccatcaatcaactttgtcgctcggccctgatcctgaaattgaagatttaagaacaactctagatccaccaactgagcaagatgattctaatacaatctctctggcaattgatgatctttttgttgaagacaccatactgtacatgcttcaggatgttatatcaaagttagatgtcaacataagactctgcattagagatagcttgttccggttggctcaaagtgctatgcaaaggaattatgctagtgatacaagcagtacaaacaacagtagcagagaagaacttaaagttgctgcaagagaagaaagaagtagccaaaacagtggaaaaactcagaatgttaagtggtggcaattcaaaggtaataaacatttgaactttaagaagaagttgttggaggaagataatgggaaatcacaaagtagtactaacctcttttgggatgggatgtctaaaaagtttggaagatatgctaggattgctgatgttgaaaccaagacaaatcccatcgatcgaactgtagctcatttgctctttcataggcctttggatttaactgggaattatcctgataagcttgagtcacctatttctgctaagatacaatatgaaagcaaagaagctaacctcgagaagtttcctatgggatgcttgccagatgaggacatgaaaagtaatcaacaaatttctccccaagtgcttgaggcccagcctcaggaccaatttaaaaacagtcattgcagagactcctcagagaatgcttctaacaatgatctagctgatgctggagatcaggtttatgtatgtttctggtttgaccggttggtcatggattcaaatccagaaacatctttgcatatgcaagggctgaaatgcgtgagaacaacatgcaaaatgattctcgaagcaatgacactgccacactggtgcccttgtcacactaaccccgaccaaggttgcagtgcaaaaccatctttgcctccaccaagtcgccgtccctcgccactgctggaggccaaacatccaacccaatttcccatctctctccgctcaacaattcacaactttatgatgttcgagacttgtaaggatgaagcaagtggtgctccttgttctgtgctttgttctcatctttggttttattttttccattga

SEQ ID NO: 81878 - DNA, 417 bp, Glycine max
  Peptide Sequence Number=SeqID_198656
atgacattgcgcttagcgccaccctcatgcttagtgcgagtaaagggatttgagcttagcgccagatccaatgcaaagttggcccctaattactatggcccatttccagtagaagacaagatcggtgttgttgcatacaagctaaaattgcctcttggatcaatggttcataatgtcttccatgtttctcagttaaagaagtttaatggtactactactgctgggaactttagtccttcacctttattggatacttctcaaaaggaacctgcagctatcatagacaaaatgacagtcaagagaggaaatcgtgttgtaaccaaagttttggttcaatggaaacatcaactacctgaagatgcaacttgggaattcttttatgacttgaagcagaagtttcctcactttaatccttga

SEQ ID NO: 81879 - DNA, 207 bp, Glycine max
  Peptide Sequence Number=SeqID_198657
atgttctcgttctcggtgctccggtcaagctttctttcctattggttacggttctcttgtctcggtcatctcattttatggtttcagcatatggctatggttcagatacagactaaagactttctttcgtgctttgatctcaggggaaatccaacagaactcaatgaaacaaacgaattcgatacatcggaatttaaccctgtctaa

SEQ ID NO: 81880 - DNA, 603 bp, Glycine max
  Peptide Sequence Number=SeqID_198658
atggaacatctagaaaaatcctatacatcaagtcttaagtttgaccttttaatgaaaaatgagccataccgagtagtgcactatgtggagattgtggcaggggtcgaagggtcagaggagttagatttggactcgagaaccaatgatgacaataggctagggagaaatatgaaggtatatgtggatgacatggtcgtcaagttcgatgacttattgacacgcattaaggatttggaaggaatacatgcaaaccctgataaatgtcaagccattttggagataagaagtcctaagaacatgaaagaagcacaaaggttggttggtagaatagccttcttatctacattcttgctaaggatccccaagagggctaaatcgattatgaatcttcttaaaaagactaaaaactttgaatggaatgatgggtacaaagaaacatttcggcagctgaaggttacacttatgatccctccagtgctttcaaaacctagcactaacaagagactcatagtatacctcttggtcttcgctgaagccataagtgcagggccgaccaatgataaagcaactaaagcccttgctttaggcctccaaaagaattag

SEQ ID NO: 81881 - DNA, 126 bp, Glycine max
  Peptide Sequence Number=SeqID_198659
atgaagcattacttgagctgggcacaggctttggcttcagcatggggattcatgttggtggtggctcttatgtgttgttgcctcagcaccaaaccgagacaagatagtgatattatctctgtataa

SEQ ID NO: 81882 - DNA, 459 bp, Glycine max
  Peptide Sequence Number=SeqID_198660
atgagaacctcattactccccctcagcacaagcaaatctcacatactggatcaaggcttggccatcgaaattctagccatgccaaaaagagccaacactctacccaaggttgatttctccaaacgttgttggtatcaccgcaatcgaggacacttaaccaaagagtgcagtatcttgaaggacaaggtagagaacctcatcaagttgggatacctatggattttatccacaagcatcaattctatcagcctcacaacaactataggcaagatcgagacagaggaagaaagagggattgcaatcaccactctcaaactgagagacgtagaagccaaatacaatatagagaaagggagaaaaaaatcccttaatcattcgagacatgtcatcagcaccattgtagtaggattcaccggaggaggagcaatgccctcagcccaaaaaaaacatttacgatag

SEQ ID NO: 81883 - DNA, 99 bp, Glycine max
  Peptide Sequence Number=SeqID_198661
atggaatgcaatgtcactacatcccctaaatcagcgagagatacaactctacatcccaaagggatacatttgtcagaggagtgggaagacggaaagtaa

SEQ ID NO: 81884 - DNA, 354 bp, Glycine max
  Peptide Sequence Number=SeqID_198662
atgtctgtatggtgcgcaacccacccgtttggatcgagaaaagaagcttaccacttccatgtctacccatgtgtagcctggaaggggtcaggggaatccggctctacctccccgactttcggagaaggaggcctcagaatctcatcggtggctgagaagtcgctagactccccattgccgatgaaagacgaatccacttttggagtagaagctaaagaaattgtaaccgagatgaaggtgttggaggacacttccaacacctcctcattcaacccccgaacctcaaagtcaaccccttcagtctccctcgacaaagcatctgccaaaatcactattactaaaagggttggttaa

SEQ ID NO: 81885 - DNA, 1071 bp, Glycine max
  Peptide Sequence Number=SeqID_198663
atggagaaagtggccttagcatgggctaatgtttcttggcgtcttcgacgatatttccatagtcacaaaattttcgtccaaaccaattgccccacaggtaaagtgttgcgcaagcctgagttggctagcaggaggatggcatggtccattgatttatcaaagtacaagatccattatgaaccaagaggcagcattcaggcccaaagcttggcagatttccatggaagtgaagttggggtcatcttggaagggcctaaaactggctatggagtccaagtggagcacatccatcgagacatcaacaacaaggccgatgagttagcaaggttaggaacctcactaagacttgggaagttgaaaactttcatactacacactctccctgttcccagtgtgtcagccaaggaatgcttgcaagttgaaggagaaaaacccgaaagcaagaaaaacaaaattgttgaatacttgctcaaaggcacacttttggaagataaagagaaggccaaaaaattgaggactcaagctgcaaggaacaagttgactatgtcatcagagaacttcatgaaggcatttatggcatgcattagaggggaagcatggaaacttgatccattggtctgcctgagagttgcatctcatcacttccccatgaccattcgccatttagggaatggatatcttaagaccctttcctatggcttcgggacaaacatcaagcacatggtgacatccgtagaacaccctcaaacaattgaccaagccgaagtggctaacaaagtaattctagtggaactaaagaaacaactacacaatgtcaagggaagatgggctgaggagctctttgaagttttatggcataccgtggggaaaatatcactaagaagacagaacttcatggaggttgagaacaatgaagtgttgcgagtaaatttagacctcgtagaacaagagatctcatctagaaagcttgaggtgaaacccagaaaaactcatcagaatgtaagttggctgctaactgggaaagacccttttgggtttggcatagcctatagaatgaagactgcaagctag

SEQ ID NO: 81886 - DNA, 774 bp, Glycine max
  Peptide Sequence Number=SeqID_198664
atggaggagacacatgaagcaccccgagaccataatctagtcaacttcgagcctcacctcggatatgccgctgaggggcaggcgttttgcagcgtacccttgacaaacactttagggggccctcagtatcgcccacaaccacaaaccttgcattttgaggtgggaagagccccttctgctatggtggaaagggagagatttgatcatatagaggagaggctgagggctattgaaggaggcggagattatgcctttgctgacatggcagaactatgcctagtgcccgacgtcgttatccctccgaagttcaaggaaagtcttactggggcagccgtcatctggtatactaatctggaaccttcccgagtccattcttggaaggacctaatggtttccttcattaggcagtatcagtacaattctgatatggctccaaatagaatgcaactacagaacatgtgtaagaaggagcatgaatctttcaaagaatatgcccaaaggtggagggatctggaagctcaagtagcgcccctaatgatggagagggagatgataacaatgatagtggacatgttactggtgttctactatgaaaagatggtgggttacatgccttcaagctttaccgatttagttttcgccgatgaaaggatcgaagtgggtctgagaagaggcaaatttgattatcctgctttattgaataagaagtctggggcaaatggagagaataagaaggagggagaaacacatgttgtgattgccgttcctacatag

SEQ ID NO: 81887 - DNA, 135 bp, Glycine max
  Peptide Sequence Number=SeqID_198665
atggagttagagagaagtttgcatttcggtgtgatgaccatcatgtattccagggacgagggggctaatacccctgcccccttaaatttgttccaacttgaggtaagggttgatccttgtccttctttaaagtga

SEQ ID NO: 81888 - DNA, 567 bp, Glycine max
  Peptide Sequence Number=SeqID_198666
atgattgttgttggtagagatcccaatgaccagtacatgccaattacctttgttgtagaaacagagactaaggagacatggagatggtttctgaatgtgttgtttgaggatattggtagcgttgaaaccaacaaatgggtgtttattagtgatcaacaaaagggattacaacaattttttttggaattttcaactccgatagagcacagtttctgcctgcgacatctttacaacaattttaagaaaaaatttggtggtggcataatgctgagagatctgatgatgggacctgctaaggttacttatgaacatctgtggaaaaacaaaatgcaacaaataaaggacatcaatgaagctacatatcattggttatataacctggagaggaaagcatggtctagcgataagcctatcataactatgtgtgagaggattataatgtaccttatgaatagatttgcaacccttagagacaaattgaaatattacaaaggtaaggtgatgcctaagcccctaaaaaggttggactgggaggttgaaaagttaggaaattgggtaactgcttag

SEQ ID NO: 81889 - DNA, 330 bp, Glycine max
  Peptide Sequence Number=SeqID_198667
atggaagttgacctgcctgtaggttggaaaccgcttaacctagagcgttatgatggaactatcgatccagacgagcaccttgacacgttcctcacccaggcaaatctctacaccaacgacggcacaatcataggactcccttcgaaatcagtcgacagattcgaaacccttgtccaacattttagctctcagtatgcaacgagtcggtcacactgccttacttttgctgccttggtcagtctgcggcaggcggatgatgaatcacttcgcaagttcatggataggtcaaccaaattgttgtccaaattaaaaacctcaatcttgaagtga

SEQ ID NO: 81890 - DNA, 341 bp, Glycine max
  Peptide Sequence Number=SeqID_198668
atgggtgatttgaggattcttccggctcatcctataagtcacttttggcaacattctggaaacataaaagggagtaaggcaaaatcggttgaaccagtcctttacctcgcaagcttgttttcaaccccgacgttgttgccggcagctctaacgtcatcttctacatcgtgggtgacccctccgacgtcctctttgtcccctccatgtaagggtggggcatcacctttgtcttcgtcatgtcctatgatggttaagtgtaaatgtgaggtacctgctattatattcacgtcgcgtagtgtgaaccatctgggagaaggttttggagatgtccacactgggat

SEQ ID NO: 81891 - DNA, 314 bp, Glycine max
  Peptide Sequence Number=SeqID_198669
tggagccagtccaagtgattgaggtgacgtcatctgaggaagaccccgaggaggacccagaggagctacctcctaagcctgctgtggatgctcttgactttctagagggtgatgaggacccacttcctgaggtggattctcccgaggacgtcatgtcggcatatgaggcagactctacggaggagagcggtcccggagggatagcgactagtggagccaccacattggatacctttgctctggatgacactatgtattttgcaaaactcccatatttttggataactttagatgatgaatgtacttatgattaa

SEQ ID NO: 81892 - DNA, 1677 bp, Glycine max
  Peptide Sequence Number=SeqID_198670
atgatgctcgaaggatcggttgagttggagaccgtgctttctttaagatctcctacagaagatatggaaaatgatgacttgtttggtaaaccaatgagcacaaagagtagagacgcttgtagtgactggttggagaagaacttctattcatcattgctggagacacagaatcaaaggaaccaagctgcactgaggttgcagaaagtttacaaaagttttaggacaaggaggcagcttgcagattgtgcagttcttgcagagcagagatggtggaaggctttggattttgctgaactaaagcgcagttctatatcattttttgacattgagaaaccagaaacggccatttcacgttggtcaagggcaacaaagagagctgccaaggttggaaagggtctgtctaaggatatgaaggctcgcaaacttgctttgcagcactggctagaggcaattgacccccgacaccgctatggtcataatcttcaattttattatgtcaaatggcttcgctgtgatagctatcaacctttcttctattggctcgatattggggatggcaaggaggtactttctgatagatgtactaggacaaaacttcagcagcaatgcatcaagtatctgggtccagtggaaagaaaatgttatgaagtagttattgagaatgggaggctcttgtacaagattagtgggaaaccggttgaaacaacagaagatgcaaagtggatttttgtacttagtacatccaagactctttatgtcgggaagaagaacaagggcacatttcaacattcaagcttcctagcagggggagccacattgtctgctggtagattagtggcggaggatggtgttcttaagacattttcaactccaaaggcagtttggcctcacagtgggcattatctcccaacaaaagaaaattttgaggaactcatgtcattccttaaggagaataatgtggatcttacagatgtaaagaaaaatccagttgaagaagaagagttcgccaaaattaaccaagatctcttccgagacaatccttcagaggtcatggaacctccaaacattgaaactgaaagttccaacacgttagctgaagatctgcctaacttgagaaatgaggattctaatgctgattcaaatcatcaacaacccttgtcaagattgtcagtacgactaggatcaaaaataactaaacttgagataccaaaacgagtcacggtgtatgacatttttggagagctagcaaatggtcctcgtaccaaattttattctccaactgcagtatcagaatgcggttatgagacagcagaagaatcatttataaacgaggaggaattcatggtttccaaatcaaacatgtttgctgaagatgaagatgaaatagacgagaatactattccaaaggagaaaatcttgaagaggatagattcacataaaggaaggaaatcatatcaattggccaatcacttgtctaccaaatggacaacgggtgcaggccctagaattggttgcatgagagactaccctctagagcttcagaatttgattctggagcagcaaaatttgtctccaaggacaagaacaacagctccatcaccccggatcccaccattgtctcgcttcagccctcgtgttgcttttccacctcctttggctgatgctccaagtgcctga

SEQ ID NO: 81893 - DNA, 456 bp, Glycine max
  Peptide Sequence Number=SeqID_198671
atgtgggtcaccatggatgatgtcatggatgctcagtgggtttatgataattatagggatgagagttatttgaggagggttgttatgccattggagatacttctaactagctataagaggcttgttgtcaacgattctgctgcactatttgtcttctatattgatcatcatcacagttgttctctgagtgcatacttgattgtcggggaattaatgtcactgctttcatgtcatgtgtcgcaacctacccttttgagggcgagcgaggcgaggcttatgggtgcgtcttccaaaggaggaaaatgcacggagtcgccaccaacgtttatttgtagaaaacgtcggaaaaaccgaaggaaaccggtcatgaagaatattccagattcgggagttgtatttacgtttgaggaaggtattagcacctctcatgtttgtctcaaaggacaacaaccttaa

SEQ ID NO: 81894 - DNA, 1042 bp, Glycine max
  Peptide Sequence Number=SeqID_198672
catatctgcacattagtgatcaaggtaggaataagcttgatcctaaatcaaagaagtgcactttcatcgattgtgtaacgtacaaggatagggacaacaaaaacactagcaactcaaaacagagtgggctagtgtacacagaggtggatgatgtcccagaaacccctatgaatgagactactatgttagaggaatcaattgaaaataacaatgagcaacaagttgacacaccagagccttctacttcagctcctgtattaagaaggtcttcccagcctcatgtgcctaacaggaaatttctgaattatatattattaactgatgaaggagaacttgaaaactataaggaagcatgtcataacatagattccagcaagtggaagcttgctatgaaagacgagatgaagtcgaagtctttaatctccaatcagacatgggaactagctgagttacccatggggaagaaagcacttcacaataaatgggtgtatcaagtaaaaaatgagcatgatggctctaagagatacaaagtcctcctagttgtcaaaggatttcagcaaaaggaaggagttgactacactgaaatctttgctcctgttgtgaaacttaatactatcaagtttgtcttaagcattattgctagtaaagagctctaccttgagcaattagatgtgaagactgcatttcttcatgaagacttagatgaagagatttacatgcaccaacctgaaggtttctcagaagaagggaaaaagaatatggtaaagtacatcaatcgtgttttgcaaagattcaacatgggcaacgccaaactggtgagcacaccttttgctagtcattttcgcttatccaaggaccagtcacctcagatagaggaagaaaaagaattcatggctaaggttttgtatgcttcagccactagaagtttgatgtacgcaatggtttgtacgaggccagatattcgccatgcagtgggagttgttagcgggtttatgtcaaatccaggtaaagctcattgggcagcagttaagtggattttgag

SEQ ID NO: 81895 - DNA, 486 bp, Glycine max
  Peptide Sequence Number=SeqID_198673
atggctatagttgaatccgtggggaagattcctttgcaagacccacttgaggaggagttttgtgttgctgacttgacttggaccaagtttgcccatgccgcaaaaaatggtctggtgaagcctgaagctatagcttttgttgcaccaacttgggctggtccactccctatcgtgtttggtcgagactctaacatggaaacaagtaacacctactctcaagcaaaatttgaagtcccatgtcacaaccaagttgtggaagcagtcttccaagattattttgatgatgccaaagaatcaagagttaagcaagttccaaagaatcaggagtcaaaaagcttcaagaatcaagtttcaaagaatcaagattcaagaataatcaagatcaagattcaagattcaagtaaagaatcaatactcaagattcaagaatcaagagaagactcaataaagataagtactaaaaaagtttttcaaaacattgattag

SEQ ID NO: 81896 - DNA, 264 bp, Glycine max
  Peptide Sequence Number=SeqID_198674
atggcacaaaaaccaaaaaacacaaaaaccttccttgctatatatacagaacaatctggaaggctctccaaaaacaatcacatgttcaaaacatggaagagaatagtgacacaatgtgaaagaggaatttggagtgggcgcagcagcgtgggctcagagaggaggagcgacaatgaaggaactgtggagaacgtgtgggctcccaggacggcacagtggaggcacaaaggcgtgggctcccaggacggcatagtggaggcataa

SEQ ID NO: 81897 - DNA, 1722 bp, Glycine max
  Peptide Sequence Number=SeqID_198675
atgagcttatccaagaaaggttcccaaacagacacaaaactgagctccttaaacaaagcaacctatttgaatccaaatgcagcagagtttgttccatttgccctcagatcatcgccatctggaagcaccagctcggtagatgcagcagcgaggtttactactgctggatctcttgggaaagcagttttagatcgatcagaatcatccatttcaaataattccgatgatgaggctcaccagtactggcgttgtcagcttcctgatgatatcacccctgacttcaaggtcatgggagaggacgaatcccaaggtcttaacaacctctctttagcaggcttatctataaatgatgataatgaatcctcaatgtttccttcttctaagggaagtagatatatactaaatgagcagctggaactgtctccacagcaccttaatggcaatacttttgctgataaattaaggttttccaattcaacctacagggaggagccatcttcaggaagcattttgaactcatcagcaaagccttgggataggcaaattgggaataccgatttgcacgttaccagtggtcaagaggaacttgtttatgatgaaaactctggacatggattcttaaatgatgtttttgcagggaattctcttgtgaatgatacagatttgaaccctttggagtttttagcttctctattccctggttttgcttcagaaagccttgctgaagttttcttcgccaatgcatgcgatttacatctgaccattgagatgctcactcagttagagattcaagttgatggtggcttcaatcagaatccgagtccaaagactctgtcatctcccaatctgagtgcaatggactttccagctcttacatcatcaaatgggcagaatacttcaaaatatgctgcagataatgttcaacaaagtggcattccatacatatcatctgataaagacatgctcatgttcaaatctggctcttctattccatctagaggttctgttgactttgcttcagcagtcagaaaattggcttctcaggattctggtatatggaagtatgataaaaatggttctggtgatgcttccactggctctagtaggggtttaaatgctctggctagtgcctacaatggtggacaggggagagtcaacattggtgatagattacagagtcgtggttctgctcgggcagctcctgtttggcttgaaactggtgacgcagttgcaaatatgtattctgagctgcgggaggaggctcgtgatcatgcacgcttgcgtaatgcatattttgagcaggcacgacaagcctaccttattggcaacaaggcccttgcaaaggagctaagtgttaaggggcaactgcacaacatgcatatgaaagcagctcatggaaaagctcaagaatctatttaccgccagaggaatcccgttgctccagagaatggaagagggcaccagagaatgatagacctacacggtctgcacgtaagtgaagcgattcacgtgctgaaacacgaactgagtgtgctaagaagcacggccagagccgctgagcagcgtttgcaggtttacatctgtgttggcactggtcaccatactcggggctcccgcactcccgcaagactcccgatagctgtacagcgttatctacttgaagaagaaggccttgatttcacggaaccgcagccaggcctgcttcgtgttgtgatatattga

SEQ ID NO: 81898 - DNA, 399 bp, Glycine max
  Peptide Sequence Number=SeqID_198676
atggttaggatcagaggattaggtcgtgccttaggtcacgttattggcaaaggagatcgtgatgatttcgattatgttgcgcagcgtcgacggcctaccgcatttgcacggaggcagcaagtacctatgactgtggcgcatgatgagtcagtactccctgcgccagatgtagaggctgacgtatttccggatgacccgatggcaccagctgatgtagaggacactggggcagacattcctgcagacacaggcgcccaggccgctgaggatgagcatgagggatttccgggtggtccaagcgacccatccatgctgacccagtatacggatcatgttgcttgcagcgtatggatgagagatgagcgtcctgagttgaagttatcctttcacgggaggaag

SEQ ID NO: 81899 - DNA, 600 bp, Glycine max
  Peptide Sequence Number=SeqID_198677
atgatcgtcatcatgattaccgttgccggcgacagtgacagtcatgttggtggcaaccacagtggtcatgacgacgatcacgacggtggtggcaacggcaatcacaacggtggcagcaatagtggtcatgttgatagcgtcaatggtggcagcaatcgtcatgttagtggtgatgatggtggtcatggcgatgatcacgacagtaatgacaacaatgataatcatgttggtggcgacaacgatggtcataacagtgatcatggtggtggtggttgcggcaatagcggtaaagttgtggtgacgatcttgacgaatgataaaaggtggcatggaagagcagataatgagatacataatcatgaaaacgatgacttatctaagaaatcccgtggcaaagaaaagatgagtgattcaaaatcttcatggtccttgttaacagaaagttctgaaggaggcattagtatcgatactacacatgagttttctggaccctcatcatgtatagtttccattaataactataatgactgtgatcgaaagggatttgagtataagaagaatcaagaccaagttatcaacaatggagaatcaagatcataa

SEQ ID NO: 81900 - DNA, 348 bp, Glycine max
  Peptide Sequence Number=SeqID_198678
atgacgattgctgccaccattgacgctatcaacatgaccactattgctgccaccgttgtgattgccgttgccaccaccgtcgtgatcgtcgtcatgaccactgtggttgccaccaacatgactgtcactgtcgccggcaacggtaatcatgatgacgatcatgagtgtgatgattgcgacaatgatggtagttgtagtgatgatcttgacctggaagagagtgtgcaagctgaaggaggaaggaagccttggactattaaggaagacttgaagacttggatattaaggaggaagggagacttagcttggactattaacgaaggaatctttgtgggtgaagattattaa

SEQ ID NO: 81901 - DNA, 252 bp, Glycine max
  Peptide Sequence Number=SeqID_198679
atgtctcattttcaagggtttttcaaaggaagtataaaaacatcctattacggagaaaggcatagaagtcaagattacctaaaaataactaagaaagaaagaatcgggagcttgttctccactgaatccttgaggtggattctgaggattttgctccgattaaagtgttcatctccatgcggtggtctggcgacaagcaaggacggctcgtggtggccaccgatagcgtggtggtggagcaggaggagttag

SEQ ID NO: 81902 - DNA, 345 bp, Glycine max
  Peptide Sequence Number=SeqID_198680
atggccaagtacatgcagatggaggaattgagtgagtataggagtctgagaggcgaagaagtcaaagctgctcaagagaaaaagaaaagaatcctctcaaccaaccaagactggtcatcaacactatcactagatgtttcgccagaggaagagcaaccgcctctacgtaaaaatgcacctactgaggaagccccaagattcatgcactatgtagaagtcaagacgaaggccaaagaaatgaaggagctagacctcgattcgagaactaacgatgacaaccgggtgaagccactagaagaaacatccaactcccagctcagtcctaaggaagggcaggtcacttag

SEQ ID NO: 81903 - DNA, 354 bp, Glycine max
  Peptide Sequence Number=SeqID_198681
atgtgtttgttgttaagtttatccaaacaaggccataatagatatgctttgcagtttcttcggcataatagggtatacatgctagatcaagcaagattttcttcaatggacccgtccaaaggtttcttttgttatgctcagggctatagcacacatttcttttgtgtggcatcttttctatggactacaacaattgcttttacccttcaccgcactgttgtaaaacataaaacagatgttgaagatttggaggccatgtttcacttgtatgtctgggagcatattaatgtggatggcatagcttcagatgctggttatgtaccaatagtagtaggacttcctactttggtctaa

SEQ ID NO: 81904 - DNA, 196 bp, Glycine max
  Peptide Sequence Number=SeqID_198682
atgaaaacgcagggttttagatctgacgaagaggaacacggaaagagagagagagagagaaaggaagcgtacagagagagcgaggtagaagacgagcttgaaggagaacttgcggagctccttgaagaggaggtagcacactacaatgaagctggaaccggccaacgacaggctcgacgctccgacgttcaccgct

SEQ ID NO: 81905 - DNA, 402 bp, Glycine max
  Peptide Sequence Number=SeqID_198683
atggatcctaatgtgcctgcgcaacttctggagtatgacaaacgttttgggcaatatggaagtgagtacacattttatgactacaatcaccctgaggatattccatcagaattgaagcattcctgcaaagttgtagttgctgatcctccttacttgcttaatcacgcttatttgagcaaagagtgcttggagaaagtggctgaaacaattcatctgctcgtacaacctggagagtcatttttgcttctactcacaggtgaagtgcagaaagaaagagcagcagagatcttgggcttgcatccttgtggttttaggccccagcactccagcaaacttggaaatgagtttcggctgttctcaaactatgaccctggaacgagactaggagggtgggaaaaatag

SEQ ID NO: 81906 - DNA, 399 bp, Glycine max
  Peptide Sequence Number=SeqID_198684
atgaaaaacaaaaatgcgaaaatgcaaaacaaccacaaaaacaatgcaaatgaaaacgaacgcaaaacaaccatgaaacgaatgcgaaccggagtcaagagcgaagcacgaagagtgacaatcaccaacgaagggaatgcagtaaggcaagagcgaagcgcgaatagtgaaaaaacctatgaaatcacaaacgcatacctcacgaatgtggaagatgtcgacaccggagtccttgatatctttggcgaagaaagggttcatgagaatgcaaacctcgtacatgtggatgaaaaggcagaggtagcgaagttgggagtggatggcgacaatggtaagcatgaggcccgggtaaagggcgcgatcgatgatggatatttgggaatgggcaatgtgttctaa

SEQ ID NO: 81907 - DNA, 790 bp, Glycine max
  Peptide Sequence Number=SeqID_198685
atggctgagaggttgacagctgtccaaaattttggttttttggtcaaaatacccatagctgagagtttgacacctgttgtgcttttgggttggtcattccgggttttattcacttgcctctcttcttcctctttcgttgcttctgtagttcaaggaaagagattcgtgaagccatcgaaggttacaaaggatatacatactgatcgtacttttacgggaaagtctatgagttttgatgcattttcctcagttcttaattatctggatttgcatgcaagctctgcacctcacaggtgtctgtggcttagtggtatttcgcgttcaatcgcttacaattggtctcgacccaacatgaaaatcggtgttaggatcattcacgcaagttcgtcttaccggaactggtcgaaagaggcatggattctgcgtcaagatgtttgtgctgggtgttgcagttttggtatcgcagggaatgatcccaaaggtggcactcctttcacttttgaaatacaggttgcacagttcaaccagtttaaggcacgcatcggaaagttcttcaagcaagaagggagaaactccttcagagaacactttcctaggctagaggactttgccaaggctatctacatatttgatattggaaaaaatgatattgttgctgctattaacagagtgggccacgaagattctcacgcagtcatctcagacattgtggattattttgaaaaccaaatccaagtaaaaacaccacaccagtttttgggtctgccacagggagcatggtttcaagatg

SEQ ID NO: 81908 - DNA, 324 bp, Glycine max
  Peptide Sequence Number=SeqID_198686
atgacaatgtgggtgtcgacggagcggtttccgacagatttcgggcggaaggagaaagagaacaacaatttcaggcaggaggatgacaaagagaagagtgaattaaaagagatagataccttcggggagagtaagaaggggttgaagagagcaatcacactggcaaggaggacaaggataagaggtggcaacaatggcctgaaaatgtttgttcagctcacaaactcctctaataatctatcttctcaatcttacactaccagtacatataaaattgaccatgtaagcagggaggtactatcaggagttttggatacagtttaa

SEQ ID NO: 81909 - DNA, 4761 bp, Glycine max
  Peptide Sequence Number=SeqID_198687
atgccggctaggaaaatcacgatagcagcatttacaagaatggaagcacgtgtgaacgcgttggaaggtgagatctcgatggtgcgatcttccttggtgagtttccaggaagaagtaaaggagaatcacgcgaatctgatcgcgatgttggagaaacatttcggaaaatcgctggatgatgaagggactggaagtgcggtaagcaagaacaaagaggcaccagaaaagaagacggaaactccaaaagggtcacgagctgataagatgaatgaatttcatcaatcggcgaagaaggtggagttaccttcgttcgaaggagaagaccccgccggctggatttcgcgagctgaagtttacttccgagtacagaacaccgcgccagaagtgaaggtgagcttggcccaactttgtatggacggacccaccatacatttcttcaactccctcatcggagaagatgaagatctgacttgggaatcgttgaaaatagcattactcgagagatacggtggtcatggcgacggagacgtgtacgaacagctcacagagttgaaacaggagggatcggtagaggactatatcacagaatttgagtatttaatcgctcagattccgcgattgccagagaagcaattccagggttacttcctccatggtttgcaaccggagattaggggaagggttcgcactttggcaacaatgggagaaatgagtagaatgaagctgttacaagtgactcgggcagtagagaaagaggtcaagggtggaaatggatctggatttgggcgtggacctaaaaatgggccttatcggtccaattctcatgggggaaacaaaggagtatcagactgggtgatggtgaaaaataaggaagggggtgtaagtagcagtatgagaagtgggctaagaggtgacaaacaggcccaaggagataatagacatactgggcctcgtgataggggattcacacatctctcttacaatgagctgatggagaggaagagaaaaggcttgtgtttcaaatgtaaaaaaccttttaatccaggccaccaatgttccgaaaaacatcttagggtgttaatagtggatgatgaatgtgaagaggatggagaggctaaggtcttggctgttgaagtagaaggaggggaggaagatgagcaaggagagatgagtatgttggatttacatcacatagctcatgagaaccatcaaaccatgaagtttcaagggataattaagggtgtagaagttctcattttagtggacagtggggcttcccataatttcatttcacaaaagctagttcaccacatggattggccaattgaacagacccaaaaaatgaaagtcaagttagggaatggggttcaaagagaagcacaggggaggtgtagggagctagagatgtacattggcagtcacaaattaaggccaaatcttcaactgtttaaattaggaggaattgatgtggtgttaggcatggaatggttgaaaacattgggagataccattattaattggaaacaacatacactgagtttttgggaagaaggaagatgggttactcttggcaataaggaggggtgcaaaaatccaatgatagcattacaaagtattgtgggtaagcccaggccaaagaaaggaggggaggtgtggagaattgagggggtcgagcctaaggtggtttgtgaatccattaggactgaaagcccacaccgggtgttggaggtggtgttgggcgagtatgccaatgttttccaaacaacttgtgaatctgtgttgtcagaaaaccaacaccgggagttggaggaggtgttaggtgagtatgcacacgttttccaaacgccttcgagcctacccccaagaaggaagaaagagcacgccatcaatctcatagatggacatggagcagtgaatgttcgtccgtatcgttatcctcatcaccacaaaaatgagattaagcgacaagtccaggagatgcttgctaccggtatcattcgccacagcacaagttcattttctagccccgtgatcctggtgaagaaaaaagacaacacatggaggatgtgtattgattacagagcactcaataaggtaacaattcccgataaattccctatccctgttattgaggaattgttagatgagttgcatggagccaaattctttacgaagctagatctcaaatcaggctatcaccaagtgagagtgaaggattctgacattgagaaaacagcgtttagaactcatgaaggtcactatgagtttcttgtcatgccctttgggcttacaaatgccccttcaacttttcaaaaccttatgaatgatgtgttcaggcccctgctcagaaaaagtgtgttagtgttttttgatgacatcctcatatacagtcaagattgggactctcatttgagacacgtacgggaagtgttgggtttattgtctactcatagtttggtagtaaacaagaaaaaatgtagttttgctcagcaaacagtggagtatttaggtcatgtaatctcagaaaatggggttgctgtggatcctagcaaggttattagtgtacttcaatggcctcaaccaaggaatgtcaaaggggttagaggatttttgggtctcacggggtactatcgaaagtttatcaaagactatggtaaggttgctaaacctttgacagaattaactaagaaggatggtttcaagtggcatgagaagacacaggcagcttttgatacactaaaacagaagctcacaactgcaccagttctggctcttccagatttttctacaaattttgttattgaatgtgatgcttcaggtacaggtttgggagctatattgatgcaacagaacaggccagtggcttacttcagcaaagctcttggagttagaaacctggccaagtcagcatacgagaaggaactaatggctgtagtattggcaattcagcattggagaccgtatctcctaggaaggaagtttgtggtgtccactgatcagaggagtttaaaacagctgatgcaacagaaaataatgactgctgagcaacaaaattgggctgctaaactaatggggtacgattttgacattgtgtataagcagggcaagctcaacaagggggctgatgcactttccagagtgtatgaagacagtgaattgagcgccatgagctccacagcaacctggatacaagaagaacagatcaaggcagaggtgcagagagatggtaaattacagaaaatcattgctgaaatccaattagatcctctatcatggccaggatatagttacagacaaggcacacttctttatgaaggcagactagtgatttccaacaaatcacttcttattcctactcttttacaagaatttcattctacgccacaaggaggacattcgggtttttacaagacatatagaagaatggctgccaatctatattggataggaatgaagggcatgattcaggaatttgttagacaatgtgacacttgtcagaggcaaaaatatatggcatcttctccagggggtttgctccatccactccctatacctgagcaaatatgggaagatatttcattagatttcattacaggtttacccaagtcaaaacagtttgaagcaatattggtggtagtagacagactgtctaagtatgcacattttattcccttaaaacacccctatacagctaggagtatagcagaaattttttgtaaagaaattgttaggttacatggcattccactttcaattgtgagtgatagggaccccatctttgtgagtaacttctggagggaaatgttcaagttacagggcacaaagctgaagatgagcacatcataccatccggaaacggatggccaaacagaagtagtgaatagatgtttggaaacatatctgaggtgctttatttctgatcagccaaggacctgggtaacatggatacattgggctgaatattggtataataccacttaccattcatcgacagacaagacaccatttgaggttgtatatggaaggccaccaccactattgacaagctgggcacagggagagactcgggtagcaagtgttcaaaaggatctgatggacagagatgaggctttgagacagttaaaaactcaattgctaaaggcacaagagagaatgaagagccaggcagacaagaagagagttgatagaagttttatgtgtggagaatgggtatttgttaagctaagagctcacaggcagcagtctgtagttaccagaatcaatgccaaactagctgccaagtactatgggccttatccaatagttgagagggttgggggagtagcctacaaactaaaattacctgaagggtccagagtgcaccctgtattccatgtctccctattgaagaaggctgtgggtaattatcaagaggataaggaacttcccgatttgttagaagacccagttgaagcatgtgaacctgaggctgcacttgctagcaggaaaattaagcagcagggtgaagaagtgagacaatttttgatccattggaagggtaaaactatggaagaagctacttgggaggacgaattaatgatgagaagtcaattcccaaattttgaccttgaggacaaggtcaattctgaagaaggaagtattgatagagtccaagggaatgaaggatatccacatcagcaattggttcactcaacacagaatggagtcagaccttttctggtttatactaggaggaagggtagaaaggtctttggcggctaa

SEQ ID NO: 81910 - DNA, 1932 bp, Glycine max
  Peptide Sequence Number=SeqID_198688
atgacgaggctcaaggacacaaacgtgagtgtgttggagtggactcccttggcgtcggagagggcgatgattagcgtagggaactcaagcttggaagagttggactgggcgatctgggatgatattatgctgcccaagtccatgtccatcttcatcacaatcccatatatcaagtgggcttggtccatattcaagtctgaggtatgggatgtgagagcaaggttgaaaatcttccaaggggccccctcgatgttcaacataaaatggcctcctagcaagcaaagtttggcttcaatagcctggtggtctgagtatgtatatatggaggaatcaagaaaagactacgagagcaaggttgagaggagaggagattcagacgacgacaacagtcccaatgccgtcttcaacgctgaaacatggtgttgttggatgcaaaagcctcaactccacaccttcattaaagccataacaactcttagaccaatcccaacaacgcctccacacacttttcttccccttcgcaaccctagtgaaagtgttatctacctcaagaaccacgaaatcgacgctttcataaaacgcaggaacccgaacgttgcactctcagtgttccacaacacgccactgcgggacactgtcacctacgacctgatcatttccgcgttccgccagcaaatcatgctattcgtttctacgcggaaatggggtgttcaggtgcattgcggagtgatcaagttcgggttttcatgcaacgtgttcatgggtgatgcacttgtcgggttctacacacaggtggggcaatgtggggtggcactgcagttgtttgatgtgccagagcgaaacttggctgtgtggaacgtgatgctgcgtgggttgtgtgaactgggccgtgtgaaagttgaagacttgttggggttttacctctctcgaatgcgttttgaaggcgggtttggtggaatcgaatgtttttattatgcggagaatgatttgttgtgtgaggctttggaggttcattgtcgtgtgatgaagttgggttttaatgaagggagtgtgcatgttcaatctgctttgattgatatgtatggaaagtgcagggacattgagagttctgtggctgtatttgaatgtcttcccgagagaacattggattgtttcaactcattgatgacctctttgtcttattgtgatgcggttgatgatgtggctgaattgtttggtttgatggtcgacgaaggtcttgtgccggatggagttaccttatcaaccacactgaaggcattgtcagtgtctgctttagcaagttttacgagttctcagttaatgcattgttatgcattgaaatctggacttggagaagatgctgtagttgcctattcttccttctccaaacgcttcacatccatgatcaatgcatatgcccgaaatggaatggggaaagaaggaattgcaatgcttcaagcaatgactgagaggggactaaagccagatgatgttaccttcttatgtgcactaaatggttgtaaccacacaggattagttgaggaaggaagaatagtcttcgaatcgatgaaatctcttcatggggtcgatccagatcgccgccatttttcatgcacgatggatctcttttgccgtgcaggacttctacatgaagctgaagagtttctgctacagtcacagggaaaaggagaatattttatgtggagctctttgttaagaagttgcagggtccacaagaatgaagaggttggaacaaaagcagcacaagtgttagttgagctagatccagatgaccctgcagtgtggttgcaagcttcaaatttttatgctgaaatagggaaatttgatgcatcaaggcaaatcagagaggtttctctagcaaggaagatgactagggaaattggtcatagtttaattgagataagacaatga

SEQ ID NO: 81911 - DNA, 1083 bp, Glycine max
  Peptide Sequence Number=SeqID_198689
atggtgaatgaattgacaacaggtgttgattttgagaaattctcatggaaaattgaggatttctcaaaaaaaaatctcatgaaattgcgctccaagcctttcaaaatccggggttgtacatggaggctccttgtgtatccactgaggagggatgtgaatcacttttcagtgtatttgatggttgctgattctttaccgccgtacggatggagcagaaacacttttttcaagttagctctaataaatcaggtggataggaataagtctatagctaaagagacacaacaaaagttcaatggaggatatcgttgctggggttcatttttcttgaatcttactgatttcaataacccaaaacaagggtatcttgtgaggaacacatgcataatcgaagcacacatatgtgtctccgatttagcacctaagattcaagtccacccaaatagttctcccatccatgactcttgtgatcaagcaacagaagaatcatcctcagatgatagggacaccattagtccaagaacctcaggatctagtactgcagcagaaggtgaaattcaaggctcaaacaatttgacactaagagaactcatagattttgagagtttaggagcagaagaacaagcattcattccactcttggaagaggtttgcatatggcaccctaatctgataaagtgccaaagggaaaggactagaaggtttagacaatgggcctttacttctttgggccatgttttgcattttctcaagaccaaaagggttaaagacatcaatgaagaggacataaagtaccttcatggcttgtggaaggaacttgtgaagtcctcagggtttgacctggcttggctggagccatatgttcaattagcattgggttcgagggcatatatggaaagagcaaaccaattgaagaagctgaaggacaaggtggttgctttggagattaagatgaagcggctcaggggggaacttgctgctgctgaaggagagtttgaagtggcaaggagaggcttgtctgaagtaagaagaggcttcaatgagatggatttaaatgctgcaattggttatgctatgttttga

SEQ ID NO: 81912 - DNA, 1932 bp, Glycine max
  Peptide Sequence Number=SeqID_198690
atgagtggcttgagtttcaggggcttcacatacatgctcctcattgcatttctcatttggtccttcaattttgaagcctgcattgcaagaagaggcaagcactggagacaaagcagggatgtctcagcttctgtgtacaagaaaaaaggcaaaaattatggcaatgctcacaacaagtaccatggtggaggatcaaaatcaaagcctccatcatcacacaaaggcacaccaacattaccaaagcctccgccacaacataaaaacactccctcaccaccatatccaacaccaccaagtgatgatacccccacaactccaccaccaaaggcttacaatggtggtggccattcttccgccaccaccttcaatgtgctagattttggagccaagggagatggaaaatctgatgacaccaagcaaatggttttgatgtaccttctgctaacaagtttaacatgcaagaccaagaattttcagtttatcatagaattcattgttccttctgctaacaagtttaacattgcaaagtattcctatgagaacttttgggagtgcacttttagacagcttttaaatttacttttgtgctcacagtttggctcatgcaattacaaaggttacaaaaaagccattaggagcataaagaattgttttcttctgtcttctctgtttgggatgttgcttatgccattaaagaaagtttaccgtgaccatagagtaagagcaaaacaggcatttcaagaggcttgggctgaagcttgtaaaattgaatcatcaaccatgctcgtcccagcagactacgcattctttgtagggcccatttcattctcgggcccatactgtaaacccagcatcgttttccagcttgatggcaccattgttgcaccaacaagccccaaagcttggggcaaaggacttctacagtggttggaattttccaagttggtaggaattaccatccaaggaaatggcatcattgatggaagaggctcagtgtggtggcaagataatcaatatgatgatcctatagatgatgaagaaaagctcattgtccctttaaaccacacagtagggagcccaagtcccccactgccgattcaaagtgagatgggaggaaaaatgccatccgtcaagccaactgcattgcggttctatgggagttttaatccaacagttacaggcattacaattcaaaatagtccacaatgccacctcaagtttgacaactgtaatggggtcatggtccatgatgtgaccatatcatctcctggggacagtcctaacacagatggaattcaccttcagaactccaaagatgtgttgatatacagcagctctatggcctgcggagatgactgtatttcgatacaaactggatgctcgaacatatatgtacacaatgtcaactgtggaccagggcatggaatcagcattggaagtctaggaaaggataacaccagagcctgtgtctccaacattactgtcagggatgtcaacatgcacaacacaatgaatggtgtcagaatcaaaacatggcagggtggatcaggttctgtacaaggagtgctattctcaaacatacaagtttctgaagttgaactcccaattgtgattgatcaattctactgcgacaaaagaacctgcaaaaaccaaacgtcagctgtgtctcttgccggaatcaactatgaaaggataagggggacatacaccgttaagccagttcactttgcctgcagtgataacctaccttgtgtagatgtttctctaacctctgttgagttaaaaccaattcaagaacaataccatctatacaatcctttctgctggcagacttatggtgaattgaaaactccaactgtcccaccaattgattgcctacaaattgggaagccaactaacaatcggattcagacagatcatgatttatgttga

SEQ ID NO: 81913 - DNA, 207 bp, Glycine max
  Peptide Sequence Number=SeqID_198691
atgtggccgacaaggacagctcagcagcagaggaccgttagacatagtccgcaagtagccagtttaaaaatgttgtgctaccagacacctgccttcactctggcacctcaatcttatgaagaaatacatgaagatgcaaaaggaaataagaaccataatggcatgaagaaagcaataatagagccgcaaaggaagtcaattccataa

SEQ ID NO: 81914 - DNA, 273 bp, Glycine max
  Peptide Sequence Number=SeqID_198692
atggagttttattggaagtttgatttaattgaagatcatgttactgccaaaattgatgagagtgatgtttgggatggaagatttggtcacatcaatttgaagtcattaaagtttaagcaagataaaaatgaaattgagatgaaaaatcctggcaaacgatgtttgaggacaagaggagttaaattaaatgtatttgatgtgcttctgaattcaagtttgaagttcatgaagaagcttgggattttcatgacaaatctcaaggaggagtgttag

SEQ ID NO: 81915 - DNA, 489 bp, Glycine max
  Peptide Sequence Number=SeqID_198693
atggggcgcgatgaaggtgtccctgctgatgccgctaaggccactgatgatgatgatgagggccattttgcagtagaaggaaatgtaatcgaaggggttggtggcggcaagggcgaagatgatggggttgaaggtggaatcaataaggttagtgtcgagcgagtggaagagttgaagggcttgatggaggttgttgctgtgtgcatggagggagatgatggtttagaggaagagttggtgggtgaaggggaggcagaggaaagaggaggagacgaaggggttatgaaggaaggaggacttggtggcgtgggcgtggagcaaggtagcaaggaggagtgtatggaagcttttagggcacagaggagcaaagaaagagaatggaattctcagtgtcaaagtaaaaaggataagaaagagatttggaagaagcaagtaaaaggtagtgttcaagttaaagaaggaaaaatcaaagataatggcgctaaatag

SEQ ID NO: 81916 - DNA, 747 bp, Glycine max
  Peptide Sequence Number=SeqID_198694
atgacgcacacccgcccatggttttcgcctcaggacatcaagaagtattatatacgtgaagaagtgtcagtgcaaacactgtgtgtgttaggaatcttgccaagacactgcgcaataactgtctgcgtcaagaatcatgttggatcactgtgcaaacactgtgcgcatcaggaatcctaccggatcactgtgcgtgtcaggaaccctgccgagacactgtgcaaacattatgggcgtcagaaattttgtcgagacactatgtgcatcaggaatcctaccagatcattgtgcgaatactatgcatgctatgaatcctatcggatcacctgcgcgtcaggaatcctactgaatcactgtgcacattgggaatcttaccgagacattatgcaaacattgtgcacgtcaggaatcctaccgagacattgtgcaacaacaatgcgcgttaagaatcccgttggatcattgtgcacatcaagaatcctgctggaacactgtgtgaacattgtgcacatcaagagtcctgccggatcatcgtgccaacattgtgcacaactggaatcctgtcgagacattgtgcaaacactgtacgcgtcaggaatcctgccagattactatgtgaaacactgtgcaaatactatatgcatggggaatcctgccaaggcattgagcaaacattgttcatggtactatgcatcaaagattcctatgcagacgtggtacaaacactactcatggtactatagttga

SEQ ID NO: 81917 - DNA, 261 bp, Glycine max
  Peptide Sequence Number=SeqID_198695
atggatgaccttctaggaagttttatagaaagcataaaggcaattagacaaaaggtgaaagttgtcaagtttgataaaagtggagagtactacggaaggtatgatggaattgggcaacacctaagtccatctgctaaactccttcagacacaagttccaagtaaagcagttctaaaaactccttttgaactatggactaataggacacctaataagacacatgcatgtttgggattgctaggcaaaaataaggatttataa

SEQ ID NO: 81918 - DNA, 138 bp, Glycine max
  Peptide Sequence Number=SeqID_198696
atggaaaaagttgcatggtcagggcgacccaacccaacctacaattatgcaacagggttggaaatccctagttgcctcacgcagaaaactgtgcggccaaagcggaaaccaccatggagggtggccatgacggcatga

SEQ ID NO: 81919 - DNA, 660 bp, Glycine max
  Peptide Sequence Number=SeqID_198697
atgacatgtgatgtacctgttgtatctgcctgggatttttctggttgttttgcaggtggggttagggaatggagttcaattagtgctcatgttgggtctccgactcgcgtgatagcaatgaagcctcatctagagttttcctcttttggtgaggcatttccgctggtagtccctatcgccgcagtgttattacctaagaggattatatctctagaggctggaaagaaagactgtgctttacggcacttttaccagacacgtgccaaggcaaggataatgagtgacattgagcaagtacaggagcaaatgaaggctgatatggaggccatgaaggagcagataacaacaatgatggaagcgatgatgagcatgaggaagatgatggaggtcaatgctgcaacagttgtttctgccagtattgctactgagagggacccgattcacccgcctgatttcagtcaagtgaatcgtccagtctcagatgtagtaggtcaaggaggtgagacgatgaaaaatggatatggacctcattatgttcaagtccaaagtaagtcttcttttccaccatacagtttgcctcctaattatacaccgcctactattgtatatgctcttggagagaatattggtaattctgcacctgttttcattgagaattaa

SEQ ID NO: 81920 - DNA, 228 bp, Glycine max
  Peptide Sequence Number=SeqID_198698
atggcggaggcaacggacaccccgtcgcaccggagtcatacccgcatgtgtgtctggtgcgagtccgacccgggacacgtcgatgatgagccacagctccttcatggagtcgagcctgtaaaggacagtggttgggttgtctctgaaggggatggcagcaatgtcgttgatgagtacgaggttggcgaggtagctacaagcgtagttgagaggggagtcgagggctga

SEQ ID NO: 81921 - DNA, 519 bp, Glycine max
  Peptide Sequence Number=SeqID_198699
atgatatctaacttaacaggagaaggggaacctcttataaggagatttgcacaactattaccctctcttaagctaaggattggggttcgtcctcggggttcgggaatggaatttgatgttaataacaaccaccatggtagagttattagtagtagtcacggtggtggtggctatagtagaggtgacattggtggtattgacaatgacgatatggtggcagtgatggaagtgatattagtggtggtggtgataatgacggtggtgggtggtagtgatgttagtgatggtgattgcaaccacattggtggtagttgtggtggcagtgacgatgacaaatgtggtattattggtagtggtgataatgacgatatcgatgacattgatgacagtggtggtggtagctacgacaacattggtgacgattgtagtaacagtgacaatgacagtagcaacaacattaatgatagtggtgataacaatgttggtggtgatggttcaatggcgatggtggtgggatag

SEQ ID NO: 81922 - DNA, 342 bp, Glycine max
  Peptide Sequence Number=SeqID_198700
atggatctgaacatgccaatgtcaagcttgaggagatgtccagaaattcagccatatgaagattgggcaatttcaagttcaactcaagtctctcctagattgaagcctaccatgtggatcacatcaataacaatgtgggtgcttgttagacatttgctagtaccaccattactttggcagattgatccaattctgctcatgtccatctccacttccagcaccaaagggaatttggctaagtcattaggagtggctaacataccctgctacatgcaatcggtcaatgtagaattaagccttgaaatagtgtttgcatttcttgctgtcataactcataactaa

SEQ ID NO: 81923 - DNA, 297 bp, Glycine max
  Peptide Sequence Number=SeqID_198701
atgggtttagatgacaaggctgctgaagatgaattggttttcgatgatgatcccttgacttggggagccgttgctgatgcaaccagggctagtgagtctttcacatacactatatggcaaataagaccaaagaagacagcttcaactgctagttataatttaggtgagaagcttctgagtggtctcgttgggatccatggaacattccttgagcattgcatagatgtcttcttcactgtgattgcccgtgatctccttgatgttttggatcgtcctcctgacactgctcggaattga

SEQ ID NO: 81924 - DNA, 1929 bp, Glycine max
  Peptide Sequence Number=SeqID_198702
atgccagcttctgagattggtagctctcctgcgcaaggaaagattcaaggcaaatcccaaggagcagcaaagaatcatgttactgagatgtcatccacttcatcagcagtaactcatagtagcccttcaaccagtagaccttcctctaattacactagtcgatcacaacaattaattggccctcaaaaaggtaaagtttatatccctgctgttcaaaagttgttatgtgattgtaaagattctgtcattattcattacccagttaatatccatattctggtgtctttaactgttgaatctggttctaataaggagtggaaaccaaagccaacaaatacgattaatcagggttctggaccagctagtgcatctgaggctcttgtttcagttgacccaactggtcagttacaatctgcatctagtgcgcttaactctgaagaagctacttcaaaactgcagaggaagctggaggatttgcatcttccacagcgtcaacatgttatacttccaaaccatatcattgtgcctgattctgaaaagaacaagtttagctttggaagtttgggagttgctttgggagttaatacaagctatgtaagtggcccagagagtgaaaagagttctacacctgtttctgaaacatctcagactattgaagaaactgtggaggagcaggattcaagtcaaaatgctgcagttacttctgaggttggagattatcctgaccatccacaatcacccactaatggagctgagaatttgtcatccagtgaggttgatggctcatccagtgctattcaagagtataacgagtccaagcaagacactgctttgccatctggaggtcatcagtactcaggggtacatacttctccaaactacagttttggattcatgcccccaatgttgggtactcagcttacacagtttgacaattctgagtctcaaacacgtgatgcttctcggcttccaagttttattgttcatcaacaattggatccggctagttactatgcccagttttatcgcacaggtggtgatagtgacggtcgcctttcacctttttcttctgctgggactaacaccaagtacaatggcaatgttacagtgcttcctgctccaacttctcaatctcctcaagagggaggtgtcttgtccaccgcaggtccaacaccacttgtgactcaagctgctgggctgatgcaaagctcaatagctgttactcaacagcctgtccctgtcttccgacctagtggggtgcatatatcccattaccctcctaactacattccttatagtccctatttttcaccattttatgtctcacctccagcaatccatcaatttatgggtaatggtgcatttcctcaacaaccacaggccagcactgtatatcccccacccccagctgttgctcccaccggaatgaaatatcctcttccacaattcaaacctggtgcaaatgcagcaaacccaactcaccttgtaatgccaagtgcctatggtgtatatggctcctctgcagctggttacaatcataattctgcagcagctgcagggaattcaacctccaatgaggatcttggttcctctcagttcaaggaaagcaatgtgtacatcggtggacagcagagcgaaggttcagcagtgtgggtggctgcacctggccgagacattaccagtttgcccactagcacattctacaacctccctcctcagggtcagcatgtgacttttgccccaactcaggctggccatggcaactttgcgggcatgtatcaccctgcacaagcagtgacggcagcaacggttcatccactgcttcaacaatcccagacaatggctggagcagttgatatggtaggacctggaggcaacgtttatcagcagcctcagcattcacaaatcaattggccgagcaactactga

SEQ ID NO: 81925 - DNA, 366 bp, Glycine max
  Peptide Sequence Number=SeqID_198703
atgggagagggagagaacacagaaatagaaacagaaacagaatcagaagcaacatcgacatggagcctcggaaaacacactcagataatcgaactttcggagacgctgacgaacgggaacctcagcgccaagattgaggccgcgagggagataaggaagatggttcggaaatcgtcgtcgtcgtcgtcgaagacgcgcgcgaagctcgccgcagcgggtgtgattgaaccgctcgtgctgatgctctcttcttccaacgtcgacgctcgccaatcctcgctcctcgccctcctcaacctcgctgttcgcaacgaacggtaccccccttcttctctcccaagatgcatgcttttttgtgaattgtga

SEQ ID NO: 81926 - DNA, 477 bp, Glycine max
  Peptide Sequence Number=SeqID_198704
atggaccataaggcagaccctgaaaaacccaagtcgtggccaaaatttattctgagggttgaccatcgtatgtgtgagtacctgacttcagggaaaaagacaagacttgcaacattgagcagttctctcaaagtttggattctcttgaaggaatgcttcctagatgctgtctttcggtgcatattacatttctgtcgggtgaatgacatgcaagtgcagtcaaactctttagaagctaggttggaattttatttaatggttgccagagggttcattagaggatcgttcgaggtcaaaccatttacagatgacaaggtggaaaaaaatcagcataaagttgccatttcaatgttaagatcctcagaggccagaaccaaaacgcctggtcaaaatgtgactcttgttcaaggagaaaaactagggtcacagggtggaagggcaaaaataatccgagttcactttttgagagcaagttag

SEQ ID NO: 81927 - DNA, 926 bp, Glycine max
  Peptide Sequence Number=SeqID_198705
tctacatgcagcagcctccaggatttgattcctccaacaaatctctggtctgcaagctttacaaggctatctatggccttaagcaagctcctagagcttggtttggcagactaaaagaactgattctcaagcttgattttcaatctagcaagtgtgatccctctctttttgtctattccaaaggatcatcaactgtttgcatgctgatctatgttgatgacataattatcacaggcaacaatccaactttgctgcagcagctcatttccaagcttaataatgtgttctccctcaaggatcttggctcctatctcctcaccaatctgagtggctgcaagctgatcaaagaaggctctgaccctctcactgatccctctatgtacagatcagtagtgggtgctctgcagtatgccacaattaccagaccagagataagcttctctgttaacaaagtctgccagtttatgagtcatcatactcttgaagctcattggccttttgtgatgctgactgggcctctgacccagatgatagaagatccacatgagtcagtggtagcttgttcaagtactgaagctgaatacaggagtcttgccttggttactgctgaagtatcctggcttcaatctcttctttctgagcttgcagtcaaacatgctgttcctgttattcattgtgacaacatgggcactgtgcctcttgttcacaaccctgttcttcatgcaagaatcaaacacatggaacttgatctattctttgttcgggaaaaagttcttagtaagctgctgaaagtggtctatgtcccagctcttgaccaatatgctgatattctcaccaaggccctctctcctatcaactttgaattgtacagaaccaagctcacagtgtgtgattcttctgtttttgctaagaatccctcaccatga

SEQ ID NO: 81928 - DNA, 261 bp, Glycine max
  Peptide Sequence Number=SeqID_198706
atgtcctgtgaaaagatacacacacctcttgggtgggataatgaagggagcattggggcgaaaaaggtgatgggggtgcgaaaaaccaagttcggccatgaagaagaagaagaagaagaagaagaagacgcagttggtggtgttgggggaaagtgttatgctatggtgggtctcacgtggattgcatggactcatggggacgtgaatggggggaaaaaatctcccatgacagggatcaacaatgaggacgggactagttag

SEQ ID NO: 81929 - DNA, 1505 bp, Glycine max
  Peptide Sequence Number=SeqID_198707
atggctactcctgttactgccgatgattgtggtggtgatcctccgccaaacggagatcctgtgctgccaattcaaccttctccagcgcacatgaacttccatcactccatcactgaaaagcttaattcggtgaactatctcttctggaattcgcaagttgagcctgtgattcgaggacattgtcttcatcacttcactgagaacctgcagattccagagtggtttgcgacacttgtggatcctgatgctggtcgcttcatcggttgcaccagttcgtggctagtctgggataagaatcacaactatttccatgctcacacgaatgtgaaggctcggcaacttcgcattgaactgcgtcaacttactcttgaaggttgtactatttctgattttctgatggagattcagaatcttgttgattctgctattggtgatcctattactattagagaacatgttgacattattattgaaggtttaccagaaaattatgagtcttctgtttcacacatcaataatcggtctgaacccctaactattgatgaaattgaaactattctccttggtcttgaggctcgcattgataaatttatgaagaaacctgtagtctctgtcaatgttgcttctacttctactgcatactctgtgtccagctccgtctcacctcaagctaatttcatgcaagaaagcaacactcagcaacaatctgaggaggccatggtggcagaggtcgtagcaacattcagtgctacatctgccaaaagtttggtcatgatgctgcaaactgcacctatgcctcagcaaatgcaaccttctgctacctttgtgcagcaatccatgcctcagccaatgcaatatatgcagcagcaacttccaatgcaacctatgcagcagcaacctcaaattttttggggtactcttcctcaaaatgcaatgtctcagcaaatgccttcctcaacttctatacctccacaaatgcctacctcgaaccctatgtcctctcataatccacaagccctaacaattggttccactgctagttcatccagcaactggtatcctgattcaggggcttcacatcatgtgacctccaatgttgaaaacatccagcaatgtgctccctttgagggtcctgaccaaggctccaatgagattctgctcaaaggacatctagggtctgatggattgtacaaattccctcacatgctgtattcctcaagtgctcccacttcaagctcatttaggaatgtgtctttcaattctgctttacattcctctcttgtaaatactgcttctcttaatttcattacaacaagcacttggcactctagattagggcacccaagtgctgctactcaaaatcttcacatagatgcatgctccttatcttctactacctattctcaacctgttgaactgattttcagtgactggtggggtcctgccccctttgtttcctctactggttacagctactatgttacttttgtagatgcttttaccag

SEQ ID NO: 81930 - DNA, 1368 bp, Glycine max
  Peptide Sequence Number=SeqID_198708
atgggttacttatgtgatttttgtggagaccagaggtccctggtgtactgccgctctgatgctgcgtgcttatgtttgtcgtgtgatcgaaatgttcattctgctaatgccctttctaggcgtcattcgagaacccttgtatgcgagagatgcaattcgcaacctgcatttgtgaggtgtgttgatgagaagatttcactttgtcagaactgtgattggttgggtcatggtacctcaccatcttcttcgacacacaagaggcaatcaatcaattgctactctggctgcccttcagctgcagaattttcttcaatatggtcctttttcttagacatcccttctatgggtgaagcatgtgagcaggaactaggtttgatgagcattaatgagaacagcaataagaatgcttgggcttctccagaagggcagaatgtgtctggttcagctgaagtgactgatctacccagcaagggtaaatcttgggctggcacatcttcagtacctgagtcaagctcagaacctcgtattctagaccagccgcctggacctgccaatgaatgtatgcccaaggcaaaactattggaaaatcataaccgtactaggtgtgatggagatgaacattctaataatgaaacagtgtatgaaattttgtactgtcctgggaagaaagtttctggaatatatgaagatgatgatctatatgatgatttcatcatggatgaagtggatctacaacttgagaactacgaggaactttttgggatggctctcagtcactctgaagagctttttgaaaatggtggaattaatagcttatttgagacaaaggacatgtctgctagtgctggtgattcccattgtcagggtgctgttgctgctgaggggaaggaagatggtgaggttggctacatgaataacatgacgtcattcgacccgggatcgtctgctgagttggtcaatgctatccaaccagcatgcagcaatgcagcatctgcagactcaatgatgagtacaaaaactgaaccaattgtttgttttacggcaaggcaatctctatcaaacatttctttctctggtgttaccaaagatagtgttggtgactatcaagattgtggtgcttcttcaatgcttctcatgggagagcctccctggtgtcctccttgccctgagagttctctgcattctgctaaccgcagcaatgctgtcatgcgctataaggaaaagaagaagacccggaagttcgagaagaaagtaaggtatgcctctcgcaaggctagggctgatgtcagaaagcgtgtgaagggtcgatttgtcaaagccggtgatgtctatgactatgaccctttgaaccaaaccagaagctgctga

SEQ ID NO: 81931 - DNA, 354 bp, Glycine max
  Peptide Sequence Number=SeqID_198709
atggcatacttgtgtccagattctgaatggcatttgaagaaaacaactacgccaccttttcctacgatcgtcatcatcgcctcaccactctcttctcttcctccctcgtccaccataacacccctggaaaagccgcacactagaaacacacttgaagagaagtttctgcaagcagatccatcgtcaccgcaacagatctggcaccaccacatcagtatccacaccaccagcatagatccagtgccgccaaccacagatccaagcgagacagtctatggacctgagtccatttatccacccctatacgcggcgagacttgctttgagtcaccgagtcaactcaacgagcaagtga

SEQ ID NO: 81932 - DNA, 600 bp, Glycine max
  Peptide Sequence Number=SeqID_198710
atggaaggaaaacaaactcttgacggacagggctacttacctttgaccgagacttcacagatgaacttctctggtgttgctttgcagagattgaagagacacagggcccaatcaaagcttgagtttgagggtcactgtaaaaacaaaaattactttgatatcaacactactaaaatcaagctatatgaaaagaagataccaaaaattcaaaatgaacgcaacactaaacttaggaatatcttaattcaggtaggaggttgtgctttgtgcggcggagctcaagagtcaagcacctgcatgactcaagaggaaacatcaaagaaggtcaattatatggccaacatgaaccaccatgggtataatcaaagaagcaatgcaagttatcatccaagaagtaatgcgggttttcatcaaggaggaaatttctctcaaaaccaaggtcaagattggaggttccatccaagtaataacttcaagaaagaccaagtggagaaaaatcctaaggaagactacaaggtgatcttcaccaggagcaaggtaagagagagtctaaaaaggaatgagtgtagagggagtaggaaaggaagtgggaaaagatga

SEQ ID NO: 81933 - DNA, 918 bp, Glycine max
  Peptide Sequence Number=SeqID_198711
atggtggccatgactatgaagggttgtcttatgtggcttcacagccagccactcttcatccttgacatgttcaatcttcgatccattcagattgacatgaaaactgagactgcgtgggtcgaaaccggtgcaacgcttggtgaagtttattacataattgatgagaagagtaaattgtttgatagaaaatcaatgggtgaagatctcttttgggccatcacaggtggtggtgaagctagttttgtcattgttttccgagttctgaaaacgctggagcaaaattccactgacatagtttataattggcatcattttgcaccaaccatcaacaacaaccttttcattacacttgtgttgaacgttacacaaaatggaataaagactatacgagaaaccttcgtagctctattccttggtgactccaaaagccttgtttctctcttaaatgacaagttttctcaattgggtttgaagcaatccgattgcatcgaaacaagctggcttggttcagtgttgttttcaaaaaacaccaacatcacagctttggttgaggtttttcttaatagacaaccacagtcagtcaactacttgaaaaggaaatatcattatgtaaagaaatcaatttccaaagagggtttggaagggatttggaggaagatgattgagttggtggatacatcattgaatttcaatccttatggtggaagaatggctaagattccttcaacaacatctcattttcctcatcgagctgggaacctatggaagatccaatacctagcgaattggaataagccagggaaagaggtagcaaatcactacataaacttgacaagaaaacttcacaagtacatgactcattttgtctccaagaatcctagaggggctttctttaattatagggaccttcacttatga

SEQ ID NO: 81934 - DNA, 459 bp, Glycine max
  Peptide Sequence Number=SeqID_198712
atgggaaacatgaaatggggtcactataaggaatggcttccaggttgtggaggtgttgaaacgaaggttgctagtcatgatcagaagtacttcataaggcagctttcaggaggcaaagacaaaaccagtgctagcatacatgttataacaacaatgaatctcacagaaaccataacaactttttcagaagacaccgatagattcacttcaccacatgtgctctcacgacaacaacaaccaaattctactcctactacaccaagaactcgttttcagtggagtagtcagtctaacacaggagtagctatgactctcaaccctggtcaagaaagagtcttcatgtctcattatggtgctaactcctttcgagttaaaattgaggaagtagaaccagaatcttctatccatttcaataagtacaatgcttgggttgagctttttccccaacttcttatgtga

SEQ ID NO: 81935 - DNA, 153 bp, Glycine max
  Peptide Sequence Number=SeqID_198713
atggctctcagccactctgaagagctttttgacaatggtggaattgattgcttatttgagacagaggatgctagtgctggtgattcccaatgtcagggtgttgctgctgctgagaacaatttatatataaggcctatacctcaatcccaatag

SEQ ID NO: 81936 - DNA, 918 bp, Glycine max
  Peptide Sequence Number=SeqID_198714
atgcaattccatcgttccctaagagcacaatcagtctcaacacctatacctgagaagatcacagaggagcctttgcctagcaaagttgcacaaagcaccgtgacatgtttttaccaagccaatgttgtgggcttttggcggaatgtatcggttttgtggtgcaaaaatctcatgaaccactccttgcacatcacggttgatagtgtaggaggtgaggtgcaatatagctgcaagattgacgtgaagccttggcacttttggagcaaaaaagggtacaaaacctttgaggttgatggcaaccaggttgaactctattgggatctccggtcagctaaattcaccggctcccccgagccgagcagcgattactacgtggccctagtgtctgatgaagaggttgtgttgttgttgggagactacaagaagaaggcttacaagagaacaaaatctagacctgcccttgttgatgccatgatgttgctcaagaaagaaaacgtgttagccaagaaaagtttctctacgaaggcccggttcaatgagaagagaaaagatagtgagattgttgtggacagctcaactgggggtcctagtgaccctgagatgtggattagcatagatgggattgtgctgatccatgtcaagaacttgcagtggaagttcagggggaaccaaactgtgatggttaacaagcaacctgtgcaagtgttttgggatgtgcatgattggttgtttagtggatcaggctcagggcatggccttttcatcttcaagccagggcctccagaagctgagagtgagaaagaaggcagtgctgtggagggttgtgagagtgatgatggcagtgttgggtatttttcaactatgaatatcgctacctttgagttctgcctcgttctctatgcctacaaaattgagtaa

SEQ ID NO: 81937 - DNA, 219 bp, Glycine max
  Peptide Sequence Number=SeqID_198715
atggctcttctctttcacatttgtcactcatttttctcatttgctctgcccaagctttcctacaaaggtgtgcttcacgactccgaaaatgacttctccttgcaatttggagtaggaatgaggagaaattttggagctttaatggaggcttcaatggtggagaaaaaagaagagaaaagcaacgtggaaagaggggaagaagtttctgaattttgctga

SEQ ID NO: 81938 - DNA, 213 bp, Glycine max
  Peptide Sequence Number=SeqID_198716
atgctggctgttacgaagtacgggtccctaggcgatagaaaatcccgatccgtggtttcttttcgacaaaccaatctaaaccgtcgaaatatttccatcaacgctccgcaacgtcctacactcctcaccacggatcgcgctcacaagccgtcgattaacaaacccccggacggccacgatgaaagtaacccactctcgaatctcgattcataa

SEQ ID NO: 81939 - DNA, 1377 bp, Glycine max
  Peptide Sequence Number=SeqID_198717
atgaagaaaacaccaccccccaatttgcatcaatctagccaaagtagacagaatgctaatctccaatttgttggaacaaacaatgatgcaaagaggcacagttctaagacactgagatctttgaagtatgctgccaagaaatgtgcagctgttttttcattgtttctctatggcaaaagaaaatcagcctcatatgttgttgggaatgatggcagaaagaatacatccaaagttagaggggtggtatcatcatcaactgatttgtcatctgagagtaccaccaagaattcatcaaaatggaagttttcttattcttacgcatcatccattactgcaagtggacaacttggaattggcaacttttcctttgaagaaatttacaagtcaactgcaaaattctctccagctaatgaaattgggcaaggtggctttggaactgtctacaagggaaagcttaatgatggatctattgttgccgtgaagcgtgccaagaaggatgtaatacacaatcacttacatgagttcaagaatgaaatatacaccttgtcacaaattgagcatcggaatcttgtgaggttgtatggatatttggagcatggagatgagaagattattgttgttgaatacgttggtaatggtaaccttcgagaacatctaaatggtattcggggagaaggactagaaattggggagcgtctagacatagcaattgatgtagctcatgcagtaacttacctgcatatgtacacagataatccaattatccatagagacatcaaagcatcgaacatcttaatcactgagaacctaaaggccaaagtggcagattttggatttgcacggttgtctgatgatcctaatgcaactcatatttcaactcaagttaaaggaacagctggatacatggatcctgagtatcttagaacataccaactaactgaaaagagtgatgtttattcctttggtgtattgcttgttgaaatggtgacaggacggcatccaatagaaccaaagagaccagttgatgagagagttacaatcagatgggcaatgaagatgctgaaacaaggggatgctgtatttgccatggaccctaggctgagaagaaatccagcctccatcaaggcagtaaagcaggttctcaagctagctctccaatgtgttgcgccttcaaaacaatcacggccgcctatgaagaattgtgcagaggttctgtgggacatccgcaaaagttttagagatgaagccaattctgatcatcctccccttccttctcaccattctgcaaactttcctcaaagagaaaagaataagtttggtattgaagatgatgacagctataaatttgtctctgtacctaatcatattcgttcataa

SEQ ID NO: 81940 - DNA, 819 bp, Glycine max
  Peptide Sequence Number=SeqID_198718
atgggtatctatgccaagtatggatgtatcgagcttgccaggaaactatttgatgaaatgcctgatagaaccactgcagattggaatgtcataatctctggatgctggaagaattcggagactgcaaggatgtattttgataagatgccagaaagaagtgtggtatcttggaatgcaatgctatcaggatattctctaagtggagcggcacaagagactctaagattgttcaatgacatgctaagctctggaaacgaaccagatcaaacaacatgggtaactgtcctgtcatcttgctcgtctcttggtgagccttgccttgccaagtcaattgttagaaagctggacaaattgaactttcgttcaaactattttttcaagacagctctgcttaatatgcatacaaagtgtgggaaccttgaggtggctcaaaagatttttgagcaattgggtgtgtataagaattctgtcacatggaatgccatgatttctgcttatgcaagagcaatcaagctgttcaaggaaatgatctctagtaaaggttcaaaaccagatgaggtgactatggtgagtgttttttctgcttgtgggcaccttggaagactaggtttaggcaattgggctgtcagtatcctcaatgaaaatcacatcaagcttagcatctcaggatacagttctttgattttcatgtacttaagatgtgggagtatggaagatgctagaataatatttccagaaatggcaacaagagatttagtttcctataacacatttgatttccgggctagcagcccatgggcatggaaccaaaccgcataa

SEQ ID NO: 81941 - DNA, 291 bp, Glycine max
  Peptide Sequence Number=SeqID_198719
atggttaagagttgtaactttcaatggcttccctgtctccttcaagggatttgggtgtttcactggttccttgagacacaaaaccatcttaagaatttgtattgtgtgtatggaaatggggacttgggtgacttggatgatggcaattatggtggggttgcggttagtggagagatgatgctcccttatgatcaagtggtgatgagcaatgcaacagctcaatcggaaaaccaattgcaagttggaacagtttcacaaattcttgccatgggattcttcaaagaactctaa

SEQ ID NO: 81942 - DNA, 219 bp, Glycine max
  Peptide Sequence Number=SeqID_198720
atggaccacaccaattgcgagagtctcaacgtggaatgtgaaagaaggtcgaagatgactcaaatgttcactcatccattaacatttttcctcattcaccacagcttcaatggcaatggtagcaagaagaaagaggacaaaggagaaagggcaatgtgtttgagcgcgaggaaaaaggacgaaggagaaagctctgtgcgcgaggggcctaaattttaa

SEQ ID NO: 81943 - DNA, 724 bp, Glycine max
  Peptide Sequence Number=SeqID_198721
atgcctagtttattcgcaatcccaggaactaagggagttgtaggcaatggccataggcctatggggaaggccagcagtgcgagtatagccggaggaggagtcaggcctccggcttcggtgaagaggctatcgcccagttgttatgcgtgccgggataggactttgctcggacagcggcggggagacggcaatgtcctacccaatgaccataactcggaccttcccctaccgaagtgtcagttggtttatgccatcctgacacagatgagtgtacatgtggctcagctaatctctgacattatttaccagtttgcaaagattgcgcccacgagacacccagtggacccagagaagttcaacagggccctgggatttcctactctgattataggcctctgtcagttctatggagtgcccgtcacccccaacaagatcatccggcctcctattaacagggcatacatcgagaaatattgcatgcccaagttggagtgttgtatacgacatgtggctaaccagcaggcgaccaaccacaggggtcagagccaggatcctagcccttatgcatggcctactcctgaggagttagaggtcatagtggcatggccaagagattggcccaattttcaaacaggggcagggcccaaagggacctccagagatggagacgaagctcaggaagacgatgacatggccaatgtgatggacttcttcctgggaggag

SEQ ID NO: 81944 - DNA, 863 bp, Glycine max
  Peptide Sequence Number=SeqID_198722
cgattgatgccttccttgcttatcaccatagcaaggaaagtccggtcacagctattttagtcgatctctatgacacgttcgaccgaagatgcgaaaagagcgacacacgaatcgtctattgtacaccaactctctatgtgtggttagtctcgcacctctttcgccacgagagtagacctgtttgtcccatgcaaggtcactacatatgcgccgagaaaggagaggtaaactgggagcaactcttggctagtgtggtaggggcatccattaattggttcccctggtggaagaaagggggagttggggttttgtcctcatgtaaaggattcccaaacattcccttaatgggaatgaggggttgtatcaattataatcccgtcctcgccataagacaacttggctaccccatgagaggagcaccatcagaggaaagcatcatgcctttgatcgcacggggtttcagtgaccacaatgcgaggatacttcaaggagtccacaaggcatggggtgcagtgcaaaggaaagataaagagcttaggggaagcgccaatggtatcatcgacgactatcataagtggctgaagactcagacgcaagagttggattggattcaaaagctaaaagtttcaagcgaggaaagggatgaaattcttgaggagagtgaggaggtgcaagccctaaaagcagaacttgaaagggcgcaagcagtcaaggaaaagttcaagacaacagccatcgagctgaagctttggaacgggaaacaaagagggcccaaaaggaagaacacggctgaaacaagtttcgaggggctttatgggggtagcaacaacgagcttaagctcccaagagctgagagggactag

SEQ ID NO: 81945 - DNA, 264 bp, Glycine max
  Peptide Sequence Number=SeqID_198723
atggcttcctatggtggtgagcttcttcagacttatcttctccttgaagtggcgtctccaatcatctttctccttctccattccgctgtcgtcaaacttcaacaagcaaaatactccattgatgaagaagatctaaggcctataagctccacatggagctacatcactatgactagatcgatatcaactagtgatgacaaaaagctcaaaagtcaagaacacttcatgacaacaaagatgatgatctcaagaatcaaagaatga

SEQ ID NO: 81946 - DNA, 249 bp, Glycine max
  Peptide Sequence Number=SeqID_198724
atggattatgcaatgaaatcacgagagtggtggagtgtgtggaaggggagtaatggtgtggtgacttctaataaggaaaatcgaaaaagcgagtatgatgaaactgtgcattatggggacaatccaccgcccaaggacaatagggggaccttgagaaattcgtttttcttgccgtcgctatgggaaagtgtaccttttcattttcaacttttgagagcatcactttttctaacggaacaaaaagattga

SEQ ID NO: 81947 - DNA, 624 bp, Glycine max
  Peptide Sequence Number=SeqID_198725
atggcagttgaagtgattgaaaatggtaagacaagaccattgatggaaatacagataagaacaactgaaatggacaggctagcagttggtggaatagctgctcattcattatacaaggctggccttactgatcctgaggaggcaaagcgtctgaagaccatcatgttggctgcaactgaattgactacgctgtgccttaaagattttctgacaagtacaaatcataaaggaattgaaattgaccagagggatagagcgttttgccttcttgacaagaacggagacgataaaattagcattgaggaacttacacaagtgatggaggagcttggtgcgccaggagaagatgcccgagaaatgatgcagctccttgactcaaacagtgatgactccctcagctatgacgaatttcatatgttccaagaacaggatatgaacgcgttgaggtatgatttaatggagttaaagccaacactatttgctagagtcccacgggttttcgaaaagaatatgtgtttcaggaatcaagaaagcagtggaagaactcaatccaatgaggagaacagtttttggcatgctctacaactacaaacttggttggatgaaaaaaggatacaaacatag

SEQ ID NO: 81948 - DNA, 741 bp, Glycine max
  Peptide Sequence Number=SeqID_198726
atgaatgagtttgatgtgaaagaggaacaaatgtggttgagtgaaagagagatatcaaaattcaaaatattttcattccattgtgaggtggagaagaaaaaaaatattctgagagggctatctattgatggaagatgggaggagacacccagggaagtgaagagagaagtaaataatttctttgagaaaaaaattagtgaggtgaatttccctagaccaagtttggatggtgcaagtttcaaacaaatttcaaaggaggagaatcaaatgctaatagtccaatttggagagcaagagataaagaaggcattatgggagtgtgatagccaatgtcccggaccagatggtatacacttcaacttcttaaagaccttttgggagactatgaaggaggatacggtgaggttcatttctgaattccttgctcatggaatgctacctagaggtactaatacttctttcataactcctgtgcgtaaggtagaagacccacaaaacttgagtgagtttaaacccatttctttggtgggatgtatgtacaaagttctagcaaaacccctagccaataaaatgaaaagggtgatgaatggagttatagaccaaagacaaagcgccattttaggggatagatacattttacatagcaccttagtggccaataaggctattgaggaagctaaaagagagaaaaagaagtcatttttttcaaagttgattatgaaaaaactcatgattccataa

SEQ ID NO: 81949 - DNA, 342 bp, Glycine max
  Peptide Sequence Number=SeqID_198727
atgtctttcgaccaagactaccacagtcttctttgcctccaagactatcaagtctgttggcttgtagagacaagcgaggtcatctgccccctttacatttcaagactatcaagtctgttggcttgtagagacaataaaggtcatctgcttctttacatttccaagactatcagagcctgttgtttcaagactatcacggcccttggctcgccaagacgtgccagaaagcttagggctgaagtaaccagctcgcttgggagagcaaggttacttttggaggaagcaaccagctcgcctgggcgagctgctaaacaacctccacccctcatttcctataaatag

SEQ ID NO: 81950 - DNA, 294 bp, Glycine max
  Peptide Sequence Number=SeqID_198728
atggcgtcgaggccgagggtgacggcattacaaatgtcgagggacttgatgacacagtcaaggagcttcgggaggattttgacgagtagtggcttctggagaaccttgtcgagcggtttcttctcctctggttttgatgatgtcaaaaagaatatacttgataattttgtcatcataaaaaagggggagaatgtgaataatgcaagttttgatgataccgaaaagaattcacttgataatgattgtcatcatcaaaaagggggagaatgtgagtatatgaatacagggttttga

SEQ ID NO: 81951 - DNA, 569 bp, Glycine max
  Peptide Sequence Number=SeqID_198729
atggctccaaagaagcttccagctaagagggcaaggaaagatgctgctggagaaggatccaatgcggccccacaagtggatgtggagtttgacggacatcggaggcaatggactcaacttgtggcacccatggctaagtataatccagaaatagtcatggagctctatgccaatgcatggcccacggaggagggagtcagggacaagcgctcatgggtgcggggccaatggatcccctttgatgaagatgtcattaatcagttcttggggcatccgttggtcctggaggaggggcaacgctacgagttcagtcagaggaggagccaggcctcgaggttcaatgaggaggccatcagtcagcagttgtgtgttttggggcaggacttcactcgaagcgtggcagggagacgggtgcggatcatgctcactagcatgaccacactgacacagatttggatgacattgcagctcaacaacatcctccccagtgatcataattctgacctccccctgtcaaagtgccagctggtctatgccatcttgacccagatgagtgtttatgtggccca

SEQ ID NO: 81952 - DNA, 585 bp, Glycine max
  Peptide Sequence Number=SeqID_198730
atgaatgggggagttgaggctgctaataagaatatcaagaaaatagttcagaagatgatcgtgtcattcaaggattggcacgagatgctccctttcgcgctgcatggttatcaaacttcggtgcgtacaacgactagggaaacccttttctcgttggtgtacgggatggaggttgtgctcccatttgaggtagaagttccttctttgagaatccttgccgaattggggttagaagaatcagaatgggccaaaactcgatttggtcagttgaatcttatagaagagaacttctggtgtgaagatcctgagggacaacagagattgaagataaagttatcatgcggagtattggatgaaagtttgagtgattatgaggtttctagagtgcacccgcacaagttcagcgagggagatcttgtcttgaagaaagtatcacaagttcaaaaggactacagagggaagtggactccgaattatgaaggacctttttttgtgaagaaggatttttcgggaggagcattgttgctcgcaagcatggatgatgaagaattgactttgcttgtgaactctaatatcgtcaaatga

SEQ ID NO: 81953 - DNA, 213 bp, Glycine max
  Peptide Sequence Number=SeqID_198731
atgagagcttctaccggtacaccctgcaccagcagagccaggacccccaatcctttcccgtggcctacccccgagcagttcggggccacgattgcttggcctagagataggcccgattttcagacaggggcaggacccgtagggaccctcggagatgaaggaggagcacaggatgatgatgatatggctgatgtgatggactacttcctttga

SEQ ID NO: 81954 - DNA, 156 bp, Glycine max
  Peptide Sequence Number=SeqID_198732
atgggttttcctttgctggcagtcacttaccttgtcgaaaatttatctggtctaaaggttttagcattctatttgctctcccttgaggagattccgctgtcctttgcttcaggggcaaggatgaggattcttttgataggccaaggtccaaaatag

SEQ ID NO: 81955 - DNA, 534 bp, Glycine max
  Peptide Sequence Number=SeqID_198733
atggagatcgtaaacttaggtgttggcgaggaaagaaaagaggtcaaggatggcatgggcatgtctacgcttatccgagatgaattggtggctttattgcgagactaccaagatatcttcgcttggtcataccaatatatgcccagcttaagtcccgacatcatgcagcatagattacctctgaatctcgagtgttccccgtttgatgttggcttcttggctgtagctcgatacccggaatgggttgccaacattgtttcagtccctaagaaagatgggaagatgcgaatgtgtgtggattattgggatctaaaccgagccagtccaaaggataactttcctctgtcgcacatcaatgtccttggaacgttctactacaaagtgatgtccattggatttaagaacgatgtggtaacttaccaacgggctatggtagcattatttcgtgacatgatgcacaaagaaattgaggtctacgtggatgatatgattgccaagtcaaagatcgaggatgaacaccttgtcaaattatga

SEQ ID NO: 81956 - DNA, 258 bp, Glycine max
  Peptide Sequence Number=SeqID_198734
atgtcattcaccaaccaaccaatgaattacatgttctcgcatccccttctcctttcaccgtgtggggaacatacttactcaaaccattccctcttgccaaaagacagtgcaagggtaaaactcgaccttgttaaggaaaccaaagatcaagcaatgataaaagccaaagaatgcaagcaaaggatggccgagaggtttaacaccaaaatgaaactgagggaattctcgaaaggcaacttggtttggagagccatgtaa

SEQ ID NO: 81957 - DNA, 993 bp, Glycine max
  Peptide Sequence Number=SeqID_198735
atgtctgcatctactcctatggctggtggcaatgaggataacaaaggtagcaagggtggaaagggaggtagcacaagtcatttacggagacattcagaaagttgcttaataaggaggctacaactgtctaaagaaaagaagcaacctatcatccccttccagccttctaatccaacaaacccatttctagttcctggaataagatactccaatgagaggatgagagaaataattgctattgtcgtgatggttcatgagctacctttcagcattgtcgaggatgaagtatggatgtgggcattacaatatgcaaattctgaatttcaaaaaataagtcgaaaaatagtgagaagtgattgtttaacattatatgaagcagagaagaaacaattgaagaccttgctgaaaattgttagcaatattagtttaacaactgatatgtggaaatctagtcaccaagttgttgagtacatggttattacaggtcattttatggatgcaggtgcctgctccacgcgaggaattgatgtggttgatgtcattttcaagtgcttaatggcatgggagattgaagacaaagtgttttatgtgtctatcgataacgcttcttacaatgactcatgtttgaagaatcttaaagaaaacttatcattgagcagaaagctggttttgaatggtgatctgtttcatgtcagatgttgcacacacatattaaacttattggtgcaagatggcctcagtaagattaaggatatcattcagaatgttcgtgaaagtgtgaagtatattaaccataatgattcaagactaaaggcattttgtgatgttgtagaacaaaaacatctaaaagaaagaaagctcatcattgattgtcccactaggtggaattccacatttcaaatgttgtcaacaacattgaagttcaaaactgcaatttcagcctatagtgaaagagatccacactatacttatgcaccttcacatgaggattag

SEQ ID NO: 81958 - DNA, 180 bp, Glycine max
  Peptide Sequence Number=SeqID_198736
atgcaagttgggtgtttgaggtgtcatggtggtgttggcgttggtaataggagaagaggccaataccgatgtagtcaaggcatgattagttggagaaagagaggtggtagaaataaagggaactgcactggccaccctggagtaactgcactgtcgggctttatagtttcattagattag

SEQ ID NO: 81959 - DNA, 228 bp, Glycine max
  Peptide Sequence Number=SeqID_198737
atgtcaaggagtttccttgttggttttgtagaaggtctagttcttgctgttctgattcaagctcaggaccaatcaggattcatcagcatagactgcagatctcctgcagatttaaactacactgagtcaacaacaggcataaattatacttcagatgcaaatttcataaatactggtgtgagtgggacaatagtatctgaacttagaaatgaggctctaaatatctga

SEQ ID NO: 81960 - DNA, 425 bp, Glycine max
  Peptide Sequence Number=SeqID_198738
atgggtgagtttacgattcagattagcaatgaccttgttaaccagcttgttaatgatatgcccgacagtgcagttactccagggtggccagtgcagttccctttatttctacctacaacattgcctgtacaaccttcccattcagagttagaaggtattcagtctatgcttcaggaaaagaatattaccacctctctttctccaactaatcatgccttgactacatcggaatcaaagtttgagtctgcaatgaggagaagaataatgaagttcctcaacatttctgacaatgactacttcatggttttcacagcaaacagaacctcagcttatgactatgagaatgaggcagtggaagcaatgattagttgctcagagaagagaggagccaaggcacatagcggcacctgcaaaaccaaaagaag

SEQ ID NO: 81961 - DNA, 705 bp, Glycine max
  Peptide Sequence Number=SeqID_198739
atgtccataagggaagagtgctcagggaagagtactcaagtactcggtaaggctaaatacttcagtgctttaagagttaccttttttggtaataagaagggagtcctcgattacaagaatgagctagcatctagtttggatagtgattatgagacattctcttctagattctcgacctcttcattagatggggggaatgttgatctgtccgaagataaggagatggtggacgagtctgtagatggtgtattcagccaaaaggtagatgtcgaggcttcatgtagtgataatgtggtcaagtttttcggtatggatgctcttgactttgccaatgttttccaagaagccagtgtcactgtcggcaatgctattattatcggccctatcaaccaaagccattggcctcgccctacaccaaatgatatggtgtcatctgctgaaaagaaaggaaaaaaagggaggaagggcaaaattgattgcaataacataaacaagataagggaagagagaatgcaaacacagttttatactggttcggccacaacccgtgcctacgtccagtactcaagcaacccacttgagatttccactatctttgtaaaatccattacaaagtctgaaccacacagggacaacccatcccttgtgttcaggaatcctttacaacaagagactcacagtctcttaaccaatctcattgaataa

SEQ ID NO: 81962 - DNA, 264 bp, Glycine max
  Peptide Sequence Number=SeqID_198740
atgagcaaggatcatgagccatgggttcgaccaagtatgaggttgagaagttcactgggtctggaggaggttcttaaaggagacttcaagctcaagaaatcgatgtcagagaaagataagaaagaaatgctggaaaaggctcacagtgcaattatcttgagtcttggtgacaaagttatcagacaagtctccaaagagaagactactacaagagtatggtcaaagctcgaagggttgtacatgatcaaatccctagtaaattaa

SEQ ID NO: 81963 - DNA, 1557 bp, Glycine max
  Peptide Sequence Number=SeqID_198741
atgactgaaaaagagttcattttggtgtttcttgtacagagtgagaaggaggagtcttttgcaagtaagaaaagtagttcatttcgttttgaaatcataagtcctcattcaagttcgggtccaagaagtgatgacaagaatctcagatatatatatgatgaaagcagaagtcctagatatacacaaaagtatgcaaggcacaccggcctctccagaaatcctataaaaattgaagttgttgatgacaggttccaagatgatgaacgtagaaatcgcaggctttcaaacatagcatcaaagctaaaacaaatttcaattgacggtcagaagaatgtggacaaatcccaacttcccgttgaacgtcctttgggagaaatattaagggagaatgcttcatctctacaagccacacattcttgtggcaagggttctgttgaggaaaatctatctgaacaaaaaaataataatccagaaaggtccattgatttgagttctaagtctcaggctactcattctgctgctggaggtagaccggaattaccacatacaacacaatcaaatgaaagtaactgggccatatttggagcttcaacagagaacaatgatcctacaactccagacacaaatacctcgaaaccttcaacaaaaaagacagcatctgaagcagcaatacctgcaaaaaatcctgtagaccttttacttttcgaattatcaggtcctgtgactccagttaccggtggcatgtcacaagccgcaagtggtactaataatgatccaacaactacaacagtagataatggcactacttgggactttccatctacttcagtagggcagacaactgcatcacccaacaatactagtgtttggtcattcacatcaaccccagccactgagtcagcacagccttctaacgaagttcctctacatactgaagtttcatatgcatataaaacatcaagcatgcaatatgttccttctgtatcaacagtttgtagttcaaccacacaaccaataaattcaccagtcaaagatgtagcttcaaataatcagccatcattagctcctagtacaaatgactcttcaggggattttactgaacaatcttctcaaactacctcaagcatgcaataccttcctcctgcattggcaggttgtagttcaaccgcacaaccaaaaaattcaccagtcaaagatgtatcttcaaataatcatccatcagttactcctagtacaaataactcttcatggggttttactgaaatatcttctcaaactacctcaaaacctactcatgaaaccaggtctagtggaagactggaacttccagaggacctttttacatcaagctacttatctggccctgcaccacttacaggttggcagaatgttcaacctcatggcatgcagtattacaataatgcagcgcctccctcagcccttccaaatgcaccgaagtactcaaacccctttgatgtaactgatgggagaagtttaatccatgtctcatcgcttgtttctgcgattaaacttgaagcttctgatgcaattcactga

SEQ ID NO: 81964 - DNA, 489 bp, Glycine max
  Peptide Sequence Number=SeqID_198742
atgaaaaggagtagaagtttttccttactcttttacctgtacttgttggtgattgtcttttctaccttctctatagtttccgtggaagcaaggaagactaacaccaagaaaaaacttcacaaacctcacaaaggtggtcacactcgagggtcacattctccatgtccaattctagcccctcaagggagcacctttgatgttttggcttttggcgccaagggaaatggagtttctgatgattcagaggcacttctagctgcatggaatcgtgcatgtaaagttgctggtgctacagttaaaattccagcacaactcaagttcctcatgaaacatgctactttacaagaggcattgaggctaacactattagaaaaatacactttcaacatcggttatttacggcattctacgtcggttttaaaatcgatgttgaaagtactgatgttgaatgtattattgttaacattggttttgaaaaaccgatgttaa

SEQ ID NO: 81965 - DNA, 1581 bp, Glycine max
  Peptide Sequence Number=SeqID_198743
atggcataccaaaaccctccttcaattccaatctcagaccctgaagcacccgaaatcactcctactcctactccttcaaccaacccactagccaatggtttctcagccaaaggggtggcgaacaaagtgaagaacaacttggtttttcattcaaaatggggtgaactcaatggtgcaatgggtgaccttggcacttatataccaattgttttggccttgacccttgctagggacctcaaccttggcaccacactgattttcactggtgtgtacaacatcatcactggtgccatttatggggtgcctatgccggttcagccgatgaagtccatcgcggcccaagccttatcggacaccgatttcggtgtgccggagatcatgaccgccggcatactaaccggcggggtgttgtttgttttgggagtgacagggctgatgcagcttgtgtacatgttgattcctctctgtgttgtgaggggaatccaactagcacaaggcttgtcatttgctttgacagcagttaagtatgtgaggaaaattcaggacttgccaaagtctaaatctttggggcagaggcattggtttgggttggatgggttggtcttggccattgtttgtttgtgtttcattgtgattgtgaatggggctggggagaagagtagagggtgttgtgatgttgtggaaagtggtggcgatgatgatttgggtggccaaaagaggaggaatgaggttgttgaaagaaacaggacaagatgggtgagaaaggttattttctcactaccttctgccttcatggtgtttgtgttgggtgttgttttggccttcataagaaggcatgaggtggtgcatgaaataaagtttggaccttccactatagaagtggtgaagttctctaagcatgcatggaaaaagggttttgtgaagggtgcaatcccccaacttccattgtcaattctgaactctgtggtggctgtttgcaaattgtcatcagatttgttcccagggaaggatttctcacccacttcattgtcagtgacagtagggttgatgaacttgattggtagctggtttggtgcaatgccaagttgccatggtgctggtggacttgcagggcaatacaaatttggtggaaggagtggtggctgcgtggcacttcttggtgctgccaaattggtgttggggttggtgttgggaacttctttggcacacattttgaagcagtttcctgtggggattttaggagtgttgcttttgtttgctggaattgaactagccatgtgtgctagggacatgaacaccaaggaagattcctttgtgactcttgttatcactgcagtttcacttgtgggatcaagtgcagctcttggctttttgtgtggaatggttgtctatgtgcttcttaggctgaggaattggacaaaggataaaccactttctactatttggatgcagaaaagacctgagcaaaacgatttcttgcacggtggtgccaagcgggttcaatggtggcattgtggagcttccaatcactccaacgctcgagtcaataaggatttaaggttgagtgaaagaatggattag

SEQ ID NO: 81966 - DNA, 306 bp, Glycine max
  Peptide Sequence Number=SeqID_198744
atggcatctttccacggtgtacctcctcccgctgtatcacccagaacaggattaatgcatgcttcaagccttgggtctttagggacaatggtatctcagtctccatgttatgcatctccagttcccaagggtgagtaccaagttaataataaggagcaacccacaagaccacaaagagctggcagcttcaacagtgagttatctgcttttggatctctagatcccatccagcagtcaaataggggactcatgacctccaaaactgcaaattatttttcaaatacaagaggaaatccatttgactag

SEQ ID NO: 81967 - DNA, 628 bp, Glycine max
  Peptide Sequence Number=SeqID_198745
tgtgaagaaagagaagaggaaattctggattgctctctcatgtgaagagatcaaagaagacatcttcgtcatgacgagccctaagcccgctcgccggcctaggaagcagcccaagaatgtccagaaacaaatgcatagtgtgttccttggcttatggttagtagggataactgcggatgcttacagagtcactgatacacccgccaaggcaatatatgtttttggagttgggatcccattgttcaatcacaatgttggaagcactcatacgatcaagtggagtttgtggataatacataaattattgcttgctgcagcatatggcttcattttatctgcaaatttctccaaatggagagagaagctgcctccaagaccatctttccacaactatgttgctgtaatgtttgtcttcagtgtgattaccttgtttgcttatggactagcagaaattgacgctggactcaacaattggttgtatgatctcactatgctttgttatcactgtgtcatcaacacgaatgccatctcacttgtggacaacgcatattacttcgctcttggaattctaaggaatagtgcttttgaaattgatcatatttttattaaccaaggacatacttactaa

SEQ ID NO: 81968 - DNA, 195 bp, Glycine max
  Peptide Sequence Number=SeqID_198746
atgtatagtgcaaaaacacctaaaacacttggtatagacatagtggttggttggaatggattatcatcttgcaatgcttccaataaggaccatgtttatcatcgtgaggaagggattgtgattaagatagtgggagaaaaagacttaacactccgatacgtgtatgaagaggttggtatcatcattattatttag

SEQ ID NO: 81969 - DNA, 366 bp, Glycine max
  Peptide Sequence Number=SeqID_198747
atgtgctgcaaggcgattaagttgggtaacgccaggggcgaattggagctccaccgcggtggcggccgctctagaactagtggatcccccgggctgcaggaattcgattacgggatcgacacgcccgagcgggagaagctgctcgccgcgacccacgatctcgaggccatgcgcaagtatatcggcgccgattcgctggccttcctgtcgatccccggcctctaccgggcgatgggcgaggaggcgcggaacgcggcctgcccgcaatacaccgaccactgcttcacgggcgactacccgaccggcctgaccgacctgtccatcgccggcccgaagcgcttcgccatgctggccgaggccgactga

SEQ ID NO: 81970 - DNA, 450 bp, Glycine max
  Peptide Sequence Number=SeqID_198748
atggctgagtctcagagaaccctggaaggccgcgtcgcggtcgtcaccggcgcatcgcgcggcatcgggcgcgccgccgccctggctttggccggggccggcgcgcacgtcatcgcggtggcccggaccgtgggcgccctggaggagctcgacgacgcgatccgcgccgccggctccagcgccaccctcgtgccgttcgacctcgccgattacgacgcgatcgaccgcctcggcgcggcgatcaacgagcgctggaaacgcctcgacatcctggtcgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 81971 - DNA, 1001 bp, Glycine max
  Peptide Sequence Number=SeqID_198749
atgccgaaactgaccgtactgcctcatcccgactactgccccgagggcgccgtgatcgaagacgcgcccaagggcgtgtcgatctgccgcgtcctgctggacaaccatatcgacatcgagcatgcctgcgaactgtcgtgcgcgtgtacgacctgtcacgtggtggtcaagcagggttatgcttcgctggaagacgcgaccgatgacgaagaggatctgctggacaaggcctggggcctgacgccgacctcgcgcctgtcttgccaggcgcgggtcgaggatgccgatctgacgatcgagatccccaaattgccgaggcgctggcggacgcccacccggacgtcgatcccaagacgctgcgcttcactcagctgcgcgaatgggtgctggccttgcccggcttcagtgacgacccggaacgcagcggcgaaaagatcctggaggccatccagatggcctggatcgacgaggccgactgaaccttctgcgaaacgctccttcgggagcgtttttgcattgggggcgcgggcggcggggtatcatcaagactcttttcgttgtccttgccatccgagtctaccgatgcccgctgcccaattgcgctttggcctggccgccaaccgactgcaccacgaaacgcccgatgccgccttgttcacctggctgcgggcctgctcatccaccatccgcgaactgggcgtgcagttgcataccgtgggccgcacgcacgacgcgatcgtgcgcgagggcatgctgcagggctatcccggcctgatccgctatccgtatggccgcgagggcgggttgatgaagctggtggcgcgcgtcaccgaaggacgcgacgggcaggagccgttcgacggtgcgatctacctgatcgatccggtcgatccgtcgtcgatctttcccgaggcgctggcgctcaagcgccagtcatcacgcatggccgtccgttcatctcgacgctggcgggcgccatcgaatggatggaggtggagcgg

SEQ ID NO: 81972 - DNA, 988 bp, Glycine max
  Peptide Sequence Number=SeqID_198750
aggactacacgtcctctccttcagagccctacatgctctcgccttcagagggctacacgtcctcaccttcaaagggctgcacgccctcgccttcagagggctgcaagccctcgccttcggaaggctacacgtccgcgccttcagagggctacatgtcctcgccttcagacgactatacgtcctcatcttcagagggctacacgccctctccttcagagggctacatgctgtctccttgagaggactacacgtcctcggcttcagaggattacacgtcctcactttcagagggctacacgcgctcccctttagagggctacacaccctcgccttcagtggactacacatcctcgccatcagagggttgtgtagcctcaccttcagagggctacacgctctctccttgagaggactacacgtcctcggcttcagaggactacacgtcctcggcttaagaggactatacgtcctcgccttcagagaactatacgtcctcgccttcagaggacttcacgacatcaccttcagaggactacacgtcctcgactttagaaaaactacacgttcccgctttcagaggactacacatcctcaacttctgaggactacatgtactcgccttcagagggccacacgccgtcgccttcagaggattacacgtcctgaccttcagaggactacaaacctcgccatcagaggactacacgtcctcaccttcagagggctacacgtcctctcctttagagggctacacgccctcgccttcagaggactacacatcctcaccttcagaggactacacgttcccactttcagaggactacacatcctcaacttcagaggactacacatccacaacatcagagggctacacgtcctcaccttcagagggctgcatgccctcaccctcaaacaactgcacatcctcacctttagaggactacacgtcctcaccttcagaggactacacgttcccactttcagatga

SEQ ID NO: 81973 - DNA, 417 bp, Glycine max
  Peptide Sequence Number=SeqID_198751
atgcatcgcattgctactgctgtttgttcgctgtcactgctggtatcgggttacgccttcgcggcacaaaaggtggccttcgtgccgcaaatcatcggtattccctattttcaggcgatggaggcgggcggcaagcgcgccgcgcacgatctcggcgtggagtttgtatatagcggtccggtagatactaacccgatggatcagctgcagatcgtgcagaacctgattgcgcagaaggtcaatgcgattggcatcagcgtgctggatgcctccagtattgcgccggtgatggcacaggcgcaggcgagtaatgtgcatctgttcaccagcgacagcgatgcgcccgacagcgggcggccggtctatgtggcgcaggccactgatgagggtctgggcgatacggtgatcgatgagatg

SEQ ID NO: 81974 - DNA, 165 bp, Glycine max
  Peptide Sequence Number=SeqID_198752
atggatactcaacaagggacattcatccataggcaacaaattgctcattcttctaaaaggttttcaaaaggccaatgttcaaaattttctcctatggaattaccaaagatgaaatactcccccatcttggtttcctttttttatttaactgaggttacagcgtga

SEQ ID NO: 81975 - DNA, 318 bp, Glycine max
  Peptide Sequence Number=SeqID_198753
atgagggaaggtacaccactaaagggacatcttgataagctaaactctattctaatggagttacgcaacattaatatcaagatagaagatgcagatctggcaataattttgttagactttcttcctcccccctatgagaattggcagaaaaagaagaaaggaaaatgtggcaagaagagtaaagatgattctaaggacatctacaattattgcaaagaaccggatcattggaagcgagactatccaaagaaagcaaataaagatgttgttgttgctcttttcagaatgactcctcatggggaagcgatttggttctga

SEQ ID NO: 81976 - DNA, 387 bp, Glycine max
  Peptide Sequence Number=SeqID_198754
atggtgttgcttgtcaatgttatgattcaacaagcgattctcctcaaatttcagccagccccgtatcaattagacttcacactttatgcttcggggtcatacaatgctcaatggaatgccccagggctcctccatgataagcacacgttgcgttcgagtcgtatcctcagaaaaatggaggttgaggaaccttggttggggctttttgctgcaaaattcctttttgttggtgtttttttggtttgtgctaaaggtggtcttcgtcattggaataatgacattgttgggtttggtgggaaacttggccgtataggaatggcagtcacagcatgggtttctccctctttctcaccctcttcatttgccccagttttctcagtcgtccta

SEQ ID NO: 81977 - DNA, 915 bp, Glycine max
  Peptide Sequence Number=SeqID_198755
atgttaaaagtttttgaccgaaatggtgaccaaattataaccaaggaagagtttgtcactggcttaacagaatacattaaccaatcaaagcatgctctggatagacaatacctccccaaagaatctctcaacaaaatgtatcagacttttatcaagccatggattgaacacgtgagaaaacaacgtgaattgaagggacatcttatatctgaagtcttgaagcatgctcagaatgatatggttggccggctgcgccaagatgatggcacacctgacaaaattgctatcaaaaggttgtttgaggaaattgatgttaaccaagataaccacatttcaagatctgaattggaaaaagtagtcaaggacatccagtttggcaaggctgtagaaactgaggaggcagttacaaaacttgttcaagatcttgatctcaacagagatgatgaaattagcgagaccgagtttgttgaaggctttacaaaatggatgaactcaaattccagccaagctgctaactcaaaatcttcgtctcacgaaattcgtcgaacctgggaagatgttgaaaaggtaatagaagagaatcaaaccaaaggaacatctgcatggttgacggctataggatatgtggtgttgggagttactatactggctcttcttgcagaacccttaatagcaagtgtccaaaaattctctgaagaagcaggaatttcatcatttttcatctcattcattttagtccccctggctacaaattttagagaagcaacctcagcaatcaaagaagctagccataagaagaccagtaatacttctcaaacaatgtatgaggttagtcatcatctccatatgccagtttcacttcttcactatgctcctatgagtatgaggcacagatacgatacagtatacatgtag

SEQ ID NO: 81978 - DNA, 1090 bp, Glycine max
  misc_feature (1064)..(1064): n is a, c, g, or t
  Peptide Sequence Number=SeqID_198756
ttcaccgatgcagcagcgaaaaaagtaaaaaacctgattgcggatgaagagaatccggcgctgaaactgcgcgtatatatcaccggcgggggctgcagtggcttccagtatggttttacttttgacgatcaaatgaatgacggcgacatgaccatcgagaagcagggtgtggcgctggtggttgacccgatgagcctgcagtatctggtgggtggatcggttgactacaccgaagcatctgatgctgggctggctgccgttctggcagccatgatttaccactcaatcgtcactaagcgtgccgtttcacggcgcaacgcatcgcggttcagtacgctttgtgtcacgcgcggctgcgcgctgaaatgccggccacagtcaacagacggcagcgtctgctcactcgggcgtgagatatcgcagcgggagaagatcgttagcgagacggcgatagagcccgtggtggttgccgcaccgatcggtgcagccacgatcagccctatggccagcagcagcgctctggtcatggcgcggacccggccggctcagccagtcatcgttaagcgcaatcaccggcacgttaagctgcggctgccagaagcgcgcgacgctggcggcgcggctggcatcaccggcagtgacaatcgcctgcgggtgccgcatcagcacctgctcccggctcacctgaggccagcttacgctgctgtcagcaaagatattgcgaccgccgcacaggcggctgctggccaaactgcagaaacagcggcaccggcgtttgctgctgatagcgctgacgcagtgtctgcaactgctggtgtaacgcctgcgcggccgcggtggcccgctggggctgtgggctccagcgctgcagcgccgccagcgcgtcaatcatctggtcgagtgattgcggatcgatccattccacatggatgcccagacgctgcagctgctccacctggcgcagcggattgccgccgcgccaggccagcaccacatccgggtaatgacgcgcggtgcggccagcagactgtggcacagcagccacagcccgagcagcagatatntagccacgcgccagctgtgccagcag

SEQ ID NO: 81979 - DNA, 198 bp, Glycine max
  Peptide Sequence Number=SeqID_198757
atggctatggtggtttggttgtttgtggcacttatcataacacagtcttacacagctaaccttgccagcatgctaactgctgaacggcttgaacctaccatagatgatatcgatcagctacggaatagcaacatcaaggttggatatggaagtgttacagttccatccttcaaacatgaggcactttggagcacttga

SEQ ID NO: 81980 - DNA, 1296 bp, Glycine max
  Peptide Sequence Number=SeqID_198758
atggagcaggaagtcacactgctgcgtgacaaaattgaaaaccgtcagacgctgacgctggccggctgcgaaatttacaccggtacgctcaacggcgttgaggtggctctgctgaaatcgggcatcggcaaaaccgcggcggcgctgggtaccacgctgctgctggagctgtgcaaaccggatctggtgatcaacaccggttccgcaggcggtctggcgccaacactgcaggtgggcgatatcgtggtgtccgatgaagtgcgttatcacgatgccgatgtcaccgcttttggctatgagcctggtcagatggcgggctgcccggcggcgtttgtcgcggacagcgcgctgattgccgccgcagagcaggtgatcaaacagctggatctcaacgcggtgcgcggtctggtggtcagcggtgacgcctttatcaatggcgccgcgccgctggagcgtatccgcagcaccttcccgcaggcgattgcggtagagatggaagccacggcgattggtcacgtttgccatcagtttaaggtgccgttcgtggtggtacgcgctatttctgacgtggccgataaagcgtcgcatctgagtttcgaagactggcgcgtggctaaatatctgctgctcgggctgtggctgctgtgccacagtctgctggccgcaccgcgcgtcattaccctgtcgccgcatctcaccgaactggcgtttgccgccggcatcacgccagtggcggtgagcgcctggtcagactatcccgccgctgctcgccagctggagcaggtggcgaactggcagggcattcgcgttgaacgcattgtgcagctcaggccggatgtggtgctggcctggcgcggcggcaatccgctacgccaggtggagcagctacagcgtctgggcatccatgtggaatggatcgatccgcaatcactcgatcagatgattgacgcgttggcagcgctgcagcgctggagcccacagccccagcgggccaccgcggccgcacaggcgttacaccagcagctgcagacgctgcgtcagcgctatcagcagcaaacgccggtgccgctgtttctgcagtttggccagcagccgctgtttaccgccgcgcgcagcacgctgcagaatgaggttatcaccctgtgcggcggtcgcaatatctttgctgacagcagtgtgagctggcctcaggtgagccgggagcaggtgctgatgcggcatccgcaggcgattgtcactggcggtgatgccagccgcgccgccagcgtcgcgcgcttctggcagccgcagcttaac

SEQ ID NO: 81981 - DNA, 1266 bp, Glycine max
  Peptide Sequence Number=SeqID_198759
atggcgacgatcaatttcaggaagaagatcagtttcacccgcccttataccagccgcaaagatcccgaaggcgaatactttattacccgccactttgaaagcgatcgtggacgcattattaattctgccgcgattcgccgtctgcaacaaaaaacccaggtgtttccgctggagcggaatgcggccgtgcgctcgcgcctgacccattcgcttgaggtgcagcaaaccggacgttacatcaccaaagagattctgcatacgctgaaaactcagggcggcgggctggcggcttacggcctcgatggctttgagggcgcggtcgagagcctggtggagatggcctgcctgctgcacgacgtcggcaacccgccgtttggccattttggtgaagcggcgatcaatgactggtttgatgacaacctgccggccgaactggtggatccgctggtggcgggcgtggcggatgacgcgcagcgtgccgatttcgaccggttaaatgcaatgattcgtcaggatttgtgccatttcgaagggaatgcgcaggccattcggctggtgcataccctgctgcagctaaatcttagctatgcgcaggtagcgtgtattttaaaatacaccgcgccggcgtggtggcagggcgataagccggcggagttcagcgtattaatgaaaaagccgggtttctatttatccgaacgtgaatatgtggccgatctccgcgcggcaacggatatacctgagcaccaccgttatccgctgacctggataatggaagcggctgacgatatctcctattgtattgccgacctcgatgacgccgtagaaaaagacatcttcaccgtcgatacgctctatcattctttgctcaacgcctggggcccggtgaaacccagcgacgcgtttagccgcaccattaatgaagcctggaaagaggccaatcagaaaaagcgtcgcagtattagcgatcaatttttcatgtcgctgcgagtcaacgttcagagcgtgctggtcagccatgcggtgcgccgctttgttgataatttacctgccatttttgccggcagctttaaccatgcgctgctggaagatgacggtgatgaagggcgcctgttaaaattatttaaaaccgtggcgcgccagcaggtgtttaatcaccctgaagttgagcagctggaattacagggttatcgggtcattaaaggattactggaaatttatcagtcgctgatgcaactcgattatgacagttttccacgtaatgaatga

SEQ ID NO: 81982 - DNA, 354 bp, Glycine max
  Peptide Sequence Number=SeqID_198760
atgaagacggaggtatcagcattgtcaccgcgagttgcatttctggaccatcaacgtttgattcttaatgtcgacaatagtgccttgaagcaacgcattgctgctttggcccaagacaagattttcaaagacgctcaccaagaagcattaaagaaggaaatagagagactaaggcaaatctatcatcaacagaacctacaaaagatgaacaacaacaacaacaatcttcaacaaactccaccaacatcacagccacaacaacaaccaatgcaacttcatcatcatcgacagcagcagataacagtgtctcaaacattgggatgcaaggacaacaaggagcagctcctcagttga

SEQ ID NO: 81983 - DNA, 464 bp, Glycine max
  Peptide Sequence Number=SeqID_198761
atggccaacttcaaccccacaacctcaaccaccaccatcgtcaccactacaactcccccaccgccttcatgggtcgacgagtttctagacttctcgtcggcccggcggggtgcccatcggcgatctgccagcgactccattacgttcctcgagacaccgtttctcgaggaatgccgaaccggtttcgaccggctcgacgaggaccagctcatttcgatgttctccgatgacattgctgtggcggcgctgcctccgccgccgctgtcgtcggtgtccaacccctcctcgccgacctccgaccaaaacagcagcgaggagaagccgatagcaatggcgctggacgtgaagccgaagacggaaaatgttgaagaggaaagctcgagcaaggatgaggaggcggcggcgccatcctccgtcaccgccacctgcactgaaatcgttgttgatcccaagagggtcaaaag

SEQ ID NO: 81984 - DNA, 900 bp, Glycine max
  Peptide Sequence Number=SeqID_198762
atgcatgagtatcatatacccttttgcttatgttcagtaaatattgtcatactgtgtacgttcccgcattgtgtcttttgcacaggcattgcatatgggttctgtcttgatccaacggagggtccgtgtcgccttcttaaaaacgtgcgttggggcattttgctacccctagacgtcgtatctaagaaggggacaaattccccggacccccgcattcctagattgcatctgtgtcatatgcattccatcatgcattcatccattccacccatgagatatcggagttttgatttgcaccagcttttatctcactttagtaagcatgagaacaaatcaaaccggcaagaggttctaccaagtcaaggtcaaaagcccaggtaccaccagcatcaaggaattagggcggttgatggaacccctccaaatgcaagctttccgcaagacttacggaaagatcttagagttgaccatagtagaggtgtccatagaagccattgcagcacttacccaatactacgaccagcccttgagatgcttcacattcgggggacttccaatttagtaccaaccattgaagaatttgaggaaattctaggatgtcctctccgggagaagaaaaccatatctttcctccgggtatctcccctctttgagcagaattgcaactgtggtcaaggattcagcaagaggtttggaccgcataaaacagactcggaacggcatagcgggcctaccacagaagtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatag

SEQ ID NO: 81985 - DNA, 453 bp, Glycine max
  Peptide Sequence Number=SeqID_198763
atgcaagtacaaccaaaggaggaggctatcgcgcaactactgtgcatatcggggcaagatttcacccgtgccactgcaaagagacgagtgcggatcatgcacaccaacatgatcactcttacacaaatatggatgacgttgctacttagcaacatttcgtctagtgaccgcaataccgatctccccttgcggaagtatcagggtcgcgcccataagacacccagtggacccagagaagtccaacagggccctggggttttcagctctggttacgggcctctgggtcgcgtccacaagacacccagtggacccaaagaagtccaacagggtcttggggcttccggctctgattacgggcctctgtcagttctacggagtgcccgtcacccccaacaaggtcatcaggcccctattaacaggggtttcatcgagaagtactgcgcccccaggtag

SEQ ID NO: 81986 - DNA, 909 bp, Glycine max
  Peptide Sequence Number=SeqID_198764
atgaagaaaccgaagcaaactctgttgagccccaattgggttcaacttcaacaagtgccttttctatcctccttcttcttccttgttttccaaaactcatgtttctacatcaatttattggtgtttgtcaccgtgcagaagctgaagctgaatggctccaaggcttcaaggaccttcaaaacttcagatgaagacaccccagaatcaatattggggaaacgtaaagagagaccagatgatgaatccaatgattgtcagattaatcctcttgttcctgtaaatgacgattcaagtctgacagatgcagtggccatggattgtgaaatggttggcgtaggtcaaggaaacaaaagtgcccttggaagagtaacactggtcaataagtggggaaatgttatttatgacgagtttgtccggccaattgagcgagttgttgacttccgcactaaaattagtggcataagacctcgagatcttagaaaagcaaaggatttttgggctgctcagaagaaagtggcagagttgatcaatggaaggatccttgttggtcatgccttgtccaatgatcttaaggcattattattaagtcatcccagaaaagatatacgggatacttctgagtaccaaccatttctaaagtcaagtagcagaagagcactgcggcatcttgctgccaaacatcttggtgttaacatccaaacaggagagcactgtccaaagtctaagatatccatattgtttcagatagaagatgctcgtgctgccatgctgctttaccaaagaaataaaaaagaatgggagaagagcataaaagatcaatttcggttgaaacagaagcaaaggaaatcaaagcaaaaaaagaagctgaagaatgaacacacttcaaatggcaaccatgttgaaatttga

SEQ ID NO: 81987 - DNA, 1056 bp, Glycine max
  Peptide Sequence Number=SeqID_198765
atgagaattccaagcaattgcgagttcacacgaatcacgccctctgctttcagctaccaccgtctcaaatcctacgtttccgactgcagagccgtgcttctcccctcattcggcggcccgcacgtgctccagcttcgctcgcacgtgccagtccctccgctcaagcctcacgatgtcctcgttcgtgcgcgcgccgtctccgtcaaccccttggacacccgaatgcgtgctggctacgggcgttccatcttcgagccgctgttgcctctcattttggggcgcgacgtcagcggcgaggtttcggcggtcggagataaggtgaggtcggtgagtgtgggagaacaggttttcggggcactgcatcccactgccgtgagaggcacttactcggattacgcgattctctccgaagaggaggttactccgaaaccggattcacttactcatgtggaagccagtgccattccttttgctgcattgacagcttggcgtgctctaaaaagtacagctagaataagcgagggacaacggatattagtagtcggaggtggaggagcagtagggttgtctgcagttcagcttgcagtagctgctggttgctctgttgcaactacttgtggaagtcaaagcgtagacagattgttagcagctggtgcagatcaggctgtcgattatgttgctgaggtggatgttgaattggctataaagggaaagtttgatgctgttttggacactattggtgtgccagagacagaacggatgggcattaattttctaaaacgaggtggacactacatgacacttcagggtgaggcagcatcattgtctgatagatatggactgactattgggcttcctgcagctacagctgttttattgaaaaaacagcttctatatcgattctctcatggaataggtagaaatttccagactatcacatgctatttttcttttgacaccttcaagtatgccacttatttcctttgtaaattctaccttctgtttgacattgatagaactggtattataacagttagaaataatgggttctgctga

SEQ ID NO: 81988 - DNA, 2148 bp, Glycine max
  Peptide Sequence Number=SeqID_198766
atggaatcagatagagagagaccccatcgcagcacaagtagcagtagcagcacaagcgagttgtttgtttgcttcacttcccgtttgtcctcttcatccatgaaactctcatccaagtccattctcagcccaagccgcagcagagaccctcctcagatttccctctcttcctccctcagcaggagactcaggagcaatggcagcatcaagggtggtggtggtggtggccaagcatctccaatgttcccaaccggtggtggtggcaagagaagaggaggctgtggctttgagaatcctgaaccttcttctcccaaagtcacttgcattggccaggtgagggtgaagaccaagaagcaagggaagaagatgagggcaaggtccaagaggaggggtgaagctagcttcaggaagggtgaacaacatcaacagcaacaagttggtgctaatgctaatgcaagtgcaacaaatctgaatctgaatctgaatccagatctcactagacaaagcagccaagggtttcagcatcaccagaactgtttgaagcataggaataatcagagatgggtgcatcttcccttgactatatgtgaggctttgagggagtttaattgtttttttccttgtaggtcttcttgcatgtcaagtgagaaggaaaaagagaaaggtggtggtggtggagtggaaggaggaggacatgggatgatgagagagggttcatgtgggaatactaataatgctgttgggaggtggctggtggctttgcaagatggggatgggaaggggaggggtattgagcttgtgatggaggaggagatggaggtcagtgggagagagaggagtaatagtcagaggaggcatgtgtttgaggacattgatgttgatttggtggtgggagaggaggaacagaagaagcatgaggaggtagtgggtggagaggaggaagagaaagctagagttagcatatgtattcctcccaagaatgctcttttgttgatgagatgcagatctgatccggttaagatggctgctttggctaaccggttttgggaatctcctgttcacaaagacagatgtcaagaagaacaagatgaagaagaacaaaacatcaaaacaaaagaagatgaacaactagaggaagtacaggaagaacaagttgaaagagaagccatagaagatagcatttgtgagagagaaacagaaactgctgttgtggccactgaagatgaagaacaagaagggaaagaaagctatgaaattgaaagcagagaaatcctggaaagcaaagaatttggtgaagtaaaagaggaagaagaaaagggtgatgaagaagaagcagcaaatggaggaaatgccgttggaaaaggtgaaactttaacacacccagaagctcattcagatctagagaaccttagaaccgaagaaaaagaggttgatctccaagagggtaaagaagaagagagagaaaacaacgaaagctcggaactttcttccacctcagaaaccgtcgcagcttcagatcaagaaaacgacggagcagaaccagaaacagacacgaattcggatccggaggaggaagaagagaaagagagcgaaccgaaggaacaacctcagcaaccagacacgaattcggatccggagtcaaaggagcgagaaaacgggtcaaagtgccaagagagagaaagagaagggttgccggagtgcttgctgctgatgatgtgcgagccgaagctgtcgatggaggtgtctaaagaaacgtgggtgtgcagcaccgactttatacggtggctgccggagagacccgccgccggcggcggcagcaagagggtcgccggagaaacgtttacaaagtccaagccgaagccgaagccacctcagccgatgatgcagctgccaaggtcatcgtgctcgttaccggcggcgggaggcagtgccggagtgtcgatggcggcgatgatcgagcagaagctggtggggtccaaatcgggtaacgggtacgagccgtttgtgctcacgcgctgcaagtcggagccgatgcggtcctcggctaagctcgcgccggaggcttgtttctggaacaacaggaagctcgagccgcaccccccggcggctcagcttggagtcggtgcgccggctggtgttgggttctga

SEQ ID NO: 81989 - DNA, 4302 bp, Glycine max
  Peptide Sequence Number=SeqID_198767
atggatataagacaaccacttgcttttacagttctcgaccttggatgtagattaaacactagatacaaggtttattttgctaactttggatgcttaaaaaatgtgagggctgcacttttccgaggaagagcattgaagtgcactcgctgtgggaggcgaggggcaaccactggttgtcgtgtcgatcgttgtccaagaacttatcacttgccttgtgcaagagcaagtggttgcatctttgatcatcgtaaatttcttatagcttgcacagatcatcggcatctcttccaaccttgtggtaataaatatttatcctggataaagaagttgaaggcaaggaaaatgatgtgggagataaggaagcgatcaaatgaagcttgtagaaaagatattggagatgaagagagatggttggaaaattgtggagaggatgaagaatttttgaaacgagaaaacaagaggcttcatcgtgatttattgagaatagccccagtgtacattgggggttcagaatctgccagtgaaaattcatttcagggatgggaatctgttgctgggcttaaagatgtcatctgttgtatgaaagaagttgttattttacctctgctatatcctgagctctttgataatttagggcttacacctccaagaggtgttctcttgcatgggcatcctggaactgggaaaaccttggtggtccgggcattgataggtgcatgttcccgtggtgataagcgggttgcatattttgcccgtaaaggtgcagattgcttggggaagtatgttggtgatgctgagcgtcaactaagactattatttcaggttgctgagaaatgtcaaccttctataatattctttgatgaaatagatgggctggcaccctgccgcactaggcagcaagatcagacgcatagctctgttgtgtcaacattgcttgctcttatggatggtttgaaatctaggggttcagttgtggtcataggtgcgacaaactgtcctgaatctgttgatccagcacttaggcgccctggtagatttgatcgggaaatttattttccattaccatcaattgaggacagagcttccattctctcacttcacacccagaagtggccaaaaccaattactggatccttgcttgagtggattgcaagaaaaacatctggctttgctggtgctgatctccaggctctttgtacccaagcggcgatgaatgcgttgaagaggaatttccctttgcaagaagtcctgtctttagctgctgaagaaaaacattctggttctaagcacattcctcttccatcctttgcagtggaggagagggattggttagaggcttatttttcgtccccactaccttgctcccggagagatgctggaaatgctgctaatgatgtagtatgctaccctcttcccatccaacttattccttgtttattgcagccattatgcactcttcttgtatctctttatcttgatgaacgtctatggttaccacttcccatatctaaagctgcaacagtgataaaggatgtcatgatttctgctctagacaaaaagcaaaagccttctgatcactggtggttgcacatggatgattttcttcaagaaacaaacattgtttatgagttaaagagaaaccttacttgttctggcattttatctgccaacgatggcattgctggttcttttgatactgtggatgatgccaataataacagcttgaagtttgaatcttccacaaggaaccatcttggcatgcatagtggtttatgtgcattgaccaacaaatcaggatttcggatactaatatctggaaattcacgatctggccagagacatcttgcttcttcccttcttcactgctttattggtaatattgaagtgcagaagattgatatggcaactattttacaagaagggcatggagtagtggtgcaagggattggtcagatactaatgaaatgtgctagcaggcaatcttgcatagtattcttgccaagaattgatttatgggctgtggagaaacatttccaaattgctgaaaggatagattcgtgtttaacaatgggcaagtcttgtttcacaccaaacgaagttgttcagaaggaaaatgacattagtaatgagaaaaactcaactgagatgaccaaaggccaagccaacacaaaggcttcatatgcctggatgtcatttattgagcaggtggaatccattgatgtatcgacatccttgatgattctggctacttcagaagttccctatacagaacttccgtgcaaagtaagagaattcttcaagagttaccaatctaaagatggccgatcaactcctttggagcagacaattcctcgattctctgtgcaaattgatgagaattttgatcatgacatggtgatcaatctatctgcactagagctattgagaattgtagttgagcagctggttcaattgattcatcagagatctcatgttcatatgggttcccaaaagggcagaagttataaatcaattgaagtttctaaagataaggaggtatgccaaagaaaagaagatggaccagctaatgataagagggaaatccaacttgaatcctttaccaaagttccaccaacacccaacagcaagtcaatgaagggaaagtcaatcctgttattagcaatatccacatttggctatcaaattcttttatacccacattttactgaactttgttgggtcacttcaaaactcgatgaaggtccttgtactgatgtaagtggaccttggaggggctggcctttcaattcctgtataattcgtcctaataattcacacgaccaggtggcagtatcttgtagttctggtggcaccaaaagcagagaagcatctggtctggtcagaggcttgattgctgttggtttatcagcttacagaggtgtttacaaatcagttagggaagtttcccttgatgtaaggaaggttctcgagatcttaattgagaaaatcaataccagaattcaagctgggaaagatagatatcaatattttcgtattttgtcacaagtggcttatttggaagacatggtcaacaactgggcttactcgttgctaagtaattccttccattttagtctggagcaggattcccctgagcataaaataaaggctataccagcaagtggtgggccattaaacagtcatctcacacatgaaaatcaccaaactgaaggtgaggactgtcatttagttgttcctgtagatggtaatgatttggagacattggagggaagtcagaaggaaattcctgctgaaacaactggatgtcttgcctctgatgacaaaaatgataatgcagacatttttgattgtgatgatggaaatgctagttctgaaggacatctacagaaccattctttttcagataagaatatcaacaactctattgctgcaagccaaccactttatccatccacaagtcaggagaatggtattttatttggacaatctgaatttgtaactgctggaaataatgaagagatggatggagaactggggatttcaaaaggcttgaacaaatccacgtgcactcaatctgtggtcccttctgaaaatggactccacactgcttgcgaaccaaagaaacacgatgttgagattgggaacattaggtctgatcagcctcttagcttgccctctgtagagaccggtgctaaatcaagtgatgttaaatctgataaacaagagaatgccccagacagtaatgtctcttcaagtaatggctgtggccctgctgaatccggggttatttgcttgtatcaatgttgccctgcatgtctccacagtctgcatcatttgacaaagaaaatacttgttgaaaagtggggtttaaacagtgacaagtggacagcagaagatgtccatgatgctgttgcatcattatctgtggatcttatttcagcagttagaaaatgctttatgcctgaagatttcattgattcatcaaataaaacctcaagaaatgaaaagcgtggaacatctctcgactgtttgaaactgagcacgtgtaataatggaaaccaacgcaaggatgttgtgccagctgaatgtgtttctcactcagcaagccaacatgcaactgcaatggaaggtatggtgctgaatgaagaatcatccaagcatgatcttaaatttgttttcagagatggtgtactagttcatttggacccagacaaggatgtctcagttcactgtaaatttgagaacttgtgcctttgttctctaagagagttgatagtaatgaaaaagcgcccttttgattag

SEQ ID NO: 81990 - DNA, 1539 bp, Glycine max
  Peptide Sequence Number=SeqID_198768
atggagcctattggcaactcttgtgagtcttctttttacaaagatgaaaaagtggaagctgcggatcttcttctcgaggagtgctggttctttgataacttgttaaagatagcaccaaggatgacaaggtgtcactctgatccttacccttcttccactggcctaatcagccccccagattttttggtgaaggactcaaactcatcatcaccaagtaaaccaccaaacaatggtgctattgttcattctaagaagatccagagagcaccatccatgccaccattgagattgagagaagaagaccataaaggaagctgttctgttaggagcaaattggtgcaccaaccaacagatcctgttgtgtctcatgcagcaagtgaacctcattgtgcacagatgaaaggacatcataacagtgattgtaatagaaggaaaagcaaactgctaagaacaccatctttgcctccatccatagggagagaagaaaagttccaagtaaatgatactagaactggcagatcccacaagcaaccatcaacacctacacatattgacattcttccccccaggcaaacctctaagtcttgtagcattccaagatgtagaccagccagaaagactgaggttgaaagcttcaacaaagagggtattatggagatgaggcgcaggttcctgaatcagaaaacaatgaggagaagcctaagtgatcttgaatttgaagaagttcaagggttcaaggatttggggttctcatttgagaaggaagccttaagtccaagtttagctagcatactacctggcttgcaagagaaaaaaagagatgagacagaagaagataaggcagcaaggagaccatacttatcagaggcatggttggtgcaaagttgtgctcctcctattccaaattgggcttctcacaagtcttcaggtgacatgaaagagcaaatcaagttttgggctagagcagtggcttcaaactgccaccaccaccttctcttcccactcacactcgcacaccacaaagttaaaccccctctctccattcttcctcctcttcaccacaaacccaccattctccactctgtttcggcttcagccattcctccatgggccgcgcaactcgccgatgcagcagcagacattgacacagagggccctgttgaacttccattctcttccactccttccattttcgccacctccgacgacccttcgcccatccaagtcgcttccagtgttctcctcaccggcgccgtctccgtcttcctcttccgctccctccgccgcagggctcaacgtgtcaaacaatcccaattcaggtcttcaggagagaagtcgataaaggaagaagcattggatagcttgaaagctatggggtcggcttcagtgaaggctaaggaggattcagcttcacctgttcaggcattgcttgggggaatatctgctggagttattgctcttattctctacaagtttgccactaccattgaggcagctctaaaccgacagacaatttcagataacttctctgtcggatag

SEQ ID NO: 81991 - DNA, 312 bp, Glycine max
  Peptide Sequence Number=SeqID_198769
atgaaaaatgcacaaaaattgaaaaagaaaaatgaaaaacttttttggcactctcaaaaactagcaaatgggcattcgccgattggcttctccgtcctattgggtgttcgaatgtgctccgaatcggaagaaaaacgccgccgttgcagcgctgccccggttggtccaaggagggagagaaaccgaaaccctagaaatcgaataggcgacgcatcttcttcgattggctttttggttcgattaaagggtgttttccattttttcagtgaagattgggtttcggggtttcggggtttcggggttcttccctga

SEQ ID NO: 81992 - DNA, 258 bp, Glycine max
  Peptide Sequence Number=SeqID_198770
atgaagaacggtgaagaatctccacgaaatcgcttacgaaaacgtctcgaaagcgttacgaaagcacctcgtgatgcaatcctccctaggaagggaccagtcactagagccatgagcaagaggctccaagaggattgggctagagctactgaagaaagccctagggttctcatgaacctcaggggctccatattgtacgtagggtaccctagaaatataggatttttcaacccttgtattttagggcacctagactag

SEQ ID NO: 81993 - DNA, 1731 bp, Glycine max
  Peptide Sequence Number=SeqID_198771
atggggaaatcctcctcttcgctcaagaagaaacgttctaagaaattatcgaaggccaaggcaagcagtaaaagtaagagaagtaggaaaagtaaatccaagaaggttcgtcgccgtaaggtttctccttctagttctgactatgatgattcaaaaagtttggacacattggcttcctctagttctgaagatagctacagaagaaaaagggacagatctcgcacaagaaaagatgtgaaaggtcttaggaggaaggctcgaggacgatcttacagcagtgacagcagcgaggactctcattatgctaggaagagaaaaaaggcaaagaggaaaaatgagcgtgacgaggtgatgaagaaatcctcccagaagaaaaagattaagagagaagcaagtgttgatttgatgagcagcagatcgtggagctgctcaacatgtcaggatgggagtgctagcagtgatgacagccaatgtaagagccgcaggggaagatcagaaagaaaagagaaagacagaagaaggtcgagaggaagaattggaagtaaaaagagtagtagatacagggcaagaagttgttctccgtgcagtattgaaaatagttatgaagtgactgaggagaaatccgttggtgagaacaattccagacggttacgatcagttattactgttacaaaagaggcggaagaatatggggaattgtatagaaatgaaaccaaggaggagattgtttatgatcatgattacccttgtagaagtaatgacagtaatgatggggggacaaagacagagttggatcatcatacacttgcatcagaagagaaattgggaattgaggatgaggcaggagatatgaatgctgatcttaacttcacagagcccgaacttagagataggagctacaatgacagcagtaaccttaaagtgtgtagtggtaggacaattgaatctatgaaggaaacaagtgagacttctggtgctattgtgaatgatgacttggagtcaattctaagacaaagagcattggaaaatctaagaaagtttcgggagattcagtctagtgcaaaagctcctgatcagaaaaataaaattgatagcctggtgaagcaaccaattacaaataaacacgaactggttcaaggtaagcctgttgtcaatgatgcagctgcaggaacaaaaattgataagcgaacccttggagaagaaactaatttgcctgatgggaggagaaatttaattgcctgtccaagaaacaatgaaaggatttcaaacatggataaagatgtatctgctaagtgtcatccagccggtgcaccagagaaggtgattgattcagacaatcctagcggaacaattactgaatcctccaattacaatactaccaatttagaattgaccaaacaagcacaaaattcttgctgtgattcacttcaaacacatgcttcaaatgaagctgccaatgcaaatttaccagtgactgaggttgatgtagaaaggaatgcagctaagacttctcatgctgcaatccagagtgttaatagcaatgacagaaatgtcaatgtttcatcagaagagaataaatcaggcaaattgcaagatgagtccaaccagggttcccagtttgagaagaaaacaatgaacgtgatgcggggtggtgaaatggtacaggttagctacaaggtctatatccctaataaagtccctgctttggctagaaggcaacttaagcgatga

SEQ ID NO: 81994 - DNA, 395 bp, Glycine max
  Peptide Sequence Number=SeqID_198772
atggcaagcatcaagtctaagcagcaagtgttaagaggaaaaaagaccaagcaagaacaagataaaacagtgtctgagcctggatcctcatcagcaccagcaccacacaagaacaacaacaacaacaacaacaacaacggaagaacagcaacggaaacgggctttcgcggagcaagtggtggaggaggtggggagatagtggaggttgaaggcggtcacattgtgcggtctacagggcggaaggaccgtcacagcaaagtgtgcaccgccaaaggcccgcgtgaccgacgggtgagactatcggcccacaccgcgatccaattctacgacgtccaggaccgcttgggctacgaccgccccagcaaggccgtcgactggctcatcaacaaggccaa

SEQ ID NO: 81995 - DNA, 1245 bp, Glycine max
  Peptide Sequence Number=SeqID_198773
atggcagcaagtcttaagaggaaaaacaacaacatcaagtgtctgagtctggatcctcaacggaaacgggcttttgcggctacggtggagcatgcaggaacgacgtcgtccagccaggggatggtgagaggaagcggaggggagatagttcaagttgaaggcggtcacattgtgcgctccacagggcggaaggaccgtcacagcaaagtgtgcaccgccaaaggccctcgtgaccgacgggtgaggttatcggcccacaccgccatccaattctacgacgtccaggaccgcttgggctacgaccgccccagcaaggccgtcgactggctcatcaacaaggccaagtccgccatcgaccaactcgcccacctccctccctggaaacccactctccctgcacctcaaaacgacgacgaatctgacaagcttaaccccaaccctaaccctatccctatccatcaccctgatgctgaaattctccaccagttcaacgagaacgataccgagaaccttcggtgcgatggaggtggaggttccagttatcttccgatggataacgacgcgataaggtcgtttttccccacaacgacgtcgtcgttggttcacttccagagctacccaccggatttgctttccagaaccagtagccaggacctgcgtctctcgcttcagtctttgcaagacccggttttgcttcaccagaatcaccacaacaacgagcacgtgctttttgctggaaccgggtttgaaaacatggtagcgtggaatagtagtagtaataataataataatactgcttctaatgatacttgtggcggtggtggtggtggtggtggtggtggtggtggaggagggtttgtgtttaacgctccttcgactttgacagggccggcgacggtggcgtcgccggcggtggtgtttggtcatggtcttggtcaaggccagtattttactcagaggggaccccttcagtccagtaacagcccttccgttcgtgcgtggattgacgcgccgtcgttcgtcgctgccgccgccgatcatcggcatcatcatcatcactatctgtctcccgcggcggccgcggcggcgttggtgtatcagtctgctccttcaacggcggcatttgcagcggcgcccggtggcttctcgggattccgcgtgccggcacaaattcagggcgaggaggagcatgacggcggcgtgtccgataagccgtcctctgcttcctccgattctcaccgttga

SEQ ID NO: 81996 - DNA, 756 bp, Glycine max
  Peptide Sequence Number=SeqID_198774
atgttgaatgtacaccccaaatttggggtgaaaaggtgtagggaagagagatataaaggaattagtaaaaaaaaaaaggagggagaaagtgaaagatgtaattggatggtaaaagaagtgagagataggaagaaaaatgaggtggaaaaggtggaagagaaagtggcaatttgttctgttgaacagtcacatcatagtcatgtgtggtctcaacaaattcagtcagattttgaactgatgattggcatgaaaaggcaaacgccatactctttctccccagattttcctcatgcccctgctttcaattgtatatcgtccccctttgctgaaataagaactaatgcaaaaactctgtgcggtaatggaaccggatttaaatttgatgctggcaattcaacttccagggaagtatcatcctctttagcatcctactctgagccaaactcaaagaaaagaagagaagagaatgagaatttcaatggagattttctcacgttggctcctccctctcctacttcgtatccaccttcgaagtccaagttgtcttcaacttacctagcatttcacaaccagggaaatgtagaagatcaaatccctgcccccccaccagtgttcaggctgttcaatcaacaaaagcaaccattttatggcttcttccttccagaaccaaaggaagaacaaattggacaaacaacagccaggattcagaatggtcatgaagtgggagaaagtgttgatcttaacttgaaactatga

SEQ ID NO: 81997 - DNA, 552 bp, Glycine max
  Peptide Sequence Number=SeqID_198775
atgttcaaaagaacaccttgcaaaggatcttcaccaagaattaatgggactccaaatgtgagcgccataaggtcatcatggcattggtgtgaagcatttatagtcactacactttgcaggcaattatatagggaaatagatcaagatggaagcagtggtatatcagcttctgaagtgaaagtccttctgctcaaaaacaaaagtagtaaagaagttgctcaaagtcaggtatctgttggaatgggactgctagctgggtcaacgacgctgcttcagactataatatgggggacctgtgtaattgttggcaagtgtgacattgagggttcaattgcaatagattcacgagacacaaggggatttagtttaactggttctggtgttagtactgatatttggacaagttatgctgcaaggattatggttatatctgtccttccatttgtgatcgttcaattaccacaaattctcaattcaacttcaggaaggcacttggctgttttgattgctctcattgtgtctctcggtttactgattgcttgttgtctttaa

SEQ ID NO: 81998 - DNA, 171 bp, Glycine max
  Peptide Sequence Number=SeqID_198776
atgggatcttcgttagcaatgagatgttcatctcagtttgatgtttgcatttgtggtagttgtgaaggtggcgtaaagggggatgaaggatggttttgttggttaaaggaggcggtagttgtagttgttgacatgagggttgtggagacaatggttgtgattgaagaataa

SEQ ID NO: 81999 - DNA, 522 bp, Glycine max
  Peptide Sequence Number=SeqID_198777
atgaaagtgccacctgacaatatcaattccaattggcacatagaacatcatcagctaaaatctggaattagagatcctgatatttatatccctacatgtgctaagtgctggcaagtgacaagtgattcgcatataattgcattacgtcagtgtcacatgatacctagagaaattcatgacaatagaggaataaaaaaaacacgaagatttggtgatttgcattgtgatgaagtgctttggggtgagaggctaaacacaaggcgtgaaatacacggatcgaatgcgcgaaaaagggagagaaagaatccattcgcgaaggattcgttaggagcaaccaaagttgaagcttgtcagccatggtgtccaggtgttaccataccttactctaccgttagtagcccttgttacgacgtgatatcttaccgcaagcaagggcttggtgaattcctttttggagaggtggtattaggagacatcttctttccacctgcctgtccaagggatgaccatcactttggataa

SEQ ID NO: 82000 - DNA, 837 bp, Glycine max
  Peptide Sequence Number=SeqID_198778
atggcgataggggcaatattggctcagaaaaattcaaccgttctcgccattgcccaagctccagcccctcgcatttccaattctccgcccaaacccttttgttggaaacagagtatccgagagacccttcacaacatggcaaaaacgaggccaggcagaaaagacgtggattcctacaccatcagaggcaccaacaagatcgtaagagctggggactgtgtgctgatgcgcccctctgataccagcaagccaccgtacgtggcgcgcgtggagaagatcgaacaggataataggaacaacgtgaaggtgcgtgtgaggtggtattataggcctgaagagtctattggaggacgcaggcagttccatggagcaaaggagctgtttttgtctgaccattatgatgttcagagtgctcacacaattgaagggaagtgtgttgtgcactcttttaagaactataccaagcttgagaatgtaggtgctgaggattactattgtaggtttgagtacaaggctgctactggggctttcacgcctgaccgtgttgctgtgtattgcaagtgcgagatgccttataacccagatgacctcatggtgcagtgtgaggggtgcaaggattggtaccatcctgcttgcgtgggcatgactattgaagaagcaaagaaattggaccattttgtttgttcagaatgttcatctgatgatgacatgaagaaaccccaggctacatttcctgtatcaccaggatctgatggcaaggtgagactacctgcatccagtcctgaacaatttgagttgagatgcacttttacttatgttccttttcagtttccctga

SEQ ID NO: 82001 - DNA, 705 bp, Glycine max
  Peptide Sequence Number=SeqID_198779
atgtcaaatgcatcagcatgcttctttttctttgcttttgtagtattagtagcacttcataatgctgaatgccgttctcttcggcctagtgtttctgatggggttgatgcagttcaattacctcaagagtcttcttatctacaactcaaagaccaaagtgttgttgtcgagtcttcttctgatgagcatttctgtaagcaaatgtacgggttcttgccatgttccaataacatacttggccatctcttcctcattttggtttatgagtacttgttgttccacggagaatcatatttggctgctgggggtgagcaaatcttcaagattcttggccctggtgtttttggtgctagtgcctttgatattcttggtgctcttcctgagtcattaattcttgttgttactggactttccagcgataaggagagtgcacaagagtatgcttccactggagttggtttgttggctggatcatccattatgcttctgacagtagtttgggggacctgtgttttcattggcagacaaaagttgaaaaatgactctaactatggtggcacaaattcatcaagtggaggaataaaagaatcactaactgcaacgagagttgagtctaacgaaagagttagttttccacatcgtggtgaaccaagacttcaatcatgtgtctcaaacaagattacctctgacggaggatacttgtga

SEQ ID NO: 82002 - DNA, 291 bp, Glycine max
  Peptide Sequence Number=SeqID_198780
atgactgatcctcttctagggtttccaaatgcgttaagcgagctgagtgcctcgcttagtgaatgtgaagaattatggtcattggtgcacaaccatctgcataaagaactcacaagttggtcgaaagaggatatcaatgtgcttggtggcatagagagatttgaggaattaaagcattccctatttgttgatggattatctatggttaccatagacaagtggatgaatattacagatacgggatatgtcattgcttcacgatacaacatgatcgttgtttctctttcatga

SEQ ID NO: 82003 - DNA, 120 bp, Glycine max
  Peptide Sequence Number=SeqID_198781
atggcaattttgatcgccaatacttcgacaacatttcatagagatgaaagactcgggaatacgtttatgatcccaacatggttggctcatggggaaaatgcaaggatcatgcatgagtaa

SEQ ID NO: 82004 - DNA, 342 bp, Glycine max
  Peptide Sequence Number=SeqID_198782
atggaggccatgaaagagaaaatggccagaatgatgaaggccatgataagcatgaagaagataatggaagccaatgcggttgcaatttccgctaccagcgttgttgctaaggtgaacccgatgcccctatgtggcctcgaccaaatgaataatccaacctcagatatggtaggcaaagatttgggaagtacaggcggcccccattatgcgcaaattaaaaacaagcacgccttcccgccatatggcttgcctcccaactatacaccacccaatgtggtgtacactcctagtgagaatgtcaataactccactcccatactcattgagagccgacaaccctaa

SEQ ID NO: 82005 - DNA, 663 bp, Glycine max
  Peptide Sequence Number=SeqID_198783
atgagttcagaggacaagtttcgcgggttaacagtggaaggaaaatgggaagaggttatcaaaatgtgtgaagaagacatcaagttatgcacgataaagatcaacaacaaaagaggcactgcactccatgtggcagtgaatgaaggcaatgaagatgctgttaagtgtcttgtgggaacaatgataaagcacaaaaggggggagaaggccttaacattgaagaatgagagaggggacacacctttgcaccttgcagctacaaggggactcaagaatatatgtgaatgcatcataggaaaaaataaagaaagaaagggtttgattacctttcttaatgatgagggagagacacctttttttcaggttgcactctcatggcaaaaagaagctttttggtacctttgttccctcgtgcctgctgatgaaaacgttaactattctaaatttcttattcggaataatggggatagtatccttcactgtgccattcggagagaattttttgatttggcacttataataatgtataaataccccaaactttacgacattcagaatagagagggattcagtcctctcaaacttcttgccactaggccctcagccttcaaaagtggaagcaatctgctatggtggaagagaatcctttatcattgtaagtag

SEQ ID NO: 82006 - DNA, 1683 bp, Glycine max
  Peptide Sequence Number=SeqID_198784
atgacacatcatttatattactttcttcctgaaggtgtatctgtagaaactctagacgtccaagaagcagagaaattgtacatgaaagcggaagtacaagaatatcagaacgaacagtgcatggttatcaaagaagaaaaggatgaactgtgcccgaacaccaaagaaaaaatggacgaattacaactcccagagaactacaacacatgtcatcacttctatcatctgtttaaagatctatgcaggttgactaatacattttttcgttcactgcaacttcttggtaaagaactgggaattttgtttaaagatctatgcaggttgattagtacatgtgcatcaggacacaagagagagaaacaagaagatccagagaaacatcaacaatgtcaaatatcaatggcagaagatctgggccatgagcatgttccaccaaatttggtttcatgtcttcagtctgtgaagcttgcatacatatatactcttggcctttcgggagtaggggttgaaaacattaggaagatgaaacaaaagcacaaatggagtggtcaactcttgagtgaatttatgaaaaaaccttatgagtcatatacgggaagtggaggtccaccactattagactcgagtgttcaaacagatttcatttatgcttacaatacagaaaatattgacaaagaggagataatggctttgaatattgacagagaagagacagcgattttggttgcggcaagaaatggcataatagaaatggtgaatgagcttatatctaaaataccaagtgccatacatgaaactaactccaagaagaaaaatgtgttacttatagcagtggagaacagacaaacccttattgttgaggaattaaaaaatcgatttggagagaagaaaacaaaagtagtcttgcacaacctaattctaggtgtagacgatcaagagaacactatgttacacctggcagcagcaccaatcgataagggttggatgatatctggttctgccttgcaaatgatgtggcatattaaatggtttcagacacttgttcacccttttaattctaccatggagcagtacataaaggagctagtgccagagcatttcacaattagaaccaataaaaaggagaaaactgcaggagaaatctttagagaatcacataaaggactcgtcaaagaagctagtgggtggctcaaggacacctcagagtcttgctcagtagtggcagctctccttgctggtgtttcctttgccacatctaccactgtccctggtggtgtcaacactgacacgggtaaacctgcattagaaggccaggttccattcgagtcatttgcaatgtgttcattaattggcctatgcttctccgtcactgccctcataatgttcctctctatactcacttctcggaaagaaatcagggattttcgaactaatttgccacttaaattgcttatgggcttaagttctcttttcatatctattgctgcattgtttgctactttctgctctgctcatttctttgtgatcgatgacaaattcaagcaagtcttaatcctcatttatacagtaacttgcttgcctgtgaccttctatgcagtagcacaatttccactatatattgatcttatgagagccattacaacaaaagtgccactggcaagtgataaaggggatgatttatag

SEQ ID NO: 82007 - DNA, 240 bp, Glycine max
  Peptide Sequence Number=SeqID_198785
atggcttctgcgtcctgcactcctaggcctgccatttcgaaactcgccagtcagagctacggtttcagcagcagtggtgaagtcgccagtgcaagtggcgagatgcccttccacgtgaagtcaccagcaccgctggcggtttggccttccacgtgtcgtatggcagcgaaattgctattgccaatggcgggctcaaaaatcccagctcaaagtcaaaaggttgcttctcctgaaagttga

SEQ ID NO: 82008 - DNA, 1338 bp, Glycine max
  Peptide Sequence Number=SeqID_198786
atgaagggattgaacttcctgcagttaaagcatgatatcatctctcatacggtgcccatgatagactattgtaaattaagaaagtttgggatttcagggttttggacgatgaacgtgggcgacctaaacaaggtttgggaaatcagggctctgaagaggaaacccgcggctgaagaagccacgaagatgttggaaaagatcgccaaacaggtccaacccatcatgcgcaaacacaaatggaggatcaaacttctctctgaaatgtgcccaagcaatccacgtcttctggggttgaatgttggagctggtatacatgtgaagttgcggctacggagaccgaacagggatttggacttctacccgtttgatcaggttctggatacgatgcttcatgagctttgccataatgcccatggccctcataatgccaacttctacaagctctgggatgaacttagaaaggaatgtgaagagttgatggctaagggaataagtggtgctggggagggatttgatcttccaggaaggcgtttaggtggttattcccgtcaacctccactttcatccctccgtaaaactgcactggaagctgcagaaaaaagagtacaattgggatctcttcttccgtctgggccaaaacgtctaggtggtgatagtgttataatgagggcccttagtccagtacaagctgctgcaatggctgcagaacggagattacaggatgacgtatggtgtggttctcaatcttgtgaaaatttggatcatgaagatgttgactatgaagttgctgagaacatcgtgcataagggggaaaatgtgggaagctcaagacaaacagacaattctactctaccttcgaatctgttatctcgaaaaagaagtcaggataccaattcaagtttacctgctaagtcatcatctagtacttctgaatttgtagatttgactatggatacaccgaaaagtagacctgacaaggagcatcaaactggacctaaacgaagatgcggtggatcagaaagcttttcacattctcaatcaaattatcaggcaggatctagttcagcaaatttatcaagtgtatctgggcgacattctgaagaatctggaatgtgggagtgtacaatgtgcactctgttgaataaaagattggctcccatatgtgagttgtgtggcactcaacagccaaaagattttagtaccaaatgcaacacttggtcttgtaaattctgtacgttggaaaacaatgtgaagttggagaagtgctcagcctgtgatcagtggagatactctcatggcccatcagtgtcaatccgagcacccaaccttggtacatag

SEQ ID NO: 82009 - DNA, 753 bp, Glycine max
  Peptide Sequence Number=SeqID_198787
atggagtcacgtgcgcaagcgcaagccataaaccctaacacagggcttttccccttctctctcgctctctttcgctgcgtcctcggttatggcttctcgcaggctctcatcatctctgctccgaccattcctccgtccatctctgccggaatttcaagctccgacccctttccggctattctctgtcccaaacttttccactcgcgtttctccgatcgccgtaagcatccgcttcattcatttccttacacttttttcgcactcgattttgatcttattacaaaattacctgggactgaggtattctcacaatttgagtccggtaatggtttagcatcagtgctgagaagctctggaatgggcttgtaccagccagctggggggcttgtaccgccttttgctagcaggtttatgtcaacagaggcaacttctgttgattcttcttctcaagatagttcgatgctggagcctgaagttcctcctcgtatcaaatttaagagattagacaaaactgccaggcacattatgcaggcatacaaggaggcagtagaggaggtgagagggcaaagagagatacctgacataaagcccggttatattgtgcaactcaaagtggaagtacctgaaaataagaggcgtgtctctattataaaaggcattgttattgcaagacgtaatgctggactcaatactacattcagaattaggaggcaggtcgctggggttgggattgaatctctattccctctgtaa

SEQ ID NO: 82010 - DNA, 168 bp, Glycine max
  Peptide Sequence Number=SeqID_198788
atgtacaaagatcatccaataagatttgatacgaagatcactgctgaaggagacagcaatggagattgcaactttgggcaagtcacagtggctacaaatgggactattgatgattcactaaagaggactagggaacctgatacttataggagtgagaggaagctttag

SEQ ID NO: 82011 - DNA, 258 bp, Glycine max
  Peptide Sequence Number=SeqID_198789
atggaagaaggatatgctaccaataagccaccaatgttcaaaggagtaaagaggaacaagctaagactcctcacgcatgagtatgtgtcgcaacgtgcccttcgcgggcgagcgagggcgaggctcacgggtgcgctttccaaaggaggaaagatgcgcggagtcgccaccaacgtttatttgtggaaaacgtcggaaaaatcgaaggaaaccggtcaaaatgaaaattctaagttcgggagttatatttacgcttaa

SEQ ID NO: 82012 - DNA, 342 bp, Glycine max
  Peptide Sequence Number=SeqID_198790
atgggtaatacatgtagtatcgagctttacaaatggttaagtgtcgaatttcctgaagagttcgctctcatataccctaaagacaaatctaagtatagcatttttcatttgagcatcaatctagaaagggtgctattgagactcgcaaatgctttgtgtgatgattatctagtgcaattacttcacatggaggtcactggtgaaagcgacaacaacggatcattcaacttagggctagtgagagtggttgcagatggcatcactcctgaacaaacagttcgtgacaccgagcatttcgaccatctttgtggaacgaaatcttgcctttatgccgtgatgtga

SEQ ID NO: 82013 - DNA, 617 bp, Glycine max
  Peptide Sequence Number=SeqID_198791
tgcagagtttaccaaagagtgcgctttcatatacacttccatcactgatactgataagcgtagcatttttcgcttgagcctgaatccagagaagaggatgctattgagattcgcacactctttttgcgatgctcatccagtgcgatcacttcacatggaggccactgctgaaagagatagcaacggatgtttcaactttggggtagtgagagtagttgcggatggctttacttctgaacagacacttcgcgacaccgaacatttcgcccacctctgtggaacgaaatcttgttgttgtggtgtggtgcgaaaaggtggaaacgtcaacgttggttctgaggagaaaatgaccacttgggaggttcttctctcgattaaggtaagtctcacaacccatattagatattatgtgaacgttgagtgtgataaagtgagaggacttagggccaagtttagaggcccattcaaatgcaagggtcaggttttgagagagggtttgccgaaacaatctgaaggttcttcactgattcggcgcgaggttgatggaaagcccccaaaagcttgttgtgcatttgttgagagtgagtttacaggacaacaacaaggggaagggaaag

SEQ ID NO: 82014 - DNA, 784 bp, Glycine max
  Peptide Sequence Number=SeqID_198792
atgggcaatatacccagtacaaaacccatgattgaggtatacaattggtcaagtgcagagtttaccaaagagtgcgctttcatatacacttccatcactgatactgataagcgtagcatttttcgcttgagcctgaatccagagaagaggatgctattgagattcgcacactctttttgcgatgctcatccagtgcgatcacttcacatggaggccactgctgaaagagatagcaacggatgtttcaactttggggtagtgagagtagttgcagatggctttacttctgaacagacacttcgcgacaccgaacatttcgcccacctctgtggaacgaaatcttgtttttatggtgtggtgcgaaaaggtggaaacgtcaacgttggttctgaggagaaaatgaccagtacttgggaggttcttcactcgattaacgtaagtgtcacaacccatattagattttatgtgaacgttgagtgtgataaagtgagaggacttagggccaactttagaggcccattcaaatgcaagggtcaggttttgagagagggtttgccaaaacaatctgaaggttcttcactgattcggcgcgaggttgagggaaagccccgaaaagcttgttgtgcatttgttgagagtaagtttacaggacaagaatatatactcttccaacaacaaggggaagggaaaggtacgagagtcaatattgttaatacaggtggacttttccatggtcatggtaatggcgctacatatgaaaactgcaatattttaatgaaaacat

SEQ ID NO: 82015 - DNA, 1245 bp, Glycine max
  Peptide Sequence Number=SeqID_198793
atgggagaaactaaagaagtgcaactctcccctgagacttgtttcaccatccacatgggagaacctcaagaagtgcaactaaccaaaattgaagctaatggagccaaagaagaaaattccttagaagacaatagttttggtggtccgatgaatgaatcaacaatgagtaagaaaaaaagatattaccgttggctcagaatatccatccattcttcacttgtgttggtgtgcggatcagcagcaatactccttggaagattgtactatgaaaagggtggaaaaagcaagtggatgggaacacttgttcaacttgctggtttccctattcagcttccttttcacttcatttcagcacccaaaaatctcaccacaaatagtagcattcatccaaaacaatcatctgcttcaatactagcatttatctatgtctcaattggcctacttttggcattagattgttatttatattcagttggtctatggtaccttcctgtatctacctattcactcatttgctcatcacagttggccttcaatgctttcttctcctacttcctcaactcactcaagttcacaccatacataatcaactctctagtccttctcaccatttccgccaccctccttgtgtttcaaaatgagtcatcatcatcagatgatgatgattcagattccacacaagtctccaagaaaaagtatgtgattggattcatatgcacagttggtgcatctgcagggtatggactatggctttccctcacacagcttgtgttcaagaaggtcataaaaagagaaacattcaaagtggtcttggatatgatattatacacttcccttgtggctacccttgctaccttagtgggactttttgctagtggagagtggagtggtttaaagaatgaaatgaaggagtatgagttggggaaggcttcatatttgctgaacctcactttcacagccatactttggcaagtcttcaccattggttgtttggggcttattcgtgaggtttcttccctcttctctaatgccataagcgctttgggagtgcctattgttccaatgctggcagtggtattctttcatgacaaaatggatggcattaagggtatctctatggtgctagctatttggggcattatttcatatgtgtatcaacagtacctggatgataccaagtcagaaaacagaaacactagtcatgttccaaaagcttcttcacctatagaagaggttcatagatga

SEQ ID NO: 82016 - DNA, 635 bp, Glycine max
  Peptide Sequence Number=SeqID_198794
atggattgtggtggtaataagaatactggtggaagtgaaaggggtgatgggccttgtggtgcctgcaagtttctgaggagaaagtgtgtgaagggttgcatttttgcaccatactttgactcagaccaaggaacggctcattttgctgcggtgcacaaggtctttggtgctagcaatgcctccaagttactcatgaggattccagcacacaaaagacttgatgctgttgttactctttgctatgaggctttgtctagggctagagaccccgtttatggttgtgttggtcacctctttgctcttcaacaacaggtcatgaacttgcaggctgagttaacctatgtccaggcccatctcgcaacgatgcagcgattgccagtgaaagtggctcctcttcctccacatcctcaaagctcttcaccaccaccaacccttcattcctcagatcacatggcaccaaatgctgacttgcaaagtgcccctatgatgcactttggtcctcttcaaccacattcagcatcattgccgctaggcagcatcgttttcgatcaatcgaatcgacaactcgacgatagggaactccgagttctggctcgagaatttgtgagcaaatacttgcccggagttagattcca

SEQ ID NO: 82017 - DNA, 351 bp, Glycine max
  Peptide Sequence Number=SeqID_198795
atgcctaaacaacagtcgtccaagctaggggagcttgacatgcctcataaacctacaactcctacactagtcgaggttggatctttgagcttcaatgagggaataagccatggaagaaggagcttcgccaccaagaatgtgccttggataagaagcttggagaggatgattcaatggaggaaaagagaaagagaaagagagaggggggagcacaaaattgaagaaggaaaagggggagagaagttgaacattgagttgtgtctcacgagactctcattcatcaaagttacaacaagtgttacacatgcttctatttatagactaggtagcttgcttgagaagctttcttga

SEQ ID NO: 82018 - DNA, 279 bp, Glycine max
  Peptide Sequence Number=SeqID_198796
atgagggatggattcagatttgtagcacagttcaatctcaagtgtggtaccccattcacccaactaaagaataatgatgtctacacccacccgaggaagacatgggaaaacagccataccttaagggatgtgttatgggcttatggcatcaaaaaccatcactcttcaattcagttcaaaagagattgccaggacatgcggggccaagatgaaataaacaattgggctgtgctactgatgatagattgggttgtctcaccccaatggcataaaagttga

SEQ ID NO: 82019 - DNA, 156 bp, Glycine max
  Peptide Sequence Number=SeqID_198797
atggaagcttgttgctgcaaccttgaagtagatgtaaatggagaagagactttcatggtggacaaggatctaataactatactaaaacatactatcgatactatgttgaacataacagtcacaaagttctggctaaatgctgctagctactcatga

SEQ ID NO: 82020 - DNA, 1605 bp, Glycine max
  Peptide Sequence Number=SeqID_198798
atggcgcaagcgacaacctctgcaagaataggaacccgcccaacaaatcagagtcagtcccgaaaatgccatcttcacgccatttgggacatcaacatcaattttttcaatacaccattacaacgaagtctccctcctatcactttcacagatagagacttcaagggtatcaatcccatcaaccaggacggccgcatggttgtctccatcatcatcgcaaacttcatagtacctaaggttctcatcaaccaggccagctccactaatatcctatattggagaactttccagaggcttgaggtctcccctggtccactccttggctttgcaggcgagaaagtagagaccaggggctacatggacttaatgaccacttttggtcaaggccatatatttaggagcttcacaataagatatctacttgttgatgcagatacatcatatttagctttgattggtaggaaaacacttaacgagcttggagccatagtctccatgctgcatttgaaaatgaaattccctaccctaattggggagatcataactgtcaaggcagaccaaaagcaagcacgacagtgctatgcagagagcctgaaggtagcatcatatcctcttaccaaggagtctgctaagcctcaccccacagtggctgaagattcgcatgatgacacttcagacggaggccccaaacccatcgaagagctcatcaagttgcaactcagacttaaacccgggctagtcgatggatcgttcgggttccaggtgctaagcttcctggacgcttactccagatacaaccagatcaggatgcacactccagacgaggagaaaacgacattcaatactaaagatgccaatttcttttacatgatcggacaaaacatcgaggtatatgtggacgacatggtcgtcaagtctaaaagcatagcccaacacgtggcagacctagaagaattctttggggaactctgcaaatatgacatgtgcctcaaccatgaaaaatgtacttttggggtaggcggaggcaagttcctcggcttcatgatcactcaccaagggatcaaagccaaccccaacaaatgcactgctatactggagatgcacagcccgaccaacgtccaagaagtccagaaaatgaatggtaggctagcatccctgtccaggttcctcctgaagcttgtcgaaaaggcaaagccgttttacaaactgctcaagaaaactgagcccttcctgtgggacgagacatgtgaacgagccttcctggctttcaagaaaaccataactacaccatcgatcctgagtcggcctaggctaggagctcaagggcttgacaagccacatcgacctgtaattctctcacttgtcgaggttaccacacctgacatcggacaaacacctatccatgcttgggggctaaacaaactcgtcaccctcctacttgtcatggctactgccccggacattaaacaatcttcaacactggacaacctctttcacccgcaagcaggctcagagcttgaagggcttatgtactgtccaggatccacaaaatacacgtggcatcatatgtggtactctgaggcacgtgtcaaccctccatgttag

SEQ ID NO: 82021 - DNA, 180 bp, Glycine max
  Peptide Sequence Number=SeqID_198799
atgtgcccaaagtgggctcttggacttcacacattggctttgagagaggtctttgttaagaggataggagggggtgggggggggaggacctgcagaacaaaggactttgacactcaagagtggagtggagtggagctgcacatccttgtttgtaggggctgttatagcctttacaaataa

SEQ ID NO: 82022 - DNA, 429 bp, Glycine max
  Peptide Sequence Number=SeqID_198800
atgtgggcctttcataccagccgacaaattgattgggcacatttagtccgatatcacatgcataaagcattgcgattaaatgctcctttaccctatccacacttagttactttgttccttcaacattttaatatccctcttgattctgaaccatatattccaatcaagagatctttcttgattggtgctgttgtggttgcctcctttggttaccgcaaagagcgtgatggctcttgggtaaaaaagggtgctcaaccaaatgatgatgaaggacacttaccggttaaaggggactcttctctccttcagagtattttggacaggttcgatggacttcaaacctatgttggtgaaaggatcacaaaggttgaaggagatgtcatcttcattcgcacatgctttgatctaccaccaccaccatcgtcttag

SEQ ID NO: 82023 - DNA, 726 bp, Glycine max
  Peptide Sequence Number=SeqID_198801
atgggttttcactgtgattttgttacatgcagtagaaggccttggagtgaaaattcaatattttgcatggaagccagagaaggtattagttctggggttacagtgataggggcagaagctccatcagcttaccatgtggctccgaggagtgaagctccaaaccaggttcatgtccctgatggtggtggtggtgctgctgctacagctgcacctgttggtgtctcacctgtgagtgtggggttggatggaacagttaagaagaaacggggtagaccgaggaaatatgggcctgatgggtctgtaactatggcattgtcgccaatgccaatctcgtcttctgctccgccttcgaatgacttttcatccgggaagcgggggaaaatgcgggggatggactataagccgtcgaaaaaagttggcttggattatataggtgacttgaatgtatgctctgatggtacaaattttatgccacatatcatcactgtcaatgctggcgagatagtggaagtgggggaagatgatgagatagtgcggggaaaaatgataactgaacactggaattataaggatgacgagtatgacatcacaatgaaggtgatatccttttctcaacaaggaccacgagctatatgtatcttatctgctaatggtgtaatttcaaatgttacacttcgtcagcctgattcttctgggggtactttaacttatgaggtgtggcagtaa

SEQ ID NO: 82024 - DNA, 282 bp, Glycine max
  Peptide Sequence Number=SeqID_198802
atggctcaaaagaggaatttatgggaacaaatcaagcagttgagaaattcaagttttggaaggctgtggtgtatacttggtgattttagtagtgtaagaaacccagttgagagagcaggaatatgtgaaaggggggtgaatgacagtaatatggaggaattcaatgaatggattgttgatcttgatgttgaagatatgccttgtgtgggcagaaaattcacgtggtacaagccaaatgggacaacaaaaaataggttggatagggtccttatttctgcataa

SEQ ID NO: 82025 - DNA, 289 bp, Glycine max
  Peptide Sequence Number=SeqID_198803
atggcttgcctcccaaactatacacctcccaatgtggcgtacattcccaatgaggatgtcaataactccactcccatactcattaagagccaacaacctcaatctgatcatccacatgtctctcgacccatggaggagacgcatgaaattccccaccacgatctagccgacttcaagccttgcctcggatatgccgctgaagggcaagaagttggtggtgtacccctgcaaaagactttggagggccctcagtatcatccacaaccacaaccctcacgttccacaacaa

SEQ ID NO: 82026 - DNA, 675 bp, Glycine max
  Peptide Sequence Number=SeqID_198804
atgacacgttctcgaagtagcactacgacaacgataacctcgtcgcgtggcaacattgaacttcccaaaggccacccttcgcacaacgttgttgaaatcatcttccacacaaactggggccgcaagcccttcccgagtcgggtcaaattgattttcaaggtgcagaacgtgtcacgcgttgtggcacggttcaaggattttctcaaggtgataaaggcacgcatcgtcgcgaggctcaccaagggcaacgagggtaaggagaacgtgcggtgcatcactgacgggaacgaggtcatgtggtttcattgctttggttccaccgaggacactgcaatgttccagccagacgttggtgttgaagactctgacaatgacattgaagtcgtagttggattcaaactagaggccgcactagttgcagagttcgcgatggcgaccttcgaagacagcgaggacataagggtgttggcttatggacgagacttgctggcgtgtgagcattgtgtagatgccgtggaaaacagtgtcgtatacgtggaggatgttggtttcttcgacgaactcagaggtgtaccaatggtagtgagtggggaacatggtgggcttggattgggaatccacacaaaagatgaaggtcttggaagcttcatcactggaaacaatggaaaaaaatga

SEQ ID NO: 82027 - DNA, 237 bp, Glycine max
  Peptide Sequence Number=SeqID_198805
atgggtatttcaagcttagatgtttctccaaaggtggcttggagtggggttgttgtggttttaggggatgtggtgatgactttgtttgtgatggtgaaaaagaagaaaggttgtggaagaaaggggttgaaggaggaagaggaagatggcttattgtatccttgtgtcattctcaagcacgtgaatgcgattggagaaaaagggagcaccactgatttcgttaaattttctatttga

SEQ ID NO: 82028 - DNA, 2961 bp, Glycine max
  Peptide Sequence Number=SeqID_198806
atggctaactgtgtttgcagtttattgattatggtcctttatgtcatgctgctaccatcaatcattgttaccagcattgcaccttcgtctaattacacgtccacaaatgaggaacatcaggctttgctccagagcggttggtggtatgcttaccaaaatatctcagaccattgttattgggatggtgtcttttgtaatgaagctggaagtgttactcagatttacccggattatttgagcattcctccattagaagaattgcggcggattcagaagttgaatgtgagtgccttccccaatttagtctatctagatctaaatggaatggctcttacaggaaccattcctaaagaaataagcacacttacaaagcttacctatcttgtcctgtccaacaattgtcttcaaggttcaattccagtagaaatatggaatttgacacaattggtggaactatatctcgataataattcactaacgggttcaattccttctactttgggtcgattgaagaatttagtctttctcatccttgattctaaccatattcaaggtgagcttatgcctaaagcattttcaaatctcactcaacttaagcaccttgatgtttctaggaattctctgagcggtgtcatcccatctacattgggtgaattgaagaatttggagcatctctccctttattcaaacaaatttgaaggtctcttaccaatggaagtagggaatttgacacaattaaaggaattatatctctcaaacaattcactcacaggttcaattccctctactttgagtcaactagagaatttgacatatctcttccttgattctaaccatattgaaggccggctcatgcctaaaacactttcaaatctcactgaacttaagcaccttgatgtttcctggaattctctcaggggtgtcatcccatctacattgggtgaattgaagaatttggtcaaactctaccttcaatcaaaccaatttgaaggtcccttaccaatagaagtagggaatttaacacaattacaggaactaattctctcaaacaattcacttacaggttcaatttcttctagtttgggtcaattacagaatttgactatgctcctccttgattctaaccatattgaaggtaagctcatgcctaaaatgttttcaaatctcactcaacttgagcaacttgatgtttcagggaactctcttagtggtgtcatcccatgtacattgggtcaattgaataatttggggcatctctcccttcattcaaacaaatttgaaggtaccataccttctacattgggtcaattgaagaatttggagcatctctcccttcattcaaacaaacttgaaggtaccataccttctactttgggtcaattagggaatctgacaaatctctcccttagttctaaccaaattactggtcccataccagtagaatttggaaacctcacatctttaaaaatattatctctctcaaacaatttactcactggttcaattcctcctactatgggtcgattgaaggtgatgataaatctcttccttgattctaaccaaattactggccccatccccatagaattatggaactcgacaggtttaatattattaaatctatcacacaactttctttcgggttcaataccttcagagattgcacaagcctattatctttatgatgttgacctttcccacaacaattttacaatcctatctccattcctaaaatgtccctatatccagaaagtggatttaagctacaacttgttaaatggaagcatcccttcccaaatcagttgtattcataatcttaaccttagccataattttttgaaaggtgaaattcctcatatttcatcagaagcaaattccatattagatagcttggatcttagctataacaatctcacagtggtacttctgtcagcattatatttcagaagatgtgtgtttcagaccaaatttgaaggaaaatcaacaaagaatggaaacttgttttccatatggaactatgatggtaaaattgcgtttgaagacatcattgaagcaaccgaggactttcacatcaagtactgcattgggactggtgcttatggtagtgtctatagagcccaattgccgagcggtaaaattgttgcattgaagaaacttcaccaaatggaatctcaaaatccatcttttaacaaaagttttcacaatgaagtcaaaatgttaacacaaatccgtcatagaaacattgtaaagcttcatggcttttgtctccacaatcgttgcatgtttcttgtctatcaatacatggaaagaggtagcttattttatgccttgaataatgatgaggaagttcaggagttgaattggagtaagagggtgaatatcattaaaggaatggcacatgctttgtcctacatgcatcattattgtactccaccaattgttcatcgggatgtaacaagtagcaatgttctactaaactcacaattagaggcttttgtctcagactttggcacagctagactccttgatcccgattcttcaaatcaaactttggtagcaggcacatatggctacattgccccagaacttgcctatacaatgaatgtcacggaaaaatgtgatgtttacagttttggagtggtgactttggaaacattaatgggaaggcatcctggagagctaatctcatctttatcaaactcaactgctcaaaacatgttgttgaaggacatcttagatgcacgtcttcctcttcctaacttgggaaaagacactcatgatataatgcttgcagtaacaatagcattagcatgtttgtgtctcaaaccaaagttcaggccatcaatgcaacaagttgttgggcagttctctaatttcaaattgccactgtctttgcctttccatgagattttgatccatcagttgatgactccagatatgttgtctttcatccaagtgtga

SEQ ID NO: 82029 - DNA, 1164 bp, Glycine max
  Peptide Sequence Number=SeqID_198807
atgttgaggaggatgagtttctgctatagatggatctcttggattgagggctgtctaaattcagcttctatcttcatattggttaatggaagcctttcagctaaattcatcccacaaagagggttaaggcaaggagatccactagctactttcttatttaatgttgttgcagagggactaaatggcttaatgagaaaagcaatggagaaaaagctatttgaaggtttcttgtttggtaggaacgaggtagaaagtatcttacagtatgcagacgatacaatcttctttgggaaagcctctagggagaatgtcaaagcaatcaaggccattctatggagttttgaacttgtgtcagggctcaaaattaatttttcaaagagtagctttggggtagtggggatgttagagaggtggaaggaggatgccgctatgtttttaaactgtagtctactggtcataccttttctctacttgggtaccctgattgggacaaacccaagggtacctaataaaatattggacaagttggtgaggatacaacagaggtttttgtggggtggaggattagagcagaggaagattgctcagttaaaatgggagtcaatggagctgtgggctagggtactggtctcaaaatatggtgaatggagtaattgggacgaggtgaggaggggcaacaccaaatcatcatggtggaagggtataagatctatagctcattccactgaagaagggagttggtttgttaaagggataaagaggaatcttgggtgtagagcaagggtgcaattctgggaggatgatggtgtaacacttatgttgaagtaccccagattgtactctatatctcctatcaacaacaacaatccattcaatagatgggaggtatcacaggcaactggacttggaagggagattcaagtggtgtatacactatggggaatgcgtatgcgatgcttatgggcgactatacagacgaaaatcaggatggagctttcaatgtgctgtggaaactctgtcttggacaaacagatcgggagcatttttgcaatgtccgagacaacatttccttcagtatgcgcttggaaagacatttggtgtttggttctagcgatggcagtgctggtggatatccttgacatggaatatttggcatcatcgtaa

SEQ ID NO: 82030 - DNA, 144 bp, Glycine max
  Peptide Sequence Number=SeqID_198808
atgactgagacaagtattactttgaaaggacttgatgatacttcacaaagtaagttcaaggctgctgctaggtggattattgttaaatatttcaatgatgctagatcattggaactagagagattgaaggtgtttcgcatctag

SEQ ID NO: 82031 - DNA, 288 bp, Glycine max
  Peptide Sequence Number=SeqID_198809
atgacgactctttgcaaatctagaagaaagagattccttaccatccaaaccataagcccaaatgagaagttcattttcatggggaatggagtgaaagctccagtggaaacagttgagacttattgtttaaaactcgatactagacatcgtttaaatttattggaaactccttatgaaaaacaagcaaaacatacaaagaaaggagctacaagaagcactcagcttcttgaaattgtgcatactgatatttgtggaccttttgatgttagttctttcggaaaggaatga

SEQ ID NO: 82032 - DNA, 369 bp, Glycine max
  Peptide Sequence Number=SeqID_198810
atgtatttaaaaggctggttatttgcacttttccttccaatcattgaagtaaagttaaaccagttccggacaattttgcagatagaatcaacaacaccagacaaattttcaccacggatagttgaaaggaaagaagactatattcgtgtggagtaccaaagctcaattttggggtttgtagatgatgttgagttctggttcccaccgggtaagggttctactgtggagtaccgatctgcatctcggttaggaaactttgattttgatgtgaacagaaaaagaataaagttagataaagaaattcttggttccatggcactgcgacaagagttggagaagaaaggatgggcatctcaagacaccatatga

SEQ ID NO: 82033 - DNA, 237 bp, Glycine max
  Peptide Sequence Number=SeqID_198811
atgaggcaggatatcaatgttctgatctttctagacgttagaaaagcattagaagagtttgatgctgttactccactgtctgaaacagaagcagttgatctggtcaaaactgtttttgcatctgcaactgagatagatatatacacagtaatgagtgaagcttcaaattgccatcctaaaacgctttacacagaaatttattgttggagataccagagttggattgggaatgtatga

SEQ ID NO: 82034 - DNA, 3969 bp, Glycine max
  Peptide Sequence Number=SeqID_198812
atggaaacttgggaaagttctggagaccaaattgagttcaattctcaaagtttgggtgatggtgatagcaatgctctaattttgccagctaagaggatgaggaagaggaaagggaaggaacaggaaaatggaaaagtcaaatcaaataagaaacaaaaattgagcaaacctcaaaaaaggaagatgaagaagttagaggatgacaaggagaagcaacttctgctggaaaaagccattaagacattgaatgaaaacacacttccagagtatgcgtatcctcttttgctgtcttcatgcaatataaatcgggatgagactatgaaggaaaagcgtagaagggctgttcatctattaaaagaaggattggaggtttcatatgatgggttgtctatgaaacctgagacggatgagattcatttagagcaagttgatgaagttgtagaaaatgacattcaaattcaacccattagcccagaagaagtcttaaatacaacatcagtttctttagagtcctctcaagaaccagttcatggcaatgaagttgaaacttataaatatgtttctgaacatcctactgacatttccattgacaaccatcttgatgaaatcagaagttctcccatgtcttgttctattgatgaaataaaaggcaccaagtcaaagtataggacaaacgagaaccataactccaatgaattgagcaaccttccaggttattctgcaccaaggcggtcaaatgttcctactgttgtgcatgtgtatagaccaactgaggttgaagacaaaagaaaggatctgcctatagttatgatggagcaagagataatggaagctataaatgaccgttctagtgttatcatatgtggagaaactgggtgtggtaaaacaactcaagttcctcagtttctttatgaagctggttatggttcaagtaagggtattattggtgttactcaaccacgccgggtggcagttcttgccacagctaagcgtgtggcatatgagcttggtcttcatctagggaaggaggttggttttcaagttagatatgacaagaagattggagaaagttgttcaatcaagtttatgactgatggaattttgctacgagaagttcagaatgatattttgttgaggcgttattctgtcttaattcttgacgaggctcatgagaggagcttgaacacagacattctgattgggatgctctcacgtgtaattaaaactcgccaaatgatttataatgaacagcagaagatgatactttcaggggaaaatataagtcccgaaaaaatggtctttccattaaaacttgtgcttatgagtgccaccttgcgagtacaagacttcacttctggaaagttattccatactcctccacctgtgatagaagttcctacaaggcaatttccagtaacagcgtatttctcaaagaaaacagagaaaacagattacattggagaagcatataagaaggtcttggcaattcacaagaggttgccacctgggggcatacttgtctttctcactgggcaaagggaagtagaggacttgtgcaggaagttacgcaaagcatcaagggagtttatcaagaaaaaagttgaagggtctttggaaactgatagcactgtggtccatgaaacaaattctgttgagggagtaaatattaatgagatcaatgaagcatttgaggttcatggaagttcgtccatccagcaaaccgatagatttagttgttatgatgaagatgaggataatgtaaattggaatgaatctgatttttcttatgattcagaaacagatagtgaactggaatttgatgaggatgatgataatcttgagctttcagagaacaaaagtaatattgtggatgtcttaggacaggcaggaagtcttgcttcattgaaggctgcttttgaaaaattgtctgggcaagccacattaagctcctcaaatgaagaggaggcatctgtgaatatagaaggtaatttagatcaatcaaaagttttcagggagaaaagagctaaagaaaattgcagtactccaggtgcactctgtgttctacctctgtatgccatgcttcctgcagcagctcaacttcgtgtatttgaagaagtcaaggacggagagcggcttgttgttgttgccacaaatgttgctgaaacatctttaacaatcccagggataaagtatgtggttgatactgggagagaaaaggtgaagaattatgacccctctaatggcatggagacatacgaagtacaatggataagtaaggcatctgccgcacagcgtgcaggcagatctggaagaactggacctggacactgttaccgtctctattcttctgcagcctttagtaatgaatttcctgagcactctcctgccgaagttgagaaagtgcctgttcatggtgttgtccttctcttgaaatccatgcatattaaaaaggttgcaaacttcccatttcctacttctcttaaagattcttctctgcttgaggctgagacttgcttgaaagctcttgaagcacttgataacaaggatgaacttacacttctaggaaaagccatggcacattatcccttgagtcctcgtcattctagaatgcttctcactgttattaaaaatacaagacatgtgcataaatttaatccaaatatgcttttggcatatgctgttgcagccgctgcagctttgagcttgtcaaacccttttgtaatgcaatatgaagatgatagcagcagagattcagagatgtctgagaaatctagcttgggagacggtgacaaaggcattggtaaaaaagaaaagtcaaggaaaaagaaactaaaagaaacagctaaagttgcacgtgaaaaatttcgagttgtcactagtgatgccctaaccatagcttatgctttgcagtgttttgaacattcacagaaatcagcagaattctgtgatgactatgcattgcatttcaaaaccatggatgaaatgtccaaacttcgacaacagctacttaaactggtcttttatcagagcgataaaggtggttttgaagaagagtgctcatggacttgtggaagtttagaggatgtagaacgtgtttggcaggcttcttctgaaaaatatcctctttctctggttgaggaaaggctcatctgtcaagcaatatgtgctggctgggcagatagggttgctaaacgtattacagcttcttctagggcctctgatggagagaatacttctcgtgctttaaagtaccaatcaagcatggttgatgaaagtgttttccttcatcgttggtcatcagcttccatagtaggccccgagtttttggtttacaatgaactgttagagaccaaaagaccgaacaaagaagggataacaagtgccaagagagcatatatgcatggagtaacaagtgtagagccagcttggctagtcgagcatgcaaagtcttcatgcatcttctctcctcccctgatggatcctagaccttattatgatgcccagactgaccaagtaaaatgttgggtaatcccaacctttgggcgtttctgttgggagcttccgaagcattcattgtccattagcaatgacgaacatcgggtgcaagtgtttgcgtatgctttgcttgaaggccaggtgtgtccatgtttaaaatctgttagaaaatacatgtcagccgcccctgaaagtattatgaagagagaagcattgggtcaaaaaagggtgggaaatcttttaagcaagttaaagagcaggcttattgatagctctgctatgctaagaatggtgtggaaggagaatcctagggaattattttcagaaattttggattggtttcagcagagttttcacaagcactttgaagagctatggttacaaatggttaatgaactgcttatggagaaacaagaacgacctctgcataaaagttctaaaaaaaagaaagtaaaatctaaatcactacgatag

SEQ ID NO: 82035 - DNA, 882 bp, Glycine max
  Peptide Sequence Number=SeqID_198813
atggttcaagctttgccccaatacactgaacaagtggaaaagatctcactccatgtagagatagctggaaagatcaacaaaattatcagagaaacagaccttcgagagcttggacagttggaacaagatcttgtttttggggatgctggagccaaggaagttattaattttttaagaacaaagcagaatacgactcctgaatataagttgcgtttgttgatgatttatgcatctgtctatcctgaaaagtttgagggtgataaagcttcaaaactaatgcagacaaagcaagcagcgcgcaaagatcgtactgaagaggaagaaacatggcaattatttcgattttatcccatgttagaggagctcattgaaaatctaagtaagggagaattggcaaagaatgaatattcctgtataaatgagccaaatcctagtaatgcacgaggttcagttagaatcagcaaacagacccagacacctccaactactgctcctcattcaatgagatctaggaggactgcaaactggggacgagctcgtacttcggatgatggatattcaagaaacaagttgtgctttaaaatgattacagtttcagtttcaagtttcaaccctgattttatacttcttcctaacttcaatagtgactccacattgaagaatgtgactactgatttcaaaaggatgggaaagcgaatctttgtgtttatcattggtggggctactcgatcagagctgcgagtttgtcacaagttgacaccaaaattaaaaagggaagtaatcctaggtactacttccatggacgatcctccacaatatcttacgaaattaaagttattgttcgacaacaatgtttcacagctgaatggcctcgggatataa

SEQ ID NO: 82036 - DNA, 153 bp, Glycine max
  Peptide Sequence Number=SeqID_198814
atgggtggtttagcctctaattgtcatgaaagatttactaatgcaaaaaggaaacaagaggtgttgaagaaaatgaaggaaatgattcccaaatgtgagctaagtcgtcagatgcacgctaagtgtagcctccaagctggctcctcacactaa

SEQ ID NO: 82037 - DNA, 273 bp, Glycine max
  Peptide Sequence Number=SeqID_198815
atgcagttgcagcaacaagtgctcctcgtgattggagttctgaacgcagattttcgaatggaaaaccgttgtgagagagagacgttggaatcgttgaatgaggctgaggaagtcgttattatattatgtgtatatgtgagagggaatataggacgtgagtttcgcgcgatgtcaaacacaatgcgcctgagaaagtcgttatacactgaaagtaacgtagatactcgatcatattttggaaatattgttttgctaattcaagattttatataa

SEQ ID NO: 82038 - DNA, 864 bp, Glycine max
  Peptide Sequence Number=SeqID_198816
atggatttttcttatgagatgtatatggtgcagggttttatcactgatcaagaaacagcaatggaagaactttacggcaatattgagaatactcgcagatttaacacctgcttgaataatatggctattcgaatagctacagtttttgcttcattgaagatggaagattttaatggactactcttgactcactgtaacgagagtgttgcatgcatgctatggttgtttgcgtggttgtcaaacttaagttcaaataaaagtagattgctacttacttgtaatgtaagaagagttaggaagggattttcatcatacatggaacacattgtgaaggttagacaacgagggagagtagtcccaaaaggttcctttccccaacctcaaatcaacataagggagtcttactctttcagccataaagagtctcttagggagttaccatgtgtgtggtatcgtgctgcaaaggatagcgacgagtctacagcaacagcagttcgtgaattagttcctaccaagcttgctaatgctgtttgggacatggtttctaaatataaatctaccattcccggttttccacaaaatgaaacttgtgatatgctcattgttgacagatccgtagaccagctctcaccttttgatgactgtgttgaatctgcaccacagattgcacctgtcattcatgaatggacctatgatgctatgtgccatgatttgttgactatggatggagataaatatatgcatgaggttcccagcaaagtcgggggtcaacctgagataaaggaggttattctacaagaccatgattctgtctggcttgaactacgccacactcatatagcagatgtacgtcttatttattag

SEQ ID NO: 82039 - DNA, 345 bp, Glycine max
  Peptide Sequence Number=SeqID_198817
atgaggaaggctgcttctcgagaagatttgactgacaactatttatactgtcctaaagctgtagatcttcagtacaaggatttaaggcattttcagtggcattgggaaaagggggagcctgtcattgtcagcaatgtgcttgaatgtacatctggtttaagctgggaaccacttgtcatgtggcgtgcattacgtcatgtaactaataccaagcgtggccaacatttggctgagaaaacaattgattgcttagattggactgagagttatcagaaccgaatgtccttgaaatattttgtgaagtaccgaaaaattacaattttttggtggatggttccactttaa

SEQ ID NO: 82040 - DNA, 411 bp, Glycine max
  Peptide Sequence Number=SeqID_198818
atgtcctggacattgtatccgacatcgtggatcctgcattgtgcattgtgcagcaactccagtattttcgggcaggatgtcctggacattgtatccgacatcgtggatcttgcagcttcaattcttcacttgacattttatcttgccttgattgtggaatcaagaaatgtcaagtttcttgaaaatgacttgattagtgggagtgatcaattaaggggcctaggttctgaaattgatcatataaagtctcagccttccatattaagtcaaagattggttgtaattcatacccctcaagttcaaagggatgatgaacaaccaatgactgacattccacaacctgttgctgataatccagtagatcaaattgatcatcaaattcttgaaaatgatgaacaactagctaaataa

SEQ ID NO: 82041 - DNA, 276 bp, Glycine max
  Peptide Sequence Number=SeqID_198819
atggtgtcatcatctggtgggaggacaaaggtgaggccactgcctatggaggaggggttgaggaagagcatgcaacgaaggaggccgaggaagagcaccatgacaatgtttgcgatctcctcagttcgtgaggtgtcgatgtggacaatgagcagaggcaacgcaggggaggtaggcgagggagtggaggagcacgacaacggtagactcgatcttgctgccgaagagacgactgagggattcgaattcaagggaacaatcctcaacgcaatttag

SEQ ID NO: 82042 - DNA, 213 bp, Glycine max
  Peptide Sequence Number=SeqID_198820
atgcatgtagagccctgggaagagaggatcatcatcattcagatgatgttccccagcggcaaagacctacaacatcccgaggcaaccagctcacttagcggatgggaaaccctagaaaaggataagtcagagatctacacgctcagcgcgcagccagcccgcccagcgaggacattgtctcttctcgcgcttagcgcgcccaagctcgcttag

SEQ ID NO: 82043 - DNA, 5139 bp, Glycine max
  Peptide Sequence Number=SeqID_198821
atggcttcttcggaagccgattcccggctgagtcaggtcgtggttcccgcgctcgagaagatcgtcaagaacgcgtcgtggcggaagcacgcgaagctcgcgcacgagtgcaaatcggtgatcgagagcctcagccaccagcaagcgccgccgccgccgggatctccttcggataccgaaccggaaaccgccgtccccggcccgctccaggatggcggtccggtggaattctcgctcgcggagtcggagtccatcctcgcgccgctcatcaatgccgccgtctccggcgtcctcaagatcgccgatcccgccgtcgacgccatccagaagctcatcgcgcacggctacctccgcggcgaggcggacccggcctccggcgccgcggcgccggaggccaagctcctctccagcctaatcgaatcggtttgcaaatgccacgatttcggcgacgatgcgatggaattgctcgtcctcaaaaccttactctccgctgtgacgtcgatttctctgcgaatccacggcgattcgttgctcctaatagtgcgaacgtgctacgacatatatttggtcagcaaaaacattgtgaatcaaacaacggcgaaggcgtcgttgattcagattttggtgatcgtgttccggagaatggaagccgattcctccaccgttccgattcagccaattgtggtggcggaattgatggagccagtggagaaatccgacgtggacatttcgatgacgcagtacgtgcagggtttcataacgaagataatgcaggacattgacggcgttttgaaccctacgacgccgagtgggaaggttagtttattaggtggacacgacggtgcgtttgagactaccacggttgagactacgaaccctactgatttgttggattccactgataaggacatgttggatgcgaagtattgggagattagtatgtataagacggcgttggaaggaaggaagggggagcttgtggatggggaagtggtggagagggacgatgatttcgaggttcagattgggaacaagttgaggagggatgctttcttggtgtttagggcgctctgtaagctttcaatgaagacgccgccgaaggaagccttgggggacccgcagctgatgaaggggaagattgtggctctggagttactgaagattttgctggagaatgctggtgctgtgttcaggactagtgtgagtgtgctctttgatgctgttgacatcttgatcttttctgcatcttcccctccttactttagaggttataatctgatacctgaatcccaatgcaactacaatactcaaggtcccttttccatgtttttaggcgccatcaagcagtacttatgtttatccttgttgaagaacagtgcttcaactcttttgattgtgtttcagctgtcatgctccattttcatcagtctggtgtcaagatttagagctggattgaaggcagaaattggagtttttttccctatgattgttctcagggtcctagagaatgtttctcaacctaattttcagcagaagattatagtgcttcgatttctggataagctttgtgttgattcacagatattggttgacatatttatcaactatgactgtgatgtcaattcatcaaatatatttgagaggatggtcaatggacttcttaaaactgctcaaggtgtccctcctggtgtaacgaccacacttttgccacctcaagaagcaacactaaaacttgaggccatgaaaagcttggtttccgttctaaaatcaatgggagactggatgaacaaacaattgcgcattgctgagcctcattcagctaagaaagttgaagcaacagataatagccctgaaagtggaggttttaccatggtaaatgggaatggagaagaccctgttgatggatctgactcccaattggaagtctccaatgatgcatctgatgtttcaactattgagcaacgccgggcttataaactggaactccaggaaggtatatcactttttaataggaagcctaagaaaggaattgagtttctcatcaatgccaacaaggtgggtgattcaccagaggaaatagctgcttttcttaaagatgcatctgggttgaacaagactttgattggtgattatctgggagaaagggaagagttatccttgaaggtaatgcatgcctatgtggattcttttaactttcaagggatggagtttgatgaggcaatcagggtctttcttcaaggattcagactgcctggtgaggcgcagaaaattgataggatcatggaaaagtttgctgaacgttattgcaaatgtaatccaaaggccttttctagtgctgacacagcatatgtccttgcctattctgttataatgctcaatacagatgctcacaatcctatggtgaagaataagatgtctgctgatgatttcataagaaacaatcgtggcattgatgatggaaaagatttgccagaggaatacttgaggtccttgtttgagagaatatctagaaatgagatcaaaatgaaagaaaatgatgcggctcctcaacaaaaacagactgtgaaccctaatagacttttaggcttggatagtatattgaatattgtgatccgtaaacgtggggaagagaatatggagaccagtgatgatcttatccgtcatatgcaagaacagttcaaagaaaaagctcgcaaaacggagtcaatctattatgcagcaacagatgttgtaatcctgagattcatgattgaggtgtgttgggcaccgatgttggcagccttcagtgttcctcttgatcaaagtgatgatgaggttgtaatatccctgtgtcttgaaggcttccgctatgctattcacgttacttctgtaatgtcgatgaagactcatagagatgcttttgtgacttcattagcaaagtttacctcactacattcaccagcagatattaagcagaaaaatgttgatgcaattaaggcaatagttgttattgctgatgaggatggaaattacttacaagaagcttgggaacgtatcttgacttgtgtttcccggtttgagcatctacatcttcttggggagggggctccaccagatgccacattcttttcctttcctcagaatgatttagaaaaaacaaagccagcaaaatcaaccattcttccggttttgaagaagggacctgggaggatgcagtatgcagctgctactttgatgcggggttcatatgatagtgctggaattggcagtaatggttctggtgtcacatcagagcagaagttgaacagtgaggccataatagattttgttaaggctctatgcaaggtctccatggaggaattgaggtctccatctgatccacgtgttttcagccttacaaagatggttgagattgcttttggttcaaatggtaagacaagggataaagtgcttaattttattgaagagaagaacattacaagtgtgcccaaggatcaagcagcagcttatgatgaccacaaaaacattgtactcttggcttttgaaattatggagaagattattcgagattactttccatacatcactgagactgaaaccacaaccttcacagactgtgtgaattgcctaattgcattcaccaatagtagattcaataaagagattagcctaaatgccattgcttttcttcggttctgtgctacaaaactagctgcaggagaccttggctcatcatcaagaaataaggataaggaagttactggaaagatttcttcatcttcacctcaaacaagaaaggaggggaaaaaagataatggagaggtgactgacaaggatgatcatctctatttctggtttcctttattggcaggtttatctgagcttagcttcgacccaagacctgagattaggaagagtgcgttggaagtcctgtttgaaaccttacgtaaccatgggcatctcttttcactacctttatgggaaagagtatttgagtctatcctatttcctatattcgattatgttcgacattctattgatccttcagggagtagttcaccggtcaatgaagtagaggctgatggtgagcttgatcaagatgcttggctttacgagacatgcacattggctctccagttggttgtagatctttttgttaacttttatgacactgtcaatccacttttaagaaaggtgctgatgctcctggttagctttataaagcgtcctcatcaaagccttgctggcattggtattgctgcctttattcgtttgatgagtaatgctggggagctgttttctgatgaaaagtggttggaagtggttttctcagtaaaagaagcagcaaatgcaacacttcctaaatttttgtttgttgaaagtgagaacttcactagaaattacgagcatgcttcaacagctgaagatgatagagatcctgccgagtctggctccccagataatttagaaaccatgaggattcgtcgtctttatgctcatttaactgatgcaaaatgccgagctgctgttcagcttttattgattcaggcggtgatggagatctataacatgtatcgaactcacctttcagcaaaagccacgctagtcctgtttgatgctttgcacgatgtagcagtacacgcgcaccagattaacggcaatactatattacgatcaaagcttcaagaatttggttctgtgacccaaatgcaagaccctccactgttacgccttgagaatgaatcgtaccagacctgccttacatttttacaaaaccttgtcattgacaagcctcctagttacgaggcggatgaggttgaattgcatctcattcggctttgtcaggaggttttggagttttatattgaagttgcaggttttggacaaaaatctgaatcttctcatggtagacagcaacattggtcaattcccttaggcactgggaagaggagagaattggcagcacgatcgcctctcattgtggctactattcaggctatttgtagtttgggagatacttcttttgagaagaacctgtctcatttcttccctctcatctccagcttggtacgttgtgaacatgggtcaaaggatctccaggttgctctcagcgatatgcttagtttatcagttggtcctgttttgctacagtcatgttga

SEQ ID NO: 82044 - DNA, 207 bp, Glycine max
  Peptide Sequence Number=SeqID_198822
atgggccttggctgcacggcccatgaaggactttgtgccattggatcaaaaagtgaagagaggtcatatgtggctggaactgtagatgggagctcagctattgagatcactggaggtgccatggtggttgcttgtggagaagaaggtggtggtggtggtggtggtggttggggtaactctagggttgcaaggtggccttgtgcataa

SEQ ID NO: 82045 - DNA, 360 bp, Glycine max
  Peptide Sequence Number=SeqID_198823
atgagtataaactctagttgtagcataagtggtggaagcagtagtggtggaaacaataacggtgccggtggtagtggcggtaacaatggtggtggtagtccttgtggtgcatgcaaatttttgaggcgaaagtgcgtgcccggttgcatctttgctccgtactttgattcggagcaaggtgccacgcactttgccgctgtgcacaaggtttttggtgccagtaacgtttccaagttgctcctcaacattccggtgtataagaggcttgatgcggtggtcacaatttgctatgaagctcaagcaaggcttagagatcccgtgtatggttgtgttgctcatatctttgctcttcagcaacag

SEQ ID NO: 82046 - DNA, 291 bp, Glycine max
  Peptide Sequence Number=SeqID_198824
atggtgggatatgcaccttcaagctttgcggatttggtctttgccggggaaaggatcgaagcgagtcttaaaaaaggaaaatttgatcatcctgctttgatgaatgagaaaactggggcaaatgaagaggatgagaatgaggaaggaacccatgttgtggctgcaattcctacatggcaaaacttcccaccagtccaacaatgtcatcgctcagcctgtaacgacccgcctcgtcgctacgaagtgattttgtcacaacataaattcatccaacaacacgcaattacttaa

SEQ ID NO: 82047 - DNA, 342 bp, Glycine max
  Peptide Sequence Number=SeqID_198825
atgtcgcgtcgcaggcctctacacggcagctgggcggttatattacacttctccaatgctggatatacgagcactttcctacaatgcatacatccgtcgttcatgatgcttatgatgaggggagcccacgggcctgcaggtggcttacagatgccctatggtgagcatcggggagtcagggcctttgacttgatatcgtcgtacaccggccagctcagatggggtcagattatggtgtacgttcgacctgagtgggttcttcgacagtttggctaccttcagacggtccctccgccgtcggtttgtgattctttgacgggtgatgatatagatgaccggtag

SEQ ID NO: 82048 - DNA, 381 bp, Glycine max
  Peptide Sequence Number=SeqID_198826
atggctataacagagtttctgttattcatattaacagctactctaggaggaatgtttttatgcggcgctaacgatttaataactatctttgtagctctagaatatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcacggtaggaattgggtacaagctttccccagccccttctcatcaatggactcctgacgtatacgaaggagtgcggttcgttcgataa

SEQ ID NO: 82049 - DNA, 171 bp, Glycine max
  Peptide Sequence Number=SeqID_198827
atggcctctgacttaaaatgggactggaagattgtggaggcctctggtaatcgattaccagcctatgtaatcgattacacagaggaacaggccactggtaatcgattacaaggtatgtgtaatcgattacacagtgcctttttcaggttttcatgtcctgaagctgtgtaa

SEQ ID NO: 82050 - DNA, 771 bp, Glycine max
  Peptide Sequence Number=SeqID_198828
atggaaacgttcttgttcaatttcgcaaacatgtcaggttaccatctggtcggttcatgtaatgggttgcactgtggggttagcgaaataccagaaggatactgtgtttgtttctggaacaaggcgacaagggtgatatccagagaatcgccaacgctgtctttttccccgggcattggtcgtagaataatgtttgggtttggctatgatccgtcaattggcaaatacaaggttgtagcaattgcgttgactatgctctcacttgacgtatctgaaaagactgagatgaaagtttatggcgcgggtgacagtagttggagaaaccttaatggttttcctgttctttggactttacctaaagttggtggagtgtatctgagtggaacccttaattgggttgttattatgggaaaagaaaccatttattctgaaatcgtaattatttctgttgacctagagaaggagacttgcatatcactgtttcttcccgacgatttttgcatttttgatacaaatattggagtttttagaggctcgctgtgcgtttggcaagatagcaacaccaatcttggcttgtggaagatgaggaagtttggagatgacaagtcttggattcaattaataaattttagttatttacatcttaatatttgtccttatgaagaaaaatcgatgattttaccattgtgcatgtctaacaacggagacttcttcatgctgaaattcactagaaatgctgatgatgaataccaaacaattctgcataactag

SEQ ID NO: 82051 - DNA, 300 bp, Glycine max
  Peptide Sequence Number=SeqID_198829
atgccgatctccccctgcaaaaggatcgtgcccacaagacacccagtggacccaaagaagttcaacagggtcttggggttttcggctctgattacgagcctctgtcagttttacggagtgcctatcacccccaacaaggtcattaggccccgcattaaccagggtttcatcaagaagtactgcgcccccaggcaggcacaaggcgagacaccacaacagcattgggacggccggcagcgagcaacagacgcaccgccaccacctctagagttcacctcatctcatccacaaaaaggttag

SEQ ID NO: 82052 - DNA, 324 bp, Glycine max
  Peptide Sequence Number=SeqID_198830
atggcttcagaagaagctttaagacaagctttttggatactattcggatatgtatccggaaatatgtatctggaggtatccaaggagtatcggtatttgacacaggctccagttgttttactaaggatattgtcaacaggatgcatgcttgttgaaatctttctttacaagccagagatatttcagaaagttcgcccacgttgtgaagcacctagacgtgacatgatctaccctacaaattacactccatgccgatatgtgaggatatcttgtttgcgtggaaatcccattgccattttctttgttcagagttacatcctatag

SEQ ID NO: 82053 - DNA, 277 bp, Glycine max
  Peptide Sequence Number=SeqID_198831
tcacaattgcagtcgtgtacgcctcaaaaaccttgatggtgtggccaaaatcgcgattgtggactggagccttgcctgttgtcgcatatacgaatttataacaagtcggtgcttgagtgggaaattgcggttggcttacgttacaaggttgtgtgtgtcaactgtcaaattctttggggtccttcttttggcttgtcaatggtttatagaggatagtttgattgttggtgaacaaatgccgatatataatccaatgaccaaacaaagtaggcagtag

SEQ ID NO: 82054 - DNA, 660 bp, Glycine max
  Peptide Sequence Number=SeqID_198832
atggcgaaaccatcaaagaagcttaagggttctctgagtcgaagccaacggcattccgagactcaagaaacgcagattccttcctccatttcctcttcctcattgttctcatctgaagaacaacggatacggtacacaaatgttttctcttctcgttccattattgatccaaaattcattgatatggatttcttttcaaatgagggttttgaatgcattcaggcatttgaaaactccaatcttattcctttcatgtctttaaaattgtctgtttactctgatttagttaaagccttctattcaaacctagaaatccaagaaggcactttaatttatgaagtttatgggattcaaatggtcattgaccaatccctattctatgagttgacccaattatctagtgaaggtgtaccatttgaaggtacactgattgatgattggaaatatgatttctctgtgcatgatgtctgccggttggtttgcaccaaccaagcggatatgaccggaaggcttcttgccagttcattggcttttgagagtcgcatccttcattatctcattgtgtgtatcttgcttccaagatcatcaaaccttgcacaggtttctgaagaagatcttattgttatgtgggcttttcataaaagccgacaaattgattga

SEQ ID NO: 82055 - DNA, 273 bp, Glycine max
  Peptide Sequence Number=SeqID_198833
atgtcgctgcatgttctctatctttatgcgttttctagatttcccccccagggatttccggggcaggatcaccttgggctaccttctggagtggagacaaaacatgaacggcagaaaccaatcaaggtgcttaaggatgaacgcaagcggggatggggtcacgaccgaccgatcgttgcccttctctgtgcgaaacaagcagggaatgtcgctgcaaggcagccccgtatcctttgtattttgcagctttcttttactatttgtttgttttaa

SEQ ID NO: 82056 - DNA, 222 bp, Glycine max
  Peptide Sequence Number=SeqID_198834
atgcggatgaggcgccactcgatgtttccatttgcctggcatgcctttagtattggtggggtgtgccttcgtggcttaggtgctgacgattggttcctgtgttgctacctaccaaacggtattcgtgtggctagtcagacccattccatccaggcctctttgttggggacgctggaggatttcaaagtcccacacgtgaaccacgttagtcgtccatcataa

SEQ ID NO: 82057 - DNA, 480 bp, Glycine max
  Peptide Sequence Number=SeqID_198835
atgaaggttgagcaactctttgcttgccatcatactagtgaggaaaggaagaaaagtacccttatgaagaggcacatcccctcctactatgaaagggagcttatggacaagctccaaaggcttagccaagggagtatgagtattgaagagtataggcaacaaatggaactactccttttgagtgttgggcttaaggaggaggaaataacaagtattgctaggttccttagtgggcttaatatagaagtgagggagaaggttgagctccttccatatagggacttagatgacctagtccaactatgcataagggtagagcatcaacttaaaaggaagcctacttcaaaatcttatggctttcactcttatccaaagaaagaccaaggtcaaggcatcttaggggctgcacattctaagcctaaagatgataaggggaagatgatgtgcctttattttctcctatttcttaaacctttttga

SEQ ID NO: 82058 - DNA, 147 bp, Glycine max
  Peptide Sequence Number=SeqID_198836
atggataccgtagagctttacactagggcaatgaaaggcaccatgcgtgagcctcaggcgaacctaggggcagggagtgacaaaccctgggatttcagtggattgattaaacggctccatcgccatcactccaaaattgtcaagtga

SEQ ID NO: 82059 - DNA, 126 bp, Glycine max
  Peptide Sequence Number=SeqID_198837
atgatcgctggtgcatctattgtaggaagcaaggatcttgccttgagaaggacgattgaaattgctaaagagcaggacgggttatactacttgcaggatgaagacaataaagagtgtactagatag

SEQ ID NO: 82060 - DNA, 321 bp, Glycine max
  Peptide Sequence Number=SeqID_198838
atgtcgtggaacttcacggattgtctaacgatgggtgtcaaatggtccccggacgaaattaggtcgcatcccaccaactgtcgcaacctgccgttcggcggggctcacgggtgcgtcttccaagaaaggaaaatgcgtagagtcgccaacaatgtttattcgaggaaaacgtcggaaaaaccggaaaagacgtggtctatgaaatttaagtgtgaaaggttcgggagttgtatttacgcacggggaagggtgtttcccttctcctacgaattcctcaattgtgataaggaaatcaaacctacgtcattctttgagaactaa

SEQ ID NO: 82061 - DNA, 281 bp, Glycine max
  Peptide Sequence Number=SeqID_198839
atgtcattgcctagcgctgttcatgtgtcctccacgttcgagtttggagctatgcttcatgattgcctaagtgtggaccctcaaaaggaaaaagaaggagtagagacgagagtcgtcatcacagaaagggctggacggacgaaatcagtgtcttatctttgctttcctcttatctccgatgagagatacttggcaccctttgttgcacaatatgtgaagtcccgagacgtgccgaaaatcaaaaggaagcaggcttatgcgatccgtgaaaattccgtaat

SEQ ID NO: 82062 - DNA, 189 bp, Glycine max
  Peptide Sequence Number=SeqID_198840
tccaggcgggtgcagggcgaaacaccacagcagcctggcgatggccggcagcgggcaacagacgcactgccatcacctctagagttcacctctgctcatccacaaaaaggtttgagtattgcctacaccacatggccgaccaataggcgaccaagtccaaagccaaaggacgcacctagttgctcatga

SEQ ID NO: 82063 - DNA, 870 bp, Glycine max
  Peptide Sequence Number=SeqID_198841
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattaccctctttagcaacgctcagttgggccacgatatctcaatggagttagtgacggcccatcatcaggaatctcgaattaagacagcggccaccgatggaccgcgctaccactggtctcaacccttccagatccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82064 - DNA, 541 bp, Glycine max
  Peptide Sequence Number=SeqID_198842
atggccatgatgaacagcagcagcagaccgaagccggcgccaagccgggatcccacacggagattacgtaaggcaagcatctcaattcccttgatcgtggccgtacgttcgatggcggcgcagcgaagggaaactttacaggactttatatatggaccgatccaaatatatggaactgtgcaggcacaccataatcatgccagctccatccgaagcggccctggattatctgcgccggacacaaccgccgcccgggagggctacagtctgcagatgacacggatcctgcacatcgaaggcgcgtccatcaacgacatcgccagcctctacgtggaaatcaatcgcgtgttcatggccgacgaagactggcaactgggcgcaagcctggatgcgcttgatgacctgcttcacggcggctacggcgctctcgcaggccatgccatcgccacggtggtgtggcgtgacatcgcccacagccgcgatgcactgggccgcgagaccacgcgcgcctggctgcaatcgaaactcgctcaggcggcag

SEQ ID NO: 82065 - DNA, 543 bp, Glycine max
  Peptide Sequence Number=SeqID_198843
atggaggaagctaaatgcaaaatatggcattgtcacagttcaacttatgctggccattacagtggagatagaacaactgccaaaagaatggggggaatttccaagaggaatgagatgccattgcataacatcattgaggtagaagtttttgattgtcgggggattgatcttgtaggccctctaccatccttttacaagaatgcatacatcctggtggccatcgattatgtgtctaaatgggtggaagccatagctactccaaggaatgatgccaggattgtgatcaaattcctgaagaaaaatatcttctcccgctttggagtccccagaaccaatggccaggcaaaagtgtcaaacaaagagctaaagagaatattggagaagaccgtcacttccttaaggaaagattgcgcagcaaagttggatgactccttgtgggcctacaggactgcattcaagacttccataggcctctcaccatttcagatggtctatgggaagacgtgtcacttgccagtggaagtggagcatggggcttactag

SEQ ID NO: 82066 - DNA, 909 bp, Glycine max
  Peptide Sequence Number=SeqID_198844
atggcggtcttttggagtcttcaacttaatcttcccactagcaaaggcatcgaggagctgcttggaatggggtcacaagccatcaatgaatatgttgagctgaaccggctcactaaacccatgcatatgagtctttcggagcaacccatggaagtggatgagatttccacctttccttcgacggtgttggactttggaaagtacttctttaggaacttctccaccacctcttcccataactcccgcgatcttcaccgtgttgcaaatctcgacgtatgtgacaagtcctctagtgttaccctccgtgggcgatcttctgccatgatgcgttcttcaaggttggtatgtggattgatcataggaatgggagatgatgattcaaatgatgaagtgtggtatcttctacaggttgcttcaatctctggattcaaggtaacaagatcttcctccgtagatgctcctaacaatgggagtttagcctctcattgccatgagaggctttacactttaggggatgatgtggatggaagaagaagagggatggataatggaagaaaggggagaatggttagagatggaggattttccctatttgagaagctcaggctttggcgggtatggcggtgtgatcacgcgctgagcgcggtagcctctgggtttagcgagtatggcaacgatcatgcacttagcgctggattcacgctaagcgcacctttgggcttcttcataggcctttttcgcattaagcttgagctggccactaagcaaggagacgcgctaggcttgtcttgtgtgctgagcgagctgtctcactcttcaactttttcttcaaggcttcttcttcaagtttttgcatcaattttccttcaaagcacttgtaatcttccttcttttgactcctgctggtaa

SEQ ID NO: 82067 - DNA, 1722 bp, Glycine max
  Peptide Sequence Number=SeqID_198845
atgtgtcaaacaatcggaaatctaaagatcgatcctataaggatgacactccagctagcagactattccatcaaaagaccattcgaggtggttgaagacgtgctggtcaaagtctgccacttcacatttccagtggactttgtattcatggacattgaagaagttgatgagatctcatggattctggggcgaccattcatgctcactgcaaaatgtgtggtggacatgggaaatggtaacttagagatgagcatggacgatcagaaggtgaccttcaacccgtttgaaacaactaaacatcctagcgacaacaaagcttgcttcaaggccttaataaatgcgattgattgcttgaccaatgaagaggagaaagatctcgaagcctgtctggaggacctagagcgattgaaggagatccctacaggggaagatgctatggaagaattgaacaaagacaaccctgcagaaaagccaaaggtggagttaaaagccttatccatgcacctgaagtatgtctttctggaagaaaataaagtcaagccgattgtaattagcaatgacctatcgccagaagaggaagaatggttgatagatcttctcagaaagcacaaggaagttattgggtggcacatctcatacctcaagggaattagcccaacctattgcatacacatgatcatgatggaagaagaatacagaccagtgagacatccacagaggagaatcaatccatccataaaagaagaagtgtggaaggaagtcctcaagttgcttgaggctaatcctatttctaacagtgctcgagtaagttcagtccaagtggtgcccaagaaaagaggaatgacagtagttcgtaataaaaagaatgatcttattccgactcagagtttcactggatggaggatgtgcattgactaccgcaagctcaatgaagccacaaggaaagaccattttcccttgtcattcatggatcagatgttggtggacaaaaccgaaatagacgtcattgagaagttaccaccactagtaaatgctaagggtatcaggagtttcctcggacacacaggcttctatcggaggttcatcaaggacttcttcaaaatcgctagaccattgagcaacttgctgaataaagaagccgtcttcaagctagatgaagaatgtcaggaaacttttcagactctgaaatataagcttgtatctgccccaataatggttgcacctgactggagtaaagagttcgagctaatgtataatgccagcgactatgttatgggtgtagtggtagtcatcttcatagatcatgcagcaatcaaataccttctcactaaagcagattcaaagctgaggttgatacgatgggtcttgttgattcaagagttcaacatcgtcatcagagacaagaaaggatctgagaatgaatccctcttacttgtggctgcaagaccttggtttgcggatattgctaattacaaagctactagaatcattccacctgatctcaattggaaccagcggcagagatttctttatgatgtccgcttctacgtctgggataatctgcatctgttcaaaattgaagcagataacttgctacgaaggtgtgtgatagtcgcaacctaccctacgatgggagtgtgggctaaaagccaaaggagcgtcttcctaaaaaggaaaacgcgtgggagtcgccaccaacgtttattcaagggaaaacgttag

SEQ ID NO: 82068 - DNA, 417 bp, Glycine max
  Peptide Sequence Number=SeqID_198846
atggcctcagtcctgtgtgggccatgggtcccaatctccatgcgcgaccgtgagatctgtaacataatcagtgtttgtccagcgtctccagtgctagaggtactctacggcatctgcacaagcagctctgactgggagaaggaagaaggagactggctggtggtaggaggagggactgttggtggcagaacaggtgatggaggggctggtgttcttctagatgtaggccaagttgatcacgaggttcaacaactcaaaggtcagggtgtcaaaagtgaccccttgtgcatcacaaagagccatgatcaatgcgggaaaatcaagttgggaagtgatggactaggcgatctgtgtgaaaggtgggggagcaaggttgaagtagctcaggatgctccatgtctaggccaatgtggtgag

SEQ ID NO: 82069 - DNA, 270 bp, Glycine max
  Peptide Sequence Number=SeqID_198847
atggctggagatggaaggtttcctttatttgagaagctcacgctttggtgtgaacaagcgctgagcgcggcagcatctgggcttagcgagtatggcagcgatcacgcgcttagtgctggattcgcgctaagtgcacctttgggcttcttcgtgggccttcttcatgctaagcttgagttggccgctaagcgaggagatgcactgcacctgtcttgtgcgctaagcgagctgtctcaatcttcaactttttcttcaaggcgttttctttaa

SEQ ID NO: 82070 - DNA, 252 bp, Glycine max
  Peptide Sequence Number=SeqID_198848
atgattggaaatgtggaagacgttgaaagcaacgccgataaacacaagggcgagaagaaccaaagagagcaatgttcattgctcaagcctcaaggtcccaagaaagggacaaagttaaagggcagccagaaaacaaaaagaagaagagtcattattaatccaacagagacatgccaattctctccaaatgaatattctattctgctaaagccagccaacctaattcgacattcaaacccaactggaagataa

SEQ ID NO: 82071 - DNA, 357 bp, Glycine max
  Peptide Sequence Number=SeqID_198849
atggaggaagcattgcaactgtcacgcgcgaaggacataaaagagaggatggcaggcatggagcgcctccaccaacttctagaagtttccagaaaaagcctatcctctttcgaggtcacctcgctcatcaacacatttatagaactcctaaaggataacaacttccgtgtctctcagaccacacttcaggctctctcctctgctgccatccacattagcgaacactacaagctccacatcaacaccttcttctatgtagttttcaaccaccttggcgacaccaagcagcccattcgcgctgcgtgttgcctcttgctcactctcatggaggtagtacaccttcttctaactcgatag

SEQ ID NO: 82072 - DNA, 249 bp, Glycine max
  Peptide Sequence Number=SeqID_198850
atggaaattttgtgtaattttcataatagagaggagcctaaagactggaaagaaaaagaatacattgaagaccctaatgatgtcaaacatgagggatatgattcgatcccaagagaaattccttacccaaatgctaaagaggatgaagaggaagatgggaaatggaaaccaccaaagatgccaaatccagcatataaggaccatggaaaagaaaacaaccacttatgctgcattgcagtgaaaatctga

SEQ ID NO: 82073 - DNA, 675 bp, Glycine max
  Peptide Sequence Number=SeqID_198851
atggacaactcatccttcttccagattcatcctcgcgctcagccgaggagtgttacgctcaacggatggctcgctaagccagcaaattggcttagcgagaaggtgttttatgtccaagatccttgtgatgaaaggtggttagtggttctacaaggaaaaaccattggtgttaatcttgaagatgatgattcaacacttgatacttgtcacagtcctttctctacacacatgcctacaatgaatggagaagatgaagttgatgacaagtacggtattagcaaagacaagtggaaccaattttgtcaaagccgtagagacccttcatgggaggattccctagaagagcaatccgcacaacatagctttactgcccatggacgtaaggatgtactgacaacaaccattgggcaactagagcatcctggccgtgtttgtgttgctagagtcggggaagctgtgttgatcgctcgagacaggaccttgacgcttacacatccagttgagctaaatgtagctccttctgttgctgacaatcctcctcactcgattgcccttgagagagtttatgaggggtcatcaattgtacaccacatgcctttggccaatgatatggtgaatgtgggtgttgaagaagtacgagatgctgatgctcgcatccctatacccactgaaaag

SEQ ID NO: 82074 - DNA, 141 bp, Glycine max
  Peptide Sequence Number=SeqID_198852
atgactgttgctttgccttccatgcagattctgaagagagtgcacatgtatggacatgcgtatgtgattccaatgaatttccccaagtggcagcagatggtcatagctctaattgctttaatgcttgcaactgcacttggg

SEQ ID NO: 82075 - DNA, 183 bp, Glycine max
  Peptide Sequence Number=SeqID_198853
atggatgccgatggccgcatcacactcctcttcatcgcaggactcaaaggagtgattagggttttggaagggacgctatttgtgtacgcagagcttgagattgaaacatcatcacaagtgacgctagtgagactgagcaccatcgcgagcgagagtggtgaggatgagaaccgttgtgagtga

SEQ ID NO: 82076 - DNA, 108 bp, Glycine max
  Peptide Sequence Number=SeqID_198854
atggagacacttaacagttcaaaaaggacacatttctgggaggagttgttaagagacaagtatcaagagcataaagttgaggagtttaatgccttgggcaagatgtaa

SEQ ID NO: 82077 - DNA, 243 bp, Glycine max
  Peptide Sequence Number=SeqID_198855
atggatagtacgcaagctgaatgtagtcatgttgttactcagatttcttctcaacatgttatttcaatctcagatgctttgcttcagagtaaaatgatgaccctagcagatcttatggaggctactgaggtagtttacgaggtttgtaatggaattgttcttgcaaaagtaatagctgttgaatcagagaatggatggtcatatcaatcttgcagtaaatgcattaaaaaggctctactgtaa

SEQ ID NO: 82078 - DNA, 2310 bp, Glycine max
  Peptide Sequence Number=SeqID_198856
atggtggtgaagatgatgcggtggaggccgtggccccctctcgtctcgaagaagtacgaggtgaagctagtcgtgaagacactaactctccagggctgcgatctggtgcgcacgtccgcagagaaaggtttcgtgctccagattaagtggaagggtcccaaacttaccctaagctctctgcgacgcaacgctgttgctagaaacttcaccaaagaggtgcaccccgagcaaaacgacgacgtcgttttgtgggacgaggagtttcacgcgctctgcactctcaacgcgtacaaagacaatgcctttcacccctgggaaatcgctttctctctcttcaacggtttgaatcaaaggtcaaagactaaagttcctgtggttggaactgcagctttgaatctagctgattttgcatctgtggttgatcaaaaggattttgatttgaacattccactcacagtttctggtggctctgtggagtcttctccttcacttagtatatcgattagtttggtggagttaagagcggttcaagagagcacagagttagttcataataaagcaatagtgcctgtgcctgtggcttccgctaattcgcctttggttcagtcaggggagactaccttggctgagaaagacgagctttcgacgatcaaagccggtcttcggaaagtgaagattttgactgagtttgtgtctgttaggaaagcaaagaaagcctgccatgaggaggaggggagtgagggaaatttctctgccaggagtgaggatggtgaatacaattatccctttgactcggattcgctcgacgaattcgaggagggtgattcagatgagatgaaggaggattccagtgtgaggaagtcgtttagttatgggaaactggcatatgccaatgctggaggggcgtcttactctagcgtgacggtgaatgatgagggtgaggactgggtttactacagcaatcatagatcagatgttgggattttgcataaagagaattcaaccgtgtcagcaaccgagccttctgtgttgcaaagctcaaggcgtagtatactgccttggaggaagaggaagttgagtttcagatctcctaaatctaagggggagccattgttgaagaaggcttatggcgaagaaggcggtgatgacattgattatgatcgcagacagcttagctctgatgaatccctttcacttgggaagactgaggatgattcagctgcaaatcgatcatcagtgtctgaatttggggatgacaattttgctgttgggagttgggagcagaaagaagtaatgagccgtgatggtcacatgaaacttcagacacaggtcttctttgcctcaattgatcagcgcagtgaacgtgcagcaggtgagagtgcatgtactgctcttgttgcggtaattgctgattggttccaaaacaatcgtgatcttatgccaataaagtcccagtttgatagtcttattcgtgaaggctcattagaatggaggaacttatgtgaaaaccagacctacagggagcgattccctgacaaacattttgatcttgaaacagttgtccaagccaaaatacgccccctttctgtggttcctggcaagtccttcattggattttttcatccagaaggaatggatgaagggagatttgattttctgcacggggccatgtcttttgataacatctgggatgagattagtcatgctggacgggagtgcactaacaatgatgaaccccaactatatattattagttggaatgaccatttcttcatcctcaaagttgaagctgatgcttactgcatcattgacactttgggggagaggctctatgaaggatgcaatcaggcgtatatcttgaaatttgacagcgacacagtaatatacaaaatgcaagatgttgctcgaggttctggcaaaaaaacagccagtgatcttcaaactgttgcagaagtattagagcagaatgaaaggcagatccagccaatcaatggtaaagaaatggattcttctgtggagacagaagaacagttgaagagtgaccaagaagaggaggttgtgtgcagagggaaggaagcatgcaaagaatacattaaaagcttcttggcagcaatccctattagagaattgcaagcagatgtcaagaaaggtttaatatcatcaactcaaacaccatttcatcataggctacaaattgagtttcactacactcagttgttgcagtcttgtgttgcacctccagtagtggctgaaccatccatgactgtgccagagactcttgctcttgcagtaactgaggtttccgcataa

SEQ ID NO: 82079 - DNA, 216 bp, Glycine max
  Peptide Sequence Number=SeqID_198857
atggccagggaattcagcatggactcacttaaagagcttagcccaaaggaatggaccatgaacttgaccaaaaagcttgtcccaaaggagtcaaccatggcctcgactaaaaagcttggcccaaaaatagttgatcatgagcttgatcaaagagtttggcccataggagtcaattgtgagcttgacccacaactcagcaaaaaccttggaaagtag

SEQ ID NO: 82080 - DNA, 3105 bp, Glycine max
  Peptide Sequence Number=SeqID_198858
atgagatcattaagcaagatccgatcctgggattccattctcctctcacaatcccacgttttgaatttttccaacgcctcaaaattttcacgcactcacagaacaacacagcaacaactttccaacaacaagccctcagacaccgatgcttcccgcgcacttttcaacgagatcacggagattctaggagctgatactgtgatcccagaccaatctccatctgggtttttgtttccacttgaaactccgcactctgaagtgggtttgaaggaccaattggattgcacaaaaggtgtttgtgaaaatgccgcacagaatgttgacattttggaagatgcccagatgggaaatatgggtgagaaagatgtgagtcgggttgttagtgagattactgaaatcgttagagtggaaaatgattccagttctgtggaagagaggttagagaatctgagttatgggttgaacagtgaggtttttcacatggtgttgaagaggtgcttcaaggtgccacagttggctttgagggtttttaattggttgaagctcaaggatggttttagtcacacaacgcggacttataatactatgttgcacattgccagagaagctaaggaatttgggttggtgaagaagttggtggaagaaatggatgagtgtggaatccaaaaggatgttaacacgtggaccattatcataaaccactatgggaaggcaaggaaaattagtgaagcattgttggcctttgaaaatatgaaaaggtgtggttgtgaaccggatgcagtttcgtatggagcgataatctgttcgctttgcagtgctgggaagcgagacattgccatggagttctacaatgagatggttcggaaggatatggtactagatgtgaggttgtataagatggtcatgaactgcatggcgagatcaggagatattgcagctgttagtttgcttggaaatgacatgatacggttgtctgtgatgccagaaaaatgtgttcatggctgtatgctgaagagtttttgtatttctgggagcattgaagaggctttggaactgattcgtgaactcaaaagtaaagatttagatcttgaacctgaaaattatgagaccttggtgagaggactgtgtaaggcaggcaggattactgatgctttagagattgttgatattatgaaaagaagggatatggttgatgggagggttcatgggattatcataaatgggtatttggggagaaatgatgttgacagagcgcttgaggtgtttcaatgcatgaaagaatctggttgtgtgcctactatttccacatatacagaattgatgctgcatctctttaggttggataggtatgaagaagcttgcatgctgtatgatgaaatgctgggaaaaggaattaaaccagatgttgtggcaataacagctatggttgcagggcatgtttcacaaaaccatatatctgatgcatggaaaatgttcaagagtatggagtgccaaggcatcaagcccacttggaaatcatttgcagtattcattaaggagctttgcaaggcttcacagacagatgacattgtcaaggtattgcacgaaatgcaggcttcaaagagtagaattcaagacaaagtattggatttggttataacttggatgaagaataagggggagcttactgtgatagagaaaatccagcaggtgcataaagcatctatacttgatcctgaaaagttcaaggagtcagacaaacaagtaccgttgagaattaaggtggaagaggatgcaaaagttgaccaatcaaagactgaaatagattgctccttgatacatccaaaacttaagaattacagcaagcaagatgttcacgaaattcgtaggattctttcatcatctacggattggtccttaatccaagaaaaattggagaaaagcaccattcagttctccccagaactggttatggagatattacaaagttgcaatatgcatggtagctctgtcttaaaattcttttcatggattggaaagcaaactggataccgacacactgcagaatcttacaacatagcaatcaaaattgcaggctgcggaaaagatttcaagcacatgcgtagcttgttcttcgaaatgagaagaaatagttatccaataacatcagaaacatggacaatcatgataatggtttacggcagaacaggtctgactgagatggccatgaattgtttcaaagagatgaaagctgatgattatgtcccaagtaggagtacatacaagtatctgataattgccctttgtgggaggaaaggaagaaaggttgatgatgctctcaaaatatatggtgagatgattagtgcagggtatgtccctgacaaagaattgattgaaacataccttggttgtttatgtgaagttggtagagtgttggatgctaggagatgcacagattctcttcaaaattttggctacacagtccctctcagttattccttgtttatcagagctctttgtagagctgggaaagtggaagaagcattggctttgcatgaagaagttggagaagaaaaattcattatagaccagctaacttttggaagcattgttcatggtctactgcgcaagggtcgattagaagaggcattagcgaaggtggatgtcatgaagcagaatggcataacacctaccatccatgtttttacgtcactaatagttcatttctttaaagagaaacaagtagagaaagctattgagacttttgaggagatgctacactcaggttatgaaccaaccattgtcacatattctgcacttatacgtgggtacatgaacgttgggaggcctattgatgcgtgggatatcttctaccgtatgaaactcaaaggaccctttcctgattttaaaacgtattctatgttcctcacttgcctttgcaaggttgggaaatctgaagaaggaatgagacttatttctgaaatgttggacagtggaattgttccaagtactattaattttcgaactgttgtttacgggctaaacagagaaggtaaacatgatttagcccgtgttgtattgcaacaaaaatcagaactaagaagaaagcgcaagctcataacttga

SEQ ID NO: 82081 - DNA, 801 bp, Glycine max
  Peptide Sequence Number=SeqID_198859
atgtctaagaaaaagctctgcatgcccctttcaacccttctgagacgcagtttaacttcatttccccaacacttcacttccaatttctctcctcagatcaaactctgtcttcatcactcatcaccaacctttgcacccccttctcataaccccgcctgcgattactattattctctcagatttttcgggaaaagcctatgctcgaaatctgctgaggaaatccaacgtggatgctggaattgccacactgtccctcactcggaacctttcctcgtttgcgagttgtgccagtgcattcagcccgtggatagctccattgactattttgacatatttggggtggagaggaagtatgacatagagggtgagaatttggagggcaagtacaaagattggcaaaagaaactgcatcctgatttagtacattcaaaatctcagaaagaaagagattttgctgctgaacaatctgcaagggtcattgatgcataccgtacacttagcaaacctttgtcaagaggaatttacttgctgaagctttatggagaagaagttgacgaagaacagacaatttcagatccagaactacttgcagagattttggaaatcagggaagcagttgaagaagcaactaactctgagactttgaatcacattctctctgagatgcaggagaagctacaaaattggtccaatgcctttggtctttcttttcaaagccaaaactttgaagaagcaaaaatggcaatcaggagaatgacttactatagtcgtgtaattgatgaagctgtaaagaagctttga

SEQ ID NO: 82082 - DNA, 411 bp, Glycine max
  Peptide Sequence Number=SeqID_198860
atgtcgatccttaccctcggaagcaaaaaaggagaaggaaaatttccaagcaaagagaaagcaaaaaaagaggggaaaggaaattcccaatcaaagagtgggagaaagcgaaaaggaaagaaaggaaattcccaatcaaagagtgggagaaagcgaaaagaaaagaaagaaaattcccaatcaaagaatggaagaaatggagaaaacaccgagactttttcaagtctcacaagttatccagaactacgtaggtctgagttcctcattggaggatacgtaggagcaagagcctcgcttttgtcgaccacaccaccttttgttgccatgacccaagagccggtagcccgcggagacaccttacggttatccgcacctcgtcattcagtgaccccaagtgtgattgacgagtag

SEQ ID NO: 82083 - DNA, 2541 bp, Glycine max
  Peptide Sequence Number=SeqID_198861
atggagaagaaaagaaagattgtgcagtatagggagaggctggataggactcttgcctcgcctgatcttgcaaatgatgagatgctcaaaaagcttgtcggaagtcaactcccaccttcttcagaacctgaagtagaaggatttagagataaattagtagaaaccaagactgcggaggtgtctcactttcttgatatgttgaggagtgcttcttcagatgatagcggaagatcttatacatcacacactgattggaaattaaaacaagatggtgacgagtttcgtgttatgtatcgtgaaggaccagaaggaactccctttcatacaatgcttgtagaaggctttgtagatgggcctgttgattctactattcccactttcaaaatcttatcagctgaatgtttgcaaaagacccggattggggaacaattatcactagtgagggtgaaggtttcatggcctctgtctctgagggaagctatagtgcactattatctgtttgagtactttcaagatgacttaattgttgttcttacaaattcggttccggattcaaagaatgccacaggaaccctttgtggtttcaacaatgaggcaattcctgaagcaagagaggttgtgagagttgatttggtgggaggctttgctttgcaaaagacggtgtcttctatgacaagccacgataaaggggaattcaataaggccttgggggatccattatatgttcgaattcgggaagctctatataacactagtggatcaaaggccatgaatggtaaagagcttcagcaagttgcaagtgttctccctgctgaagatcttgttgaaagtaagcagggtggggaaaaagatgcatctaaggaagatatgagtaatcaatatgcaaataatgtcatgccaatggcagtgaataacaaagtactagatagtagcaaaacctttaatgagattgtagaagtagattgtgaagaaattgtacaaggtaaggaaaaaaatgcatctaaggaagatataagtaatcaatatgcaaataatgtgatgccaatggcaatgaatacaaaagaactaggtggtaggaaaaaatttgctgagattgtagaaatagatattgaagaaattgtactaattgaggaggacactgaagaagtaaaagacattcaaaataaggaagttgaaatgagtgtactaaggggcaagaggagtatatatatcagatcagaggtagaacatgctctagaaacattagaaaaagccatttcaatggttcgtgaacagcgacttcattctcgggtggtatcttctagcgttgccgacgaagagtccccttttatgaaaaatgatgataaagttgatacatattcctcaaaactcactcaaccaagttccaaaaatgaggttagtgttgaagtacctaatggagatatttcggagggagcttcgcaagaagcccttgggaataaccctggcatccaaaattcaaggtgtacaggaacagatcctaactcaaaggacgtaaattctaacaaagtagtaccaacttcatcagagcagaatgtttcaacatctattttgttaagccaggctgtttcacatcccttgggaaacggagcaattctggaccaaacaacaatcagcaacaagcaattaaacactgattcagtccaagacacgtctttagatcatgcagacaagtcaagcaggcagaaaaaactaaacaccattgtaactcaaagtcacgagggcacgggtagtgaaccaccagctgatggaggtagggaagtacaacccaatgtttctttttgtgacaagttttttatgaacaaggaaaagccctccacgcaacctacaattgatcttattcaacaacaacttgctaagatgaagtttgaagatgggaaacctttgaagcttaaggttctcatagcggaatcaatgtttgaaggtcaatgtgcaccatggcaatacgctctattggttaagttgttggaggaagatagttcatgtttcattgacgagggaccatggatgattctagaccattatcttacggttcagtgttggtatccagagtttgtgtctaccacaacaacgattgagatgactatggttgactccaatatgttggatgtcaagcgtggtcgtttcatgatagtttgcattgaggtctatctcaacaagccaatggtagggaaggtgtggctccgaggccacaagtacaacattgaatatgaaggattgcatcatatctatgcgtcgtgtggttgctacggtcacttgacaagagatttcaagaatgggaacgatcacttggttgatgctacggtgcaggagggtgtgcagaatcaaccactgttgctagtgcctggagttacgatggagaataacagtttgacagagaaggccaataatcaatcccattcaattggcattaatgacatgacccataggaaaattggtgatcaacatctcattcatgcatgggacgaatgttatgcaatcaagggagctaatcttgggggtgttacatggaggaatttatga

SEQ ID NO: 82084 - DNA, 432 bp, Glycine max
  Peptide Sequence Number=SeqID_198862
atggcaccgccatctttaacccgccacaccaccgctattcagtggcattttttcagaaaaccgcaacgcaactccgccatggtgccaccatggccaccatttaacaacactgaaacctccctacccccaataatatctcctttgccagcatactactataaaaaaccttatttgaagttaaacaattcacatacctcaaacagacagtacattacctcgccgttcagaaagggacgccgttggatgctgttccagcagcctcagcgaaggcgacgacgacggcaaggatgcgagattaagacagggacggtaaggatccaggtgatggttacttcagagaggagatggttaggatccagtgccaccgtcagaggacggcgtggcgcggcaaacttgcaggagcaacaatgtagcggtgttgtgtgggtttga

SEQ ID NO: 82085 - DNA, 309 bp, Glycine max
  Peptide Sequence Number=SeqID_198863
atggcggagtacaatactagatcgcaagattttagaaaatttgaagattcaatcaaagaaaaattaaaggagatgagcgaaaatatcaggaaaattgcatattgtgttggtgggcaagaaactcatatttcagctcttaatcatcaaaatacagtgcttatggagaggacaaaccagaaggtgcatcatggtggtagttcgcatggatcgggttcgttccatagagatcgtagttacatggctactcgtcaagagaagattgattttccatggtttgatggcagtgatctcaatggttggttgttttga

SEQ ID NO: 82086 - DNA, 699 bp, Glycine max
  Peptide Sequence Number=SeqID_198864
atggagaaaaatgaagaaacaacaatggaagagaaggtaaagcaaaaaattaatggagcttcaatgaggtccttcaatggtgattttccaccatggagaagcagtggaaggcaaaaaagaagaggagaggggaggcaccatccactaggaaataagccatggaagaaggagcttcaccacaaagaatgtgtcttggataagaagcttgaatatgatgctttaacggaggaaaagaaagagagaaggggggagcacaaaattgaaggaataaaagagggagaaaagtggaactttgaagtgtgtctcataagactttcattcatcaaggttcatgagaatcctaaggttcatgagaaccctagggccttctttagtagctctagcctaatcctcttgaagcctcttgctcatggctctgatcttaataatgttgcttacaaggacgagcctttcatcatggcagaacaaacaaaacatgtgttttatgcccaagatccctctagctcaagatgttcaatggttctacatggaagaataagtggtgtttgtcatgaaaatgatgattcaacacttgatgtttatgagactctttctttctccacacgcatgcctaccatcattgaagaacatgaagtgtaccaagcacatgcaaattgtaatgaccatgatgaaggtttacaagagaacattcctacctaa

SEQ ID NO: 82087 - DNA, 936 bp, Glycine max
  Peptide Sequence Number=SeqID_198865
atggcttgcacaaagctatcaagggagatggcatttgaggttgcacaacaaatttctgataacattttgaaaaaatctttggaagagcagtgcacacaagtcgttgtgaccatcaaccaatactttggaagatcacatggttctcaaacttcttcattgttgaacctacaacaattggctcagttgacagagaacattaaaaagaagttgaaagatgatctagagttagaggagaaacataaagaggagaggttgatagagaagttgaagaggcgactaaacacagagggaagttgtgctgctaatccctcaagggaagagcctggtagtgatatgttagatcagcatgagttatacattgataagcatgctccctgcttggtggccattgggagagattatgaaggggtgtcaacaatacaccacatgcatttgaccgaagatatggtgagggtggaggttgaagaagttcgagatactgatgctccagtacctattcccacagaaaaggatacatatggaacaaagaaatcggtccaacatgttgatagggtggatcctgatgatgatttcttttataaattgcttatggctagcatggaaatgtgcaagaatgattttgagagtaacaagagaggaagagatgtagaagcaaagcttcatggtgaatcaaaggtgattcaaaggagttttgatgataacaatgatgatgacaaaggtgatgaaaaaaagctcaaagatcaatcaaagaacaactcaagtgaatcaagaacaattcaagagatcaagataagaatcaagaagaattcaagaactcaagaagaaagtctagagacaagaatcaagattcaaggttcaagatctcaagaatcaagatcaagattcaagactcaagattcaagaatgaagaaaagactcaatcaagataagtattaa

SEQ ID NO: 82088 - DNA, 531 bp, Glycine max
  Peptide Sequence Number=SeqID_198866
atgatgcttcatttgttctatgatatgaattctatagattcactaagttctcattgcttgccgcttttggatgaaggaactgcaaattttcaaggacatggatctgaagaagatctgtctgatcatgagggagagcttcagaaggatgaagtagaagcagaaaatgcaggtgaagtggtgtcagctcaacatgaacaggcgaaccaacaagcagatgtagagtataatgagcgagatgtagaggcaaaggaccagcagtcataccccaggaggggttatcagaaccatagaggtggtcgtggtggaggtggtcgcaggggttactcaaatggtcgtggaggtcgaagtggtggcagaggaggctaccaaaacgggcgcaatcaatactacgatcagcctggaaattattatccaaggaacaactattataacaacagaggaaggggcggcagaggtggtggctattacaacaaccatggtgcaggcggtcaagttaatcatgtcgcaggtgatgtgggggtgcaatcatga

SEQ ID NO: 82089 - DNA, 384 bp, Glycine max
  Peptide Sequence Number=SeqID_198867
atgcagcatgatgatgaactttgggaacaattaatcaagcaatgcattcagaaacctgacatggttggtcaatgctttattattttggctttctatgcaagatttacatacataagtacttcataccaagatcctgttgtagagatacataactacttcacacaagggtcctgttgtagagacagtggttacgccagcaccatctttgaaagctcatcttactacatcggtggttacgcgacaaacgacttagaaagcacatcttattacgtcggtgctaaacctgacaccatagttgaaaatccatctttcaaatatggtcatgacgtaagcaacgattttgaaaacacatgttctaagtcgatgctaacgtcaccaccgtag

SEQ ID NO: 82090 - DNA, 1848 bp, Glycine max
  Peptide Sequence Number=SeqID_198868
atgggtgagactggaaaacgatatcgttcgcagagagaccatgatggggacaggaaaaatcaaaagagacaaatgactgatagagatgacaggggcaatgatgaattgattgtttataggatactctgtccagatgaagttattgggagtgtcattgggaagaatgggaaagtgataaattcaataaggcaagaaaccagggcgaaagtcaagattgtcgatccttttcccggtgccaaggatcgggttataacaatctacagctatgttaaggagaaggaaggcgttgagattgatgatgagttcgctggtaaagaacctctgtgtgctgcccaagatgctcttctaaaggttcatgttgccattgtgaattccatagcagctcttggagattctgggaagaaacggaaggatagagatgaatgtcaaatccttgttccatctagccagtctgcaaatatcattggtaaggctggggctaccattaaaaagctgagaagtaagacaagagcaaatatcaaggttactgccaaggatgcagctgacccaacacacacatgtgctatggagtttgataattttgtcttgatcactggtgaatcagaagcagttaaaagagcactatttgcagtttcctctattatgtataagttcggtcccagggaggacatctctctagacacagctgtaccagaagccccaccccgtattattattccctctattccctctgatgttccagtttatcctcctggtggactatatccagcttcagatcctattgtcacacctagagcagttcctcaaattataggcacaacaaatgtaccagatctgcaaggttatgctgatgcagaaaattcatggcctctgtacacatctgcccttcccgttgtttctggtgttggtgcttcccggtctgaggagttaattgttagaatgttgtgtccctctgacaagattgggcgggtcattgggaaaggtggtagtacaattaaaagtatgaggcaggcaagtggtgctcgtattgaggttgatgattccaaggctaattatgatgagtgtttaatcattataactacaacagagtcgccaagtgatctgaagtccatggcagttgaagctgttctgctgatgcaagggaagataaatgatgaagacgataccactgtttcaatccggcttctagttccatccaaggtgataggttgtattattggtaaaagtggttcaatcataaatgaaattcggaagagaactaaggctgatgttcgaatctctaaaggtgataagccaaaatgtgcaaatgcaaatgatgaacttgttgaggtgggtggctcagttgattgtgtgagcgatgcactaatccagattatcttaagactcagagatgatgtactgagagaaagggataccagccataatccttcgattggtgacttggtgttgaatccttttcctcctgttgctgctccgatgccctatgatcatagggctgaaagtggagctggcctgggcatgctttcttcaagcagtctttatggtggatatggatctttatcgatggaggaaaatggctatggatcgttgtccttgtatgccacccagctgtatggcggtttgcctcccccatcaactctggatatgttgattcctgctaatgctgttggtaaagtgctgggtaaaggaggggcaaatatagccaatatcaggaagatttcaggagcatcaattgagatatctgacaacaaatctgctcgtggtgatcgtattgctcttatatcaggcacacctgaacaaaagcgtgctgctgaaaatttgatccaggcttttataatggcaacctga

SEQ ID NO: 82091 - DNA, 1098 bp, Glycine max
  Peptide Sequence Number=SeqID_198869
atggctgccacgagaccggtgcagtgtttgttacgaagggtttgcaggggaagtaggagttttggggttgccacagaagttaatgcttcttcttcatcttcttctcagaaaatcatcgacaaggaatatgaacacagtgcccacaattaccatccccttccgattgtattttctcaggcaaagggaacctctgtttgggatccagagggaaacaaatatcttgattttctatctggttactctgctgttaatcagggacactgccatcctaaaattctcaaagcattacaagaacaagcacaaaggctgactgtgagctctcgagccttctacaatgatcgctttccagtctttgctgagtatgtgacaaacatgtttggttatgatatggtacttcctatgaatactggtgctgaaggtgtggaaacagcactgaaattagcacgaaagtggggttatgaaaagaaaagaattcccaaagacgaggctattattgtctcatgttgtggctgcttccatggtcgtacactaggtgtcatatctttgagctgtgacaatgaagctacccgtggttttggtcctttattgcctggcaatcttaaagttgattttggtgatgcagaagcccttgaaagaatttttaaagaaaaaggagaacacatagctgcgtttattttagaacctatccaaggtgaagctggggtgatatttcctccagatggttatttaaaagctgttagagatatttgctccaaatataatgtcttgatgattgctgatgaaattcaaactgggttagcaagaacagggaagatgctggcttgtgagtgggaagaagttcgcccagatattgtgattcatataaacattacctgtcgtcatagggttaacaaaattttagatccaggaactccacctatggtttcatatctggttccaagtccaagtaaaggaggaggtcgtgttaggccctcggcagtcaatgcaaaactcgttgatataccaaacaatattttagacttgaaactgaaactatttggcaagaaaaaagcatgtgtagttgattccatagataccatacttcttttaagcatatga

SEQ ID NO: 82092 - DNA, 327 bp, Glycine max
  Peptide Sequence Number=SeqID_198870
atggctgcctgtaaatctgtcaatgaatatgaaggagataagtggggtcctgatccaaggagaaagaggactgcgttggggtcggcagcttccgttatagctcgccaggcttccacattgacggccaaccactccgccttaaatgtcgccgcattgaagacctttgttgttgttgttgttcttttggttgctagcgacgacttccaccttgaaccagctatagtggggatgcacaaagagggaacgaaggtgcaaagagaggaggggttgaggaagttggtgctgagcataaatggatgtgataacggaatgcatccattttactag

SEQ ID NO: 82093 - DNA, 252 bp, Glycine max
  Peptide Sequence Number=SeqID_198871
atggtacgaacatctttccttcgacttggggatctagaatatataaaaattggaggtactaaaaacaaaaagtggagaaataacgaagaaaagaagaaatctacaacaaggtccagcctagatgccttgctcagcgcgcagctcgcgttgagcatgactaaagacgcaggcgctaagcaaaggcgttatgcacgagattcagcacccgcgctaagcgggcaacaggtgctaagcgggcaaaacagaaactga

SEQ ID NO: 82094 - DNA, 387 bp, Glycine max
  Peptide Sequence Number=SeqID_198872
atggtccaagaagacccttctagggaagtgaactatatgggaatacagaatcgccacggattccaaggttataaccaaggaagactgtcaggattcaatcaaggaccaattggatttaatcaaggcccaccaggattcaaccaaggtaggactttcacacaaggctcaagctggaggaatcatccaaggaatcaatacaacaaggagcacaagggtcagccagcccaaaatctcaaccaaggggtagatcttcatgagaaaaccagcaaacttgaggagacgctgaaccagtttatgcaggtatcaatgtctaactaccgaagtactgaagcctccatcaagaacctggaaattcaagtggggcaattagcgaaacagatggcttaa

SEQ ID NO: 82095 - DNA, 447 bp, Glycine max
  Peptide Sequence Number=SeqID_198873
atgtcactctacaccaagtttatgaaagacatcctcaccaagaaggggaagtatattgataatgagagtattgtggtgggaggcaactacagtgcaatgatacagaggaagttacccaagaagttcaaagaccccaggagtgtgactatcccttgcaccataaagaaggagtcagtagaaaagaccctcattgacttaggggcaagcatcaacctgatgcccttatcaatgtgcaaaagaattggcaatctaaagattgaccctaccaggatgacgcttcagctggcagaccactcaatcacaagaccgtatggggtagtagaagatgtcctagtcaaggtccaccacttcacctttctggtggactttttcatcatggatatcgaagaagacacagagattcctcttatcctaggcaggcccttcatgttgactgccaaatgtgtg

SEQ ID NO: 82096 - DNA, 1446 bp, Glycine max
  Peptide Sequence Number=SeqID_198874
atggtggtggtgactttaacagcatggttaccagagttgcatcctccaccatgcactcctcagcaacaagcattgaaccaatgtgttaaagctagcacacctcacctaggtgctctacttacgggactttgcctattaagcgtaggctctgctggcataaggccatgtagcatcccatttggtgtggaccaatttgacccctccacagatgaagggaaaaaaggtatcaatagcttctttaattggtactacaccactttcacggtggtgttgttgatcactcaaacagtggttgtgtatatccaagactccgttagctggaagataggttttgccataccaacagtgtgtatgttctgctccatcatcatgttctttgtgggaacaaggatctacgtccatgtgaagccagaaggaagcattttcactagcattgcacaagttctagtggccgcttatagaaaacgaaaagttgagctaccacgtgagaagcatgttgatggggttttctatgatcctccacttattgggacaaacgttttgtcaaagctaccattgaccaaccaatttaggggtttgaataaagcagctgtaataatggagggggagctaaaccctgataggagtagagcaaataagtggaaacttgtcagcatccaacaagtggaagaggttaaatgcttggcaaggattttcccaatttgggctgctgggatcctaggttttacttccatggcacaacaaggaacatttactgtgtcacaagccttgaaaatggacagacaccttggaccaaaattccaaatcccagccggttcacttggggtcatatcattcatcaccataggtgtgtgggttccattctatgacagaatcatggtgccaacactaaggagagtcactaagcatgagggggggatcacactccttcagagaattggaattggcatggtgttctccatcttatccatggttgttgctgcattggtggaaaaagtgagaagagatttggcaaatgcaaatccaagcccacttggaattgcccccatgtcagtcctgtggctggtcccacaactagtcctgatgggcctgtgtgaggcattcaatgtgattggacaaattgagttcttcaacaggcaattccctgatcatatgagaagcattgccaatgcattgttctcttgctcttttgctggggctagctatgttagcagtgcactagtcaccactgttcatcatgtcactagaacacatagccacccagattggttgacaaatgatataaatgctggaaggcttgattatttttactatctggtagcaggaactggagtcctcaacttggtttattttctgattgtggctcaaagatatcattacaagggaagtggtgacctccaagataatgctcaagatgtggagttagcttcaaaaggaaagagttag

SEQ ID NO: 82097 - DNA, 955 bp, Glycine max
  Peptide Sequence Number=SeqID_198875
atggctattcgtttgccaagtgccttgagtgctagacacattcttcgcagatctaatgcagctgcaacatcactggatgtgcctaaagggtactttgctgtgtatgtaggagaaggtgaaaagaagagatttgtgataccagtgtcattgttgaatcagccttcatttcaagaactgctaagtatagctgaggaagaatttggcttcactcatccaatgggtggccttaccattccctgcacagaagacatttttgacgactctgtttcttacatgtccaagtccaacgtttttgagtttttgcaccaattccgtgtaagtggcaatgtctcagccattaagaaactccatgctcagctactcagaagaggcatgctcttcctctcccatcatctccacacccaactcattgccacatatgccgcatgcctccctaacaacacccgtcaatccctcaacaacttcttcaaatgcatgaattccaccaacccattacacttcaacgccacaatatccgatttctgtcgcaaaggtttcccctttctcgctctctcctccttctccttcatgcacaccaatggtgttcccttggatacatacgctttgtgtagcacgttgaccgcttcctccaaagtcaaagatcttaatttggggaagcagatacacgcccaagtggaaaaatcaggttggtcttctagcgtgtttgtgggtagtgctctcattgatctgtactccaaattgtcgaatgtaaaagatgcagcccatgtgttcgatgaaatttctgacaagaacactgtgtgtgccaatgcacttctgtcgggttatggcgaggccggcctgtgggttcaggaacttgaactagttaggaagatgcccgtgttgaaattgaagcatgatcactttactctatcagcagctttgcgtgcatgcactggattatctgctgttgaaatgg

SEQ ID NO: 82098 - DNA, 1212 bp, Glycine max
  Peptide Sequence Number=SeqID_198876
atggatgaagaaatcaaggcgatcaagaagaacaacacatgtgagttagtttcacttccaaaagggcacaaggcaattggtgtgaagtgggtgtacaaagccaagaagaacgctaaaggagaagtcgaaagatataaggcacaattgatgacaaaaggctatagtcaaaaagttggtactgactatgatgaggtattcgctctccttgctcgactagaaactgttagactaattatttcattagtagctcaaaataattggaggatacatcaagtggacgtgaaatcttccttccttaatggagtccttgaagaagaaggcaacgaaaacaaggttttaaagttcaaaaaggcactctataggttaaagcaagctacaagagcttggaatgctcaaattgacaagtacctacacgagagaaacttcatcaagtgtccatatgagcatccacttcacatcaaagcccaaaataatgatgtcttgattgtgtgcttgtatgtagatgacttgatcttcacaggttgcaattcaagcatgttcgatgattttaagaaagagatgatgaaagagtttgagatgaccgacattggttgcatgccttactacctcaacattgaagtaaagcaaaaagataaaggcattttcatcactcaagaaggctatgctaagggggtgattaagaagttcaagatgaatgattctaacccaatcaacacaccaatggaatttggaatcaagctatcaaagcacgaggaaggagaaaggatggatccaacactctttaagagcttagttggaagtttacggtatttaacatgcacaaggcctgatattctctatgcgattggagttgttagtccctacatggagaatccaacgaccactcatttaaaggcggcaaagagaattcttcaatacatcaaagagttgggcttgttacaagaagagccaaccaagattttcgtggataacaagtcagcaatagctttggctaagaacccagattaccatgaccaaaataagcacattgatatgtgctaccactacattagagagtgcatcgcgagaaaggatgtgcatttggagtacgcaaagactcacgatcaagtagttgatatcttcaccaagccacttaagaaagaagacttcgccaggctaagaagtttgattggagtaacaaaatcaagtttaagaggggatgttgaaatatga

SEQ ID NO: 82099 - DNA, 315 bp, Glycine max
  Peptide Sequence Number=SeqID_198877
atgacaacttgtacgactcctgtgagaccaggaataagtgttatcaaactggaggatgatagattgggtttagaaaggaacaataggttgttcttcctagatgaagtcattagtggaagaactgctgacaatactttgatttgtactcatgagattgctcataaattgttctccgctagcactgaagaactacatatcgtacccataatcttcttgatgatgatgatgagattgtggccttcatcatgtatgttggcaacgactgatggactttgttgtggagctgaacgagatgtggcagcaacgtttggataa

SEQ ID NO: 82100 - DNA, 360 bp, Glycine max
  Peptide Sequence Number=SeqID_198878
atgacttcatcatcaatcaacgcaattgtgtattatgatggtgcaatcataacaactaaacatggttcaacgtttgtaagcagtttaccaaagatcattcaagttgacaacaaaatgtcatttgatgccttgaagcaagttattggaaataatattagtctaccaaatggtaaagtggtcaatacagggcatgcatgttgcaagatgatgagaacgtatgactatgttttctatcttcgtcaaaatcttcaagctcacatgcttggagttatatattgccaccaaagacacacccacacaaacatgtgcacatccaccaccaatttatgccagctctttgaatttggagggtttggataa

SEQ ID NO: 82101 - DNA, 402 bp, Glycine max
  Peptide Sequence Number=SeqID_198879
atgtgtgaagaatatataggtgttgttcctccagagaatgcactggtgggattaacacttaaactaaaatggttaaaagaacacatgctgactctcccaacagaacccacaccacaacaactagtagcccattgtagagcatacattgtagggcatattggtggggtgttgatgctagacaagtcagagaacaaagttcacctgaagtatctacccctgttagcaaatcttaatcggtcttgggcatggtataacatgtcattcattcaaccaagggttgagtgccaactgtcatattcgcttgcaatcagatggagcgatagaggcctttggttttctagaatcccacgtggtgatgtgataggctacaggttaagatttgacaacatgagcaacgaggag

SEQ ID NO: 82102 - DNA, 972 bp, Glycine max
  Peptide Sequence Number=SeqID_198880
atgtggaagcccgagtggctagtgagcaaagcaaatcagataaagggtagcccaattgctacagatgaattagatgtaacttcaagtgataaacaggacattgaagctggtgaatctggcattgagggtatattgagtcggttggagaaacaaagaaatagatcttttggacttgacttggataatatttcttttgaaaataatgaagataaagatgaatgggatcatagaactacaacggatgcagtagctactggcctagaaaatggtagcatagcatcctcatcaagctctacaagcagtcatcttagtggttctcagatcaaacatgatccatacggatctcaattaggtactgaaaatttaagaaactcgcttaagccagagacgtggaggagttggattgttcagagaactggttttcgggatacagattttgaagatgctgaaattgttcccagtgaaactgagaaaggaggcatgagtgatgcttcaggacaaccagatatcctcaacagaagggagttttcttctgaacatataaacagagaaacgggtttatattctcttgatggaaatacaaatcacaatgacattaaatcccgtatccagaatctggaatcggagctatcttctatacttcacttgttgaggtctagctcggataaaattacaatgcagatgatatgctgtgtgtggctgtgtgcattgactggtgccagcaaggagtttcacaggctctgtgctagcaaggagttgttgtgtgatttaattggtgtaggagtagctactagctaccacacacttagttttctacactgcgaagaaactagaagaatggtccagaagagctcttctgatggtctagcaaagctttctgatgcttgggaattccaggaaaatgagatcatgaatgctcagggcagattgcgttctatacgggctaagttgtcagtgttagaaggaaagatg

SEQ ID NO: 82103 - DNA, 129 bp, Glycine max
  Peptide Sequence Number=SeqID_198881
atggggtttatagcctctcattttcatgagagactttacactttaggagatgatgttactacttgctggggcgagatcctattgagcccagggcagggaaggtacaagaaaaaaatcaggctaaagtaa

SEQ ID NO: 82104 - DNA, 313 bp, Glycine max
  Peptide Sequence Number=SeqID_198882
ttacaaggattgcacctcgtcaagtctttcttctctacatagtgtttcatcgtcctcgagtcgatctagcaggacaagtagttcgagtctgcttttctgttcaagagggaagaaagccaaagctctctttccagaatcacaaaagaatatgccccataaaggtgtttactatgattcttattcgaatgaacgagtcatctacattggtcctatcggcaattctctgctcacgaacaacctcatgggattcgcctttcttacgtctactaaaaggaatcaatgtcagctactgttgagtactattggagattga

SEQ ID NO: 82105 - DNA, 652 bp, Glycine max
  Peptide Sequence Number=SeqID_198883
atgatcatttcatatccgggatacagggattttgaacagagcatcacggtagataagaatatcaagctggaccttccgctgaaccaggaggaagaagagagaacagcaaagattgatgaagtgatcatctccggagtaaaaaaagataaaaacctttctactgcccaaatgggtaccgagactttaagtattaaaaatatcgagaagcttccggttttattcggtgaaaaggatgttatgaaaaccattcagttgttgccggggatcaaaagtaatggtgagggaagcagtggattcagtgttagaggtggagctaccgatcaaaacttaattttactggatgaagcacctgtttataatgcttctcacctgttgggttttttcagcacatttaacagtgatgccttaaaggatgccagtatcatcaaaggaaacagccccgcacaatacggtggtcgcctttcttctgtcatggacgtgaaaatgaaggatggaaataataaagattataatatcaatggaggaattggtttgatcagcagcagattaagtgtggaaggtcctattcaaaaagaaaaatcatcgtttatagtttccggaagaagaacgtatgcggatttatttctaaaaggaagtgaagattttaaggaca

SEQ ID NO: 82106 - DNA, 515 bp, Glycine max
  Peptide Sequence Number=SeqID_198884
atgtcattgcctagcgctgttcatgtgtcctccattatcaagcacggagcctctggtgactgggaaatatgttcttctgttgttttccggatcgcaaaaaaggaaggagtagagacgagaatcgtcatcacggaaagggcaggatggacgaaatcagtgtcttatctttgctttcctcttatctccgatgagagatgtttggcaccctttgttgcacaatatgtgaagtcccgagacgtgccaaaaatcaagaggaagcaggcttacgcgatccgtgaaaattccgtgatattcttcctccagaaggctgttgcttctggaggaagcaaccttgctcgcctgggcgagctgggtggcaagctcctcccctattttgctataaatagggggaggagtgaagggagaaggggttcagccttcttggcacttctcattctctcgaaattactgaggaaaattatttccgtgaagaaaaccaagccgatgcgcttccgtaacgtttccgtaacgtttcc

SEQ ID NO: 82107 - DNA, 432 bp, Glycine max
  Peptide Sequence Number=SeqID_198885
atggctgagggtgatgaggccggtcgacagaagttcattcacctgacgttcaatctctgctttctgaaaataagggtagcggtacaggcttatgttcatgaggcggcggagttgcaaggaggaggtgtccgcgggggtggttggtgcatcaacgtggagggtgattggacggccgtcgaggtggaattgcatggtcagcgaggcgtaatcagtgacaacaggtccgagttgtatgagccactgaatgcccaagacgatgtcagcaccgttgatgggaaggacgtgaaggtccacggtgaacgtcgtgccctgaaggaggatgggagcttggtagcatacatgggtgcaaggaatgacggtgtcgttaccgacagtaacctggaggggaagggtgggggaggagggaagacggagatgctaggccacccgtga

SEQ ID NO: 82108 - DNA, 231 bp, Glycine max
  Peptide Sequence Number=SeqID_198886
atgactcatcataattttcaagtgcaagccattggtctgtttgctcaagcgacctgtgctcttgagtttggacttccaagaccgttcaatcagagattactcgtcttgcacgttggtgggggtgccgtaaaacaacgagtaaagttcaaaacaaagagaagtaagttatcaagaataggatgttggacaaatggcctcacttaccttaagaaaaagaggggattgaattaa

SEQ ID NO: 82109 - DNA, 663 bp, Glycine max
  Peptide Sequence Number=SeqID_198887
atgtttgcacattcgattaaaggctgccgtcccttgggacggacgtgtggggtgctaataccttccccatcgtgtcttttccggtttttccgacgttttcctcaaataaacgttggtggcgactccgcgcgtattcctttcgtggaacacgcatcccgcgagtctcgcgtcgccctcccgccgaagggactctgccagtcgttcgtagtccccgtcacacctagcaaggtgattcggcctcccatcacccgagcttttattgagaagtattgcacacagagacaggcccagggggatgctccgcaggccgcagacgcgttgccacctcatcaggctggtccagccggatcgtttgatacggagcagtacttgcggcatttggttcgccagcaggcggccaaccaccgggctcatgtacaaacccatgattgtctttaccagatgagcctcagcctgcagagccagggttttacttcttttccgtgccctactccggaccagttcagggcagaggtcgcatggcctggagattggcctgaggcccaggcaggagaggcgccagtagaggcaccagcagaggctcccgacgaggcagatgaggcccgcgaggacgaggagatgaccgatttacttgatttcttaggagggagcagggccacatga

SEQ ID NO: 82110 - DNA, 201 bp, Glycine max
  Peptide Sequence Number=SeqID_198888
atgcatgctcagcgagcatgtctcactgagcgagagttagtgactgggcacttagtggatgttcacacgctaagcgtgagaagcaacaaaggcttcgctggtcgagctagctgcgtgctaagcacaatgctctctgactttacattctctagggttcttctcgcgctgggcgagctggctttcctcgctaagtgggtttag

SEQ ID NO: 82111 - DNA, 869 bp, Glycine max
  Peptide Sequence Number=SeqID_198889
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggtgatagatatgaccaatgcggaaaatgttaaggaatctatacttaaggagattccaatagctaaaattgatgtcatgaagttagatcttagttcaatggcatctgttcgaaaatttgcatcagagttcatttcatctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82112 - DNA, 235 bp, Glycine max
  Peptide Sequence Number=SeqID_198890
ctgcccctgctccccctacttctgctccctctacttctactctcccttcaccaccagcagctccagttcttccaggtccctccgctcaaagcttagagcctttcatgtctatgctccagagcctacaccagggccagctcctgattatgcagagcttgcaggatgtggtctagcagcgggtagttatgagcctggaggagtttgttcagaaggtggtgtggcgtccccaaaataa

SEQ ID NO: 82113 - DNA, 423 bp, Glycine max
  Peptide Sequence Number=SeqID_198891
atgaagagtgatagtagtgatggtggtcgcgatagtagaggtgacagcgacgacggtagtgagggtggaatagtggtgacgacggaggtggaggtggtggtggaatctggcagcaacattgacaacaacaatgggggcgacgacaatggtggtggtggttgtgccaatggtggtgatggtggcggtaacaatgttgttgttggtgacaatagttgtgatggaatgatggtggtggaggtagtggcagggtgtggtggtgatagcagtggtgttggtagtggtggcgatgataatagtggtggaatggtggaagtggaggcggcaatgtcacaacttaccctttggcgggagggcgacgcgggactcatggatgcgtcttccaagggaagaaaatacgcggagtcgccaccaatgtttatttga

SEQ ID NO: 82114 - DNA, 2826 bp, Glycine max
  Peptide Sequence Number=SeqID_198892
atggatctgctctcccagctggaagtcgacatgctgaagcgtactgccagcagcgatctctaccagctgtttcgcaactgctcgctggcggtactcaactccggcagccagaccgacagtagccacgaactgctttcccgctttgaaaactttgacatcaacgtgctgcgccgcgagcgcggcgtgaaactggagctgatcaacccgccggaagaggcgtttgttgacggccggattatccgttcgctgcaggcgaacctgtttgccgtactgcgcgatatcctgtttgttaacggtcagctctcagcggcggatcgtttacaaaatcaggacgtcaccgactccgcgcacatcaccaatcaggtgttctccattctgcgcaacgcgcgcgcgctgcacgtgggcgaatatcccaacaccgtggtgtgctggggcggtcactccatcaacgcggtcgaatatcaatattgccgcaatgtcgggacgcagatgggcctgcgcgaactgaacatctgtaccggctgtggtccgggcgtgatggaagcgccgatgaaaggggcggcggtaggccatgcacagcagcgctatcacgacagccggtttatcggcctgactgaaccgtcgatcatcgctgcggagccacctaacccgctggtgaatgaactgatcatcatgccggatattgaaaagcgtctggaagcctttgtgcgcatcgcgcacggcatcgtgatcttcccgggcggcgtaggtacagctgaagagctgttgtatctgctgggcattctgatgaatccgcagaacagcgatcaggtcctgccgctgatcctcaccgggccaaaagagagcgccgattacttccgcgtgctggatgatttcatcgttaatacgctgggtgaagctgcgcgccggcattacaaaattatcattgatgatgctgcggaagtggcgcgtctgatgaagaaagccatgccgcaggtgaaagagtatcgccgcgaaaccggcgatgcttacagctttaactggtcgattcgcattgcgccggatctgcaggtgccgttcctgccaacccacgaaaatatggccaacctcaagctgttcccgaatcagccagcggaaaaactggcggcggatctgcggcgtgccttctcgggcatcgtggccggtaacgtcaaagagatggggatccgcgaaatccgggaaaaaggtccgtatcagctgcaaggcgatgccgatctgatgcaccgtatggacgaactgctgcagggcttcgtcgcgcagcagcgcatgaagctgcccggcagaaggcagcctgcgggctgccggtatcactatgtcgcgtcatctgcttataatcgacgcgctcaatctgatccgccgccgtgcacaccgtgcagggttcgccctgtcgcgaggcctgcgtggcggcgatgcatcagatactgggccacacgcgaccaacgcaagtggtggcggtgtttgacagccatgaccgacagcctggctggcgtcatcagttattgccggactataaagcgggtcgcccgccgatgccggacgatttacagcaggagatggcctcgctgcagcgggcctttgaggccagcaggtgtcagctgctgggttgccgaacatgatgaagcggacgatctggccgcgacgctggcagtgaagatggccgacgccggtcatcaggccaccatcgtttccaccgataaaggttactgccagctgctggcgccgagcatccgcatccgcgattattttcagaagcgctggctggacgtgccgtttatcgaacaggagttcggcgtcgcgccggcccagctggcggattactggggcttatgcggtatcagcagcagcaaaattccaggcgtgcccggcatcggaccgaaaagcgcacgggaactgctgctgcagtttggttcgcttgaggccctgtatcagcagctggatcaggtacctgagaagtggcagaagaagttacgcgatcaccgcgcgaccgcggaagtgtgccgacaggtgtcaacgctgaagcgggatttggtgttgcaggggaatttaaatacgctgcggtatcagggcgctgccaacgccgcgatagtgcaaagaatgaagcagaagttctgcgaaataatttgtgccaccgcaggacggcaagcacgagctggtcaggcaggtttcagccccattccacaccggcgcagccaacgccgcgatagtgcaaagtatgaagcaggcctagcgttcgtcgcgccgtccgccgactgccgcccagatccggcgcacatgcacggtcacttcttcgcggtcgtgatacagctggcgcgcctggatctgcgcgtttacgcccttctccttcagcgccgcgtccatcattgccaggttctgcgtaacttcttcatagcgctttttcattggcagcttgaggttgaagatcgcctcacggcaccagccgttgaccagccattcggtcatcaggctggcgacgcgcaccggtttttccaccatgtcgcacaccagccagctgatgttgctgcgcggcgggcggaatttgaaaccgtcttcgcggcagtgcgtaacctgtccggtatccatcaggcttggcgccatcgggccgttatccaccgcgtagacccacatgctgcgcttcaccagctgataggtccagccgccggggcaggcaccgagatcgaccgcatacatgccgctgcccagccgttcgtcccactcatcggccggcacgaacacatggaatgcttcttccagcttcagcgtagagcggcttggcgcatcggccgggaacttcaggcgcggaatgcccat

SEQ ID NO: 82115 - DNA, 186 bp, Glycine max
  Peptide Sequence Number=SeqID_198893
atgaaaggacattgggcgaagtatgcacttactggcgcatttctggcgctgttagccggttgtagctctaagccgaccgatcgcggtcagcaatatattgatggcaagctggagcaaccgctcgggctggtgaatgagccgaacgccaaagggcgtaaggtcaatggccgtgatttcggcctgcag

SEQ ID NO: 82116 - DNA, 345 bp, Glycine max
  Peptide Sequence Number=SeqID_198894
ggtgcgggcgtgggcggcgaagagccaggcggcgaggacggggcagcagcggctgcggtcaagggtggggccgccaccgcaggcggcgttgacaccgccgaagagctcgttggagaggtcgaggcggcagatttgggactggtgtgtgatatggacgcgaggaaaacgaggtacgctataaaggaagtgaatgattgcattttcgcttttaagttgaactgtgggcactggttggtgattggaagtcgagtgtggtggtttgttttggtgtcggagaaagtggcaacgttgttctgggaagtggaaagaaagggtttgcgcgaggaaaaagaaggcactggataa

SEQ ID NO: 82117 - DNA, 246 bp, Glycine max
  Peptide Sequence Number=SeqID_198895
agatcgtgcccgcaagacaccgagtggacccgaagaagtccaatggggtcttggagttgtcaagctctaattacgggtctctgtcagttttacagagtgcctgtcacctccagcaaaggcatcaggccccctactaatcgagctttcatcaagaagtactgcgtctccaggcaggcgcagtggaaacaccatagcagcatggggatggctagcagcgggcaacagacgcatcgccatcacctctag

SEQ ID NO: 82118 - DNA, 639 bp, Glycine max
  Peptide Sequence Number=SeqID_198896
gtagctgtgtctccgccaaaaccacctccgaagccccatccggaggtcgatgatccgctgtatctgatgacattgaccatccaagagcttttcttgaggccttatcaggttagatgggatgccaccgtgttcggggttgttaatccagatttccccctgtacataaagcacgaagacctcttcgaaattgcacacggtggtcaatgtctcagcatatcagtgttacagttgtggattcaacatctcactgaaacatgtatgcgagcggggaattctgatatctatgaattcctcgagcaacagtccattcagaggtctgggcaatcgcagtttgaatctgaaagttacataaagagttggatgcatagttcacaacgcgatgtgtatcttggagcctacctaaatggtggacactggcagatggtggtcatcctgcccaaggaacacctagttgtctggttttgttcattgcataacaggccagacaactaccttaaggggattattaatagcctaaatcaaaggcttcggctaggtggattgtcgtcaagacaaaaaggaagtactgagtgcggctactatgtgatgcactggatgtccaccatcattttaggaacttttaggaataatggggaagcg

SEQ ID NO: 82119 - DNA, 246 bp, Glycine max
  Peptide Sequence Number=SeqID_198897
ccctttgtagaaagcttgtccagctgtcccaagcatggtgtacacaaggcttggaaggcaccgcaaagatatctcatgtttggagctcacatgttatcacttcctaaggtttcagatttctttacaatgttaatacaaagagtttctccaaaaagttaccagcaggcttttggtgaagtctatgtgacacaaaagtttctagagaatttttgtggagagcagatatatcaaaataagacgcattag

SEQ ID NO: 82120 - DNA, 300 bp, Glycine max
  Peptide Sequence Number=SeqID_198898
atggtctctggtaatcgattacaaagggagtgtaatcgattaccaggcttgaaaggtcaggaagctaggagagctgctagtaatcgattaccaagggggtgtaatcgattaccaggcttagaaatgaaggcagcaggttgtggaggcctctgttttcatgtcctgaagctgtataattcgagtttggcctctggtaatcgattaccaaggctgtgtaatcgattaccagagatgaaaagcctaaagataccccttttacttgcatttagtggttatgagacgcattgtgttgcggcgtag

SEQ ID NO: 82121 - DNA, 153 bp, Glycine max
  Peptide Sequence Number=SeqID_198899
atgtctggtttttcacgagtctatgatttaattgattatcaggtgttcccaaaagtgatcaagaacacgttattcgattacatcaagaatctaatcgatgacattgttcttgaaagttttctagattttgggaagaacactttaatcgattga

SEQ ID NO: 82122 - DNA, 708 bp, Glycine max
  Peptide Sequence Number=SeqID_198900
atggaattcttttctgctgaaagttttgattgcattcaggcatttcagaatttaggtctcatacctttcatgtcattacaattgccagtttatcctgaattggttaaagctttttattgtaaccttgaaattcaggacaacactttgatttctgaggtttttgggataaaaatggtcattgaccaatcccttttccatcacttaacccaattgtccagtgacggtgtaccatttgaagggcgtcaacttgactgggcacatcttgtaagatatcgcatgcataaggcattacgattaaatgcacctttgccatatccacatcttgtcactctctttttccgccattttcaaattcctcttgattctgaaccttatgttccaatcaagagatcttttttaattggtgctgttgtgattgcttcttttggttaccgcaaagagcatgatggctcttgggtcaaaaagggcgctcaacccactgatgaagaaggcaacctaccagttgaagataattccactcttcttcgaaggcttatggacaagtttgatggacttcaaacttttgttggtgacaagtttgatgccatggaattgcaagtcgacatgcggttcgatgccatggaatcaaggatcaccaaagttgaagaagatgtctccttcatccgtacttgctttgatccaccaccaccgcctctatcatcatcttag

SEQ ID NO: 82123 - DNA, 165 bp, Glycine max
  Peptide Sequence Number=SeqID_198901
atgagactaaaggttctcatgaactatatgacaattgagggtggattgactatcacagtaaggaaaagtgagggtgataaggggaaccatgaggtcttggagaaagtaggcctccaagcggaaaatcaaacacgcactaaaccatgtgctggtggtgctgggtag

SEQ ID NO: 82124 - DNA, 129 bp, Glycine max
  Peptide Sequence Number=SeqID_198902
gcgctaagcgtggcgttaagcacgaaggagcagaaaccgttacgcgcgctaagcccagctaggcgcccagcgcgtgatccaacagaagcacaggctaagcctgtagggcgcgctgagcgcgcgatctga

SEQ ID NO: 82125 - DNA, 279 bp, Glycine max
  Peptide Sequence Number=SeqID_198903
atgtcgcagaacttcacagattgcttaacgatgggtgttaagttcctcgaagcggtcaaacaaaggttgtatgcaatcaaacaatggtccccagacgaaattaggactagcctttggcttgcctgggcccccaaattacttcagggtgaaggaaccagcttgcctgggcgagctagttacttcaggagtaagcatcagctcgcctgggtgagctccagctcaactgggcgagctgccattgccccaagtgcccattttcctatacataggcatgcttaa

SEQ ID NO: 82126 - DNA, 927 bp, Glycine max
  Peptide Sequence Number=SeqID_198904
atgaagaacctggtgtcgcgcgccaagaacgccggcctgtcgcccgaacaggcgatggccgccgcgcgcagcaaccgcgagaaagaagcggccagtgtctacgagcgttaccagctgcgcctgacggcgttcaacgcggtcgacttcgatgacctgatccgtttgccggtgcagatcctggaggaaaatccggagatcgcgctggcctggcgtgagcgcatcggctacctgctggtggacgaatgccaggacaccaacgacgcgcagtaccgcctgctcaagcagctggccggtgagaagggcaacttcacctgcgtgggcgatgacgatcagtcgatctacgcctggcgcggcgccaacccggaaaacctgcagcagatggggcgcgattaccccacgctggaaatcatcaagctggagcagaactaccgctgctccaaccgcgtgctgcgcgccgccaacgcgctgatcgccaacaatccgcatgagcacctgaagaagctgtggagcgaccaggccgacggcgaacgcatccgcgtgtgggaatgccgcaacagcgaacacgaagcggaaaaggtcgccgccgaaatcgccttcgtggcgcaatcgcgcaacgtgccgtggagtgatttctgcatcctgttccgtggcaacttccagtcgcgcccgctggaaaaggcgatgcagctgctgcgcattccctaccacctgaccggcggcaccatgttcctggaacgccaggaagtgaaggacacgctggcttggctgcgcctgctggtgaacccggacgacgacaccgcgttcatgcgggcggtgcagtcgcccaagcgcgatgtgggtgccggtacgctggccaggctggccgagctggcgcaagaaaaggatatgctgatggcgcatgtggacgagaccatcggcgccctgtag

SEQ ID NO: 82127 - DNA, 264 bp, Glycine max
  Peptide Sequence Number=SeqID_198905
atggtacctaatgcatggttaactaggaaatggtgtttcttcgggcatctcaatttcataattacattttccgtgcataagcttaagggatgcccgagtcattcatcggtgtgggaggttgttgaagtattggcgatcagaattgccattccttggattacggggttgaaccgagctcatgcttttacaaaaagaaaaggacacactttacggcgcccttaccgaactcgtgctagagctagagtaatgggtgaagcagaggag

SEQ ID NO: 82128 - DNA, 246 bp, Glycine max
  Peptide Sequence Number=SeqID_198906
atggataaagctatctctagaatatgtccattggatttaatgatgaaatatgtgcaatttcaggccaagtgcacatccaccactaagcgcagcttcagcgcacttagcgtgatagaagaatctggcaggccatcaacatcaaggtcgcgcactaagcgcgagattagtgcgctaagcgcagcaggtgtcttcagccaggctcagcgcacgactggcactaagctcgaatccacttacccgcattaa

SEQ ID NO: 82129 - DNA, 256 bp, Glycine max
  Peptide Sequence Number=SeqID_198907
cgcccaatacgcaaaccgcctctccccgcgcgttggccgattcattaatgcagctggcacgacaggtttcccgactggaaagcgggcagtgagcgcaacgcaattaatgtatgcttatgctgtgacatctgcattgcatggtgtagagcataatcttcgaaaagactttatgcttcagccaccttgggacgaaaatgttgagaataagtttatcatccactatacatatggatgtgactataaggggatcctctag

SEQ ID NO: 82130 - DNA, 673 bp, Glycine max
  Peptide Sequence Number=SeqID_198908
ccaacacctcaagtgaaaagattcctggtgcttcgtcctcatctgatgctgaaataaactcttcagtacgccaagattctctgctcttgaagttatcaacggaatacgcacggaaagatgtgcttaaatccattgaagagaacccctctgctgcctttgggcacctgaactttttgaagaaattgcacaacccccttacctctgacgagactctaggcaaagttatccaaatcgaggccatcattgaccaatttgcaagtactgtgcagaaaaaacgcgaaaatggcacaaaactagatgcccagaaacaggcacatatccttctgctcgagaaagcccgagctgctcaacatgaagtcgaacgtctcaccaaagaggcgaaagaaggatcttctgagatcaaagactgtgatgataacatctcctcctgggaggcaactattacggatctgctgtttcaggtcgatgatctaaggcagaaaattgtgacagagcaggccaaacgcaaggaactccaggagaaggccgctaactcgattcagaaattggttgatgaaaaagggagggaaggcctgaaggcctttagcgcatctcaggctgtagcagatgaggcaaaggttatggagagtgctgaccaggtcttaactaaagagatggccaccttgaaaaagct

SEQ ID NO: 82131 - DNA, 207 bp, Glycine max
  Peptide Sequence Number=SeqID_198909
atggctatggacttgaacttctcttcgactacccgggctctctcaagctttgcctttagggcttccgccgatgatcccattactgcttcccctaagctctctgtcctttcttcacgccgtatcccatgccttgcgaactccttggagtaccctcgcgttgtggtcactgaaaccccgtgcgatgaaaggcgtgatgctttcgtctga

SEQ ID NO: 82132 - DNA, 726 bp, Glycine max
  Peptide Sequence Number=SeqID_198910
gaattagaccgccaaaggcaagtcgaaaatggggtggtcggaataccgagaaaatatttggagggagtcctctttccaaatgtggaagggttggtggacctggcagcgatcgacgtttttctcgcctatcataaccacaaggaaagtccggttgtcgctatgatagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaatgatgacagagagcttaggggaagcagtaatgggatcatcggcggctatcataagtggctgggagtccgaacacaaggattggattggctcccaaatctaaagactgtgagagacaatgaggttaaagcttcggaagaaagtgatgacgtacaagccctaaaggcaaagcttgagagagcccgggtagtcgaagagaagttcaaggcagcaatagtgagctcaagctccgaagaggtgaaaggaatcatcacgggtcaaaggcatgatcttgaaggacgagctaaaggcttgccttag

SEQ ID NO: 82133 - DNA, 441 bp, Glycine max
  Peptide Sequence Number=SeqID_198911
atggcggatttttcgcgtgggaggctttattgttttgctcggattctggatcgcgtaatactcttagcatctgccggatggttttactacaacgcttttgttcatgatgagccgctaaccattacggtaagcacaatttcacaattacaaagcctccgccagcaggcgaagtttactgatcttccaggcgaagatactcaagccgaacgcatgagaaacgaaagcgatcttaacgagctaattgaccggcttactgctggcatatcggctaatccgcgcaaacgttgggtcattcttcaaatgaattcgactgtagaaaagatgtatctcgaagatacagaggcacgcgaaagattcattgattaccttgtgcaaatcaataatattctaggcatctcaagcactaacggtgcatttgctcttaaactcattttcttttag

SEQ ID NO: 82134 - DNA, 484 bp, Glycine max
  Peptide Sequence Number=SeqID_198912
atggcatacagatccatcaaccagaatgtgctagcaaatgcaccttgcttggtcagaattctagtggataaaggcttaagtggctctaaccatttggcgggaaatcaagtatctcatcatgtagcagtgttgttctttagaggaccaaatgatagagaagcattgtgctatggatggagaatggtggaacatcatgggattagccttaccgtaatgcgttttgtccaaagtgatcaagtacaagtacaaccattgaggcaacaacatggtggcattgatttggatgaaccgagggtgctgacagtgcaaacagatagggatattcagaagcaacatgatgagaatcttatacatgagttttggatgaggtgtggggatgatgatgtggttgattatgttgagaaggtggtcagcaatagtgaggacgcagtggcagctataagaacaatggatgacattcatgaccttttcatagttgggagag

SEQ ID NO: 82135 - DNA, 375 bp, Glycine max
  Peptide Sequence Number=SeqID_198913
atgactacacacaaaagaagggagttaagtagtcatgcgcctacgcatcaagagaagcacactcatccaatgcatatatacgattcaaaaggttttcacaacaataatccacacatcaagagagggataagcttgttaacaacatacacgcaggaagataagggctcattaagagtagccggaggaggagctctagagagcactagaaacgccatcattgctaacgaggaacgcttgagtgactacattgagaaccctaacagagtagcaagaggaggagctctagagagcactagaaacgccaccattgctaacgaggaacgcttgagcgactacattgaggtaagagatgagttactcacacttggggattag

SEQ ID NO: 82136 - DNA, 156 bp, Glycine max
  Peptide Sequence Number=SeqID_198914
atgagtcaggtataccaaagtggagaagatcgtgttgagagtaaagacctagatccgaagatagggagcactggccacagctgcccgttatcccccaatgttcaatcctctagctcttatttttgtgaccttttcagaagctatcatacttggtga

SEQ ID NO: 82137 - DNA, 276 bp, Glycine max
  Peptide Sequence Number=SeqID_198915
atggcaagacgcaacccacaaaatctgtctcagaaaaatgatgatctcggactcattcaccgttggatcgtcgtgaaatttgagtaccacgtttacaacccaattttgagcattctcaccgttgggaattgcaaagtcatgtctgagcttagaaaaaaggaatcgcatgaagccagtacaagtggaggcttcaatctcttcttcgtctccctgacgttcgagaattctatcggagcagtcggaggaaaaactggaggaatctctggaaacctctag

SEQ ID NO: 82138 - DNA, 1506 bp, Glycine max
  Peptide Sequence Number=SeqID_198916
gttagtagtgaaactggtagagtaacactctctctaaagcagacagcttgttcttcaactgatgcatcatttattcaggactactttctcatggatgacaagattgcaaggttggaatactgtggctctggtgcatctgatacaaagtgggatgaaggatttaacattggtatggttgcaaaaggcaaagttaaggctgttgaggatgttggacttgttataagctttgaacattataatgatgtttttggttttattgccaattatcagtgtaatttttctccttcccacatgagtggctctatagtggaagcattggttcttgatgttggaaaggcagacaagcttgttgagttaactctaaaaccagagttcattaatagatctaaagaaagttccataagtcgtaccaacaagaaggttctatcaattccagaaaatgattacactataggatatgcatcagtatcagactataatgctcaaaggtttcctcataaacaataccaaaatgggcagagtgttgttgcaactgttatggctcttccaagtcctgaaacatcaggaaggttgctcttacttgtcgatgtggtcaatgagacatcatctagttctaaaagaaccaagaagaagtctagctacaaagtgggaactctggttgaggcagagattactgacatcaaaacgcttgaactgaagctgaagtttggatttggtctatatggccggattcacataacagaggtatattatggaaatgttttggaaaatccattctctagctacaaagttgggcaaacagtgacagcaaggattgttgcaaaacctaatgagtcagatggcaatcggaagggctctcagtgggagctatcagtcagacctgaaatggttacaggttccagtgatatagatgatgtatctgaaaatcttgagtttaaaattgggcaatgcgtggctggttatgtatataaagtagaaagtgaatgggtctggttaacaatatcgcgaaatgtaagggctcagctatatattcttgatagtgctactgaacccagtgagcttgaggatttccagaatcgatatcatgttggacaacctgtttctggtcatattctaagtgtcaacatggagaagaagctattgcggttggttgtgcgccccttttctactctttcttgcggaactagtgaagagccactaactaatgttgtggataaggatttaacagcatatgttcatgaaggagatattttaggtggaagggttagtaaaatacttccaggtgttggtggattgcttgtccaagttggtcctcgcacatatggaaaagtacattttactgaacttgcagacacatgggtgcctgatccgttgtctggatatcatgaagagcagtttgtcaaatgtatagtgcttgaagtcagtcacactgtcaagggtactattcatgttgacttgtcattgggatcttccaatgtgaagctttcccaggattctgctgtgtaa

SEQ ID NO: 82139 - DNA, 387 bp, Glycine max
  Peptide Sequence Number=SeqID_198917
atgggcgaaagcctgacggagcaatgccgcgtgaaggtagaaggcctacgggtcatgaacttcttttcccggagaagaagcaatgacgcagccgcggtaagacagaggatgcaagcgttatccggaatgattgggcgtaaagcgtctgtaggtggctttttaagttcgccgtcaaatcccagggctcaaccctggacaggcggtggaaactaccaagctggaatcggaaagaacaccaacggcgaaagcactctgctgggcccgacactggacactgagagacgaaagctagggggagcgaatgggattagataccccagtagtcctagccgtaaacgatggatactaggcgctgtgcgtatcgacccgggcaatgctgtagcttaa

SEQ ID NO: 82140 - DNA, 255 bp, Glycine max
  Peptide Sequence Number=SeqID_198918
atggcaaaattgtgcctagtgccttacatcgttatccctccgaagttcaaggtgccggatttcgataagtacagggggactacttgccccatgaatcacttgaagatatactgtcggaaaatgggggcatactcgaaagatgaaaaattgctgatgtatttcttccaggaaagtcttactggggcagccttcacctatatcagtataattctgatatggctccgaataggatgcagctacaaagcatgcgtataa

SEQ ID NO: 82141 - DNA, 300 bp, Glycine max
  Peptide Sequence Number=SeqID_198919
atgaactacaccaacaataaacgaattttgacccgctctgctttaatgcttgccatgcttggctctttggcaggctgtggaagtgatagtgatgacacatcaactccctcaacaacgaaaccgcctcagttgtctcctgctgtgggcgtaaaaatgacaggaagctgttcagacttactcggatttcaatacaacaataccgtcattagttcagccacgcttcaagaggcaggcacattgactgtagccaacaaaccgattggcgctcattgtttagtcaaaggttatatggatcaacgt

SEQ ID NO: 82142 - DNA, 306 bp, Glycine max
  Peptide Sequence Number=SeqID_198920
atgacatgtctttcggaaataaaaaaggctagtgctttagaagaggaagtgtttactcattctgatgtcaagcctggcatggtggtgaaggctaagattctttcagttgacagctttggcgctatagtgcaaattccaggtggtgtgaaggcactttgtcctcttcgacatatgtctgaattggaaatttcaaagcctggaaaaaaatttaaggtgggagctgaattggttttccgtgtgcttggttgcaagtcaaaacgagtgacagttacacacaagaaaacccttgtatgtttctacatgtga

SEQ ID NO: 82143 - DNA, 1176 bp, Glycine max
  Peptide Sequence Number=SeqID_198921
atgaagctttggggtgttgttgctgaagtaaatgagaaagaccttgtagttagtttaccagggggtttacgtggtttagttcacgcttcagatgcggtagatcctatttttgacgacaaaattgagctggtttcttgtgttgtactgagattggatgatgacaagaaagagaaaggaagcaggaaaatttggctttctttgcgtctttctttgttgcacaagaactacaacttggatgttgttcaggaaggcatggtccttgctgcatatgtgaagagtattgaagatcatggttacattcttcattttggtttaccttttttcatggggttcttaccaaaaaacagctctgctggtaaaagtcaagctcctgctgtgaatttgctgctcatcttgtctggcatgattgaaccaagctcaatttgtgaaggctggggtggtgaagtaaaaattgggaaacttctgcagggtttggttagaagcattgataaagttcgtaaagtggtttacttgagttctgaccctgatacaataaccaaaagtgtgaccaaggacctcagaggtttatcaattgatcttctagttccaggaatgctggtaaatgcctgtgtgaagtcaatccttgagaatggtgttatgttatcatttctcacatacttcacaggaactgttgatctgtttcatttgcaaaatatttatcctggaaaaaattggaaggataagtgcagtgaatctcagaaggttgtttctcggatattattcattgatccatcaagtagagctgttggtttgacactgaatccacatcttgttcagaacagggcccctccttctcatgttaaaattggagatatatatgacaactcaaaagttgttagggtggatagaggattaggactattgcttgaagttccatcaattccggagccaactccagcttttgtcagcatatctgatattgctgaggagatcccaaaacttgagaagaagtacaaagaaggaaatcatgttcgagttcggattcttgggttaagatatttggaaggaattgctacaggagttttgaaggttgtcattgtctttttgtttggagaatgggttatgtggagaatgagaatgggttatttggagagatggagagaatctgtgagtgagggagagaatattgaaaactga

SEQ ID NO: 82144 - DNA, 399 bp, Glycine max
  Peptide Sequence Number=SeqID_198922
atggcaccgcattcaaaaaaaccgcagaagaagaacgactctgtagacaaaccgaaaatcgataaagcctctaagaaaatattcaaaccgaaaaagagggaacaaaacatcgccgtcgccgccgcaaagtccgaagcactctctctgccactagaagacgaggttcccgatttccctcgaggcggagaattttccgcgaagggtaggaatgattatgatgagtttggcgccgaggatccctccaagaagacgaggaagaagaagaaggggaagaatgcgtcgggtaagagtaatgaagccgcagatgactggggctcgctttccggcaacggtatcaccggaaagttgccgcggcgtgtgaataaaattactctcagggtagggtgcagcagtttgtag

SEQ ID NO: 82145 - DNA, 660 bp, Glycine max
  Peptide Sequence Number=SeqID_198923
atgggacatgaagccattattttcaaattcatgaatcaaccacatggagaagttgcaaaggttgttgatccagatgaggaggtacatgaggaggagtacttgtttgttgatacatgtttctctagcattgaatcaagtcaaaattggcttattgacagtggttgtactaaccacatgacaaacaacaaagatctatttaaggaactaagcaatgcaagcacattgaaggttcaagttgaaaatggagcaatctcaaccaacaaagatacaaaactcatttctaatatgttgtatgttcctgaaattgatcaaaatttgttgagtgttggacaactagttgagaaaggttttaaattgttgttcaaaaacaaaagctgcttgattaaagatgcaaatgataaagatattctcaaagtaaaaatgagaggaaatttttttgctttaaatccattggaggaggagaaaattgcatttcctataaaagagaatgttagtgtatcaactagttttgaaatagaagcccccaagtctcgaagtggtgctattgaagaaaaatctaaagttattgtgcaggagctcacaaacaagctgatacaattgagtgaagatgctttaagagaatttttttcgggactttggttagaaaggaagatgaaatga

SEQ ID NO: 82146 - DNA, 408 bp, Glycine max
  Peptide Sequence Number=SeqID_198924
atgactccacggtccttcccagctccaacatcgtcgtcggaccctacgtcggcgattcccaaatcaaggacgtccagttcgtcaagagcagtgcccacaccaaggattgccccaaagactaggaggaagcatttgattttaaaggaaggttggaggttcaagaagggtgagctcaagggtcaacaagtagctgttaaggtgataccaaaagcaaagttctacgatgcatttgaagaccaagataatgtctacattgtaatggagttatgtgaagggggggagctcttagatatgatattatcaagaggacggaaatactcagaagatgatgcaaaggttgtcatggtgtggtacaccgagatcttaagccagagttcaccagtcacttgggcacaacccaagcattaa

SEQ ID NO: 82147 - DNA, 249 bp, Glycine max
  Peptide Sequence Number=SeqID_198925
atgtcgggggtgggacgagaaaaaccaaccccgttgggggcggggatgggggataaatttacacccttgtcgggtttcgagggcaggggcgggttgaaccagcttgacgggatcattgacgctaaagaagaggaagagagcaatggtggcaaggagaagggaaaaaaacttgaaatgttgttgccgataatcgcctccagcaatggcaaacagtggtcagaatcttgtcttctccttctcaatgtttga

SEQ ID NO: 82148 - DNA, 1581 bp, Glycine max
  Peptide Sequence Number=SeqID_198926
gttaagtaccctcttcattctgtcttgtcttattcccgtttgtctccttctcataaaaacttcatcatgtctataaccgcgcccactgaactcaattcatatgctgaggcttctagatttgactgttggattaaagccatgcagactaagttaaaggctcttcaacagaaccaaacttggattctaactacactcccaccacacaaaacggccattggttgtcgctgggtatacaaaataaagcataacgttgacggaaccattgaaagatacaaagcgtgcttagttgcaaagggatacactcagatggaaggcttggatttcctcgatacattctcccccgtggccaagcttaccactatccggttactccttgcccttgctgctcttcataactggcaccttcgacaactggatgtaaacaatgctttccttcatggggatcttaacgaagaggtttatatgaagctccctctaggacttattgtggataatcccaaccttgtttgtcgccttcagcgttccttatatgggctcaaacaagccaatcgccaatggttcacacggctctcgtcatttcttctctctcagggattccatcaatctttaactgatcactcgcttttcttatactctgataatgataatgatataacagatattcttgtttatgttgatgatatcatcttgacaggaaataacctcgagactatagcatatgttaccaagcttctcgatcaaactttcagcatcaatgatcttggtattatgaagttcttcctcggtctcgaagttgctcgttccagccatggtatacacttgtgccagcgcaaatatgttctggatatcttatcggatttcggtatgcttggttcccatcctacttctacccatatggattactctacacgcttaagtgcttccatgggaaccccactatcagaaacttctgcttcttcatacagacgcttgattgcacaactcatatatcttacgaacacacgaccagacattgctcatgccgtcttacgttacctcaaaggaactcctggttctggcatcttcttcgtggctcaaggtacactcactctcaaagctttcagtgactccgattgggcaggatgttgcgacacacgacgctccatcactggcttctcagtctatctgggtgagtctctaatttcctggtggtccaagaagcaatctacggtctctcgcagttcatctgaggcagagtatagagccttggcttctactacgtgtgaacttcagtggctcacctacctccttcatgattttccggtccccttccttcaacctgcaactctctattgtgataatcagtccgccatccagatagcctcaaaccctattttccacgaacgaactaaacacattgaaatcgactgccatatcgtgcgagacaaagttaacaaaggattgctcaagcttcttcccgtttcgtcttcaatgcagcttgctgacatcttcacgaatcctctttctcgtgctctttttcaaggtttatatttcaagctggaaatgatgaacatccattcccagcttgcggggggctcttag

SEQ ID NO: 82149 - DNA, 210 bp, Glycine max
  Peptide Sequence Number=SeqID_198927
atgtccgtgatcaatggtaagttctcatggcctgagttggttggggtgcaaggaacggtagcggaggctacaattgagagggagaatccttcggtgaatgctattattgtgcctctaggatccgtggtcacaacggatcttcgaagtgacagggtttgggtttgggttaataaagatggaattgttaatagagttccaaaaattggatag

SEQ ID NO: 82150 - DNA, 1560 bp, Glycine max
  Peptide Sequence Number=SeqID_198928
atggtgagtgtcgccactcttcagcaccaagtgaaattggccaatccagaaggttccggcatgctagccgtccaggcttgtgggagtgacgatttcctttttctgagggcggtgtcgggcagtctgcccttgagtgcattccagtgtgctctacttgagcacttgaatgtagccacttctcaactccaccccaatagttggttcctagtgaagcatgatgaaccttctagtgggattgtgccattgtctactgtcattcctcctactggagaaggggttgttgaggtctcccctagcatgccttcctctattttggctaagaggaagtgtgacaacgacactagggtatcaggccgcaagaagtcgagggccccttctagccttcgagctgtgaggcaagctggtctgcctatggctccttcaactgtccaagctcctgcatctgccgctcctgctgttgccactcatgctcctccaccttctcctgttgcgtttgttcaggagatttctacttctcttattgctgaagttagtgcatcagccgctttggtcggtcctgtcatggctcctccatccaccattgttgtacccttgctaagtgccagtgtggcaaccacgagtgctcctgagatgccgcctcttcctttttcaactccattggtttctccctcggctgtgttggcatcaacgtcgccttccttttcttctcaccctaatcttcctctagagaagtatggcgatcttcgcggagaatggataacgacaccaggaggctctgagcaaagtggcatccttggaggctgggtgaagcgtcttaaggtggccaacaccactgtcgcctttgacgagcccatgaggtcgaaccatcggctatcatccaaggttggtagtgttctagccaagtttttgtgctctagattggatggtgatgagttgtttgagcgctacaagggcttgtggagagagaagaatgaattggttggtgaggtggagagcgctactgctgagaaggataagcttaccaaggtggttgctgacctagaggcccaattgaaggagtcagagtctgagcttgaagaggagctgttgatatacaagaaggaggccgtggaggagaatgaaaaggactttcataaggctattaggcaggtcgggttcttcgacaaggatcttgacttgggtctttttgacccattcaaggacatgagggacgttgttctacttgacaagaaagatatagttgctaagaaggaggatgccgtcgaggagcaggatgttagggccaggaccattcataggctccatttggagttcggtggtgtcctttggcctatgcacaaaacagatagggtagaccttgtgtttgacaagcctatagagatgcgtcaaggcttaccaagggcagaccttgggtttgatgagcctttggagaagcgagactcaccaaggcctttggagaagcgagactcaccaagggcaggccttgggtttgacgagcctttggagaagcttaactcaccaagggcgaaccttgagtttgatgagcctttggagaaatga

SEQ ID NO: 82151 - DNA, 585 bp, Glycine max
  Peptide Sequence Number=SeqID_198929
atgagaagtctgataactttggaggagaatggacagtggcaccaggtagctctgagcaaggtggcatccttagaggctgaggttttcaagtggagggcctctgttcgtactatttggagagtgaagcatcctaaggtggccaaggccacttttgcctttgttgaggctgtgtggtcgaaccatcaattgtcattccaggttggcagtgttcttgcccaactgctgtgcaccagattggatggtgataagttgtttgagcattgtaagggcttgcaaagggagaaaaatgaactggttgacaaggtggagagcactgcagcagagaaggatgagcttgccaaggtggttgtggacctcgaggcttggttgaaggagtcggagtctaagctcagggcatccaaggagaaggaggtcatcaaagagcttgaagaggagctgttggtgtacaagaaggaggttgttgagcaacatgaaaaaggctttcataaggctgtcaggcaagccaggttctttgtcaaggatcttgacttgggtcatttttaccctttcaaggacttgaatgacgatgttttgcttgatgaataa

SEQ ID NO: 82152 - DNA, 1153 bp, Glycine max
  Peptide Sequence Number=SeqID_198930
atgaacgagttactactgaactcagaaagctatctttatcttcatccaagtgaacacccagttgttgcactcgtctccccagctttggattccagcaactaccattcatggagtaggtccatgataacagcattgagcgccaagaacaaagtggaattcgtgaacggaaaagcactagaaccactaaagactgatagaacgtacggggcatggagtcgctgcaacaacatggtggtgtcctggttagttcattcagtattcatttccattagacaaagtgttttatggatggacaaagcagaagaaatttggaatgacttgaagtctcgatatgcacaaggggatcttctaagagtttttgatcttcaacaagaagcttcatccatcaaacaaggtactctttcggttacggagtattttacaaagctacccgtcatatgggacgagatcgaaaatttcagacccgatcccgtctgttcatgcaccgttaagtgcacttgttcagtccttaccaccattgctcaacgaaaactagaagatcgagccatgcaattcttgcgagggctgaatgaacaatacaacaatatacgatctcatgtattactcatgaatccaatacctacaataccaaagattttctcgtacgtggcacagcaggaacgacaactaacaggtaacaactctttaccaagcttcaatcttgaaactaaagaaggtccttccatcaatgttgttaagagcgtttgtgagttttgtggacgtattggccataatgagagtgtttgttataagaagcacggtgtgcctccaaattatgatggaaaagccaaaggatacaatacaagaaatgggaagacatgtacctattgcgggaaacttggccacaccatagatgtttgctacaagaaacacgagtatcccccaggattcaagttcaacaatggcaaagtaatagctaacaacgtagtggcagtagaaggaaaggccacagatgaccaaatacagcgccaagaatctcaagaattggttcgtttttcacctgagcagtacaaggcattgctggctttaatacaacagccatatgcaggaaactcagcatccaccaagcctcaggtcgcttccatttcatcttgctctagtaacgatgcaacag

SEQ ID NO: 82153 - DNA, 771 bp, Glycine max
  Peptide Sequence Number=SeqID_198931
atgtctaccctggacaacttgaaagaagcaactcggacaacacttgtccaagccttggggcttgacaagcctaacagacttgcaactcttgtacttgtcgaagttaccactctcggcaccagacaactctcgtccatgcttaaggggcttgatgaactcgtgaccctcctacttgtcaagattactaccctcaacacaaggcaatctccctcgacactagacaacctctttcacccacaagtcgactcagagcttggtaagtttcgcttctccaaaggctcgtcaaacccaaggtccacccttggcgagtctcgtttctccaatggctcatcaaacccaaggtctgcccttcatgagtctcacttctccaaaggcttgtcaaacccaaggcccgcccttggtgagtctcgcatcttcaaaggtcagtcaaacccaaggtccatccttggtgagtctcgcatctccaaaggctcgtcaaaccaaggtccgcccttggtgagccttgatgcatctctacaagcttgtcaaacccaagatccaccccgagtgaacttcgccaaaacccaggacgcacacatccttggtccaaagctcattaaacccaaggtcctcctaggtgagcctcttcatttccaaatttcacattcacaaaaatctaaggaatacaagtcagtaggaacaccaaatacccaaggtcctcccttggtacaaaaactcaaggtccatccttggtacgcactcctacaaaaacccaaggcatgcccttggtaa

SEQ ID NO: 82154 - DNA, 1149 bp, Glycine max
  Peptide Sequence Number=SeqID_198932
atgatagaccttgggtttgacgagcctttggaaaaacgagactcaccaagggcagaccttgggtttgacgagcctttagaaaagcgagactcaccaagggcagaccttaggtttgaccagcctttggagatgcgagactcaccaatgatagaccttgggtttgatgagcctttggaaaagcgagactcaccaagggcagaccttgggtttgacgagcctttggagatgcgagactcactaagggcggactgcagcttgatggcctcttctttgattatggccatctcttggacttcgtcttttgtctctagttctacctgcatatattcttcattgtgttgttcctggaacaacaaccttattgtcgatggttccccgacttcgatggggatcatggcgtttgtgccatatctgagttggaaaggagtttcattgggccttgaggatgactctgttggctgtatctgcttaattgttgttctagggatgtttaatagaggttacaagcggtccaagtatgtccattccccatatggcgaagggccaaggggagctcaagctatgaagattgttaggagaaatgcgtggaatgtctacgaattcttggcagtgtatgcttctctttgtgaaatcgagggtgtttgccctgagtgtcagccaatagtagccggcacgcaccactttggttgcaagggagtgtcccttcgatatgaaggccgcagatcccttcatgaagttctccataatctccttggtgtctatggtgggagtttggagtgtcctatggatgatggtcttaagatgctcggtctatttggtgctggccagcttagagagcaggtttgctctggtgttactttccttaggatctttgatgatgatgcctgccctgctttccttcatgttggatgcgtcatccacgtaaaggttccaccagtttggggtgttctacgtaccatgctaccatcctccttgcagttcaagattttgcaaaacctgtttgacggggtagttcgtcttaaccaccacttggtgactttgaacgtatggtctgagacgtcaaacccagcacttcttagcatcatgaagtatgttgttggtgaagtagatgggaagttggtgcttcctttcctctggtgcgagggttga

SEQ ID NO: 82155 - DNA, 1224 bp, Glycine max
  Peptide Sequence Number=SeqID_198933
atgacgatgttggcgagccaggttgagtacctgacttctcagataaaattggctttgatgagcttgtctacttcctctctggccgttttacgttgttcttttcccatcttcttcttcttctgtaacactggtttggcctggggaaagatggcctctaacaacaatgtcgtcatgtggatctacactgaatacattattcaggctttcttggtagatggtcaggagaatatggtgccactttcaggctttcagcgtagcattgtcgtgcttgcttttgattcgccttatagtcactatctctcctatcaaggtggggaacttcatcttaagatacaatgtggagacgaaggcttctcgctcgttgacatagcctcttgtctttactctttctcctacaaagccaaggaatggaccgaagaccttggacaccataaagttggcgattacgatggagacaaccatggggtcgacacagttgatgtcgaagtcccagatggcgtggaggtggcatttacaggactgactggactaccctccataggaaaatccacccacaatgttgacgctcgcatctttgtcggtggtgcctttgtctcccttgatcttctactttatcccttcctctatcggcattgtgattcctatgttgatcctcttggtgtgctccgagtctcgctcctgctggaattgaagtgttcgacatgggtgtcaaagctatcaatggaacttagagggagtcctctgtaccaggtgaggaatgcatccagatgttcatccagattagtggttccatcaaatcgctttaggttgagtggtttccaaacctatgggtgtcgacgagtggtctgcccttctgggcattttgtgggtagagtgctcatctttctgaacgtcaaacacaagcctccagatggtcgtgtatttgtcatggttgcttggggaggattggagccttcgaaaggggtctcgcgtctgaggccagacaacttgctaaccatggatgaaaagagaggctatgggtggcctttgttaggaggacaagaggaaggacctgtaaaacaaaggtctttgatgctcaagggttgttacggtggtataattgaatacctgacacaagataaggaggctacatcatattcaaatgatgaagtggttagagataacctatcaattgagagcccgactgctaagggcatgacgctcatgcctttttgccagggctga

SEQ ID NO: 82156 - DNA, 624 bp, Glycine max
  Peptide Sequence Number=SeqID_198934
atgtgcatcaactacaccgatcttaataaggcgtgtcccaaggatgcatacccttggcttagcatcggcaggctagtcaatggagcgtatgggttccatgtactaagattcctggatgtttatttaggatacaatcagattcggatgtatgccttagatgaagagaaaatgacattcattactgaagatgtcaacttctgctacaaggtcatgtcctttggcctaaaaaatgcaagtgccacataccaaagactgatggaccagatcttcaaacaccaaatcagacgaaatgttgaggtctacatggatgacatggtcatcgaatcccataccatagctcaacacgtggcagacctagaagaggtatttggagaaatccataagtacgacatgcgcctcaaccctgaaagatgcacctttggggttggcagaggcaagttcttgggctacacgataacacatcagggaatagaagccaacctcgacaaatgcacaaccatactgaagatgcacagtcctaccaacatccaggaagtccaaaagttgaatagtagactagcatccttgtctaggttcctctccaagcacgctgaaaaagtgaagtcattctacaagttgctctag

SEQ ID NO: 82157 - DNA, 360 bp, Glycine max
  Peptide Sequence Number=SeqID_198935
atgttgattagttggaagttttatctctttactaaagcacgttcccattttagcgaagaaaacactaagactatttctagtctcacaagttatcaagaactacgtaggtctgagttcctcattggaggatacgtaggagcaaaagcctcgcttttgtcgaccacaccgctttttgttaccatgacccaagagctggtagcccgcggagacaccttacggttatccgcacctcgtcattcagtgaccccaagtgtgattgatgagcagaggccaatgtggtcatctgcgccctttccggagatgtcagcatcttccggtggagactttttcaagtctcacaagttatctagaactacgtag

SEQ ID NO: 82158 - DNA, 285 bp, Glycine max
  Peptide Sequence Number=SeqID_198936
atggttacttccttacttcaacttgactcaatgaaccttttcgtaaaagcacaagcttggttcaaccccataacccagggaatgacaattttgatcgccaatacttcaacaacatttcatggggatgaaagactcgggaatacgcatgctatgcatgcaaaatgtaattatgagattgagatgccctgtcgcaacctacccttcggcgggagggcgacgcgagactcgcgggatgcgtgttccacgaaaggaatacgcgcggagtcgccaccaacgtttatttga

SEQ ID NO: 82159 - DNA, 183 bp, Glycine max
  Peptide Sequence Number=SeqID_198937
atggatggcattgaagagctagatcatagccggtatcaggcaactcaaaggccaacccaagatcagatgaataagatcgcttcctctacttggagggctgggagcggacatgggctaatccctgggtctgggtgttgctctatcagtctcggccaacgcgtaaagccagttaatgattcatga

SEQ ID NO: 82160 - DNA, 591 bp, Glycine max
  Peptide Sequence Number=SeqID_198938
cgtgactcaaaagtcagtatgacagatcttgtgagcgcggaagatgacggcgcagaagacgacgttagtctctgcgtgctatcaagcttttcgtcttacagaaagcaaaaagtttatacggataaccactcgggtatttccgcccgtcaacgtgactcaaaagtcagtatgacagatcttgtgagcgcggaagatgacggcgcagaagatgacgttagtctctgcgtgctatcaggcttttcgtcttacagacagcaaaaagtttatacggataaccactcgggtatttccgcccgtcagcgtgactcaaaagtcagtatgacagatcttgtgagcgcggaagatgaccaaaaagtttatacggataaccactcgggtatttccgctagtcagcgtgactcaaaagtcaatatgacagatcttgtgagcgcggaagatgacttcgcagaagacaacgttagtctctgcgtgttatcaggcttttcgtcttacagaatgcaaaaagtttatacggataaccactcgggtatttctgcccgtcaacgtgactcaaaagtcaatatgacagatcttgtgagcgcggaagatgac

SEQ ID NO: 82161 - DNA, 771 bp, Glycine max
  Peptide Sequence Number=SeqID_198939
gaggagaacatggaattgaagaggcggaagaataattcagatgattatgcatggaatgactacctttcactgccatttacacaaaatgttatcagcgaaagtcttagaatggcaaatattgtcaatgccatttggagaaaagcagtcaaagatgtagatattaaagggtacctaattcctaaggactggtgtgttgtggcatctcttacttctgttcatatggatggcatgaattatgaaaacccttttgaatttaatccagggagatgggagaatattgggactgggactaataacaattgctttacaccatttggtggtggacagagactatgccctggcatagaactctcaaggctagagctctctattttccttcatcatcttgttacaacttacagggttggtggaagacaagaggtgaatctggtggttaattgggcaaggtgggggaagggtggtcggggtttggaagagggagacaaatatggtgaggagggtctcgatgacgggaagaaggtgttcggaatggtggatcgggttaaaggtcaggtgtgggtagtaaggtcaagtggaaaagggccgagagggcatgggtttagtaaagctcatggtaagagtggaatagtccatggtaattggcctaagggttttcagtcgttacacgcccaaaacaatgagggtgccactaatggagccgttgcataccatgacccgcaagggaggggtcacaaggaagaaagacctaagaacttggcaacatgggtctga

SEQ ID NO: 82162 - DNA, 774 bp, Glycine max
  Peptide Sequence Number=SeqID_198940
atggaaacaacctcgttttccaaattgttcttcttcttttcctttttggttttgtgttctcatgttgctcgtgcttctgttacctacgacagaaaggcccttctcatcaatggacagaggagaatcctcttctccggctccatacattaccccagaagcacccctgatatgtgggaggatctgattctgaaggccaaagaaggagggattgatgtggttgaaacctacgtcttctggaacgttcatgagccttctcctggcaattacaatttcgaagggaggtatgatctggtgagattcgtgaagacaatacagaaagcagggctctatgctcatctccgcattggaccttatgtctgtgcagaatggaatttcggtggatttcctgtttggcttaagtatgttccggggataagctttagaacagacaatgaacctttcaagagggcgatgcaagggttcactgagaagattgtgggaatgatgaagagtgagcggctatttgagtctcagggtggccccatcatactctctcagattgagaatgaatatggggcacagagtaagttgcaaggagctgctggtcaaaactatgtgaattgggctgcaaaaatggctgtggaaatgggaactggggtcccttgggtgatgtgcaaggaagacgacgcaccagatccagtgataaacacctgcaatggcttctattgtgataaatttactccaaatagaccctataagcctatgatttggacagaggcttggagtggctggtaa

SEQ ID NO: 82163 - DNA, 1202 bp, Glycine max
  Peptide Sequence Number=SeqID_198941
atgtatcatggaggaactaattttggacgaacagctggaggccctttcatcgctaccagctatgactatgatgctccactggatgaatatggtttgattaggcaaccaaaatatggtcatcttaaagagcttcatagggctatcaagatgtgtgagcgagctttggtttcaactgacccaattgttacttcattaggggaattccagcaggctcatgtatacactacggaatctggagattgtgctgcttttctctccaactatgactcaaaatcctctgctagagtgatgttcaacaatatgcactatagcttgcctccttggtcagtcagcatcctcccagactgcagaaatgttgtcttcaacacagcaaaagttggagtgcaaacatctcagatgcaaatgttgccaacaaatactcagttgttctcatgggaaagttttgatgaagatatttattctgtggatgaaagctcagcaattactgctcctggtctcctggaacagataaatgtaacaaaggatgcaagtgattatctttggtatataactagcgttgatataggttcgtctgaatcctttctacgtggaggtgaactccccactctcattgttcagtctacaggccatgctgtgcatgtattcatcaatggtcaactttctggttctgcctttggaacaagggagtataggagattcacatatactggcaaggtaaaccttcttgctggaataaacagaatcgctctgctcagtgtagccattggacttcctaacgtgggagaacactttgagtcatggagcacaggaatccttggtccagttgcactccatggacttgacaagggaaaatgggacttgtcagggcagaaatggacttatcaggttggattgaaaggagaagccatggatcttgcctctccaaatggtatctctagtgttgcgtggatgcagtcagcaatagttgttcaaagaaatcaaccattgacatggcacaagacttattttgatgctcccgaaggagatgaaccattggcattggatatggagggtatgggcaaaggtcaaatatggatcaatggacagagtattggaagatactggactgcttttgctactggtaattgcaatgactgtaactatgctggctcatttagacctccaaagtgccaacttggttgtggtcaaccaaaccagagatg

SEQ ID NO: 82164 - DNA, 333 bp, Glycine max
  Peptide Sequence Number=SeqID_198942
atggagaaaaatcctaaagaaaagtgtaaagctgtgatgactagaagcagaatggcgattcaagctgaggaaggaagagctaatcagaaggtggagggatttaaacaacaactagctaatcggctagcactagaaccagttgatgatttagttgaacttgaagaaattgttgaggaagcagaaggtgatgaagaagaagagacaccaataaaagaatgtcaagagagaataaagaagaaggaagaagaagaaaaagaaaaagaaataaaagaagaaaaagaaaaagaaaaagaaaaagaaataaaagaagaagaagaaaaagaaaaaaattga

SEQ ID NO: 82165 - DNA, 108 bp, Glycine max
  Peptide Sequence Number=SeqID_198943
atggtcacttggaacatgctcgggtgcaccccaagtttctgcattctaatgcaacttcccataaatgggcttttggaggtgtggtttctttggctctcttgtatttga

SEQ ID NO: 82166 - DNA, 228 bp, Glycine max
  Peptide Sequence Number=SeqID_198944
gtggcctggccaggagaccagccttcttcctctggaaggggtggggcctccacagcccaggagcctgtgactgaggagcccacaacaccagcagcagcagaggaggagagcatttcagctcagacccctcaaccatctccaccatctgcacctactcctgaggagactcagccatcatcagcattggatcttaatgaagaccagccacaggaggagcaggacgtttaa

SEQ ID NO: 82167 - DNA, 219 bp, Glycine max
  Peptide Sequence Number=SeqID_198945
atgggtgccaaatacctcgaagtggtcaaacgagggtcgcatccaaacaacggatggtccccggatgaaatttggacacgatcgcctctggatggcgaaaaggtgggcggaatgaccataatttgtctccgcccacctctcggctttctgtccccgaatgacaaagggcgcaaaatctgtctctgcgcgtttatcactcgacttgagaaatctaaatga

SEQ ID NO: 82168 - DNA, 273 bp, Glycine max
  Peptide Sequence Number=SeqID_198946
atgaagagacagattctgcgccctttatcattcaggagcagtgaggcgggtgataaatgcgcagagacagattttgcgccctttgtcattcagattttgcgcccttctggaggaagcaacctacctcgcccaggcgagctgggtggcaagcttctcccctattttcctataaatagggggagaagtgaagggaaaaaaggttcagccctcctgattttcaaccgttcttcgacgttcttcgttcgctcgtcgtcattcttcagtcttcaaccg

SEQ ID NO: 82169 - DNA, 395 bp, Glycine max
  Peptide Sequence Number=SeqID_198947
atgagaggccctctcaaagagtcgacctcttcctttcttgtaaagtcctttggtacttgtacctattggttcacctccagaggactacatgtcctcgccttgagagggctacacgccctaagcttggaggactacacgtcctcgccttgagaggactacacgtcctcaccatcagagggctgcacgccctcacctgcagaggactacatgtcctcgccttgagagggctacacgccctcaccttgggtactagttaccctcaccgtcagaggactacacgtcctcgccttgaaaggactacacgtcctcaccatcagagggctgcacgccctcacctccagaggactacatgtcctcgccttgagagggctacacgccctcaccttgggtattag

SEQ ID NO: 82170 - DNA, 621 bp, Glycine max
  Peptide Sequence Number=SeqID_198948
atggtgcatctagctctaacagaactagtgtcttttgagcaagcaatcattgaacctgaaagcaaagcagcaatggaggaagaattaagggctatggaagaaccacacatgggagcaggtcatattgatattaccttacaacaaagggtctattggagtgaaatgggtctacagagtgaagtgacactgactggacaagaaaacaaggtgtcaattaaagaaggctttacctattgggtttcaacaagtgtagagcagaatatggagtatcagagctactgcaggtgtacaacagacatattgaaaagatttcacatgttggattgcaattctactcaaacaccattgtggtacaaagttggagaaggaaggaagggacaaattgctaagaggatactaagatatgtgaaaggatttttggactatgggttctcaaaccatggcaaaaatgtttctgatgaaatatttggttactatgactcggtggtgataaaactgacagcttgtacagcaagatatgtgtttaagatgtgtcgagcatttatttcatggtgttcaaaggagtcagtggtggcactgttctcatgtgagacctcaatgagagcttgtcaagccttgtaa

SEQ ID NO: 82171 - DNA, 1041 bp, Glycine max
  Peptide Sequence Number=SeqID_198949
atgaggtttatatatattcctaaccttttctattatgctgacatcaattctcattataataccgtaatctgtctcaagcaactatccaaaacactagcatgcaaaccacctccaaatgattttgatgatataggatcacatggaaccaaagttgtaatatacaatttgtggttgaatgatgaagggatatatgaattgagttttgatgatgatgctgagttagttacacaagtttcaggattcaacggtgaatcggtgaggatcttagcaactcatggatattatgctgagagatgggccacccatggagctgagaaaaatttgtgcaaaaaaactgttcagcttcagtcacatatttcttaccgccttcgtttttctttacgggcatatgtttcgatgttgtaccttagaaaattttctaacttctctatcatactaagggggaaacttgtggatcaatttaacattgtggacgatttaatatattcaaaagtaattccatataagcctcagctagccatggcatcaaatgaggctatagtggagacaaagacaaccattggatttataaaggaggctgcagaaattaaggttactggatttaatgtgtaccacaaaaatcgcctaatcaagcccttttggaaagtagttgctgatggttcatcaaaagggcgttgtgttgttggggttcttgaagccaattttatagaaccagcgcatgacaagcaggattttgagagatcagtgctgttcattcggttggaaaacaaactgaaacaaatgacaatggattactggagagaacactgtcacttggttggatatcagccaccaaatttgaaatcacaaaaaaatgtggtaaaagaagcccacattcgaaaatcagctgaacattcaactaatccacagaatcagttgcttgctgatcaacaggatactagcttggtagctgagcatcaaagtggtctgagtcagtcagttgtgggtcttgcagtgactggcatgcaaggtttgcgtcatgagcaccttgtaagtagttga

SEQ ID NO: 82172 - DNA, 987 bp, Glycine max
  Peptide Sequence Number=SeqID_198950
atggcggggttattctcattaggaggaggaggaggaggagggcgaggaaacaacaacaacaaccaaagcagcgagattccaccagcggagaccctattctggtacagcagcaaaaacgacgacgtttcgtccttccaccgagggtttgagctatggaaccagcaggaccagcaccaccatcaccatcatcacgtgatgcatccacatgcgcgtcctctcctgcagcgagatctttactcgtcaggagtggggcccagccgcggcggcggcggcgtctccgatgatgatcactcgtcgtcgagatcggctgcgttggtggcgatgcgcgcagccgcggccgcggagggaggaataagctgccaggactgcggcaaccaggccaagaaagactgccctcacatgcggtgcaggacgtgctgcaagagccgcgggtacgactgccaaacccatgtgaaaagcacatgggttccggcttctaaacgccgcgagcgtcagcaagcactcgccgcgttacagcagcaacagcaagaacaacaacaacagcaacagagagatatttccaagaggccgagagacccgacctcttgcactcgtttaccctcgtcagggttagaggaagaagggaattttccttctgtggtgagttctccagctgaattcagatgcgtgagggttagctgcgtggaagatgctgatgatagatacgcataccaaaccgctgtgagcataggaggacatgtgttcaaaggaatcctctatgactatggtcctgaaaataataaccacaacaacagtaataataatagtaataataattacacggctggagaaacctctgctagtgttgttgctgcagctcagcccttgaaccttgctgctatttcttcagctgcacttgttgatacttcctctttgtattcggctccggttaacgcattcatggctggtggtagtggtacgcaattcttccctcacacaagatcttga

SEQ ID NO: 82173 - DNA, 177 bp, Glycine max
  Peptide Sequence Number=SeqID_198951
atggtggttttatcagctgagctcaactcaacaaggagggaacttggttgggttgatgaattccagcaattgtcaggtgatttagattgggtgccggggaagaagggcttagggctaaaaaaggaccaggaccaggaccagtggcatagtttattgttcgtggcagttaaggactag

SEQ ID NO: 82174 - DNA, 543 bp, Glycine max
  Peptide Sequence Number=SeqID_198952
atgggcctctatcaatcctacagggtgcccgtaccccccccccctgcatggtcatgccatcgcgacataggtaaggatcgcgcccgcaggacacccagtggaaccaaagaagtccaacagggtcctggggtttccagctctgattacgggcctctatcagttctacgtagtgcctgtcaccccagcaaggtcatcaggcctcctactaaccgagctttcatcaagaagtattgcgcccccatgcaggcagagggcgagacaccacaacagcctggggatggccagcaacaggcaacaaatgcaccgccaccacctccagagcccctcagctcatccataaaaaggtataaagataccttggatatgcatagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 82175 - DNA, 242 bp, Glycine max
  Peptide Sequence Number=SeqID_198953
atggaatcttattgccagcagatgaaaccgaacatcgaccacgacactgaaccaacaaagtactttctttgtgaaaaagtgggtgtagtagaaggggaagaaactgcttcttttataatttgtgatgacctttccgtgttgcccaatgttcttgtaacaagtgtaaatctgctccagaagcttggaattaaagacatgaatgctcttgaggaacaaactgttgatatccgcaagagggagag

SEQ ID NO: 82176 - DNA, 215 bp, Glycine max
  Peptide Sequence Number=SeqID_198954
gtggccttgttggtgcttgtgcgcttagcgcaactctggctcgcttagcatgcataactcatccttcttccaaattcttcctcgcgctcagccgcaagagtggtgcgctcagtggatggctcgctaagccggcagattggcttagcgagaagctaaaaatcagcacttcacaaacttgcctaattaacctgaaatataaaggaaatgattattaa

SEQ ID NO: 82177 - DNA, 288 bp, Glycine max
  Peptide Sequence Number=SeqID_198955
tatggacaaggagtccatatcgccataagacaccttgaatcaatgataaggatgtctgaagctcatgcaagaatgcatctcaaacaacatagctttagaaagtatgtgactttcaagaagaactataatgattttctcctttatattctctgtgagcttgtacagaatgcttttctttcagaagaaattgtcactggatttgcttcgggtctaacatacctagatgtcgaagtagataatctctgcaacaagttaatttctgacaattttaaaacggttaggaaataa

SEQ ID NO: 82178 - DNA, 531 bp, Glycine max
  Peptide Sequence Number=SeqID_198956
atgaaattctcagccatccaggaaaacaataaaagaaaggatcatgaaatttctctctcacttcaagacattgcgaccaccagcggtgaaggaccatcgagaattaatgagatctttaacaaacaaattcgccaaagtgctccatctcctccacacactactgatcatgatgatagtttaagcgagagtgaattgggtttatcactaaggttgcaaccaagcacaagtcatcataaagaaagtgatgtgggaaataacaataaggaagacaaaaatgatcaacaattggcaagttttgcatcagtgcagaacaaactacagcggacacatgagttgcctggtattactacccatgctgctttccctcctaacagaaaggctagggtttcggttagagcaagatgtgaagctgccacaatgaatgatgggtgccaatggagaaaatatgggcagaaaattgcaaaaggaaatccatgtccacgagcctattatcgttgcactgtagccccaggctgccctgttaggaaacag

SEQ ID NO: 82179 - DNA, 840 bp, Glycine max
  Peptide Sequence Number=SeqID_198957
atggcactgaatctagatgatatcatgcgcatcgctcacctcgcccgtatcgaggcagttgataccacaggtattgaaccgatgtcgcactcacaagatgtgacacagcgtctgcgtgaagacgtggtcaccgccaccaaccagcgtgagctatttcaatccattgctccggcaacacaggatgataccctagccatgatcaacagcagtcttaaacagctaggccaacagttggccagcaagcaagtttccagcgtcgagctgacgcaagcctatttgcagcgcatggcgcagctcaatcctagcatcaatgcctacgtcaccatagacgaagccaaaacattggcacaggccaaagccgcggatgcgcgtatcgcagccggtgatttcggtccattgaccgggatcccgctggcacagaaagatattttctgtgccaagggttggcgcacgacatgtagctcgaaaatgctggagacatttatttctccgtacgatgcgcatgtgatcagccagtttgatgctgccggtgcggtcaatctgggcaagaccaacatggacgaatttgccatgggctcgtctaacgaaaccagttacttcggtggcgtgaaaaacccatgggatgttgaccgtgtaccaggcggtagttccggtggttcggcagccgcagtcgctgcgcgcttatgtgcggcagcgacggggaccgataccggcggatcaattcgtcaggcccgcttccttgtgtggctttaccggtttgaagccgacgtatggcctggagtcgtgttacggcatgattgcctttgcctccagcctggaccaggccggcccaatggctaa

SEQ ID NO: 82180 - DNA, 252 bp, Glycine max
  Peptide Sequence Number=SeqID_198958
atgggccccgacgggtgtagagaaacgcgaagaactggaactggagaggcggcacacaaaccgagccaggactttagcatccaaaaagctccaaattcctcttcatttccataccaagttgcaaggaaaagctatttttggagcctaggagcctacctctacctcgtgggaccttcaatttcagaaagaaaactggtagagaggatggggagagttagcttggagttaaatgtgagaatggtagtgttgtag

SEQ ID NO: 82181 - DNA, 483 bp, Glycine max
  Peptide Sequence Number=SeqID_198959
atgtataaaaccttgcctcaaaacagatttttgcaagatgaaaatttccgatgcctcctaaggtgtctagttcctccggcagaggaggaagatccagtacaaaagaccgtggctgactatgcctggtcaatacaaactctcttggccttagaagatataggcctcaccaaaataccaaaattagccaaaaagacctgggcagaaatggcctcagaatcagacgatgattctgaaacagatctgcaaaaacaaatccaaaaagccaaacagaccaaaacggtctgtaaccaaaaaccaagccaatcgttgactcaacaagaatcaacaccgcaacccggtaacagttacatttcaaaaaacaaatttttcaatgttttacaagatggaaccagaatactgggacaagaatcctttcaaagcaaccgccaaagtattttccccgggattccattacaggccaatagccacaaacaaaacccgtaa

SEQ ID NO: 82182 - DNA, 310 bp, Glycine max
  Peptide Sequence Number=SeqID_198960
ggatgcacataaggtagttgaagaaaatcagaagaagattaataatgctcaaaaagctttgcaaattctgaagactacttgtgtagtttggcctaataaggcttcagaagttcttttaactggatcatttgatggttggtccaccaagagaaagatggagaggttaagtctcggtgtatttcttttgaacttgcagctgtatcctggaagatatgagttcattgtagatggagaatggaaaattgatccattgcgccctgttgttaccagcaatggctatgagaataatcttctcatcgttcatgattga

SEQ ID NO: 82183 - DNA, 282 bp, Glycine max
  Peptide Sequence Number=SeqID_198961
atggcttttcgcttacctggttttagacgttcatcattcagtgcaagccaagcatcttctttcaaggatgaggaagtcccaaaagggtatcttgccgtgtatgttggagaaaaaatgaagaggttcttgattccagtatcatttttgaacgagcttttatttcaagaattgctaagaaaggctgaagaagaatttggttactatcatcctatgggtggtctcacgattcccttcatggaggatgtgttcttagatacagcttctcacttgaaacgattataa

SEQ ID NO: 82184 - DNA, 326 bp, Glycine max
  Peptide Sequence Number=SeqID_198962
ttgatgggcatgtttacacctggggaagaggcttcaagggctttgaagatgctcgtgttcctcagtgcttaaactcttcattgaattttaccaaagttgctctggggtggaaccatgctttagctatgagtggtgagggggaggtttgtatgctaggtggaaatcaccttggagtgcttagtgatcttcagaacataagcccagctaagcatttacctcatttaagagaagtcaatttggagaaagtccctggtcttgatgggacgaaaattactgatattgctactggagctgagcattctgtcattgtcacaggcaagatgtag

SEQ ID NO: 82185 - DNA, 688 bp, Glycine max
  Peptide Sequence Number=SeqID_198963
atggaagaaccaaaaaaaacagagaacgaagatgacaaggatgaatcagaacaacgagtgtggagttggggtgctggaaccgagggtcagttaggaacaaaaattcttcaggatgagcactttccacaactccttcatcaaccctctctctcctccatctcttcccttgcctgtggcggcgctcatgtcattgccttgacctctgctgggaaggtactatcatggggtaggggcaattctggccaactaggccatgggttggttgtgagtaactctttgtatcccaaggctgtgacatcattggatggctacttcataacccatgtctctgctgggtggggccactctggttttgtttcagataatgggtgtgtgttcacttgtggggatggctcctttggtcaactggggcatggggatcatgcctcacactgttctcctgtcaaagtgtcatgctttgttgatcagcatgttgagcaggtggcatgtggcatgcgccattcccttgtcttgttaaaagattgtacaggaaatcaagtttatggatttggctctgggaagcgtggtcaactgggtgtcagcaacgatagggtcaaatctgttaatgttcctaaagttgttagtgggtttgaaggtgttgaaatcgctggaattgctgctaatggtgaccatagtgctgcagtatctg

SEQ ID NO: 82186 - DNA, 183 bp, Glycine max
  Peptide Sequence Number=SeqID_198964
atgttgatggatctaagcggcattggggcagtatccctcaatgtccccacgaaatatttacatttgatggcgtcacttcccccactgatgagcatttggatccgaaaagcttttagatggttccactatgggctcctgaaaatgaacgggaaccatatgatcgaccctcataatgtcaactga

SEQ ID NO: 82187 - DNA, 133 bp, Glycine max
  Peptide Sequence Number=SeqID_198965
atgggtttcagtttgcgtggtgttcaaagacgtgtggatgtcccaaagggctgtgtagcagtgtatcaagaatttggatttgatcatccaatgggtggcctcacgattccttgcagagaagatgtgttcctag

SEQ ID NO: 82188 - DNA, 639 bp, Glycine max
  Peptide Sequence Number=SeqID_198966
atggtgtcaaaggcaactgaaaaagaagaagaccttataaaggatatcctggataattatggaagagcctttgggaagcaaggttcgagacttctcactaaccaagatattatagtttttaaggtcttcaaagtaaaatactttacacatgggagttttctagatgccgaattgggaggcaatttgagttttgtttgccataatatttatgcttcacaagtaattttgagacaaggaataaagcggaaacttggtgacaatagagaaatcaacatttggaagaatccatggctcaattcaagctctaacccttacatccaatttatccctcaagaaggtaatgagcatttggttgttgccaatatcattgaccatgacatgcagtgttggaatataaacgtcttgccatatttcttctcaaatgaagacattcaagcaattgaatcagttcctctcttgaatttgcatgacagtgaccaattaagttggaagtttactcctaggggttcgtattcagtggtgacaacataccactatgtagtgaaagatattttgaacactacccatctaaaagttgatggcaattggaaggcaatttggaacttaaaggtacctccaaaactgaagcacatgctttga

SEQ ID NO: 82189 - DNA, 300 bp, Glycine max
  Peptide Sequence Number=SeqID_198967
atgggtattcgtctgccaatattcatggctcttcatgctaacaagatattcaagtggcagcagcatctccatagtagaaaccactcgaatgttccaaagggtcacatagtagtgtatgttggagaggctcaaaagaagaggtttgtggttccaatatcttacttgaaccatccttcgtttgttgacttgctaaaccgagtcgtggaagaatttggctacaatcatccaatgggcggtctcactatcccttgcaaagaagaggcattcatcactctcacctctcaactacgtgcctcctga

SEQ ID NO: 82190 - DNA, 879 bp, Glycine max
  Peptide Sequence Number=SeqID_198968
atggagttgggtgctggagttgaactcgctactgctgcagtgccgcatctctttcttccactggcttgtgctgctaatgtactcaagaatgttgctgccgtaacatcaacctcaactcgcacaccaatttataaagcctttgctaaaggagaaaacataggggatgtcactgctaaaggagaatgtgttggcaatattgcagacctgttaggaactggtttgagcatattgattgccaaaaggaatccatcgcttgtcaccacattttccctcctttcatgtggatatatccttagctcttatagagaggtaaaatctgtggttttgcacacacttaactgtggaagattcagtgtggcagtagagcattttctcatgacaggacaagttcctactttgcaggagggcaatatgaatgagaacatattcagttttccatggaaagataggcctgttgtccttggatcaagaatcaaggaagcattccaagaccctagtgcatatgttgccatagagcccttgtttgatagggagagatatattgtaacatataacccctcaaaacacaaggtttatgcggtgctcaaggatcaggcaaagtcagatgacattctgaaagcagcattccatgctcatgtgctatttttcagtttgatgaaatcattgaatgaaaataaggcctcatctttgaagcaaagggaggatctctcaaacatgacacacacagttgctgatatcgaggctcgtatagctggtacttgcaagaccgtggcagattcttatgggtgtttcaagaataaagctaaggagcaattgtgctcaggctccagagcacttggcttgttgcatgatgccctgctatgggtgaccataccttga

SEQ ID NO: 82191 - DNA, 510 bp, Glycine max
  Peptide Sequence Number=SeqID_198969
atgcgagaagtccccaggaaagcagaggtttattactacaataaaaagatgggcattagaaaagcagaaggagaacgtagaggtacttcattcccctggaagatgacagacacatatcgagattggcacgaaagggttcactctaacttttggggtatcgaaattcggacttacaccggcaatactccctgggttatgggattccattgcctggaatgggagaacaggaggaggaggaggaggaggaaattggggtggaaaccgaagggaaggatgtttgtccatttcccaatctcaagcacttggttgttggctgtttacaaccactatagcagaatccgcctcaaccaacatttgccattgccgatgcaacaacattcacacaggcaggatatgtccactcaatattatataaccttcttttgtttgaacaaaccttcaaccctcactacgggtgaaatgaaagatgaaaattcaatcttatttctggaggattatgacatgcattaa

SEQ ID NO: 82192 - DNA, 219 bp, Glycine max
  Peptide Sequence Number=SeqID_198970
atggacaaacatccttcccttcggtttccaccccaatttcctcctcctcctcctcctcctgttctcccattcctatttctaacgccacacccacaagcaatggaatcccataacccagggagtattgccggtgtaagtccgaatttcgataccccaaaagttagagtgaaccctttcgtgccaatctcgatatgtgtctgtcatcttccaggggaatga

SEQ ID NO: 82193 - DNA, 693 bp, Glycine max
  Peptide Sequence Number=SeqID_198971
atggccaatctagctttgactagcatactagaaaagatgactgggaaggacaaagattacagatatatggccacatctgatttgctcaatgagttgagcaaagcaacgtttaaggccgatgctgatctggaggtcaaattgacaaacatcatcatacaacaacttgatgatgcagctggtgatgtttctggacttgctgtcaaatgtcttgctccgttagtgaggaaggtgagtgaggtaagggttgtggaaatgaccagtaaactatgtgacaaattgctaaatgggaaggatcagcatcgcgacattgctagcatagctttgaagacagttgttgcagaagtttctactcagtctcttgcacaatctattctccagactctcacgccgcaattgataagaggaattactggtcctggaatgggttccgagattaaatgtgaatctctggatattttatgtgatgtccttcataaatttgggaatctaatggcagcggatcatgaactattattaagttccttgctttctcagttgagttctaatcaagctagtgtgcgcaagaagactgtggcatgcattgttttgagtgttgtcattttttccttcttcaccttggttgaatcctattgtagtaaatttgttcagaacaaaatcttacttgatttttactgtggtttttctatattctga

SEQ ID NO: 82194 - DNA, 267 bp, Glycine max
  Peptide Sequence Number=SeqID_198972
atgtcaattatacctaatgcatatgcattttatgttacgcgaagagtaaggacaagccatcctactttggcgtcgcttattgttggtgcagtgggcaccgttgtcgtaaacttgaatcctaatacacctgtcttgcctgttgaattaaagagtagatgtagggtttggaatgatgagcatggcatgcggcgtagcagcgaggcagagagagcagtaatccaagtaaagcgacgtcgtgaaggcaaggaagggaaattgggaatttga

SEQ ID NO: 82195 - DNA, 695 bp, Glycine max
  Peptide Sequence Number=SeqID_198973
catctctctcttcaagcctgtcagatgatttgttggcaaaggcaactgttgaagttgttactaacttgaaaaataaagttgccaagtccgaaatgatccgtacaaatatacagatgatcggtgctttgagtcgagctgttggctaccgatttgggccccatcttggagacactgttccagtgctaattaattattgtactaatgcctcagaaaatgatgaagagcttcgtgagtacagcttgcaggcactggaaagctttctccttaggtgtccaagggatatttctgtttactgtgatgaaattcttcatttgacactagaatatctaagttatgatccaaatttcactgacaacatggaggaggatactgatgacgaaggtcttgaagaggaggaggatgatgagagtgcaaatgaatatacagatgatgaagatgtaagctggaaagttcggagagcagcagctaaatgtttagcagcattgattgtttctcgtcctgagatcttgtcaaagctgtatgatgaggcttgtccaaaactaatagacagattcaaagagagggaagaaaatgtcaagatggatgtatttaatactttcattgagctcttgcgtcaaactggaaatgtcacaaaagggcagacagatgcagatatgaggcaacatatttcaaacttaagatgcacaatcaaataa

SEQ ID NO: 82196 - DNA, 915 bp, Glycine max
  Peptide Sequence Number=SeqID_198974
atgcaagggcaaggcgttgatgaagtgaacattgaagagttggcctcgaatctttccctctacaaagatcaactgaaccaggttaggcaactcttgaacgatgacccttcaaattctgaatatgctgacatggagagggaactttccgaggtcattgctttgactgaggaactccttgcaactgcaaagcagaatgaaatccctgctcctcctaacgctgctgctgcctctccaaccttgtccatacataatgacaatcaagtgctggatagcagctctgatcatcaagagaaacttcctgttggcaccaaagttcaggcagtttggagtgaagatggggagtggtatgatgcaacagttgaggcttatacaccaaatggttattatgtaagctatgacaattggggtaataaagaagaggttgatcctgccaatataaggtcaattcaagaaggttctgttgatgctttattagaagctgagcgagttgctgaagcaacaaaacaggccatcaaacgaaaaattgtgcaagctgcatctatcgatttacagtctcggagtctacctgcaaagcttcgtatagaggctgatgatcctgaggatgtggattatagatgtcattggaaagcttcgaaacgcaagaaaatacatgcctttaagtcaaagatgcggatggagcaacttgaagtcacacaaaataagcggcaaaatgcttggcagcaatttcagtcaaccaaaggaaaggcaaagaagattggtttcttctctggaagaaaacgggagagtatttttaaatctcctgatgatcctcagggaaaggttggtgtgacgggaagtgggaaaggtttgacagagttccagaagagagaaaaacattttcacctcaaagatggtactgttgaaaatgatgagtag

SEQ ID NO: 82197 - DNA, 2058 bp, Glycine max
  Peptide Sequence Number=SeqID_198975
atggatgaactttatcatgctctttctgcccctgttctgtcagctgttggtgagcgttattacaaggtcactgcagaggccttgagagtatgtggagaacttgtccgtgttgtgcggccaaacattgaggggtctggttttgatttcagaccatatgttcatcccatatataacggcattatgtcacgcttaataaaccaagatcaggatcaggaggttaaggagtgtgctatctcctgcatgggcctcattgtgtcaacatttggcgatcatcttaatgcagaattacctgcatgccttcctgtgcttgttgatcgaatgggaaatgagataacccgacttactgctgtcaaggcatttgctgtcattgctgcttctccacttcgggtggatctatcatgtgttctagagcatgtggtagcagagttgactgcattccttcgaaaagctaatcgtgctctaaggcaggctaccttgggaaccttaaattcacttatagttgcttatggtgataagattgttttgtctgcttatgaagttattatcgtagaactgtcgggactaattagtgattctgacttgcatatgacagctcttgccctggaactctgctgcacattaatgggtgacaagaggtcaaatcaaagtattggtttggccgttagaaacaaagttcttcctcaagctttaacattaattaaaagctcattgttgcaggggcaagcactttcggctttgcaaaacttttttgctgctttagtctattctgcaaatactagttttgattctctgctggagtcactacttgcctgtgctaagccttctccacagtctggtggcattgctaaacaagctctgcattcgatagctcagtgtgttgctgttctatgccttgctgctggtgatcagaagtgttcatctacagtgaaaatgctcactgacattctcaaggatgacagcagttctaactccgctaagcagcaccttgcacttttatgtttgggggagattggtagaaggaaggatctaagtacacatgcacacatagaaaatattgttattgaatctttccagtccccttttgaagagataaagtctgctgcctcatatgctcttggtaacattgctgttggtaatcttccaaaatacttgccatttatcttggatcagattgataatcagcagaagaaacaatatctcttgcttcattctttgaaagaggtaattgtgagacaatctgtagataaagcagagtttcaagagtccagtgtggagaaaatacttaatttactcttcaaccactgtgaaagtgaggaagagggagtgcgcaatgtagtggcggagtgtttgggcaaaattgctcttattgagcctgttaaactcatccctgcactcaaggtaagaagaaccagcccagctgcatttactcgagctactgttgtcattgctgtgaagtactccatagttgagcgtccagagaagatagatgagatcatataccctgaaatatcttcatttctgatgcttatcaaggataacgataggcatgttaggcgagctgctgttttggctataagcacatttgcacacaataagccgaatctcatcaaggggcttcttcctgatctgctgcctcttctatatgatcaaactattgttaagcaagagctcataaggacagttgatcttggtccttttaagcatattgtggatgatggacttgaattgaggaaggcggcttttgaatgtgtagacacattgctggatagttgccttgatcaagtgaacccgtcatcattcattgttccttatcttaaatctggtttggatgatcattatgatgttaaaatgccatgccacctgatactctccaaactagctgacaagtgtccttctgcagtcttggcagtgttagattcattggttgatcctctccagaagactattaattttaagccaaagcaagacgctgtcaagcaagaagtagatcgcaatgaagacatgattcgaagtgcactccgagctattgcatccttgaaccgcataaggcaacgttga

SEQ ID NO: 82198 - DNA, 183 bp, Glycine max
  Peptide Sequence Number=SeqID_198976
atgtttgtattcaatagtgctttgaaaggacttgacgatactcaacaaagtaaatccaagtctcctgctaggtggattgttgttaaatatttcactgatcctagaccattagaactagaaagattgaaggcgcttcgcaaccagtgggcaaagtactatttgaaagtgaaaaatgaaacttaa

SEQ ID NO: 82199 - DNA, 2226 bp, Glycine max
  Peptide Sequence Number=SeqID_198977
atgatagttagaactccaccgccacccaagaggccccgcgccgatggcgatggacagctggtcatctacgaggatccgccggagtcgtccccttcggagcacatgctttgcacatatcaatgtcgccaaatggtcaaatccgattttattgatgccttaagcaaagctgaaaatcaagctcgtcattatcaatctaaatttgagacattggagcctaatttccacaaacttgaatctgagaggaagaaatttcaggaccaattcttatatgctcaacaggaacttgcagctgcaaaaggccgcgaacaggctctccaagaccaactcttgatggaggtcacccagtctcaagaacgattaagaaaacaaattcaattaaacactcaactccaggttaagctccaaaatgagacagaccttcgcaaaaaagctgagtctcatgctgcttcagcagaggaaaaagcaacatctttcgaaggtaaactaggccatctctccgaaagtatagagagggaaaaaaagcgacttcgtgatgaccattcacaactgaaaagcgactcaaagttatctatttctagaatatccgcaaagcttgaacaaatggaatgcagagctaataatgctgagagagaagcagagctgctaaaagaacaactgaaacttcttaaggatcaacttgatgagtgtttgcatcagaagattgaagttgaaaaaaaactatctactttaatgtttcaagaagttgcttctacagagagtaatgttttagttaagcatttgcaacaggagcttcggaactatgaatctgtagtaagggaagccagaaaactaagatcaagtcatgagaacgttgagcttttgaaggagaaattattggaggaaaagagccacagggaaagggcagaatcagagctatccaaattacacgatatccagttaaacatgaaaaagttagaggatcaaatatcatcatggagagtgatgattacagacatacctggtgtctcatgttttgaggacctgcctgttaaatttgcagctttacagaagtaccaaaaagagatattgctagctgctttacatttgagtaggcacctattgtcttttgatcttgatatctactatcaatgcagagaagtcatttatagcacacagaaggagggtgagatcactgctcgcttgaagcaaatggaggtggctctggatgctgctgaaattggtaaacaaaatgctgaagccgaggctgcattggctaaagataaagcagaagtattaaaatcagaaattaaacgaattgaattaatgcttgctgttgtcactgaggaaaggaataaattaagaaatgtggccaatttgaagaatgatgaagctctggatgcatcgaaaaatgcaaatcctgttcaggagcctgaatcatctcttatgaagaaagatgattgcattaaagatttagaaagtaccttgcatgagcaaagaatggttaataatcgtcaattagatgaaatgaagttacttaatgaaaagttgcatggtgaagcaagaagagtgaagtcactggagagggagagtgaccggctccggtcagagatttcattattagaggcaaagttgggtcatggtgatttttccgctgctaatacaaaagttctgcggatggtgaatacacttactgtcgataatgaggccaaacaaaccatagaggcactgcaaactgagcttcaaaaaacgaaagagaaattaaaagctgttgaagaattgaagagtcaatcagatgtatgggttttcctgatcacttctaactctttaggcgaagctggaaagctggtagatagctacatatcggataagatgttgcaattaaaagagcaaatcgcaacacttgagaagcgagaagaaagatacaagactgtgtttgcagacagaatttcagtcttccggagggcatgctgtgagctttttggttacaagattgtgatggatgaacaccagcgttctaatggaatcccggtgacacgatttaccttgcaatccatttatgcacaaagtgatgacgaaaagcttgaatttgaatatgaatcagggaatactaacattttggcaaatcattatacatctcagcctgaggtttctcgtcaggttgagatattcattcggaagatgaattcaattcctgctttcactgccaacatgacagtggagtctttcaatagaagaaccttgtcttaa

SEQ ID NO: 82200 - DNA, 1101 bp, Glycine max
  Peptide Sequence Number=SeqID_198978
gtgcatcgtgtgcttgtggatcttgtttcttcttctgcaaatgcaacgcctggtcttggaaggtatcctccattcaagagagagattgtggcaattgcaagttcagccctagaggcatttaaaaatgaatccaaaaaaatggtggttgcactagttgatatggagcgtgcatttgttcctccccaacactttattcgtttagtgcagaggcgaatggaaaggcaacgccgagaagaagagctaaagaaccggccatccaaaaaggcacttgatgcagaacagtcaattctaaatagggcaactagtcctcaaacaagtcaacaaagtggggggaacttaaaatcgatgaaagagaaatccagtcagcaagacaaggatacacaagagggatctggcttgaagactgcagggcctgaaggggagataactgcagagtactcattcatttattttgaggaccgcaacagtttctatacctttctttctggacctgctgccttctgtttttacctctcacgatatttgttgaaaaaaagtggaaaaggtagtggttggagcagacgatggtttgttttaaatgagaagactggcaagcttggatacaccaaaaaacaagaagagagacatttccgaggagtaattacgttagagaatttgaagttgactggaataatgaccattgttaaacctttcagcacagaatgcaatattgacgagatttctgatgatgatgaagcctccacaaagagttccaaggataaaaagtcaaatggacctgattctggaaaagcatcaaaccttattttcaagattacaagcaaggtcccttacaagactgttatgaaagctcaaagtgcagttttgttaaaggctgagagtatggcagataaggttgagtggatcaacaagttaagaagtgttgcacaggctaaaggaggtcaagccattggtgaacctagttttcctatgcgacaaagcctttctgatggttctcttcatttgggcttcgggcctaacttaattccacaaaatcagcttgtaagaggagaaatgcccaagctatataaggatttcatttgttttcatttgtcatatctctag

SEQ ID NO: 82201 - DNA, 2622 bp, Glycine max
  Peptide Sequence Number=SeqID_198979
atggcttcaactctcaaatctggcggaattcatacaggggcaatcaatgatgatttatacaaggaattgtggcatgcatgtgctggtccccttgtcactctccctcgtgaaggggaacgagtctattactttccacaaggtcacatggaacagcttgaggcatctatgtatgagggattagagcagcagatgccttccttcaacctgccttctaaaatattatgtaaagtggtcaatgttcatcttcgagctgaacctgaaacagatgaagtatatgcacagataactttgcttcctgaagcagatgtgaccagccctgatgatcctctgcctgaatctccgagggtcaagatccattcattttgcaagacacttactgcttctgacacaagtacccatgggggtttctctgttcttcgaagacatgcagacgattgtctgcctccactggatatgtctcagcagccaccatggcaagaattggttgcaactgatttacatgggaatgaatggcattttaggcatatttttcgagtgattgtggctggtttgtggtgcatgctatattccaggggtgaaaatggagagctgcgagttggggttaggagggtcatgagacagcaaagcaatgtgccttcttctgttatatctagtcacagtatgcatcttggtgttctggccactgcatctcatgccattgccactggaacactgttttctgtgttttacaagcccagaacaagccggtcagagtttattgtgagtgtcaacaagtatctggaagttcagagtcataaactctctgttgggatgagattcaaaatgcgatttgagggtgatgaaattcccgaaagaaggttcagtggcacaattgtgggtgttggagataataaatcatcgtcggtctggcctgattctgagtggcgatcattaaaggtgcaatgggatgaaccatcctcaattttgcgtcctgacagagtttcatcatgggaattggagccacttgtgtctaccactcttgcaaactcgcagccaacccaaagaaacaagagggcacggcctctcattctaccttctacaatgcccgattcttctttgcaaggtgggtttgctgggttggttgtgcagaatttctttgtcattctgctgcccattctgtttttctacataatcatctttctttgtgcaccaggcatatggaaatcatcagttgaatctacctctttctcttattgtgacccccaacaaggacgtggcctctatccatcaccaaagttcaattcttctgcaactaactttattggttttagtgggaatagctctgtgggatctccttccaacaaatcaatatattggtctaataggatggaaaataacttggaatctatttcagctatagctcttaaagaagctggagagaagagacaaggcactggaaatggctgtagactctttgggattcagctacttgagaattctaatgcagaaggaaatctacaaacagtcactttgtcaggaagggtgggtgatgataggtcggttccatctttagatgctgagtctgatcaacattctgaaccatcaaatgccaaccgatctgatattccttcagttagttgcgatgctgaaaaatcatgcctgcagtctccccaggagtcacaaagcaagcaaataaggagctgtacaaaggttcacatgcaaggaatggctgttgggagggctgtggatttaacacgatttgatggatatgaggatcttctcaggaaattggaagatatgtttaacatcaagactgagctctgtgggtccctaaaaaaatggcaagttgtctacactgataatgaagatgatatgatgatggttggagacgatccgtgggatgagttctgtagtgttgtgaggaaaattttcatctacacagcagaggaggtgaagaagctttcaccgaaaataagacttccaatgaatgaaaaagttaacccaagcaagcaggattcagaagcaatatcgtatgaattccagttccagtatatcctagttgttatgaatgcaataaatgttggtgtggagagaggcgataatgaactaaagctaggctggctggctggcatgacgtcagcaagcaagaatcgacgcagaggggagtgtagtggtccttgctcattcggttttgagttggccgcaagcaccaacatactcagattcggcattcccgtggagcattgtttccacggagttgcagctgggagagcttccgagtggggtgaggttctggaacttcaaggaaatacgtgctttcgacacaatctcattcctctaccagagtcatcacctccgtcaccacgtgccaccccctctcgtagaggaagtggatttggtgtgtctacattcaatgagccaagagatcatgatattccttctcagaagcctttgacgatagtgacaaataagatggaagcgataatagtgaacatggcttgtggatggggaagcaagtctgtggcaaaagacatactctcctcttgctttggtgcttctgcttctctctatcaagcaccgctggctgcattcatgattctcaatctcactccagctgacaatagtgcttctctcactgtctga

SEQ ID NO: 82202 - DNA, 1779 bp, Glycine max
  Peptide Sequence Number=SeqID_198980
atggcagcggttagtgttagtgttactgtgagagtgaggtggtgcactcgaaaaccacccactccaactccaaccagattcagcgttaatgctctgtttggtgattggggatttgggaatagaacaaggaactcccttcagcagcaattcacgttcactcttgctgatagtaaagtgataagcgtgtcggttgtttcttcgatctcagatgttgcatcgagcgaatgggacgcttgtgctttggatgcgactggccctgacaacttcaatccattcctttcgcatgcctttttgtcgaccttagagcactctgcttccgctgtcagggaaactggttggatcccacaccacatcgttgccaaagccaacaacaacagcaacaacaacgttgtagccgttgtcccactctatcttaaaacccactcctacggcgaatttgtttttgatcattcttgggctaatgcttaccattcttatggctacaattattaccccaagttacaatcttgtgtccccttcacacctgtaactggtccaaggatcttacttcgtaacacctccttcaaacatcaagttttcgacattattgtctccgcaatgaaggaactcgctctcaccgtaatacactcccagctttcatcattacatgttacttttccctctgaaaatgagtggcacaagctcactgagaaaggcttcctccccaggattggaatgcagtaccactggaaaaaccgtaactacaaaaattttgatgacttcttgatggacatgaagcaaagtaaaagaaaaaatatacgtcaagagcgcaaaaaggttgatatctgcagattttatcaactggtcttagagttctatccaatagcactgtcctcaatctcagcccagaacttgattatgaaacgcctccggggttatgaaataaagatagtccttagggttcggattgacgcaaatgatcccctaaagttcacagctaggcactgggattccttctactctttttacaggaacacaactgataacaaatggggcactcctcacctgacaagggaattttttcatgagctgggagcaaaaatgggagataatgtgctacttgtggtggctgaagaaggggatgaactagttgctggagccctaaatcttatcggaggagataccttgtttgggcgcctatggggatgtcagccacgaagttactacccaagtttgcattttgaagcgtgttattaccaggcaattgaagcagctattgaactcaatcttaaaactgtagaggcaggagctcagggtgaacacaagattcagcggggatatcttcctgtgacaacttatagctgccattaccttattgatgaagaatttagagaagctatacaagattttttaatacgtgaagctgctcaggtgaagctagttataaaactcttgcatgattctggtccttttaaggaagacagtgagagaagcactattgtcagctggagtgagattgagaatcatgaatgcagccagcggtgcttgatagagagaagcagaagcaccaaagcaagaggagagtatgtcttttgccacagacttgctcagcccttttatcgcccactttggtgcacaatagagctaccagcatcgcacccaccttccccatccacaagccatgttcactattatcgcttccatcttatttgtcactatcgtcaaaggcttctgagaaggaatatcatgctaaaactgcagtcaaatattgtaacgaatcctgtcaaaattcttaattga

SEQ ID NO: 82203 - DNA, 159 bp, Glycine max
  Peptide Sequence Number=SeqID_198981
atggctgaaggagatcctatcgtaggggcaaaagatggttcatatacgaataaggtgttgactagtggcaatgcggttcctttcttgatgtttgatggaagatttttagggaaacttgaaattggaattcctctccctcttattccaaaggaggattag

SEQ ID NO: 82204 - DNA, 597 bp, Glycine max
  Peptide Sequence Number=SeqID_198982
atggttagcactcagtctagcctcagaagggagacccctcttgaaaattttcatcctcatccggcaactatgacaaacacaaatactctacaacagctccaaaaccgcattgcggacgacgagcacttcgctcacatattgcctaagggcacccaaggggaatcacacccccgacgcacagtcaacactctagatgacttaagtctcacccacatgcaccgtctagcaggacagactacttatccaaatgagcatctagatgccttcatgactcaggcgaacctctacactaatgatgatgtgattctatgtcgtgtctttccaacgttcctcaaggggtacgcgaccagcagatctcactacgtgaccttatccgccttggctagtttgcgacaagcagacgacgagtctctcagaaaattcatggacagatttgggcgcatagctgtccagatccaaaatcttaatcccaaggaagctttcaacttggacttacccattaggctacccccgatgaaacctcctaggttgggttcaaacgcaaccaaatattgcaagtatcatcacgatattggtcataacatagaagactactag

SEQ ID NO: 82205 - DNA, 306 bp, Glycine max
  Peptide Sequence Number=SeqID_198983
atggtagaaaatggttttgttcaagatgatatcacaccaccgcccaagtcttgtagcaacaagaagatggttgaaccagggaaacctgctggacttacctggcagcgaaaattaaacaacaatggaaatgcttcatcacaaatctccttatctttgaaggagatcattcatctggctccaattggttatcggctatggcgtcattgtcgggaagaagctgccaaaggaagggggggaatgattgatccttttgccaagcgccacgtaacattttgtcatggtgttcctttgggaggtattgggtag

SEQ ID NO: 82206 - DNA, 2187 bp, Glycine max
  Peptide Sequence Number=SeqID_198984
atgggtgtctccaataaaactcctgaatttctcaagatcaatcctattggcaaggttcctgtgttggaaacacctgatggtccagtattcgagagcaatgccattgctcgctatgttacccagctgaaaggtgataacactttgtatggatcttctttgattgaacatgcccacattgaacaatggattgatttttcatcattggagattgatgctaatattatcaagtggtatgccccaagagttggacgaggaccatatcttcctccagctgaggaggctgcaatttctgcactaaagagagctttggctgctttgaacactcaccttgcttccaatacttacctggttgggcattctgtgaccctggctgacatcataatgacatgcaatttatatttgggttttgcaaacatcctggttaagtgctttacctctgagtttcctcatgttgagagatacttttggaccttggtcaatcagccaaacttccgaaaaataattgggcaggtcaagcaggctgaaactattcctcctgttcaatctgcaaagaagccttcccagccaaaagaatccaagcccaaggtaaaaaatgaaccaaagaaagaggcaaacaaggagccagaaaagcccaaagaagaagcagaagaggaggctcccaagcctaaagccaagaatccccttgatcttctccctccaagtccgatgatactggatgagtggaaaagactctactcaaacactaaaaccaacttcagggaggttgctatcaaaggattttgggacatgtatgatcccgagggatactctctctggttttgtgattacaaatacaatcaggagaatactgtttcttttgtgacattgaacaaggttggtggatttcttcagcggatggatttggctcgcaagtatgcatttggaaagatgcttgtgattggatcagatccaccatttaaggtgaaggggctgtggcttttccgtgggcaagaaatccctcaatttgtgattgatgaatgctatgacatggagctctacgaatggactaaggttgacatctctgacgaacctcaaaaggagcgtgtcaatcagatgattgaagattgtgaaccttttgagggcgaggctcttttggatgccaagtgcttcaaacagctggagacaggctggaggcaacataatctttgcctttggattctcatttctcatttctccgcttccttccctcctagatccattctctcatccgtagttagacacccaataaaatcaagtaatcttttaggttgccatgtggtggaatctgtaattcgggtaatgcccctgtcgagatttgctgccgattattcggttaagtctgctaaggcgcggccttcacttgcagtggcaatggcaggaggaaagtatatgcaaatgactggcggcattatcaatacaaaatggaatgtgaagacggccggatacattctgctttactgcttcccactttttgttcttcaactgtttgttatttttgttggaggagagttcaagtcatcatcatcatcgtcatgtacttaccctttactaagcactcttctccttggcctttttgcccttattctgacctcgtacctcttctggcttggaagccggattttgaaattagttattaataagggtttgcagaagagggtatacacattggtactctcagtctcaggcttccttccattaagggttgttttccttggtttgtccgtattatctggacctgaggattttatgtttgaggcctttgctttcttggctttccttgcccttgcgtcttgtgctggggtgtgcatgtgcatgcttgtgtaccgtccacttgcagattgtttagcgctcgatattaatgataccacgtctcttataaaaggagatagggatgccacgtttcttcaactaagcctcttctctcccactccaaaccgatttctttcttttctgagctcggttaaattcatgtcacctgtgaaaccgactccttggaagccttgcaactggaggagaaccagttcagtgcttgcaaaccaatgtgctgacttcttagctcgcttgggttcctcctcatccgagactcttcgtactgtggctttgcctcttcctgagatgaaacctttgcttctagcagatgcttcgagtgtagtttttgtgcacttgtag

SEQ ID NO: 82207 - DNA, 2103 bp, Glycine max
  Peptide Sequence Number=SeqID_198985
atggaaacagttccacatatcatgcattatacccaagggcttggacagtatatgaggatcgatcatctcttctgttcaaatgcagaacctgacccagctttgagaatagtttgtcggcagatttcacctgttataccccataattataaggagagtagctttcctgtgacagttttcactttcacgctgaaaaatttaggtaacacaacagctgatgttaccttgcttttcacatggacaaactcagttggaggaatttctgaatttactggtgaccactttaattcaaagacaacgaggaatgatggggttcatgctgtgcttctacatcataagactgcaaatgagagatctcctgtcacatttgcaattgcagcagaagagactgaagatgttcatatctcagaatgccctgtctttgttatatctggtgcttacagcagtatctcggctaagaatatgtggaatgaagttaaacagggggttaaacaccgggagatccctattgatgagttacaagtaaactacacaagtgaacttgacaccgcattcaacccaaaactcaagcacgggtcatttgaccatctgaattttgctgaaacctctgcgccttcagaaccaggatcatctattggagcagctattgcagcaactgtgactattccctctaatgctcagcgtattgtgacattttcattagcatgggactgccctgaagtcaagtttcctgaaggaaagacatattacaggcgttacactaaattctatggtactaatggtgatgctgctgcagatattgcacatgatgctattatggaacattgccaatgggaggcccagattgatgattggcaaagaccaatactcgaggacaagaggtttcctgaatggtacccaactacccttttgaatgaactttactatttgaattctggggggacaatttggacagatggttcacttcctgtgcatggtttagttaacacaggagaaagaaaattttccctggatggattcaacaataatttatctcataaaaatgatattgctatcaacattcttgaaatgtttaactcagtagttgagcaaacgcactctccacctgcatcgaagtctgcatatggagtaaatctgctccaagaaggggaagaaaacattggtcagtttctttatcttgaaggcattgagtatcaaatgtggaatacctatgatgtccatttttactcttctttttcactagtcatgctatttccaaaacttgaactcagcatccaaagggacttcgctgcagcagtattgatgcatgaccctagtaagatgaaacttctatatgatggccaatgggcaccaagaaaggttcttggtgctgttcctcatgatattgggctcaatgatccatggtttgaagtaaatggctataatctttataacacagataggtggaaagacttgaatccaaaatttgttctccagatttatagggatgtagttgccactggtgacaagaagtttgcacaagctgtttggcctgctgtttatattgcaattgcttatatggaccaatttgacaaggatggtgatggaatgattgagaatgaaggctttcccgatcaaacttatgacacatggtctgtgtctggtgtgagtgcatacagtggtggactgtgggtagcagcacttcaggcagcatcagcgctggcacgtgaagttggtgacaagggttctgaggattatttttggctgaagtttcaaaaagcaaagtctgtatatgaaaatttatggaatggttcttacttcaattatgatagcagtggtggaagttcgagtttatccattcaagctgatcaattagcaggccaatggtatgctagagcatgtggtcttttgccaattgttgaagaaaagaaaaggaggcgtggtgcggtaaatgggatgttacctgatggaaaggttgacatgtcaacaatgcaatctcgggaaatatggtcaggagtcacatatgccttagctgcaacaatgatccaagaaaatatgattgacatggcatttcaaactgctggtggagtttatgaaactgcatggtccaacaatggactcgggtaa

SEQ ID NO: 82208 - DNA, 288 bp, Glycine max
  Peptide Sequence Number=SeqID_198986
atgctggatcatcctgaacccctgaaactcccccattgtacagaagttcctcttagagcttgcggcaaccacatgacagtcttaaggcgacatggccccccactacaatggaaagttgaaacactgaatcctgctattagtggaaaaggtgttgtccaaccatggtatgattttcttgaagaaatgaattttgatgatggagatgaaatctctatttattataggtattatgaaaaaatttgggatgtcataatcaggaggcaggaggcaggaagattgggaagatga

SEQ ID NO: 82209 - DNA, 450 bp, Glycine max
  Peptide Sequence Number=SeqID_198987
atgacaaagagcttccttttaaaaaccctcctattgttcctcatcacaaagagcttctataatcctcctgttgttcctaatctagaagcgagacaagctcataatgatttgaggataagaggagtaaaaacctttctatttgttcttctcttcttcccacagcacacccgctttccaatgctagaggttccaactaaagtcttcttccaactacgccagaggttccaacactctcctcctccaactctccacaccagaaaggttgttctagaatctttctttcttctagaaaggcttgttcataacacctttatggaagccaaaaattcattccagaaagcctattccagaatgcagaaaggcctttctaaaacaccttttcctgctaatggaaacactattccggaagcattttttggttatggaatggtcctttcggaaactgtttaa

SEQ ID NO: 82210 - DNA, 582 bp, Glycine max
  Peptide Sequence Number=SeqID_198988
atggattcaaaacccaacctttggaacacaccaccttcaacttgcagcagctatagcagcaacagcagcgagagcgatgccagccccttctgttcccatcgcatacccatagccatagtttctggcttcttccactctcaccgatcactcgcagttctctcgggacacgtgggctccgtttcatgcttggccttatgcggtgagttcatcctcagtgcctcgcagggtaaggatatcatagtgtggcagcaaccagatttgagggtgtttgcaaagttcggacaaggagatgggtcagtgaaggcacttgcatcggttgggaacaaggttttcaccgcacatcaagatagcaggatcagagtttggaaggtgtcaagaagctcagagaacgtgttcaagctcgttgatactcttcccacaaccaaggactatttggggaagttcatgaagcagagcaattatgtacaaacccggaggcaccacaagcgtttgtggattgagcatgcggatagcatttcatgcttgacggtttatagcggtttgatttattctgggtcgtgggacaagactcttaaggtgtga

SEQ ID NO: 82211 - DNA, 1440 bp, Glycine max
  Peptide Sequence Number=SeqID_198989
atgaaaaatgatccaaattacctcagttgcaaaaagaaagaatgtaagacattccaaaatgggaaatgtgctgtctcaacgtgcagtggttcactacagtttcatgttgtcaacattagaagtgacatcgagttcgtgttcttctccggtggattcgtggaaccatgccttgtgggaaggtccacgcctgtgagctttgctaatcctaagaggccactctatggacatctctcgagcatagattccactggaacatcaatgagattgacatgggttagtggagacaaggagcctcagcaaatccaatatggaaatggaaaaacagttgcttcagcagtcactacattttcacaagatgatatgtgtagttcagcgctgcctagtcctgctaaggatttcggatggcatgatccaggatacattcattcagcacttatgacaggacttaagccttcaagcaccttctcctacagatatggaagtggctgggttggttggagtgaacaaatcaaattttcaactccacctgctggaggatcagatgagctaagattcattgcatttggtgatatgggcaagactcctcttgatgcttcagaagaacactacattcagccaggagctctttcagttattaaagctatagccaatgatgtaaattccaacaatgtaaattcagtctttcacatcggagacataagctatgcaacaggttttctagcagaatgggattacttccttcaccttatcaacccagtagcttccaggatttcttatatgacagcaattgggaaccatgagagggattatatcgattccggttcagtatatgttactcctgactctggtggggaatgtggagtaccatatgaaacatactttccaatgccaacttcagcaaaggataagccttggtactcaattgaacaaggaagtgttcatttcacagtaatatcaactgagcatgactggtcagagaattctgagcagtatgaatgggtgcaaaaggacatggcatcagttaatcgacagaaaacaccttggctaatcttcatgggacatagaccaatgtacaccaccaaccatggattcttaccttctgaaaacaaatttatggaagccgtagagccattgctattagaaaataaggttgacttggttctttttgggcacgtgcataattatgagagaacttgttccttgtttcaaaatgaatgtaaagccatgcctgcaaaggataaaaatggtgttgacacatacgatggcagaaattacagtgcccctgtgcatgctgtcattggcatggctggcttcaccttagacaagttctcaagcaatgtaaaaagctggagcctgaaaaggatttctgagtttggttatttaagagcacatgctacgaggaatgatttaaacttggaggtcaacagcaaagcaccctaa

SEQ ID NO: 82212 - DNA, 318 bp, Glycine max
  Peptide Sequence Number=SeqID_198990
atgactaaaagagattggagaatggaagattgtgaagttgtggccgacaatagtgaaaactatgtcttggcaggaaatataagaaaatgttggcaacgacaaaatctgagacatgatgggtgtgaaaaggttatcaaagaaataagggaagaagaagcagttaacaaagaaagtgatgaaagcaataggttcgagttggattttttgattttacaaagttgtaacccaaaacctaaactaaacgagatcggattgcgaaacaaaaatggaatcaaacctatcatcttaaacaaatcatggaaattaataaggctgtaa

SEQ ID NO: 82213 - DNA, 597 bp, Glycine max
  Peptide Sequence Number=SeqID_198991
atgcaaggtgtgagtcgtcagccaaagttatggactcaggttgacagtaccagcaggggtgtgcgtgtgcaagggatgaactgggatgatgacgagcgcatacgcctaatcaatcttcttaatgaatgtgtcaagcttactgaattaggcaacttcaatgctgcagatgttgcattctaccatctctctcaccttgcttcccctgatggtgattcaatgcaacgcgttgccacttgtttcattgaggcactagcctattgccaagtggccaaaaatttgcgtggtgtacccaaagttctccatttgtggactaatctcatcaagtgtttaaaaccaagcacaccaacatgtccgaaaattactatcacagccatacatgagaagaaggaggtgttagagaaaatggggttgcatcttggagttgaagctcaaaggttgcttttccctttccaattcaatcctgttgtaagcagtttggagaaccttgaccctgagacattgcctatcaagaaaggtgagcctcttgctattagttctgtgcttcagcttcactctcttcttgccagtgatgatgacgatgagatggccaaaatgtag

SEQ ID NO: 82214 - DNA, 309 bp, Glycine max
  Peptide Sequence Number=SeqID_198992
atggctttatctgaatgggtcaattcccctaatgaagtgattcaaaatatggcagaaaagattgatggaagcttgcttgaagaaggagcttcaccaccaagaattgccttggataagaagcttgaagaggatgctttaatggaggaaaagaaagagagaaggggggagcacgaaattgaaggaataaaagagggaaagaagtggaactttgaagtgtatctcataagactttcattcatcaaagttacaacaagtgttacacatgcttctatttatagactaggtagcttccttgagaagctttcttga

SEQ ID NO: 82215 - DNA, 609 bp, Glycine max
  Peptide Sequence Number=SeqID_198993
atggctccatcttctgtcactgtcactgtcacttcccgttttcatgaatctgtcacccgcaatgcacttcgctcttttctctctgactttatctccactttcttctatgtctttcttgtcgttggcgctggaatgccctcacggaagttgatggctgatgcttcactgaacccaacaagtttggttgtggttggcattgcaagcgcatttgctttgtcttctgttctttatatcgcatgggacatctcaggtggaaacgtgaatccggctgtgacctttgcaatggcggcagtgggaggccacggtattctgacatttgttttggtgtacagagtgtatgcagccagggaccctaggcatggtccaatgagttccactggcatacttgtagttggcttaatggctggggcaagtgtcttggccacagctccattctccggcggctcaatgaaccctgcatgtgcttttggctcggctgccattgcaggcagtttcaggaaccaagcagtgtattgggttggacccttgattggtgctacaatagctggccttctttatgacaatgtgctgttccgatctcaacccacagattcaattcaaggaattggg

SEQ ID NO: 82216 - DNA, 795 bp, Glycine max
  Peptide Sequence Number=SeqID_198994
atggctataaatgatccagtggctgcatctgcacaaagatacaaaccaatacaatctgcagttcctggaactaccttagggccaattcaaattaatgctttcctaggaggagggaaattgtacgacactcctggagttcatctctaccataggcaaactgcagttgttcattctgaagatctacccatccttgctccacaaagccgactgaggggcctgtctttcccaagttctatattatcttcagtagaggaaggagcttccaccatagtgaatggcttgaatgcattttcaatattttggggaggtcttgttagaattgatgtcttgaaggttctcccagaaacttgtttgacattttatggacccaagagaataccaattcatatggtacccacagagcaagcagttgaattttatcagacagaacttggagttctgctgaccccaccaagtggaggagaaaatgctgagaactggaaaggacttgaatcagaacgaaaattgcaaattaaatttgaagatgtggacagttatgatcccaaaccagcttgtgatatagctatatcaggtctaggatggtttactgttgagccagttagtcggtcactcaaaatctcacaaccaaaaccggtagagactgctggggaattgattttggctgtgcacgtccccaaggctgttgagatttttgtgaggtcaccaataccagtaggcaaggctggagcagagtggtaccagtatgtagaattaacagagaaacaagaggaaatgagaccaaaatggtacttttaa

SEQ ID NO: 82217 - DNA, 558 bp, Glycine max
  Peptide Sequence Number=SeqID_198995
atggcgcttaaaaccctatccactttcctctcacctctttctcttcccaacaccaaattcccgcaattcctcaccaccaagccttccctcattctctgcgagttccctcgctctcagaaatcgcgtttgctcgccgccgattcggaaggcaccggcgccgccgctccttctcccggcgagaagttcctcgaacgccagcagtccttcgaagatgctaagatcattctcaaagaaaacaagaagaagagaaagaagaaagacaatgctataaaagcttctagagccgtcgcttcttgctacggctgcggcgctccgttacacacttccgatgccgatgcccctggctacgttgatcccgaaacctatgaattgaagaagaaacaccaccagcttcgaaccgttctgtgtaggcggtgccggcttttgtctcatggcaagatgataactgccgttggagggcacggaggatatcctggcggtaaattattcgtcactgctgaagagcttcgagaaaagttgtctcacctgcgtcacgagaaagctctaatcgtcaaattg

SEQ ID NO: 82218 - DNA, 1113 bp, Glycine max
  Peptide Sequence Number=SeqID_198996
atgtggaagcatgcaatgaatgaagacatgcaatctatgatagttaatggcatatgggagctagttgatttgcttgagaattgtaatgcaatcgattgtaaatgggtcttcaagacaaagaaggactcaaatggtaacattaagaaatttaaggctagattagtggaaaagggttttatgcaaaatgagggtgttgactttaaagagacattttcgcctatatcgacaaaggattcctttagaatcattatgaccctcaaagctcacttcgatttggaattgcaccaaatgaataattatgaacctggagatgtgtcgattgtcaaaggtgacaaattcaataagaaccaatgtcataagaatgagattgagcgagcaaagatgaatgatagactttttgggagtggtctgagcagcctcatgtatgctcaagtatgcactgggcccaatattgctttcatagttggcgttcttagtagataccagttgaaccctaggaatgatcattggatagttgctaagaaggtaataaggagagttgataacttggaggtcgtggggtacacaaattcatatcttggtggctacttcgatgataagagatcgacttctggatatatctttatgatggctggggacgcaatatcatggaagagtaagaaacaaactcttgttgcctcttgtactatgcaagcagagttcattgtttgttttactgttgttactcatgttgtttggttgaggaatcttatgacaagacttagcattatggactccattgctaggcccttgaggattttatgtgataacaacattgttgtgttttatacgaagaataataagacttctaaaggatctaagcacttgaagttaaagtgcccaactattagagatcttgtgaaagatggttccatagtggtaaagcatgtggacatagattccatgttggttgatcccatgaccaagggactcaagcctgtagttttcatacaacatgttgaaaacatgggcattgtgagttcttttgatatgcttgatgtgaaattattaaagctcggtgtcgttgagaccactgtgccgatggtcgacactaaaattggagctaagccataa

SEQ ID NO: 82219 - DNA, 432 bp, Glycine max
  Peptide Sequence Number=SeqID_198997
atggaactagaagctccacaagttagcacatgggaagggtatgtggattggaggaacaagcctgctcttagaggacgccatggaggcatgcttgcagcctccttcgttctggtggcggagatattggagaatctggcgtttttggccaatgctagcaacttggtgttgtacctgaggcattacatgcacatgtcaccttcaaagtctgcaaataatgtcaccaatttcatgggaacggcctttattcttgccctcctcggtggtttcttatccgatgcttttttcacctcttatcgtgtctatctaataagtgcagttattgagttcctggagaataattacataaaaaaagaagagattttcaatttttttttatgggtgactctaggaacacgtgtccggcaaaaggatgtgacgtgtctaccggaataa

SEQ ID NO: 82220 - DNA, 810 bp, Glycine max
  Peptide Sequence Number=SeqID_198998
atgaccttactaccgagtgtgttgtcgaagaagagaaactcaagaaagaaaaagattgacatagccctattatcagtccatggcaaacctacttctggcaagggacactggaaaaaaacaaagagtgcatctaatacttcttatagatatcaaggtttagggaaaccaggtaagggtcagcaccacaatcaaggaggttctaggttagctatctttaagaaagtggatggtttatataaattgtctttggattatgataatacttcttcatctttagttgttgagaattctgttgctaaaaggtctacatttgaagaaaaatcccttatgttgtggtacaaccgcttaggtcatatttctagggaaatggttaagagattgacaaagacaaatattctaccctccttgaatttagatgacttgggtacttgtgtgggttgtataaagggaaagtttactagaaccaaaaagaaaggtgcaactagaagttcagatctcttagagaaaaagacaaaccccaagatgagtcgttgtttttttgttggatatccagatcgaactaaaggatataggttcttttgtcctgataaaaggaacaaaatagtagagtccatgaatgctaagtttttggagcttgatgtggtggaccttgttattccatctaatgagattgatgtcgagtcacctaagactatttctctgcctctacctattccggttgttagtgtttcgagttttgtttcgattaagactggggttcagatcatcccaattgagactagggtcctaatttttcagttgagaccatag

SEQ ID NO: 82221 - DNA, 1014 bp, Glycine max
  Peptide Sequence Number=SeqID_198999
atggacgctcagagagctctactcgacgaactcatgggtgcagcgcgcaacttgacggaggaagagaggaaggggtacaaggaagtgagttgggacgataaggaagtgtgtggattctacatggtgcgcttttgccctcacgatctctttgtcaacacgcgcagtgatctcggaccttgccccagaatacatgacccgaagttgaaagaaagttttgagaaatctccaagacatgatgcatatgtaccgaaatttgaagctgaactttctcaattttgtgagaaattggtgatggacttggatagaagagtaagacgtgggagagaacgtcttgctcaagaggtagagccaacaccaccaccaccactgacagccgaaaaatctgaacagctatctgtgctggaggagaaaattaagaaccttctggaacaagttgaatctcttggtgaagcggggaaagttgatgaagctgaagctcttatgagaaaggtggagacacttaatgctgagaagacagccttaacgcaacctcaaaatgataaggtgttgatgcttggtcaggagaagaagatggcactctgtgaaatatgtggttcgtttcttgtggcaaatgatgctgcagaaaggactcagtctcatgtcacaggaaagcagcatgttggttatggaatgactgctaaggagaaagctaatgaagaggaaagattagctcgggaaagagaggcagaagaacggaggaaacagagggagaaggagtccgagagaaggagacgaagtgattcaagtgacagggataggcatcgtgataaagatcacaatagggagcgggataggtatagagatagagactcagatcgtgaaaggtctcgggagcatgatgttagaggttatcgagatggaggaaggggggtggattatagggcgagaaatggaagaaatggaggtagagacaggtaccgtgatcggagcaggtcacgctcccctggtaagcatagccacagaaggtcttcttga

SEQ ID NO: 82222 - DNA, 1437 bp, Glycine max
  Peptide Sequence Number=SeqID_199000
atggctaaggaacatggattttttgtgcagggtctgattgtactcaccatccaagctcgtgatccttcattaaaaccaccaaagtgtgacttagacaccccatgtcaagaagttaatgatagcaaagcagcaatgttgttcattggcctctatctggtggctctaggggttggaggaatcaaagggtcactgccagcacatggtggtgagcaatttgatgaaaccactccatctgggaggaagcagagatcaaccttcttcaactactttgtcttctgcctatcatgtggtgcccttattgcagttacttttgtggtgtggattgaagacaacaaagggtggcaatggggttttgcaatatctactattagcatatttgtgtctatcccagtgttcttggctggttcagctacttacaagaacaagatcccttcaggaagtccacttacaaccattttaaaggttttggttgctgctttactgaatatctgcacctacaaaaacactagcagtgctgtggtaaatatggcttcaagcccttctaatccacactcaggtagaatggaatcaaaactagaaactgcaaaagcaagcacaatagctgaaccccaacgattacctcaagttttcaacaaagcagttacttacaagccaaggtattcatcactagaatgcactgtacagcaagtagaagatgtaaaggtagtattgaaagtgctacccatatttggatgcaccatcatcctcaactgttgcctagctcagttgtccacattctctgttgaacaagctgccactatggataccaagcttggttccctcaaggttccaccgtcttcgttaccagttttcccagtggtattcatcatgatcctagcaccaatttatgaccacattatcatcccctacacaaggaaagcaaccaaatcagaaatgggaatcacacacctccaaaggattggttttggattagtgctctccatagttgcaatggcagtggctgctcttgttgaaatcaaaaggaaaagagtggccactcactcaggcctacttgattatcctaccaaaccactacctatcacattcttgtggattgcttttcagtacttgttccttggatctgctgatcttttcaccttggcaggattgttggaatttttcttttcagaagcaccaataaggatgagatcattggccacatctctttcatgggcctctttggcaatggggtactacctaagttcagtgattgtgtctatagtaaacagtgtcactggaaatggcacccacaaaccatggctatctggtgccaactttaaccactatcacctagagaagttctattggctcatgtgtgtgctaagtgggttgaacttcctacactacctgtattgggccaccaggtacaaatatagagggacaggtactactagttaa

SEQ ID NO: 82223 - DNA, 99 bp, Glycine max
  Peptide Sequence Number=SeqID_199001
atgtcttctcctttcatgaaccaacgccctacctttattgtctgggtggttagaggaaaacaatcgtcgcctcttgttattagaagcgaggcaaaatga

SEQ ID NO: 82224 - DNA, 168 bp, Glycine max
  Peptide Sequence Number=SeqID_199002
atgacaaccgcgccgacgaccacagcaccgacatcgatcgtcactccgaacgctctttccctagcactgcgcgccgcgacgatatcttctcaggttctgaacatgatggaccaggtcatggacaatccgttcctctccgcgtcgcgcgggatcggagctggcgctgga

SEQ ID NO: 82225 - DNA, 261 bp, Glycine max
  Peptide Sequence Number=SeqID_199003
atggctggcaaaacatgtgaagaaggtatcccgccattgcttctggcgagacaacgtagcataggaagcaggcttttcaaaaaccttttcagaaagggtttcgcaactgggagtggcaaaataagtttctctcctataaaacgatcgtgcacgaatgaatgggagcatctgtgtgaatttcttggtgcttgttacgcttgtgctggtggcgaaaagcatgagctgtgtattctcctctttctcaagcttgacagaaaatag

SEQ ID NO: 82226 - DNA, 294 bp, Glycine max
  Peptide Sequence Number=SeqID_199004
atggcgttggtgttgaaagagcggtgggaagcggaagcggcggggcgaaggagggacctggagaggagggaagaggagaggaagcgcttcgcaatgagagaggacgccattgaattgagattgcaaaaggtaggttggttcttggacttgatgagcaagctgggaaaaaatctttgtgcagggaaatggggagtgagagtgggtgatataaggggaatgagattctcgaaggttctgccttggagagcaagcatatccgttttattagccatcgaccatcgtggccacacttaa

SEQ ID NO: 82227 - DNA, 180 bp, Glycine max
  Peptide Sequence Number=SeqID_199005
atggttaacagtttgccatatctatctctaccattagattatgactatttggtcatagagtatgatggttgtgaacaaggatggggagtcatcctaaagaaagagaaaaataaatatgaaaaaattcatgatgaagaaatctgtaagtatgcttcaggaaaataccacacaaaaccacag

SEQ ID NO: 82228 - DNA, 273 bp, Glycine max
  Peptide Sequence Number=SeqID_199006
atgcaagcaaagggaaccccgcgggttggccgaaaagaagacaaaagcgtgactctaattaaggcccaatgggatctgttggctctcatttatcatcttgcattatccgccgaatgtttggctgcggtagaaattcaacacttttcagtcgagacaaactgggaaaacactcagagcatcatcaagagcccccgcatatgggtggttcttcttctctatgccgccagatctttaactggaccggggtggatctcattccaatgctcaagttaa

SEQ ID NO: 82229 - DNA, 1084 bp, Glycine max
  Peptide Sequence Number=SeqID_199007
cccaatatgtatcgacaaagcagagaaatctctccgagtcggagttagcatcgtcgacgttgcgatggagaaggaagcgagtagcaccgacgacccttcttcgttcacgcttctagtgtcgtgtccttccggcctttcaccttcacaggtttctgtggcattcagcgacgcctacgaccggatcccccactctgacgtcatcttggagaacacgatttccgagatatggaagcagaggagtcagaagaacaattcgctcttcaatgggaagaagttcaggcacacctccaatccactaggaaatggtgcagtggtggaaacaaatgacaacaaaatacttgtattacaacgaagtgataatgttggtgaatttcctggacattttgttttccctggaggccatcctgagatatgtaatctaagaagcacggacgcggcacttcaacggtgtgttcggtgttggactaacgccagacacggatgcggacccgactcgtatgcgatgcggtatcagggagacgacgacaagatgcgcaaagggagaatgttgtcggttgctttgtggccgtcaataatggcaacattgtccgtgaatgtgctcctgtggtgcctcttcaactgcgacattgtttcggggatgacgctcaacggtgtgttgaagttggggaaggccgaggcacatccagatctgcttgtccctgtgtctgtgtccatgtcgtgtccgacaccgtgcccgaatccgtgcttcttacctcaagaaattggtataacatctcatcaatataacaaggagttaacagaatctattaacactaaggtttcacaggagatgtttgacagcattgttcgtgaagtagttgaagaaattggagtgccggcttcatcccttagcatcccggctttcattggtatatctcgcaggaacttgaatgttagaccagctgcatttttctttattaaatgcggtcttgactcaaaggaagttcggcagttttattcaagtgcacaagatggctatgagtcaactcagctatatgctgttccaatggtgaatctaaagcttgttcttattgtgttagcatga

SEQ ID NO: 82230 - DNA, 702 bp, Glycine max
  Peptide Sequence Number=SeqID_199008
atggcgcggtcgcgacgtgtcgtcggcccgcccggacggccacgcccagcgccgatagcccttgctccccttgtcccctcgcgggcgatatgcctcgccaaggcggccgaggacctggacatgtcgtcagctggtctgagcaagcagctgcgcgccctcgaagcccacctgggagcggtgctgatccagcgcaccacccgcaagatgagcctcaccgacaccggcgccgcctattacgccgaatgctgccggctgctcgatgcgctggatgcgctggagaagtccgtcaagcgccagtccggccgcgtttcgggacggctgcgcgtgaacgcgccggtgtcctttgcgctgagcgtgctgtcgccgttgctggcgcgcttcctgcgccagtaccccgagttgcggctcgatctggccatggaggaccggctggtcgatgcggtggggcagggcttcgatgtgtcgatccggctgcgagcgcaactggatgattcctccctgatcgcgcgtcgcctggcgtcgctgacgcaggtgctgtgcgcggcgccctcgtacctggagcgccgcggccttccggacagcgtcgaggcgttgcgcgggcatgacatcctcagctatagcctggccgacagccccggtccggttcccgaggaagacgctggccagccggccgatccgctggctggccccgcgctgatccag

SEQ ID NO: 82231 - DNA, 192 bp, Glycine max
  Peptide Sequence Number=SeqID_199009
atgccttatgctgacctactaccatctttgataagcaatcagatggttgtggtgaaccccgtgaaggtctatcaatctcccttcccacgatggtacaattccaatgcaacctttgcctatcacggtgatgatgacaaaaagcccaagagaatgatttcaagattgagtcatcaagttcaaaatcaagattaa

SEQ ID NO: 82232 - DNA, 654 bp, Glycine max
  Peptide Sequence Number=SeqID_199010
atggagaggagtatgattgatgctgccagtggtggagctcttggtgatatgactcctgttgaggctaggaatctaattgagaagatggcttccaactaccaacaattcagtgcaagaaatgatgttattgtccttagaggagtccatgatgtagccacagattcatcttcatctgctgaaaataagaagcttgagggaaaacttgacgccttggtcaacctagtaactcagcttgccataaatccgaaatctgcatttgcacctgttactgttgcaagagtctgtggtctatgttcttctgctgatcaccatacaaatctttgtccttctttgcagcaatttggaatcaatgagaaacctgaagcctatgctgcaaatatttataatagaccccctcagcagcaaaaccaacaacagcagaataattatgatctttcaagcaacagatacaatccaggttggaggaatcatccaaatctgagatggtcaaatcctccacaacaacaacaacaacaacaacagcctgcccctcccttccgtaatgctgctggtccaagcaggccatatgttcctcctccaatgcaacaacaacaacaaagacaacaagcaactgaggccccttctcaaccttccttagaggagttagtgaggtaa

SEQ ID NO: 82233 - DNA, 1476 bp, Glycine max
  Peptide Sequence Number=SeqID_199011
atggggttgggtggtgagaatggcaaggtggtggagtcttgggatgtgtgtaaatcaaaaggtgggaggaagaagaagaagaaaggggatgcagaagaagtggaagaaggggctgaggctgaggctgggtgttgggttaggttgaggtttattgggagctgcatttcttcaagatccaaggttgatacctcagtcagtgccagtggcatcagtactcattatgctgaaagtaaatcaactaatgatactagtagagaccaaccaacagctccagcagtctcttctacaaccactagtaatgcagaaagcaattcgtccacttccaagcttgaagaagagcttaaaattgcttccaggctgcgaaagttctctttcaatgatctcaagtcagcaacaagaaattttcggcctgagagttttcttggtgaaggtgggtttggttgtgttttcaaggggtggattgaagaaaatggaactgctccagtgaaacctggcacagggcttacggttgctgtaaaaaccctaaaccatgatgggctccagggtcataaagaatggctggctgaagtgaattttctcggtgatctagttcatccaaaccttgttaaacttgtaggttactgcattgaagatgatcaaaggttgctagtgtatgaattcatgcctcggggtagcctggaaaaccacttatttaggagatccatgcctcttccatggtccattagaatgaaaattgcactaggagctgctaagggtcttgcttttcttcatgaagaagctgaacgaccagtaatatatagggattttaaaacttcaaacatattactagatgcagactacaatgccaagctctcagactttggtcttgccaaagatggtccagaaggtgataaaacccatgtgtctactcgggtgatgggaacctatggttacgcagcaccagaatatgtcatgacaggtcatcttacatcaaaaagtgatgtgtacagttttggagtggtactacttgagatgttgaccggcagaagatccatggacaaacaccgacccaatggtgagcataaccttgtggaatgggctcgaccacatctaggagagaggagaaggttctacaggttgatagaccctcgcttggaaggtcatttttcggtaaaaggagctcagaaagctgcccagctggctgctcactgccttagtagagatccaaaatccagacccctaatgagtgaagttgtagaagctttaaagcctttgccaagcctcaaggacatggcaagctcttcatattatttccaggcaatgcaagctgaccgatttggagcgagcccgaacacaagaaacgggcgaatgcaaggtgcattgctcacccgtaatggacagcagcaaaggagcctttcaataccaaatggtacttatgcatctccatatcaccatcagtttccccaaccatcaccaaagcccaatggcaaagcctag

SEQ ID NO: 82234 - DNA, 699 bp, Glycine max
  Peptide Sequence Number=SeqID_199012
atggaacctgaattgatgatctctgggaagcatgttgtgatgtggagccacaaaacacgtgaagggttcttcgtggattgtctaagcctaaggccaagtgccccggagaagaagattggtttagcgaagatgggacaaatgttcagtatgtttggttttgtgcaagtggaacagtcaagtgtggcgatcaaggaagttttcgggaagtacaatgatgttctcgatcctggttgccactgtgtgccgtggtatttcggcaatcgtgtggctggtgcactttctttgcgtatacaacagctagatgttcgttgtgaaaccaagacaaaggacaatgtgtttgttactgtggttgcctctatccagtatcgagcattggcagaaaaggcatcagatgcttactacaaactcagcaataccagagcacagatacaatcctatgtctttgatgttataagagcaagtgttccaaagatggaactagatgctacttttgagcagaagaccgacatcgcaaaaacagtggaggaagaacttgaaaaggctatgtcagcatatgggtatgagatagttcagactcttattgtggatattgagccagatgagcgtgtgaagagggccatgaatgaaattaatgctgagtcattcatatttccttttcaagctatcaaaataaatgttagtttaatggagaggttttga

SEQ ID NO: 82235 - DNA, 1161 bp, Glycine max
  Peptide Sequence Number=SeqID_199013
atggcagtgaagggacagagtcttgaggtggtggaggagttgataaaagctgatccctcaacaataaacatggttgataataagggtaacacagcattgcatatagcaaccaggaagggcagggctcggatgcgaggaattttgacctccaagagatatgcatatgtagcgtctatgagtgttgaacttattcagccttgcaatgttttgatttgtaatatttataacaatgttcaagttcaggtcttggttagctcagacctaggtctcatgattgttaagttgcttcttgggcagacagaaaccgatgccttggtagttaacagatccggcgaaactgcactagacacagctgagaaaactggtaactctgaagttaaagacattctcctggaacatggtgtccgaagagccaaagccataaaggctcaaccaggaacagccacagcccgagagttgaaacagactgtgagtgacataaagcatgaagtccactaccagttggaacacacgcgccaaactcgaagaggtgttcaaggcattgccaaacgcatcaacaaaatgcatactgaaggactcaacaatgcaataaactccacaactgtggttgcagtcctcattgccacagttgcctttgcagcaatcttcacagtccccggccaatttgctgatgaaccaaaagacatccctgcaggttcaggaatgaccattggtgaagcaaacatagccccacaagctgcatttctcattttcttcgtctttgattccatcgccctcttcatttctctggccgtggtggtggtgcaaacctcggttgtgatcatagaaagcaaagcaaagaagcagatgatggccatcattaacaagctaatgtggttggcttgtgtgcttatttctgtggccttcttggcactgtcatttgtagtggtggggaaggatcagaagtggcttgcaattggagtcactatcatagggacaactataatggccacaactttgggcaccatgagttactgggtcattaggcatcgcattgaggcctcaaacttaaggagcattcggaaatcttcaatgggaagcaggtcaaggtctttttcagtatcagttatgtcagattctgagctactaaacaatgaccgcaagatattgtatgccatatag

SEQ ID NO: 82236 - DNA, 1805 bp, Glycine max
  Peptide Sequence Number=SeqID_199014
cagagttttccttgcagtcttctctgaatggatctgcttcaaatcttccagatggtgctggacggtcttttgcttcatcgttttctggtcagtctggtgcagcctccccaaattttcatcacactggagctattcaaggattgcacaatattcatgggagctttaatgttcccaacatgcccggtacactcacatcaagaaactcaactataaataatgtaccatcggggggtgttcaacaacccactggaagcctttctagtggaagatttacatccaacaatctcccagttgcattgtctcagctatctcatggaagctcccattcaggaatcaccaatagaggaggtataagtgttgtaggaaaccctggatttagtagtagcacaaatggagttggtggttctattcctgggattcttcctacatctgctgcagttggtaaccgaaatgctgttccaggattgggagtaaacccaattttgggaaatgcaggtcctcgaatcacaagttctgtgggaaacatggttggaggagggaatattggaaggactggtggaggattgtctgtgcctgctctcgcatctcgtctaaatttgggtgcaaacagtggatccggtggtttaggtatgcaaggaccgaatcgattgatgagtggtgtgcttccacaagttgactgtggtaaccaacattttcttgacgcaggatctccacaggtaatttcaatgctaggaaattcttatcctagtgggggtccactttcccaaagccatgttcaagcagtgagtaacttgaactcaatggggatgttgaatgatgtgaataccaatgacagttcaccttttgacatcaatgacttccctcaactgacaagtcgtccgagttctgctggagggcctcaaggacagttgggttctttacgaaaacagggtcttggtgttagtcccattgttcaacaaaaccaagagtttagcattcaaaatgaagatttcccagctttaccaggattcaaaggtggtaatgcagattatgctatggatatgcaccagaaagaacaacttcatgacaatgctgtgccaatgatgcaatctcagcatttctctatgggaaggtcagctggtttcagcttagggggtacatattcatcacatcgagcacaacagcaacagcatgctccttcagtcagtagtggcaatgtctctttttcatctgttaacaaccaggatcttctccatctacatggatcagatattttcccatcttcacattcgacctatcattcacagcttgtctttcaagatgagaccagtggacctcctggcattggattaaggccgctaaattctccaaatacagtttctggtatgggttcgtatgaccagctcatccagcaatatcaacagcaccaaaatcagtcccagttccgccttcaaatgtcagctgtaaatcagtcttttagggatcagggcatgaagtctattcaaactgcacaaccggcaccagatccatttggtttgctcggcctgttaagtgtgatccggatgagtgatcctgacctgacgtctcttgctcttggaattgatcttactactctggggttaaatttgaattcatcagaaaatcttcacaagacctttgggtctccatggtctgatgaatcagctaagggcgatccagagtttactgtgccacaatgttattatgccaaacagccacctgctctacatttacaacagaggttggttttatcacaaagaacatcgtttgtggtttataagagttcccaacatggagccgctggttaa

SEQ ID NO: 82237 - DNA, 1347 bp, Glycine max
  Peptide Sequence Number=SeqID_199015
atggcaaaaattcataatttctaccttttaacctgtttggtagtcatgatacctaccttgtatgccaatgtcaaagaggatgaagcatattggaagaggcaaagtgaagtacttcttgttgattcatattggcaggaaagagcatcaattgctgaaaaagagaaccagcaagcttatacttctgacccatattcactcaccaagaacttgacctttagtgttagcgaaatcataataggtgagaagagtggaagaaggaatttgaggggaagaggtggtaaatgcatggcaacaaacccaattgacaggtgctggaggtgtgatcccaactgggcaaacaatcgcaagaagcttgcagattgtgtgcaaggttttggaagaaacactattggtggaaagaatggtccattctatgtggtaaacagtagtttagataatgacatggtgaatcctgctcctggtacccttaggcatgcagttacaagaagtggacccttgtggatcatctttgctcgtagcatgaacattaggctcagccaggagctcattatgacaagtgacaagaccattgatggaagaggagttgatgtctacattgctaatggggctggtattaccatccagttcatcaagaatgtgatcatccatggaatcaaaatttttaacattcaggttggcaatggtggacttattagagattctgagacccactatggttttaggacttatagtgatggtgatggcatttccatctttggctccagcaatgtttggattgaccatgtttccatgagaaattgcaaagatggattgatagatgccattcagggttccactgctattaccatctctaatggccatttcacagaccacaatgaggtgatgttgtttggtgctagtgacagctatgatggcgataagataatgcagatcacattggcattcaaccactttggcaagagattagtccaaaggatgccaaggtgcagatatggttttgtccatgtggttaacaacgattacactcattgggaaatgtatgccattggtggtagcaagcatcctaccattattagtgagggcaacagattcatagcccctaacaacgtatatgctaaagagataacaaagagggagtactcaccggagcaagagtggaaaaactggcaatggagatcaatcaatgatgagtacatgaatggagcatttttcagagaaggtggttctcagataacagacaggccgttctcaaggcaggacatgataacagcaaagcctggatcatacgtgggaaggctcactcgttatgctggaagccttaggtgcattgttggaaagccttgttga

SEQ ID NO: 82238 - DNA, 1001 bp, Glycine max
  Peptide Sequence Number=SeqID_199016
atggctatggctatgcaaagcggaatcggagtctccaagatcctcatcatagcaggagcaggttacaccggcaccgtcctcatcaaaaacggaaaactctcggatttaatcggcgagcttcagggattggaaaaatctggggagcatgctgaaggtgaaggtgaatatgctgatgccatagctgctcaggtgcgtcgcctggcgaatgaagttcggcagctagcatcaaacaggccaatcacagtactgaatgggggtaatttatcatcccttgtcgttccagctgctgccttgggcgctctgggttatggctacatgtggtggaagggaatttcattctcagatcttatgtatgtgactagacggaatatggaaaaagctgttgcagatttaaccaaaaagttgcagcatgcctcagatgtcattgctgataccaagaagcatttgacccagagaattcagaatttgaatgacaaaatgctcaagctgaatgagttgcaaaggtcaactaaggatgaagtacgccttttgccacatacaaatttgatgcttgcacacaactggatcaagattcctttagatgatattgattttgacactctgttgatggatatctatgttgctggagttagaagtactattactaatatccatgaagacttgggttatttgcaacaaacagtggaaacattggattataggttagctgaattgagttctaagcaggattatgcaaattatggattgtcatatctcatcgactatgtacacggaaaaagccagaaaaagcccgaattgttgcagggtcttaaagacattgcagaaacattgtctggtttagacatgtctgcttcagatagtgtcatgccagatggcggggataaacgagagcaacagcgaaggccattgttgaggaagggcattgcaaaaacattgtccagtttagacaaatttgcttcagatggtatcatgctagatggtgtggataaactagagcaaca

SEQ ID NO: 82239 - DNA, 2577 bp, Glycine max
  Peptide Sequence Number=SeqID_199017
atgagggattgcagagaaatttgcttgttcatctgtgtcttatcaatcttgcccttggtatgtttttctgccaactttgttcctacagataattaccttatagactgtggatcaccaaccaatactccaatagatagccgcaatttcacagcggatagtttctataagaatttcctttccacacaacaagatattgttgccagtacctccttgaaatcaatcacttccaccagtgattcgcctctctattcaacagctagaattttcactgcaccctcaaagtacacttttcctattaacaaaaaggggagacattggatccgtctttatttctttccatttgcatatgagaagtacaatttgagtgctgcgaaatttgctgtttccacccagaactataatcttctcagtgactttagtgtgcagaaaaatcctgttatgaaggagtactctctaaatgtgacctcagacacccttgtgatcaccttttccccttccgacaattccattgctttcgtgaatgccattgaagttgtttcggtccctgatgacctcattattgatgatgctaacaccctaaatccagcaggaagctactctggcttgtttgcacaggcactggagacagttttcagggttaacatgggtggtccaaccatctcctccggcagtgacacacttcaacgaacttgggttcctgatgagaaattccttatacaacctaacttggcccgtaattttacaaatataggtgctgtgaaatatgtagatggtgggccaacagaaaatactgctccaccttctgtttatggtactctaacacagatgaattcagccgatgatccccgaagtaatttcaatgtgacttggcagtttgatgtggagcctcaatttcagtaccttgttcgacttcacttctgtgacataatcagcaaaagtctcaatgaactgtacttcaatgtttacattaactcctggtttgttgccaaggatcttgatcttagtacaataaataataatattttggctgctccgttttttaaggatatgattacagccccatctgccagcaccaaaattttcataagcataggcccttctactgtgaatagcaattatcctaatgctattttgaatgggctggaaataatgaaaatgaacaactctgtgagtagtctcagctcatcaacagctgtgcctttgtctagtacttctggttcaggttctaagaaagttggcttgatagtgggtgtgagtgttggggcatttcttgcagtggtcattgttggagttttcttttttctactatgcaggaaaagaaaacgtttggaaaaagaagggcattcgaagacatgggttcccttatcaatcaatgatggaacttctcacaccatgggaagtaaatattctaatgccacaacaggaagtgctgcttcaaactttgggtatcgcttcccttttgtgacagttcaggaggctacaaataattttgatgagagttgggttattggcattggtggttttggtaaagtatacaagggagagttaaatgatggtactaaagttgcagttaagagggggaatcctcggtctcagcaggggcttgcggagttccgaactgaaattgagatgctctctcagttccgccaccgccatctagtatcattgattggatattgtgatgaaaggaatgagatgatattgatatatgaatatatggagaagggaactctcaaaagccatttgtatggttcaggtttcccaagcttaagttggaaggagagacttgagatatgcattggagcagccagaggactgcattaccttcacactggctatgctaaggccgttattcaccgtgatgtgaaatctgcaaatatcctgcttgatgaaaacctcatggccaaagttgctgattttgggctatcgaagactgggcctgaaattgatcagacacatgtgagcacagctgtcaaagggagttttgggtaccttgatcccgagtatttcaggaggcaacagcttacggaaaagtcagatgtgtattcatttggggtggttctgtttgaggttctttgtgctagacctgttatcgatccaacccttcctagagaaatggtgaacttggctgaatggagcatgaaattgcagaaaagagggcaattggagcaaataatagatccaacacttgctgggaaaatcagaccagattctcttaggaagtttggagaaacggctgaaaaatgtttggctgactttggtgttgacaggccttctatgggagatgtcttgtggaatttggagtatgctctccaacttcaagaggcggttgttcaaggtgatcctgaagaaaatagtacaaacatgattggtgaactctctccacaggtcaacaatttcaaccatgaagtaagtgtttctgctgcacaatttgaagctacaagtctggatgatctgtctggtgtatcaatgagtagggtattctcacagctggtgaagtctgaagggagtggtttgtcttctgaacgggtagttctcagcctccttgcctgcttgaggcactttatagacttgtaa

SEQ ID NO: 82240 - DNA, 378 bp, Glycine max
  Peptide Sequence Number=SeqID_199018
actccggaagcctcccgccgtgtcttttgacctgatcggcgagagaaccaccggcggcgtattcgaggaaaatgttctaatactcttctccgttttcaacagtgtgatcatggccgaaacatttgatgacataaggggaagctccaaggcaatcgagtatctccttctcgtttttcagcatagacgaggagtgaacatcggaggatttgacggcggtgggagaaggaaaatgaatggaagtatttgtgggtatggctatgttgacggtggcgaagctgccagtgccgagagagtctccgcgaacccaaatcatggttatgaacagtgtatgtgtgtgttctctgttttggaggagaaagaaaacaaaagaaggaaagg

SEQ ID NO: 82241 - DNA, 1134 bp, Glycine max
  Peptide Sequence Number=SeqID_199019
atggaaagaggtatcttgaagagcaagtttggagtactcaagcttcataaggatcaacttggacaacaaaaattcaagaagaaagagtaccaacaattggacaagccaaaatccttggttgagcgaatctacactcaaaatggaaataggttcaagaacaatgcttatccaggcctcatcaaggagagggaaaggtggtccaagctgactaactttcttatcaaaatcaatgaggaagtggtgcacaaattctatgccaacgcttacctaaggatagatagtgatccaacactacggtccttggtgcacggtgtcctaattaaatatgatgttgtgaccatcaacaagtatttagagaatacttttaaagaggcagtaagccaagactgtgctttcttcctcgtgtgtgcttggaggagtagtttcaacaatactgactttagtaacaaactatgcattctggggagatcctatgtggagaatgatgagggaaagcctctcaggtttaagagatcatccttaagaccattgctcaaatttggaccagctttctcttctccaacattactctcaccatacacacctcaaagcttagcatgtctcgcttatattgtctattgtgtaatgagcaatataggagtgaacattggaagtgtgatttcaagggaaatgcacaagtttgtcatggccaagtcttcaaccaacccaccaaaacctcttggttttccagctttaattacaactatttttgctcatcaaggtagcctatcaacttggactacattgatcaaaattcctacaatcttgttgagtttgatgaagagaaacctctcatccctttcgttattgagcctctcaatcgtgctcaaatggttgttgcctttgtatttctatttcaacaaagtgccaccatcaaccggtccataccaagcctcaatgcttccatctatcacttcctcaaccatgcaacctcaagtgcagccccagcttggtgaccaacccactttcatgaggggtgttgatggcccagacatttcttcaaatgttaaaggagttggactagttgctggaaagggtcagcaagcagaagaaggacccatcaaggaggagattaaagaagaggatgatgattaa

SEQ ID NO: 82242 - DNA, 420 bp, Glycine max
  Peptide Sequence Number=SeqID_199020
atgcatagacccttcttgggaggatgtgcggaaaaaggcccaagtcatccagaagcaaaacactgcccccacgtgttgtctcgtaggggttgcgaatatttagaacaaaagctcatggcagagaagaaaaataagaaattggagaaagctgcccaatctagaatcactgatggcgtcattgaccctccatctcccatcagacgccacgtgaagtggaagatgacccgcacgaagaaaactgggcaaatgacatctgaggcagcaaaggaaatcactgagaagatcgattctttggaggagcaagcgtcacagggatcatttgtcctaactgctgccattgggcgaccagaacaccctggtcatgtttgtgctgctagagccagtgttatcataaagaaatacttcggattggctccatga

SEQ ID NO: 82243 - DNA, 840 bp, Glycine max
  Peptide Sequence Number=SeqID_199021
atgagggacttgaaaactttaaaggaattggtggcaagcgttacagattggaagtcgcttgagaagatgtcttgcaaaccctttaagccttccattttgcatttggcaatatcacaagatgcgccccacttatatagcgaagaacagttgattcaattaaagaatttcagcaaactactctcgagggctgaatcgaagccaaatacaaacaagactgacaagagggtggccaaaaaaagacaaattgaggagaggcctaaagaggaaagaatcatgcccgcaatgattaaaaaaccaagaaaaataatcttggtacagaacggaccatcaccagatttgtccagaaggatagtcttgggacatagtggaacatcatcagatttgccaagaaggataatcttggaacatagcggaccatcaccagatttgcctgtacaattcaagaatcgagtcactgagttgagtggtcatgatcttaaatatttgatgcacaagagactcttctgttcagatgtgaggccgaacaacaatcgtctcatgcccatgaatgagattatgtgtgaatttctcacacaagacgagattgaaaaattggatgaaagaaatggaagcaatggaaaaggacggctggttggtctcgaagtgactgtgttagacccatgtctgagagaatttagtttagcattgaagaagtggagcatgcaaaggactgacacctataacctcgtaacaaattggaataggatcgtatttatcaatgagttcgaagaaggccacgagctccaaatttggtcttttagggttgataacaagctatatcttctactaaacaaactgtga

SEQ ID NO: 82244 - DNA, 300 bp, Glycine max
  Peptide Sequence Number=SeqID_199022
atgaagaggtggagcgctgagatgcttttgcatcaccctttcgttaacaatgaaacggtttcttttcacaaagttaatgagccgttgccgttaccgtctccgtcaccgaggacacactttgatttaactcactgggcttccaccgtaacgacgtggcttccgtcttcccctgattctgatgagtggcgtatggcggaattcgggtcctcgtgttcgccggagaatcggtttcggcggctgctcaccgatcagacgccggcgaattggtcagaatcggatggctggacaagcgttaggtga

SEQ ID NO: 82245 - DNA, 316 bp, Glycine max
  Peptide Sequence Number=SeqID_199023
aaattcaacagccacgatatttaggagtgacgaagacaataattcactagccctttacatagcttcgttttcatctagaggtccgaatctaattacccctaactctctcaagggactaacatcaattgggcagaagaagtcattctcggtcataattgaagggagtattaatacggaaatactctctgcttctctggtgtgggatgatggcacttttcaagttagaagccccatcgtagtgtatggcaaagtagatgttattacatggtctaagaatactatggttccaactaatctccgcgtgatacataattaa

SEQ ID NO: 82246 - DNA, 456 bp, Glycine max
  Peptide Sequence Number=SeqID_199024
atgggagaacaaatgtgtaacaaacaaccaatttctgtcacacaaaaggggggaggtgggactgcaaacgcaattgctattaagatagtgacaaaaaaccgagttgagagaagcttttcattgatatccactggcaaatatgatttctttaaggctaagccttcttttcacgcacttaactgcggtctgataattcatcagacatattccaagaatgatcggaagacttatattgtctacatgggcgaccaccctaagggcatggaccccgcatccttaccttcccttcatatgacaatggctcaaaaagtccttggcagcgactttgaaccagaagctatacttcacagttacaagaaaagctttaatggatttgtcatcaaattaacagaacaggaagcggaaaaaatggcaggaagactaatctgcacacaactagatcctgggacttcttag

SEQ ID NO: 82247 - DNA, 477 bp, Glycine max
  Peptide Sequence Number=SeqID_199025
atgaaaagaggcatattaacgtcaaattctgccatgaatttgggtccaggattttacactacgacgatttatccaccgtggatcctttctgtggctgctagcactatcgacagaaagttcattaccaaggtgcaagtggacaacggcatggtttttgagggggtttcaattaacacttttgatctcaaaaggaaaatgtttccaatggtttacgctggagatgtacccaacactgccgatggatacaacagttccatatccaggctttgctacgataactctgtggataaacatttggtgaaaggaaaaattgttctgtgtggtggcttccagtctattggacatgttgaggttttgtctggggaagctgggatgcttgttggaggccctgctgcaaaagatgtgcaagcaacatttgcactagtgaaagccagagcttggaacaagcaaaaattggctgcaaaattgaggaactga

SEQ ID NO: 82248 - DNA, 1482 bp, Glycine max
  Peptide Sequence Number=SeqID_199026
atggagttcacgaaggggcatggtatttgtacagatcaaaatcttgaatcagctaaaggggaaaagggagagactagagaagaaaacaagatgttagagttctatggaatccttcatcacgataaacctgatgatgctacaaatgctaaaggtgtgtttagccatattgaggaaaacgaagaaagtgaacttgtgtcactttctcttgggatatcaatatctaaaggcaagcctagcaagaatgagaaaatgattaataatggaattgaaaagagagaagatgaggatgtgcataaacgacttgtacttgggttagatatcaatttggaccctgtagatcaagatgaattagctgcaaataattccacccctgaaagtagctttggtgagggagggaaggaagatgaaccaactgagatgtggccacccagtaaagtttcgaagacaatgaaaagtgaggataaaagtgaagcttcaccacattatcagcccaagaagactagggtttctattagagccagatgtgatacccaaacgatgaatgatgggtgccaatggagaaaatatggacagaaaatggccaaaggaaatccatgcccccgagcttactatcgatgcactgcttctccatcttgccctgtaagaaagcaggtgcaaagatgtgctgaagacatgtccatattgattaccacctatgaaggaacacacaatcaccctcttcctatgtcagccactgcaatggcctgcacaacttctgctgcagcttccatgcttcaatctccctcattgagttcacaacatggactagtcgattcagctatatcctccatcatcaactccagtgctgctaattactacaatcctaataatgctctaaacttctccacacaccaagtttctagaccaaaccaattctacttctccaactcatccatttcaaccttgaattctcaccctacaatcactctggaccttacagcacccccaacttcctcaaactcaagcttcactcacatgccaaaatactcatcaacaaacctgaatttctcctctggtttctctcctctacattctagcatgcctcaatcaccttggagcagttataattacttcaattctggaacactttctcaaaatagaaaacatggtggtaattacttgttaaacactggaaatcaaaatcaaccacattctttaggaaatctccatcaacctatttacatgagaagcaataccatttctcagcattctttgcctgatcccattgttgctgcaaccaaggcaatcacaagtaacccaaagtttcaatcagcactagcaactgctctcacaacatatgttggcaatgaagctggtggtggtaggttaagagaaaatcatgttcttgagagtgcagaactgatgaacttaaagctatgtagtgaaaatagcataggaaactcaagtatagttcaactaccactactggagcaatggaagtga

SEQ ID NO: 82249 - DNA, 654 bp, Glycine max
  Peptide Sequence Number=SeqID_199027
atggcgttcaaagtggaccatgaatacgattacctcttcaaggtcgtattgattggggactccggggttggaaaatctaacatcctttccagatttacgagaaatgagttctgcttggaatctaagtctaccattggggttgaattcgcaaccagaacattgcaggtggaggggaagactgtgaaggcacaaatatgggacactgcagggcaagagaggtacagagccatcaccagtgcctactacagaggagctgttggtgccttgttggtctatgacataaccaagaggcaaacatttgacaatgtgcagaggtggcttcgggaactacgggaccacgcagactccaacattgttatcatgatggctggaaacaaatctgacctgaatcatctgagagcagtgtctactgaggatgctcaaagtttggctgagagggaaggtttgtcctttctagagacttcagcattggaggcatacaatgttgataaggcatttcaaaccattttgtttgatatatatcacattataagtaaaaaggcactggcagcacaagaggctacttcctctactggccttccacaaggaactaccataaatgtctcgaatatggctggtaatgccggcggcaatagaagttgttgctctaactaa

SEQ ID NO: 82250 - DNA, 1944 bp, Glycine max
  Peptide Sequence Number=SeqID_199028
atggcagaaatggacaacgttatctctgttttcccaaacaagaagaatcgtcttcacacaacaaggtcgtgggacttcgtgggccttcctcagaatgtgaaaagagcaaccacagagagtgacataattgtgggagtattagacacgggagtttggccagagtctgagagcttcagtgacaaaggatttggtcctccaccaaccaaatggaaaggatcttgtcataacttcacctgcaacaacaaaataattggtgcaaagtacttcaatctggaaaatcactttaccaaagatgatatcatatctccaagagactcgcaaggtcacggatcacactgtgcatccacagttgctggaaactcagtaaactctgcaagtctatttggatttggctcagggactgctcgtggaggagttccatctgcccgaattgctgtgtacaaagtatgttggctcacagggtgtggtgatgctgacaaccttgcagcatttgatgaagctattagtgatggagtagacatcatttctatttcaactggagcctctggaatagtacacgatccttattttcatgattcaaataatataggaagtttccatgcaatgaaaagggggatattaacctcaaattctggcaacaatttgggcccttctctttactcaatgacaaattatgcaccatggttagtttctgtggctgctagcacttttgacagaaagattgtcaccaaggtgcaattgggcaatggggctatttatgagggagtttcaattaacacatatgatcttaagaaaaaattctatccactggtttacggtggagatatacctaatattgctggaagacataacagctccacatccaggtattgcgtagaggactctttggataaacattcagtgaagggaaagattgttctgtgtgacctaattcaagctcctgaagacgtggggattttatctggggcaactggtgttatatttggaattaattaccctcaagatttgcccggaacatatgccctacctgctttgcagattgctcagtgggatcaaagactcattcattcttacataacttcaaccagaaatgcaacagccacaatatttaggagtgaagaaataaatgatgggctaatgcctttcatagcttcattctcatcaagaggtccaaatccaatcacaccaaataccctaaagcctgacattgctgctcccggagttgaagttatagctgcatggtctccagttgcctcactttctcaatttgagggtgacaaaagagctgtacaatataatgtaatctctggcacttcaatggcctgccctcatgctactgcagcagctgcatatgtcaaatcatttcaccctagttggtctcctgctatgatcaagtctgcgttgataaccactgctactccaatgagtcctattcttaatcctgaagctgaatttgcatatggagcaggactaattaatcctgttaaggccgcaaatcctggtttagtatatgatattaacgaagcagattatatcaagttcttgtgtggagaggggtatacagataaagagcttcgaatcctcacagaagatcatagcagttgtagtggacgagctaacaagaaagctgtatatgaattaaacctcccaacatttgctctttctgttaatggcttagattatagtcgtgcttatcgaagaacagttacaaatgtgggatcggcaacatctacttataaggccaaagtaattgctccatccttgttcaatattcaagtgaaacctagtactctttccttcacatctataggccagaaaaagtcattttacgtcataattgaagggacaattaacgtgccaataatctctgctacattgattttggatgatggcaagcatcaagttagaagcccaattgtagcctacaaggcaccaaataattga

SEQ ID NO: 82251 - DNA, 774 bp, Glycine max
  Peptide Sequence Number=SeqID_199029
atgatgttgaataaagagagtgagagagcagttgatatgtttcagaggctggaatctgaagggttgaagcctgattcagctacttggaattccatgatcagtgggttcgcacaactaggggtgtgtggagaagcttttaagtactttagggaaatgcagtatgttggtgtggctccatgtttgaaaattgttactagccttttgtcagcatctgcaaattcatctatgttacggcgtggaaaagagatacatgggtttgctttaagaactgatatcaacagggatgatttgttggcaactgctctggttgatatatacatgaaatctgggcatccttcttgggcacgaggagtttttgatcaatttgatgcaaaaccagatgatccggcattttggaatgcaatgattggtggccacatgggtcaggttgatagagggttgcattttttcagaatgatgggaaaagagtatggcttgcagccaaagcctgagcattttggttgcatagttgatcttttaggtcgatctgagcctcctgtatctgtttttgcttctttgcttggtgcttgtaggtgttacctagattccaatcttggggaagaaatggccaagaagcttctagatatagaaccagaaaaccctgctcctctggtggtattgtctaacatatatgttgggctgggaagatggaaggaagtggaaagaataagagggatgatcacggataagggactggacaaactctctggctttagcatgatagaacttgcatga

SEQ ID NO: 82252 - DNA, 1242 bp, Glycine max
  Peptide Sequence Number=SeqID_199030
atggcactttcttcagccgaagatttaaagagaccaaacggatataattggggagaagacaccggtgatgattactcaaaggcacctcacgatacccttaactcatctgcacaccctccatttgcccctacaccattttatccccatccccacaaatatagaagagtatgtggtggctgcaaccaagagataatgtatggaaattgtttgggctgcatggatacttattttcacccaaattgttttcgctgtcactcttgtggttaccccattaccgagcgcgagattcctataaatgctgctggtttgattgagtataggtgccaccccttttggtcgcaaaagtattgtccatctcatgagtatgataatacagctcgctgctgtagttgtgaaagattggagcctctgaacataaaatactatagactagaagatggacggagtttgtgtttagagtgcatggaatctgctataatggataccggtgattgccaacccctataccattctatcagagactactatgaaggaatgcagatgagaatagatcaacaagttcccatgcttctagttgagagggaagcactgaatgaagctattgtaggggagaaaaatggttttcatcacttaccggaaacaagaggtttatgcctttcagaagagcagactgtcaccagtatacatagaagaccaagaattggaggccatcgactaatagggatgagaactcaacctcaaaaactgactagaaaatgtgaagtcacagcaattcttgttctatatggtcttcctaggttactcacaggtgcaatacttgcccatgagttgatgcatgcatggctacgccttcatggttatcgcaaccttactcccgaagtagaggaaggcatttgtcaggttctttcgtatatgtggcttgagtcagaagtaatgcctagctttcaaaacatgccatcaacatccacaagtgctggttcttcctactcttcttcctcctcctcctcctcctcgtcgtcctcctcctcctcaaagaagggtgcaaaatctcatgttgaaaataaattgggtgaatttttcaagaatcagattgccaatgattcttccccagcttatggtggtggctttagagctgctaatgaagctgtcaataaatatggtttgcgtagaacacttgaccatattcattggactggttttttcccagtggaaaaagaacgcaagttctctaagtatggatag

SEQ ID NO: 82253 - DNA, 798 bp, Glycine max
  Peptide Sequence Number=SeqID_199031
atggaagctagggttggtgtggcggtggatggtggtggtgtacggaagttggtgcagccgccgccgccgaaacatattgggactgtttctcagcttcttgccggaggagtcgccggcgcgttcagcaaatcctgtacggcgccgcttgcgagactcaccatcctctttcagattcaaggaatgcattccaatgttgcaactttgagaaaagccagtatatggaatgaggcttcacggattatccatgaagaggggtttggagctttctggaaagggaatctggtcaccattgctcaccggttaccttattcttcggttaacttttattcgtacgagcactacaagaagttgctaaagatggttccgggacttcaaagtcatagggataatgttagtgcagacctttgcgtacattttgttggtggtggcctggcaggagtcactgctgccacaactacttatccattggatcttgtaagaacacggctggctgcacagagggcgagccctggtgcagcggtaaagttgtgccttggtgacttgttggtcatgggttcgaatccggaaacagcctctttgcatatgcaagggaagcaacttgagggggctggtgggcgagcccgtgtgtatacaacaggcctctatggtgtgtttaggcacataattcagacagaaggggttcgtggtctctacagaggaattctgcccgaatattacaaggtggtgcccggtgtaggtatttgttttatgacttatgagacgttgaagatgcttttagcagatattggtactgcataa

SEQ ID NO: 82254 - DNA, 318 bp, Glycine max
  Peptide Sequence Number=SeqID_199032
atgaaggaagtgttgtttgaaacacccaaatggaagccaaaattcaaagcggagaagccaatagagagcaatgttgagaaccaaaaggagaagttgttcgtcaaacccaatttgatttttgaggtttttaaagtttgtagtgtaagtgagagcgtgtgcacactcgtcgaagaagaaacacatcaaatggtcaacagatctctgacaaaggggcagagttcaacgtcgttgtttcaagcagggaagagtttgctggatctcttgctaaatcatcaaaatggcaaagtgaaggtggctcgggttaagccacgaccttag

SEQ ID NO: 82255 - DNA, 282 bp, Glycine max
  Peptide Sequence Number=SeqID_199033
gtaagtcttatgcaaaacttcgaaacgattgcgtttaaggcagaggatgcggagctggatgagggtggtgagggggagaatggagccggtgaggttgaggtcttcgaggacgaggcgggagacgcggtggtggttgtggttgcggaagtaggagatgccgtgtcggggtttgaagccaatgaagtagtgggtacaaaaattctggtgtggctttggttttatggcattgagtccatggcggtgttggggttggctaatggtactgtgttgtttgtgatttaa

SEQ ID NO: 82256 - DNA, 231 bp, Glycine max
  Peptide Sequence Number=SeqID_199034
atggcgagggttcgcagcgtaggcggatgtgagggcggaagaagcataagggtcggaatggaaaccgattttgaggagatgggcatggagggtttgggtgtgggaaggggaacggaggttggtgcatgctttgaagagagtggggaatgtgaaggagtgaagggtgggggaaggttgcatgttttgttgtgtccatgcaactctgatttgactctggtcgcgactaaatga

SEQ ID NO: 82257 - DNA, 1359 bp, Glycine max
  Peptide Sequence Number=SeqID_199035
atgaaggtcaaagttatatcacgctccgtggatgagttcacccgagagcgaagtcaagaccttcagagggtgttccggaattacgatcccagccttcgtcctcaagagaaggcggtggagtatgtgcgtgctgttaatgcggtgaagttggacaagatatttgcaagaccatttattggagcattggatgggcatgtagatgctgtttcgtgtatgacgaggaaccctagccagttgaaagggatattctccagttcgatggatggagatattcgtctctgggatttagctgcaagacggacagtttgtcagtttcctggtcaccgaggtgctgtacgaggcttgacagcatctacagatggacgcattcttgtgtcatgtggaactgattgcactatcagactctggagtgttcctattactactcttatggagtcagatgactcaactaagagcactgttgagccagcaagtgtttatgtttggaagaatgcattttggggtgctgatcaccagtgggatggcgagcattttgccacagctggtgctcaagtagatatatggaatcacaacaggtctcagccaataaacagttttgaatgggggtcagatactgtaatttctgtccggtttaatcctggagaaccaaatctgttggccacctcagctagtgaccggagcataattctgtatgatttacgtatgtcttccccagtgaggaaaatgataatgatgaccaaaacaaattctatatgttggaacccaatggaacccataaattttacggctgcaaatgaagatggtaactgctatagctatgatgctaggaagttagatgaagctaaatgtgttcacagagatcatgtttctgcagtgatggatgttgactactcaccaaccggacgggagtttgtcactggatcttatgatagaacagtgagaattttccagtataatggtggtcacagcaaggagatttatcatactaagagaatgcaaagggtatttgctgtcaagttcagtggtgatggaagttatgtgatttcaggaagtgatgacactaaccttaggctttggaaggcaaaagcatcggagcaacttggagtaattctcccaagggaacggaagaagcatgagtatcatgaagccataaaaaaacgctataagcacctccctgaagttaaccgtatcgcaagacatagacacttgccaagaccaatattcaaagcttctgctttaatgcgcgttatggcggatgctaagagaaggaaggaagagaagaggaaagctcacagtgctccagggagtattacaacacagccattacgaagacgaagaattatcaaagaagtcgagtga

SEQ ID NO: 82258 - DNA, 399 bp, Glycine max
  Peptide Sequence Number=SeqID_199036
atggcgttgctggcggccagtggcggcgacaccgtcaaactcttcgacgcctctgccgtcaagcccggcgtatacactcccgccggcgatccctgcgccctcagcttcaccccctctcccggttcccaggtcaattcagtcaagtggaaccacaccaatttggtcgtggccagtgctggagatgataagaagatctctctttggcggaagaatggaaatagcatggggaccattccggttgccggcactgatagtggagacagcattgagcaatacacttgctctctctccatgagacaaagctcagaagtctttttacattctacaaacttaaaacgacaacggcttttacttcattacacacctgtcttcaagggagtttctgattctatagcgtag

SEQ ID NO: 82259 - DNA, 2223 bp, Glycine max
  Peptide Sequence Number=SeqID_199037
gaatctatattggccatcagcttcagcaacaaggcatccagatatgtgtgttcaggaggaactggtcaagttgtaaggatatgggatttgcaaaggaaacgctgtattaaatggctaaagggtcatactaatactgtcacaggtgtaatgtacaattgtaaggatgaacatttggcatctatcagccttagtggtgacctaatgcttcataaccttgcttctgggcaaaaggctgcggagctcaaagaccccaatcaacagatgttgagagttcttgattattctcgagttagtcgtcaccttcttttgactgctggtgacgatgggacagtacatttgtgggatacaactggtcgcagccctaaggtttcatggataaagcagcattctgctccaactgctggtattagcttctctccatccaatgataagatcattgctagtgttggccttgataaaaaaatgtacatttatgattctggatctagaagaccatcatcttacatttcttatgaagcacctttctcttcgttggcatttagagatgatggttggatgctggctgctggaactagcaatggccgtgtggcattctatgatgttcgtggaaaaccacaacctgtggctgttcttcacgcttatggtagttctgagccagcgcagtttaatccattgaaggagatggtgcttgatgacatgcgagtatatatattgagtactgtgattagtgataattttggaacagtgagcatgcaacaggctgttacaagcttatgctggcaaaggtctaaaccagttgttgttgatgaaagaaattgctctgcagagactgctcttgtgggagatacagttgaagattcaatactaatgcctgatcctttaccttctgcaacttcatcaaacaattctctttctacatcagtgtcaagtactaggaactctggtcggctgggtgcctcctttgatggttcttcacttacggcatctggcagtggttttacatccaacatactaaatgtatctactgccgaagaaactccacaacgaaaccatttatggccaggtggaaccctgtccaggttgcatgctccccgtgctagttataacttcaaggatgacatggaggtcttctcccctcttgtggatgttcaaccattagccccctcactatgggatgaaaatgggataaagaaggataatttatttgccgataggaaacctttgttgtttccgtcatctagtcgaagattttcaaattctgaggatgtaaccagtgatcatccagtatctgattggaaatctggctcaactgccaagcaggatattgctcagtcttcctttccacttgtggggtcaactcctcctccatcttcaaagaatgaagattcttctatcactcctccagaagcttggggtggtgagcggttaagtgataaatatgcttatacacgtcagcctgtcaatgcaccatctcgttttgggatgttggcttctgctggtcagacagcaggatcaatgttatctggattgcaggatacatcctcatccgtgggtgttagttcctataccagttcaagcctaagttttgctaatttacgtgccaaggatgcctcttcaagccaggaaacttccttggggtttactgatcacatgttctctacttctttgccgatgtccatcaatacaaaaaccagccttggacaagcaattgattccccaaaaatccttgattccccaagaatgtcatcttttaatcgaagattttctacttatgcagaaagaataagcactacatctaccttgagcgatggagtgtcgctttcagttggctcacctaagattaagaaatcaggagcagaaaccagagaagaacttctaaatagcttgctgttgaagtctgatatatctgctccaatagaatctggctcattaccactgacaagtggagtaatctcacagccgaaagcatctcagccagatgcacaaggatcttcatttacacttcagctttttcaacggacccttgaagaaactctggattcctttcagaaatccatacacgaggatatgagaaaccttcatattgaaattttgagacagtttcatatgcaagagacagaaatgtcagctgtaatgaactctattctcgaaaaccaagctgagttgatgaaagaagtgaagtctcttcgtcaggaaaaccagcagctcagacaaatgctttga

SEQ ID NO: 82260 - DNA, 1758 bp, Glycine max
  Peptide Sequence Number=SeqID_199038
atggggaaaggaagaagtcctgggaaatggttcaagaacttactcttggggaagaaatcgtcgtcaaagtctacttcatcaaagaagaatgatatttttaaaccttctagtgacaaggatgcgctggtgtcgtctgaggtgcccgtgtctgatccaaccgttgattcgttgcagatatccgcaccaatatctggagctaatgattctaaaggagtgctttccgaaaaggaggtagttagtaggtcatcacatgatagggatgttctttcaactggagttgaagaagctaaggtgcaagatgttgctaattttggatctcaagaggatcttgagaaactccagcttacagaagcagctataaaagttcaggctgcttgtagaagctatctggctcgtcaaacatttaaaaaactcgaaggtgtcatacaactacaagcttttattcgtggccacttggttcgaagacaagctgtttctgcattatattgtgtgaagggaatagttaaatttcaagcattggctcgtggttacaatgttagacgttctgatattgggcttgcaatccaaaaaattcgtaaggatacccattgctcaaattctgttcgggtagcttcatccacacaggcagagaagctgtctgaaaatgtctttgtttgcaagcttctggcttcatccccatatgcagttcctctatcactcaacagtgatcctggagaacctaacatggttcggaagtggcttgactattggacaaggtcacacttttgggcacctcttcctgaattagaaaagaaacttggctcagcgtctgatgagaaaaatggcagttctcagacagttcaaaaggggcaaattaaaaaaattactcggaaatatccggctgtgaaagctaagaatggctcaaatttaggttctaacaaatctaaacagtgtccaaaaaaggattcaagccacccattgccttcagcgcaggaacacccacagaaagaaacggagaaaagtagttttgaaaagactcacgcacataatgtttcaaatggatctgaggttgttagtgaaaaaaggaaatctggcaataaaaagattttggatcatgctgtcactgatgtttcagagcagggcccaaatgcctcttcagagaaaaagaaagatttgaccgtgccaaagtcaaaagagtctgatcctgagaaaggtgatggacaggaagcaaaagacaagaatgataatgagctacatcgttaccctgttgccgtcttaaagacaactgtgatgaagggtgaaaacgaaggatatcaaggagtcagtgagaatttgaatggtggtgacaattgcatgagtaacaatagccaaagaagagcttcattacctgctaactttaatgatcaagagaatgagttatataacactcctgttactccaagactgccaagttatatggctcctactgaatcagcaaaagctaggctaagaggacaaggctctccaagatttgctaatgatttggtagacaaaaacagtacaaccaggcggcattcactttcatcttcacttaatggcaggtcaggttcattttccccaagagctgaaaagctgataggcgtaagcggcagaggagggataaagtctgatagatctctgtcatcttcaagggatgggactggtttttccaatccaagttgcattttctcttcacccttgcaaagcaggaattccactagttgtaatactcataggaatgaatacacaaaagcaatttaa

SEQ ID NO: 82261 - DNA, 2199 bp, Glycine max
  Peptide Sequence Number=SeqID_199039
atgaagaatttcttggtttctttgtactacttgtttcctgcaatcattgcaatcattcttgtgctgctcactccaattccaagtgcacagctaacgacaagtgagaacagaatccttctccaagttcagaagcttcttgaataccctcaagctcttcatggatggaccaacttgaccaatttctgctccctcccttcctctccttctctcaatattgtgtgctccaatggccatgtaaccgagttaactgtcgttggaaattcatctgagactctctcagaaagattctccattgagtctttctttactgtcttgacaaagctctcaaatctgaaggtgttgtcattggtgtcacttggtttgtggggtcccttgccctccaagattgacaggttctggtctcttgaagtgatgaactttagctcaaacttcatttatggggaaatcacaccttcagtgtcctctttgaagaatctaaaaagtcttgttttggctgataatcttttcaatggaagtgtgcctgatcttggaaaactagcttctcttgaagagctcaatttgagtggcaacaaattaggccctgagttcccttcattgagcaagaatcttgtgagggttatcttgagaaacaactctttgagatgtagaatccctcctcaactcatgcatgtttataaacttgagctgtttgacatctcttccaatgtgatatttggaaatatcccgtcatttattttctctcttccttccctcaagtacctaaagttggcttcaaaccaattaagtggttccctttctttgaatgtgtcatgtagttcttctctgacttttgttgatatctcacacaacctcttggtgggaacattgccatcttgcgttggttcaaaggcttcaaaccgaacaacactttattatgggaattgtttgataaacagaagcttaagtgatcaatatccatcttcttattgccagaaagtggaggccttagctgttattaagccatcaattaaaagccagaagaaggaaccagagatgcaactaggccaaattcttggtattgttggaggtgttgtgggaatttccgggcttctggctcttctcatttggtgcatcttcagaaagtccaaaccagaaaaagcagacagtgattatagcatagacatctctgctccagataatttctctgtccgtgcttatccaagaccaaatattaatgcaagacgtcctcctctaccaatgaggcaaccttttcttggattcccaccatactgcattttctcattagaagaaattgaagatgctacaaacaactttgacccatcaaatcttatagcagaaggatcacagggacagctatataaaggttggcacatagatggttcaatggtcatggtcaattgcgtgaaactaaagcagaaaagtttatacaaaaacagtattcagagcttgaaggtattgccctatttaaggcacaggaatttggaccgtccccaaatgataagcacagtattcattgtatttgaacatgtctcaaacgtgtcattgagggattaccttgcagataggagaaaaagggaaatgctgaaatggccacaaagaatggaaatcagcataggcattggaagaggaatccagttcttacacaccagagttcatcctggcatatttggcaacaatataaagattgagaatattctgttggatgattgtctcaacggaaaagttagtggatacagcattccatggccgtccaagaaaggtcataacagcaaactttgtgaacaaagatccactaatcaaattggaagcattgatgatgcagaaaaggaagacatctatcagtttggtgttattctacttcaagttatcactggcaaactaattacatcttccagtgaagtagaggaggtgaaggatgagctggagagaggtttagcagaagctgcatcaccatctctgaggggtgcatcaccatcactaaagggtacatcaccgatactaaagggcgtgttcgattcttccctccgggagacttgtgtgtatgaatcattgaagactgcagttcagatcaccatcagttgtctcagcaaggtttcaagtaatcgcccttcaatagaggatgttctctggaatttgcagtactccatgcaagttcaagagccaaggaccagcggtgtacacctcttttcaaaaatgtaa

SEQ ID NO: 82262 - DNA, 570 bp, Glycine max
  Peptide Sequence Number=SeqID_199040
atgtccactccagcaaggaagagactcatgagagatttcaaaagattgcaactagatcctcctgctggcatcagtggggctccccaagacaataatattatgctttggaatgcagttatctttggaccagatgacaccccttgggatggaggcacatttaagctaacacttcagttcattgaggattatcctaataaaccaccagcagtgcgctttgtttctcaaatgtttcatccaaacatttatgcagatggaagcatatgtttggacattttacaaaatcaatggagtccgatttatgatgttgctgcaatacttacctcaattcagagatggaaaagagctaagtacaagataagaggattagatatcctccaaaagcctagagcttgctttgtgatccaaacccaaactctccagcaaattcagaagctgctcggatatttagtgaaaacaaacgtgaatacaacagaagagtacgagacattgttgagcagagttggactgctgattaattatcttggagcctctattgctgttaaaaggttgtcaaaggatctgattgaataa

SEQ ID NO: 82263 - DNA, 369 bp, Glycine max
  Peptide Sequence Number=SeqID_199041
atgatgttggtcaaccatagtggtcagattttaccactccccaatgagctgatagtgagggcttatgtgttgtggtcaggggtatcaaccttagttatgtcatggtaccctgccacaaacaagggcttcgtgaatgcccttatggaggggattcaaatggtgtcaggctccatgcagagcttgctagacctcaaagttgtgctagagggaacaagttatcatcagaccatacaacaagctctgcaattgctacagggaggctttgaagttgggtgcagcttagagaggcaaagcaagagggtggtagaaaggtgtgtttcgtttacttattttttgtgttcatcgactgttgaaccaatacgcacctag

SEQ ID NO: 82264 - DNA, 162 bp, Glycine max
  Peptide Sequence Number=SeqID_199042
atggcgcaatggccaccatggcagaatgatggatatggcaatgtcctctcatttgttactgttagaggtgcttcccatgaagcctctttctcaacacttgaaagatcacttgtcctattcaagtcattcttagaaagcaagcctttacccgatgctttctga

SEQ ID NO: 82265 - DNA, 207 bp, Glycine max
  Peptide Sequence Number=SeqID_199043
atggataacacaattttgtggagaaactatgtatgtccaagccaccttgcagagaagaatcagacattgttgaaggtagaatggaagtttgtgaaaggggtagacacaaatggctccaattcccatggagaaactctatcaggatgcaaaatagatgatggtgactgtgtaattgcacccaccatgtttagtgctatgcaaggttga

SEQ ID NO: 82266 - DNA, 117 bp, Glycine max
  Peptide Sequence Number=SeqID_199044
gtttcacatattaatgagatgtactttgctataacactggatcatacgagtgttggtctaattataattgcttgtagtaagggaggaaccagcattgaagaccttccagagaattaa

SEQ ID NO: 82267 - DNA, 411 bp, Glycine max
  Peptide Sequence Number=SeqID_199045
atggcacgcagagaccaagtttggtcattctgcacacatgatacgcggagataccttacggttatccgcacccctttgccattcagacacagtcgtgtccgttggcacgcagagaccaagtttggtcattctgcacacatgatacgcgggagataccaaaacggttatccgcacccctttgccattcagacacagtcgtgtccgttggcacgcagagaccaagtttggtcattctgcacccatgatacgcggagataccttacggttatccgcacccctttgccattcagacacagtcgtgtccgttggcaagcagagaccaagtttggtcattctgcacccatgatacgcggagataccttatggttattcgcacccattcttttgctatctgtaagacagaacgcttga

SEQ ID NO: 82268 - DNA, 150 bp, Glycine max
  Peptide Sequence Number=SeqID_199046
atggatggctatgctaaattgcggaaaaatgtagtccatgcgtctgcaatgatggttgcaacaagtttgcagagtcctaaaaacttgacattttggccaaaccaacctgtcatagtcttcctgattccggtgatggcaggatgcgtttga

SEQ ID NO: 82269 - DNA, 358 bp, Glycine max
  Peptide Sequence Number=SeqID_199047
ggaggcagtggtcatgttgggggatgtaggaggagagtttgcggaaggtggaggggacaagaggagtggagttgaggaggagagtatcgtgggaggggagggtgcgggtggcgaggatgtcgaggagggtggattttctggcgccgctggggcccaccgcggccaggattttggaggggagggcggtgagggagatgtctttaaggatgcagcagattggtggggtggtggtgcatggggtgaagaagagagaagtaaattagggggtgtttgtggtggtggtggtggtggtggtggtggggaatttgaggggtcttccttggaaggttggagtgagcgtgaagagctatggacgaag

SEQ ID NO: 82270 - DNA, 282 bp, Glycine max
  Peptide Sequence Number=SeqID_199048
atgtcttctttgcgcttgtgcttacaagttaaagagaggactatatcgggagattcatactatggctctcacgtgatgcagtatggtgatgtagggcttagcagtgatgttctcttccattatttgggtatagatcctgttaatgataatttcacttttgtgaacaaaaactccttatggtcaccttcaaaaccagtcaaccaatgtgatgctgatctcatccatttttgggataagtgtttgatcatgtcatcaccagtgacaaccaatgaacatatgtga

SEQ ID NO: 82271 - DNA, 243 bp, Glycine max
  Peptide Sequence Number=SeqID_199049
atgaaactaccaaaagatactacacaatatctgcataatggtgtagaatggatatttaacatacctatacaacaactggagaaagctaggggaggtgtaaccggcaaaggcagtggcttcgatgagaacattgacgatggcatatttgaggatgttccaacaattgggagaggcggcggaaggaggaggggaagcggaagcaacattggtgcagaggaatggagaagagggcacacacactag

SEQ ID NO: 82272 - DNA, 803 bp, Glycine max
  Peptide Sequence Number=SeqID_199050
atgcgcaacccgttcaacttctcctttcgcgctgaaccctcttgccttcttctaaccctaagcgtgggctttcgcaacacccctagaacttccgaatcaaggactgtcagcaagaagcacaacagctacaactgcggccgttgcggcctccctaagaagggccatgactgcaccggcaagaccgctcccactcccacctccgcttcttccgccaccccttcccactcctctttctccgccgtttccgctccttcctccggctccgcctcccgctgcccgctgtctcacttccgccgcgctctctccttcgacgaggacgaagctggcaggctcgacctgtcggagcccgtcgatgtgcggtctgaagaagatgatctggattcgtttggtttgttggggaatcttctatggagtttgtggagaacggcggaggagttaaggattagggttccagcgtgggctcaggtgggttttgtgtcaattttgaagaagtgtccggggatcgtgaaactctcacttaaaagggaaaggtctgtggttgaattgggctttggaaatggggtagttgataatattttctttgtccctgggtatagtatcaatggatttgttgttgctcaggtcctcgtgaactttatggaaaaggcagtacgatttgatgtggatttgaatcaagttgaagtcaagtatcacttagaagttgagaatgtgaatgggattcaattacaaacagttctggaggcaatggatgtagttggtattctagagtatgggcttgctaaagttgctgatttgatgatcaa

SEQ ID NO: 82273 - DNA, 249 bp, Glycine max
  Peptide Sequence Number=SeqID_199051
atgtcatatattccaattttgagaagcgttttcgtgccattttcagcatatgtgcacatttgcaaagcatttggctacctattcaacatacacatgtacatggtgaacaacattttcacaccatctatgtacaaagaaatcatcatggtgcagcctaaaccaagtgctggcactaaggggaaaccttaccaacatgctctcactttcatgccttcttgcatttcaaaaatcaaaggcttgggtccctag

SEQ ID NO: 82274 - DNA, 300 bp, Glycine max
  Peptide Sequence Number=SeqID_199052
atgtacatccaaaaaagggaaggaattgaaagggaacaaaacatactttctagctggctacactattacattaattttagaagaaataataaaaggatagctcctcaaactagcactattggtgtgactcctccaactagtcatacctctctttcttttgtgagaatgcctccaaaatcaattgcgaatgaccttttttttggtaacaattttgcgagtgtcttggtctgctatgcctcatggtgttggttgagcccaagagttcccccaaacacttcattgaagaaggctaaattataa

SEQ ID NO: 82275 - DNA, 228 bp, Glycine max
  Peptide Sequence Number=SeqID_199053
atgaatggccatcgtcgaggaccaccgttgatcaaggggaaacatgcggtcgtagttgtagacgtcggcgacgaacaaggagagcttcttcacgcgaaagatgacgaagaaacgagtggcaatttctttgggttgttgggatttaggtttggacagtggatctggagaagaaagagacaaacagttatcggatgctggctggtggttgttatggtgtttggtgattga

SEQ ID NO: 82276 - DNA, 1044 bp, Glycine max
  Peptide Sequence Number=SeqID_199054
atggatgcttgtggcatccgtcatgctattttgtcactgacatcgccgggggcgcagtcgattcttgatgttgctgcagcaactcatttcgtaacctgcaccaacgactatattgccgaatattttgttcagcctcatcccgatcgtttcagtgcttttgcaacagtggcgctacaaaatcctcaggcggcagcggatgaactggaaagggcggtgaaaaagctgggtatgaagggggcattgatcaacggttataccaatatgagcggcaccgaggaagggcgctatttggatgatcctgcggtagaagtattttggcagaaagtgagtgaactgaatgtgcctgtctatctgcaccccagagagccactccctgccgcctgtggaatttatcgcggctatgaaagcttggtaggttcagcctggggttttgcaacggaaaccgcagtacacgctattcgtctgatgatgagtgggttattcgaccgctatccgaatattaccattatccttgggcatcttggggaggggctgacatttatgttaccgcgcactgcccatcgtctggaaaaacagtttgagggcatcggtctggggggcaaccagcagcccttaacggattacctgacgaataatttctacgtcacgacgagtggtcacttcacaaccagtgccctccataatgccattgaagtgatgggaaaggatcgggtcatgttttctgttgattacccttatgaggatatgtgccaggcggctgattggttcgatccattagtcctggacgccgacgttaaacaaagtattgcgtacggcaacacatggaaatgcggccgcacaccaggcggcaacttgtccgggaaccgtggccagcaactcagtactggctacaatgttccctacgcccaagaagctagggagcaacattttggttcgcagttgaataccgctgcgtgccaggcggggaaccagagcaatttggcttatatcagccattgcgatagtaaagcttcgctgactggtgcggggatcgaaaggcaatga

SEQ ID NO: 82277 - DNA, 403 bp, Glycine max
  Peptide Sequence Number=SeqID_199055
atgcttccaaaacccctttcacaaaaaaccccatcttccatttctctcaaagttcgatgctttcgagcttctgaacccatccctcttccctcttcttctcctttaagttccgttctctcgtcacgttcccccaaacgtgtctctcgcctcttgaggtccgaagctcaacacgctctaatggattacatgcattccacgcgtggctacactttctccgacgccgagtacatcagcgagaactcaccacgttttattgaatcattggtctcaatgattgacgacaaagatgatgttcttcggtcgttggaaagattcctcaggtacaaccccattaacgagtttgaaccatttttcgagagtttgggaattgacccttctgagttgtatttgtttcttccccatg

SEQ ID NO: 82278 - DNA, 912 bp, Glycine max
  Peptide Sequence Number=SeqID_199056
atggagtctctcttcgactcgatcaacgtccacgaccttctttcggcgcaggatctctcggaccctaactcccctctctcggcgccggatctccgtctcctgatccagcgcctggagtcgcactccctccaaatccgctctcaggtgcagtcctacctcgtctcgcaccgcgaggatttcgcgcgcctcttttccctctgcaacgacgctgtttcgcagacgcgcgaggtctccgacgacgtcaccgccatcctccgactcctctccgaccgcccgattgacgccgaggtgcgcgacatcgtgtcggagatgaaggcaaagaaggaggaactgaaagtgaagaaggaactgctgggattggttggaaccgttgtggcgctgaaccagagattggagagtgtgagggaagcgttgaagagtgggaggttcgaattcgcggcgcaagggttgaaggagttgaaggtggcgttgaggattggtgaggagaatgatagggagcctttggtgtatggcttgttgaggaaggagtggtctcagtgctttgaagaggtttatagttatgtgttaatgcgtggtggatttggtgctgtgaatattcaagaggtcctcatgaagtttatggaaaaggcagtacgatttgatggggatttgaatcaagttgaagtcaagtatcatttagaagttgagaatgtgaatgggattcaattacacacagttgtggaggcaatggatgtagttggtattctagagtatgggcttgctaaagttgctgatttgatgatcaagtatgtcattactccttttgtaaatcatggacaacctctttcatttcttgaggaattgcatcaagaatcggctctactgaagatagttccatcactagatagtaagagttctcaattttctagttga

SEQ ID NO: 82279 - DNA, 114 bp, Glycine max
  Peptide Sequence Number=SeqID_199057
atggatgaagaaccaccttctaagatggctagggaaggtgatatttctggggctaagatagctgagataatggaagcaatggattattatggtgtgcgcaagagatcgagatag

SEQ ID NO: 82280 - DNA, 981 bp, Glycine max
  Peptide Sequence Number=SeqID_199058
atgacaaggggtagggatgggactcagttcaaagttggtggcgtgttctatcaacaccctccactagagagacatcgtgtcctcaaggtggaaaatcttgcgcaagtcatcccatttttcccacgtagtatccttaggaaccaatccactccattgcaccaagaccaaaagtgtgggacgggaaatgtctgtggaccatttgctgtcgagaatactaaatggtttgataagtggatgattgtctatggcactgggcagaagaggattggtaatctacaacgtcaacactggaagaccccaacaagtagtggggaattgaaggtggagggagtggtactaaaaccacttggtaggcgcatcatgtacaaagcagcaaaggtattgctccaaggtgcgactaagaacctcggtttgaccattaatttctggatggtacaagtgcaaagttccaaagtggtggtgatggcattagtagatattgttgccatttcatacggttgtggtgatgacatgaagtttcctaacatacgtggatgcacgttgaaggcgagggcaaaaagccttgttgaagaaggccaatgggtgtccatgatgcataaggactacacccatagcgtggctggccacattcgtctcggtgacaaatctgtgaagaaagggtttaaggagcttattcacggtggcttggaagtgttgtattctgccattaggatatggtggaatccttggagtaagtcaagtttcaaaaatcaggaagttgtgcccagtttgtccaacagctcatccatcattgacattggaaagcagtccttaatcgatgagaaagggttgtggttgaggcggatgaggctaacggaaagcatttcagtgactttttttttcaatcttagctttctaaaaatgagggtagcgatatggttggacattgacgggttcagtgtttggaaggagatggatttggtgggtgatggttcgggctag

SEQ ID NO: 82281 - DNA, 1098 bp, Glycine max
  Peptide Sequence Number=SeqID_199059
atggctggcaacgactccacatctaaatctacttttcatcccgctttttctgtctcaaacattaaaaaccacattcaaataaccctagaaatggagaatgttcattacgattcatgggcagaattgttcctcaatgcagccaatgccttcgatgtcgccgatcacattattccacccaaggatgtgactattaagaaagatgcacaatggtcccgactcgatgcaatcgtgaaacaatggatatatagcacgatatccattgatctcctcctacatacgattctaaaacctggtgccaccgctcaagaagcatggaatcgcttgaaggacatctttcacgacaataaaaactctagagccgtatatctagaacaacaattctcccaaatccacatggataattatccaaatgcgttgtcgtattgccaagcattgaaactgatagccgaacaactcggcaatgttggggcttcggttagcgaggatcgcctggtcctccgccttgtgacaggcctctcaagtgggtacgatagtctcgccaacatcattcaacaattagatccgctgccatcattttacaaaacgagatctatgctcacacttgaggaaacccgtcgcaataagaacactggtgccgagtctgccctcctccacacacaatccgatgtttcttctgccgctccaaatcagtctcttgatgctgcaccttctcgctccaacaatcgcaacaccggaggtcatggaaaacaaggaaatcagcctgcttcttggacatggattccttttacgcctccctcttggccacaacagccatcttggaacccaccaccatgtccataccctaccacaggctgggttccctctgctactggtcatggtgctggtgttttgggaccaaaaccacacgcttttcttgcccaaaatcagactcttggtgcaccgcaagggtcacttgtacccactgacatcgcagccactatgcagaccatgtctcttcagcagcccgacgacaattggtatatggatacaggggcatcctcccatatgacgtcgaatgcaggatatgcagacgaggaagccacttatgaggcgcactag

SEQ ID NO: 82282 - DNA, 561 bp, Glycine max
  Peptide Sequence Number=SeqID_199060
atggtcctcacttctgcaggctctcgaatctcagttcgcttcgacgacccaaatggagccttattcaagctcactcaaaagggcttcgtcaatgagtacctctatgagtttgaaagacttgtgaatcgcattgtcaggttaccaccctcgttcctcctcagttgtttcgtttcaggccttatgaggaggcgtaggctttgcaacccatctccttaccttaggcgatatcattggcaaagctccaagagaataaactggaggatcgtcacaagagctatcgtgttcgcccaggagtttcaaacacaacaccactgccacaaccaccaccctaacttccttcttttccaccccttccatcacctccaactcccacactcaaaacctaagatgaagatgctactcttgacccccctccctaaccactcgatacttccattaccccacctttaccagacctcacccacacgcaaattagttttatcaccattgtcaaaacttcaacaccggaggccttgcgtctctacggttacttacgccattcacgtgtcacaatgctcatag

SEQ ID NO: 82283 - DNA, 561 bp, Glycine max
  Peptide Sequence Number=SeqID_199061
tgaggatatgcctatagtgagagattttcctgaagtgttcccagtagatgttactagtctaccacctaagcatgagattgagttttccatatccatatttgtaacaccttatagaatgtctcctttacatcagtgtgagagtagcttccaagaccttaagaataggttaacatcagcatcggtgttagtgttgcctaacccaagtgagactcatgagaggaattaccccactcatgatttggagttggcagtcgtggtatttgccctcaagctttggaggcattacctgtatggttctaggtttgaagtttgcagtgatcataagagtcttaggtacctattagaccataaggagttgaatatgaggcagaggaaatggttggagttccttaaggactatgactttgagcttagctaccacctaggtaaagccaatgtagtggttaatgccttgagtaggaaatatttgtctatatctgcatttatggttagggagttagacctcttagagcagtttagagatatgagcttagtttgtgaggttacccctaagagtgtgag

SEQ ID NO: 82284 - DNA, 240 bp, Glycine max
  Peptide Sequence Number=SeqID_199062
atgtggaacttcaagttttatgtgggtggtgttgcttggtggagggggaaggtgatggctgaggcttgtgtggtgtttggagttgcagggcctgaagttgttcttgaatggcatccagccagaggtcctgcaagtatatgggcttatgtagcgtcctcctgggtcgaagttggtggcgccttctataaggtaggacaatgtagagcatgcggcatattaaaagtccaagacttgacttga

SEQ ID NO: 82285 - DNA, 301 bp, Glycine max
  Peptide Sequence Number=SeqID_199063
atggcaaaacaaccatgtcagctgaaagaaaagagtgatagaaatgtttccatgcctgtccgtccagggtcccagtttttgccttttggaaacgaaatggagttcatgttgctgaaagctgttttcagtagtgaaatgaggggcaagaaaaggacactgttagatgtgttgatgatcctcagaatgtaccgttacattctggaggaggatgaattagagattcagattaggagggctcttttgcagagtggcggttgtgaggggttggcacttggattgagcgacggagactccattccaa

SEQ ID NO: 82286 - DNA, 681 bp, Glycine max
  Peptide Sequence Number=SeqID_199064
atggggagagccactaggtgggtgaagagtttgtttggaataagaaaagagaaagagaagaaacaaaacttcaagtgtggagaggctaaaagcatggaattctgttgttctgagagtactagtaattcaagagttttgtgtcacaatccagggactataacccccaacctttctcaagctgaggctgcttggttacaatccttctacacagagaaggaccaaaacaagcacgccatcgccgttgctgctgccacggcagcagcagctgatgctgccatggcagcagcacaggctgcagtggcggttgttaggctcaccagccaaggaaggggtggcaccatgtttggggttggacctgagatgtgggctgccatcaagattcaaacagtgtttagaggatacctggcaaggaaggcactgagggcattaaaaggattggtgaagttgcaggcacttgtcagagggtatttagtgaggaagcaagcaacagcaaccttgcatagtatgcaggctcttgttagagctcaagctactattcggtcccacaaatctcgcaggctcatgaccacaaagaatgaagcatatagatctcaaattagagcaagaagatccatggtattggcacaaatcttgaattgtagctacatttctcattatatgaactatggttatatattctaa

SEQ ID NO: 82287 - DNA, 368 bp, Glycine max
  Peptide Sequence Number=SeqID_199065
gagaagagtgcagattctcctctacagcacaaagcactccacgcttcacaaattcttgtagctgtggctcagttgcagtacctatgacaccaaagagtgtgtgcactgataacttgttcttcctaaggcagtatgggaattttccaaactacatggctagtactcagtcttttaaggccaaattgaggtctcatagtgctccaaagcaacggccagaacctggtccaaggaagaggatttccctcaatgaaatgatggagtctaggagtagcttgagtggggttagaatgcagaggtcttgttcacaggttcaagaagtcattagtttcaagaacgctgtgatggggaagcttcagaaatccacataa

SEQ ID NO: 82288 - DNA, 756 bp, Glycine max
  Peptide Sequence Number=SeqID_199066
atgggaagtgaagtagggatggatgtggcttcctcatgctctaattttgaaggaggagaaaatgataaagtggaacaagtgccaaatgacccgggcggtcacaagaggaaggtgttgaaggaaaagagtgagtttagggtgaaaagttcaaaatattacccaccagataataaccatatgttagaaagttgtcataggagagttaagatcgttaaagaccacgtggggtgtaagacgttcaaggaggaacatccaataggggaagttgtagcagaaaatgagcctataggagaaaggaagtgcaaagtattggaagacaattacaacaagaggaggagggacaatcagaatatgactggagttcaaaaagaagaagaagctatcgagcctagcatagggtatgagcgtgttcaaagcctcaacaatgtgaaaataactttgaagcaaggttcagttaaaatgattactccaatcatgattacagagtctatttcaaaggatgtggaggttggaatcaaagggaagagtgaaagagttgtaaatggtggagatatgaagaacatgttagatttgtcaccacaaaaagatgagtacaaaggctcccaagaccttagcactgatgagagggttgaaaatacatatcctgactctgcttatgtgtatgacatagaagggtcagagaaagtatgggaggaacaaaatttaatgggggtatcatacggaatagaagagaaaaatatggctgaaaaaacataa

SEQ ID NO: 82289 - DNA, 597 bp, Glycine max
  Peptide Sequence Number=SeqID_199067
atggataaatgtttgtgttcttcactatggggcgatggggagttggaatgggtagctttgccttctttgggagcatctaggggattgctatgtatttgggacccaaaattttttgttgcacatagacatttcttgggtgtggattcattggattggaagaaatttggtgaattgaaggtggagaaagcaagttgggaatgcggttgggataaaagcccaggatcaaagggatttaatcttaaattcatcaaagctttttgggatatgttaaaggtggatttcatgagataccttgaggaattccatcaaaatggggtaattccaagaggttgcaattcgtctttcatttctcttattccaaaggtggaggtgccaaatcaattggatgattttatacaattctcacttgtggtgtgcatgtataagatgttggcaaaaatactatccaatagattgaagaaagtattgaataaagtggtggatcaaagacaaagttctttttttaaagataggtctttgcttcataatgcaatggtagctaacgaggttgtggaggaagctagaatgaaaaaagaagttgtttggtctttaaagtag

SEQ ID NO: 82290 - DNA, 384 bp, Glycine max
  Peptide Sequence Number=SeqID_199068
atggaagaagaagaccagcagaagcttccagatctggtgaaggcactcgtccacctcctactctcccagaatctccccttaaaccctaactctcccaaattctgcaactcccttcacatcctctccatccgctttacccccttcgtcgcccctgacgctgccaccatcgccgactccatcaagtgccgcctcacctcccatggccactcctcccaagccctctcctttgccgaccttttctccaaatttgcatacttgagttctttttccttcatttcttgcatgcgcaagagaagggaagatgaggtttcacaacagagagagcgagagaaagaaagtgagaataaaagagagaaagggtcagtgtgttgcccaataagataa

SEQ ID NO: 82291 - DNA, 102 bp, Glycine max
  Peptide Sequence Number=SeqID_199069
atggtggatctggtagggtttagtggcttggcttttcctctaccaaatatatgtgctgcactgacacatactttgtctacacctgtcatctaccaacaatga

SEQ ID NO: 82292 - DNA, 660 bp, Glycine max
  Peptide Sequence Number=SeqID_199070
atgaccaattatgacagcgatgccgaaatgtctgatctgccttgggccttggccagaccttctagtaagccaacttctcaatcagatctaagacgaaatggtaatcgtaagtatggagttgatgagctaaatgaacctcctcctcgtcttcctggtattcgttcattacttcccttgcctgggggtgatttattgactggaggtactgatttaaagatacgtcgatgggatcattacagtcctgacagaagttactgtatttgtgggccaaacttaaaaggaataggaaatgatgatttttatgaaacaaaatctagttttggggtgcaagttgtacaggagaccaaaagacgtcctcttacaatcaagctgacagcaaaggcaattcttgcagctgctgccactgattctgctggttgccatagggattctattgtttctttggcttctatcaagttaaaccagagacttttactttcaagtggtagagatggggcaatcaaggtactaacccaccaggtagtcattagagccccctccctatttctctctgatacttttccatttttgtgtacacctgatctgtaccagcaggaaaaagttgcgattttgatatttttagatagacctcagttttatttgaaggtgtcaatcgtttga

SEQ ID NO: 82293 - DNA, 3899 bp, Glycine max
  Peptide Sequence Number=SeqID_199071
atggggaacaaaatcgcgcgcacgacgcaagtatcggcgtcggagtactacctgcacgagctgccgtcgacgtacaatctggttctgaaggaggttttaggtcgcgggcgcttcttcaagtcgattcagtgcaaacacgacgagggtttggtcctcgtcaaggtctatttcaagcgcggcgatttcctcgatctctccgattacgagcgccgtctctctcagatcaaacacatcttcacctccatcgatcaccctcacgtctggccctttcagttttggcaagaaacagataaagcagcataccttttgaggcagtatttcttccataatctgcatgataggttaagcacgcgcccttttcttagtctcattgagaagaaatggttggcttttcagttgcttgtagctgtaaaacagtgccacgagaacggagtgtgtcatggtgatatcaagtgtgagaatgtgctgattacttccaccaattgggtttaccttgctgactttgcatctttcaaacccacttacattccatatgatgacccctctgatttctcttttttctttgacactggtggacgaagactctgttatcttgcacctgagagattttatgaacatggaggggagatgcaggtggcacaagatacccccttaaaaccctatatggatatattcgctgtcgggtgtgtaattgctgaacttttccttgaggggcagccactatttgaactgtctcaacttcttgcttatcgcagaggacaatatgatccaagtcaacatcttgaaaaaataccagatcttggaatccgtaagatgatattacacatgattcagttagaaccagagtttcgattatctgctgaaagatatctgaaggaatatgctgcagttgtatttccaatctatttttcaccatttctgcatgatttttaccgatgctggagtcctcttcattctgatatgagggttttactatgccaaagtgcttttccggagatacttaaacaaatgatgaacaataagtcatctgatgatgcaggtgttaattccgctgaacttttggaagagatggttgctaaagaaagtgcgagtttcatgaaggattcactgatgaagagagaggacataggcaaaggcttagtccatgatcactatgaacttctaggtgatattaatagcctactgagggatgctaaaaaaaataataatccatcgcatgtagcagaaaatgcacataattctacttttcctgaaaatctgaaaaatttgcaaactggtaaactgcttcaaactatctccaatgcatttcgaggaaatgaccatccctttctgaaaagtattactatgaatgatttaaattcattgatgtctgagtatgatagtcaatcagatacgtttggaatgccttttctaccgttaccaaaggatagtatgagatgtgaaggcatggttttgataacttctttgctctgctcttgcatacgcaatgtcaagttgcctcacttgaggagggcagccgtactcttgttgaaggcttctgccctatatattgatgatgaagatcgtttgcagcgtgttatcccttatgtgattgtgatgctctctgattcagcagcaattgtgcgttgcgctgctttggagactttatgtgacattcttcccttagtgcgggattttcctcccagtgatgcaaaaatatttccagagtatattcttccaatgctttcaatgcttcctgatgatccagaagaaagtgtgaggatatgctatgccagcaatatagctaagctggcactgactgcttatggattcctgatacgctcaataagcttgagtgaggcaggtgtccttgatgaattgagtttgccacagaaaccattgacatcatccactcagacttctggaaggatgaagaggataaatggcgatgcccaacttctgcagctgaggaaatccattgcagaggttgtccaagaacttgttatgggtcctaagcaaaccccaaatataaggagagcacttcttcaggatattggtaaactgtgctgcttctttggtgtgagacagagtaatgactctctcttacctatccttcctgctttcttaaatgatcgggatgagcaattaaggacagtattctacgaaaagatagtttatgtctgcttttttgtgggccaaagaagtgtagaagaatatttattaccttatattgagcaagctttaagtgatgtgacagaagctgtcattgttaaagctgtagaatgtatgactattctatgcaaaagcgggttcttcaggaagaggatattgcttcaaatgatagagcgtgcctttcctttattgtgttatcctagtgaatgggtgcggagatcagttgtctcttttattgctgctagcagtgagaacttgggtgcagtagattcttatgttttcctcgctcctgttatacggcctttcctccgaacgcaacctgtgtctcttgcttcagagaaggctctgctctcatgtttaaaacctcctgtctcaagacaggttttttatgaagtcttggagaactccaggagttcggacatgctagaaagacaaagaaaaatatggtatagttcttcccaatctaaactatgggaaatggatttactgaaaaaaggaattgatgagttggattcattaaagaactggactgacaagcaacaaggtcctggggttcaacaaacagttggcactgccttccaacagccagggataactgattgtgacaaagctgaggcaaaattgagagatatgggggcctttatgcataatgatagcaatactgtaggacatcgtgatacccaatgctcagagaagttgcagttttcaggatttatgtcaccacattttagtggtatgaatagtttgacgtatgaaaagccatcagaaggcatacctttgtactccttcagtgtggacaggcgaggaatgggaatcccttctgcagcatctgatcctccactgccaatgaattctctgggtgttagttcatctgcaatgccttgggttaatccacttagtaagtcctttaatttggctaattcagttccagcaccgaagctcttttcaggttcttatagtatcagcaatggttctaaacagttccatcgagtggtacatgaaccagatgccagggaaaatgagacagcctatgttaataacacatttcaagatgtgggattatctgctaatattaaaggtacttcaattgcattggaagatgcaactgcccaaacggatctatctggatttccatcatttgctcgagcttccattcctgactctggttggaggccccgtggggtgttggttgcacacctccaggagcaccgttcagctgtcaatgacatagctatatctgctgatcatagcttctttgtgagtgcatctgatgattctacagtcaagatttgggattccagaaagctggaaaaggacatttcattcaggtcaaagctaacttatcacatggagggaagccgtgtgttgtgtgcaacaatgcttccaggttctgcacaagttataattggagcatctgatggatttattcatatgttttctgttgatcatatctctagaggtctaggaaatgttgttgagaaatattctggtattgctgatatcacaaagaaggatatcaaggaaggtgccatactcaaccttttgaattgtcctgtggataattataccatcatgtatagcacccagaactgtggcattcatctgtgggatactaggtccaattccaatacctggactcttcaagctactcctaaggagggctatgcttcttctctggcatcagggccttgtggtaattggtttgtatcggggtcatcccggggggttattacactttgggacctgag

SEQ ID NO: 82294 - DNA, 534 bp, Glycine max
  Peptide Sequence Number=SeqID_199072
atgcatgcacgtggtagtggccctcgtgtcatgttaaccagacagcctacagaagggagagctagaaatggaggtcttcgtgttggagaaatggaacgtgattgcttgattgcatatggtgctaattaccatttggtagaggtggagacaatgttctttggagtggggtcaggaaggaaagagagcggagatgttaaggaggaggaaaggacaggaggcaaaattgattgtttacggggagatattggcgtggcaccgattgaagaaaagatgatagaaaattggctaagtcctgtgaaaagggaaagaggtagaccgagaaacacattagaggaagttgttaaggagtttatggtatgtacagcatgtgggttgttgggatattacaaccataagctgaaaactggtatttgttcatcttgtaagaatggagacaatatttctaccatgaagctgccatatgcatgcaaactcatgattcaggaactccaatcaatgaatattgttccccgcttaaaactggcagatgcgtga

SEQ ID NO: 82295 - DNA, 1158 bp, Glycine max
  Peptide Sequence Number=SeqID_199073
tgcgagtctttgggcgttgaagacatgaaagatctctctgcagaggagcttcatacaccagattcctttcttgtcatttttaatggtttaatccttggcaagcataggaggccactgcattttgctactgcaattagaaagttgcggagagctggtaaaattggtgagtttgtgtctgtctatgtcaatgaaaagcagcattgtgtctacttagcttctgatggtggtagagtttgccgtcccctggtcattgctgacaagggaatatcaagaatcaaacagcatcatatgaaagagttaatggatggagtacgcacgtttgatgattttttacgagatggcttgcttgagtatcttgatgttaatgaagaaaacaacgctttgattgctttatatgaaggagatgccacatcagaaactactcatattgagattgagccttttaccatcttgggagttattgcagggttaattccatatcctcatcataatcagtcacctagaaacacgtatcagtgtgcaatgggtaagcaagctatgggaaatatagcatttaaccaggttggatatgataagcttggagccggtcaaaatgccacggtagctgtaatgagctatagtggttatgatatagaagatgccattgtcatgaacaaggcatctcttgatcgtgggtataatgccatcattcagaagcactcgaatgacacgtcagaccgaatacttaggcctaatagaactgcagacactgcaggacgtatgcagatacttgatgatgatggtattgctgctccaggggaaattcttaggccatatgacatctatatcaataaacaatcaccgattgatacacgtactccaaaaacaggatctgcagcaaatttgcccgatagtgcatatcggtccaatgcacaatcattcaagggtaatggaggagaagtagttgatagggtggttctatgctctgataaggataataacatgtgtatcaaatttctaattcgtcacactcgtaggcctgagcttggtgataagtttagcagcaggcatgggcaaaaaggtgtttgtggaactattgtcccgcaagaagactttccattttctgagaaaggcatttgtcctgatctgattatgaatcctcatggtttcccaaggtaa

SEQ ID NO: 82296 - DNA, 180 bp, Glycine max
  Peptide Sequence Number=SeqID_199074
atgtggtatttatggtgccaattctgcataatggattatgagcatgcaggtgttggggctatagagtttattatatgccattcagaggtctcaattgcacttgcagaagagaagaagatacctgagctattcaagacatttccaaatgcaacaaagtatctcaagagtaagttttgttga

SEQ ID NO: 82297 - DNA, 849 bp, Glycine max
  Peptide Sequence Number=SeqID_199075
atggcgataccggtacccgttccacagctcgatcatgcagtgatcaatgttgccgatcggctggatgacgccagcgcgctgtatcgccggctcggtttccagctcacgccacgcggccatcattcgctgggctccagtaatcatctggcggtgtttggtgataattatctggaactgctgggctatgaagccgggcgtgcgcaccggcgtcaggatatctggcaggcaccggcgggcctgagcggtctggtatggaaaaccggcgatgccgatgcagtgtggcgctatctggaaagtcaggatattgatggcgatcccgccgccagtttttaccgaccggtgcagttgccggatggcagcgcacagcaggcgcgttttcgcaccgttcgcctgcgccccgctctggtgccaaatggacgcagttttttctgccagcatgagacaccgcaggcggtctggcagccagtgtggcagcagcatcccaacgcggtgaccgatattattgagtttgtggtggtggcacaggatccggcagccgccgcgctgccctacagtcgtttatttggtgccgataagctcaccgcctgccagcagggcgcgtttgtgctgaaagcgggcgtggccaccgtgcgctttgccgctgcgcactatgtgacgcagcgctttaccggcctgccgcccgattatgacggcagtgcgcgtatggccgcgctgacgctgcgcagcagcgacttacgcagggtgaaagccagcctgctactgggcgatatgcctttccgcgaagagccggatgccatcgtggtcagcgcggaacaggccagcggcgtggcgctgcggtttcagctatga

SEQ ID NO: 82298 - DNA, 246 bp, Glycine max
  Peptide Sequence Number=SeqID_199076
atgtcattgctggtggcgtcaactttctctatatcggctctggcagcgcaggagattactaaagaagaggctaagcagtatcaggaagttggtaaggttagtaccaataatgaatacagttcaccggcagaggccatggctgaaatctcgaaagaggccgatgagatggggggcgtcatagtcattgcaacaggccgttttaataacggcctgttgtcgtgtttctatttctacagtaagcgatga

SEQ ID NO: 82299 - DNA, 365 bp, Glycine max
  Peptide Sequence Number=SeqID_199077
tcttacggatagcgaatgagactttttcgcaatctcggccggaaaatgctgacatcttcgggaaaggtgcagcaaatgtgactttttcgcagtttcgactggaagatgctaacatctacgaggaagaagacgttgacatcctcgggaaaggtgaagtgttacggatagcaaatgagactttttcgcagtctcggccggaacaccctgacatctccgaggaaggtgcaagtgatgactctcggtcggaaaacattgatatctccgacaaaggtgttggtgacggtgaaaatgctagcatcttcgagaaaggtgcaggtgacgacgatagtcactggatgctattgggctttgagtcttacggatag

SEQ ID NO: 82300 - DNA, 904 bp, Glycine max
  Peptide Sequence Number=SeqID_199078
atggaatctctaagctctgattcagttgacaaatccgaaaccattgaaagttgtcatttccgctcactaacaattgaatttctgaattcattgacaacatctggcttacccaatcactgtctcaaactcaagattggaacaccaataatgctattaaggaacttagaccaaactcaagggttgtgtaacggtactaggttaattatcacaagactagcaaaacatgttattgcagctgacataatttctgggacaaatatcggagatcatgtttatatcccacgaatgtctatgtcgtcttcacagtcaccatggccttttaaactattgaggagacaattttcgataatgctttcttatgccatgacaattaataaatcccaaggacaatcactatcttcagttggactttacttgccaaaaccagttttttcacatggccaactatatgttgcattatcaagagtcaagtcaaagaaaggacttcgaattttaatacatgatcaggacaaaaaaaatgacttcaaccacgaatgtggttttcaaagagataatcaattggccttgcaaaatattatctatgccaaatcattatcgacttcagcattagacagcaataaaaatacctcttcacctgcctccaccaccacaatctttcatacttatcattctgccaattcacgtccaatctttgaacagaacattcaatgctccacagttcccaaactacttaacttgccgtcacttacacccccccgaaaagcaatgacccttccatcacccactactttacatcatcagaccacagttcatttctctaccaccttcatttcaattctaaccaaattattctctcaaagcgactaccaccatgtctcccgcttcatcgactgcctcaagcaag

SEQ ID NO: 82301 - DNA, 672 bp, Glycine max
  Peptide Sequence Number=SeqID_199079
atgtgccgcgtcaccactagagcaactcacacactttgtcacgtcacacctctgagtcctctagttacacttacttccaacacacatggcctccattcccctcctctcaccacccaccaccgccacaaattccaccgtcagccaccaaccctcctccacctccacctccttctcccacaaatcccacaccctccaccgccgcctcacgcggctccatgtgtcctcccccaccaacaacccccgcaccacctccaccactccccccaccaccaccaccaccacctccggcgagaccatattcttcgacggcggtgcccactacggcgacctcgccgcgaacctcctcctcggattcaccctcctctggctccccctcaccctcgccgcggtgtcacgcgccatgttcctgcgctacaggttcccaacctccgcgtcaccgtcatctcgggcctcagcggccaggaccgcagcgacttcgcctactccgtcatcaaggacgtgcaggtcgtgccgcgttttatcggagaatggggtgacgttgtcataacgctcaaggatggaacaaaggtcgatctcaggagtgtccccaagttcagagaaatctccaagtattgcctcgccatggctcagaaacccatcgtgttgaacgaaagtggacccaaaggattttag

SEQ ID NO: 82302 - DNA, 150 bp, Glycine max
  Peptide Sequence Number=SeqID_199080
atgactttgttagactgtggtggtgctattcgtggtcgtgaagggttgcacacagatttagttgtagtggggatgcgcaacaatactggatttggacggaggtggcggtgcacagtggtgctggaggacgagggtggggtggctcaatga

SEQ ID NO: 82303 - DNA, 1740 bp, Glycine max
  Peptide Sequence Number=SeqID_199081
atgggaaacaactgtgttggatcgagaacctcttcttctaaagacggaacaaatggctcttctaattcaagttcattctggtggtcacgtggacacaagaaagatgcttctcatgcacacaaaagtggcaaaaagagtgcaaaagccgcagaaactgttcaaaacaagcctccggagatggtgaaaatcgagagggaggatgtgaagcctcctcatcaatccaaagagactaaaccgccttcggaagaaacaaaggagcagccaacaaaaccaaagaggccacacaatgtgaagaggctagcaagtgcaggcctcaaaacagattctgttttgcaacgaaaaaccggtaaccttaaggagttttacaatttgggaccaaagcttggacaaggccagtttggaaccactttcctttgtgtggagaagatcactgggaaagagtatgcatgcaaatcaatattgaagaggaagcttttgacagatgaggatgtggaggatgtaaggagggagattcagataatgcaccacttggctgggagtcctaacgtgatctccatcaaggaggctttcgaggacgctgtcgcggttcatgttgttatggagctctgtgcagggggtgagttgtttgataggattgtggaaagggggcattacactgaaagaaaggctgctaagcttgcaaggactatagttggtgtgattgagtcttgccactcccttggagtgatgcatagggatcttaagcctgagaattttctctttgttaatcagcaagaagaatcccctcttaaggcaatagattttggactgtctgcttttttcaaaccaggaagtccttattatgtagcacctgaagttctacgtaagcgttatggccccgaagcagatgtatggagtgctggtgtcataatctacattctcttaagtggggtgcctccattttggggtgaatcggagcaagacatattcgaggcgattttgcattctgatcttgatttctcatcggatccttggcctgctatatctgaaagtgcaaaagacttggttaggaaggtgcttgtcagagatcctactaaaaggataacagcttatgaagttcttcgtcacccctggattcaagttgatggagctgctccagacaaacctctggattctgcagttttgagtcgcctgaagcagttttatgcaatgaataaactcaagaaaatggctctcagagttatagcacagaatctttctgaagaagaaattgcagggttgaaagaaatgtttaaaatgatagacacagacaacagtggtcaaattacatttgaagaactcaaggttggactgaaaatgtttggtgctaatctcaatgaatctgaaatttacgaccttatgcaagcagctgacgttgataacagtggcacaattgaatatggagaattcatagctgcaacattgcatctaaacaaggttgacagggaagatcatttagttgcggctttcgcttattttgataaagatggaagtggatacatcactcaagatgagcttcaacaagcttgtgaagaatttggcgttggagatgtccgcttggaggaaatgatccgagaagctgatcaagataatgatggaagaatagactacaatgaatttgtggctatgatgcagaaaggccatgcagatttgggtaagaggggtcgaaagggtaacactagttttagagttggatttagggaagcaccacctgtacgttaa

SEQ ID NO: 82304 - DNA, 1741 bp, Glycine max
  Peptide Sequence Number=SeqID_199082
atggtccttgtttctcctcctctaaatgccaacaattatcacacatggagcagaggacaactgcaaggaaatggaactagtgactcaaaggtttttttacctcctcaaatcagcagaataatcaagggaattgaaggccacaagggagagggggtagcagccttggtagaggaagaggtaatggaatcttgggcagaggagatggaaatgttggaagaggaagagggcacaactatacaagcaaatagttcacaaggtggaactgtcacctctccgggagttcagttcaaacctgaacaactacaccagttgctcactatgttgcagcagtcctacactaaatcaactcacttagtaagtcagatcacttcagggaatgttgatgaatcttcttcacaacaacaaaattgcctttcgggtagatttctttcaaaatttgctacttggattcttgatagtggtgccactgatcatgttacacatgattcttcctttcttgtcacttttcatgctattaaacctatacatgtcaatcttccaaatggaattactgtcactgctaaatattttgatttctttaactttcttcttgacccactcccttcacattcccaacctgcacctgaatctcttaatcccctcaataattctaataaccctacacatattcccattttatctgcatctcaacctgttttgcccgaagctgctcctgccactagaagatcttccaggatcagaaaagcccctgagtatttgaaagactttcattgtcaattcactcaatcaacagttttgtcttttcattctatttctccttcgcaccttaaatatactcttgtcatctccaccacaaatgaaccaaagacatataaccaagccattaagtctaaggaatggatacaagctatggaaagtgaattacatgcacttgaagcaaataatacttggtatctcactaagttgccgagaggcaaagtccctattggttgtaggtgggtctataagatcaaacatcatgttgatggttcaattgagagacataaggctcgattggtcgccaagggttacactcaacaagaaggagtagattttttgaatactttcagccctgtggccaagttaactacagttcggttattgcttgcttttgtagctgttaaaaattgggatttacagcaattggacgttgataatgccttcttacatggcgatcttcatgaagaggtatatatggagttaccactgggtcttgttccagctaccccaaatcaagtgtgtcgtctcaccaagtctctctatggtcttaagcaagccagccgtcaatggtttgccaagctgtccagcttccttgtttcaattggtttctctccttccccttttgatcactctctcttcaccaagcaacatggttcctctttcacaacccttcttgtgtacgttgatgatgtcattctcactggaaattcaccttctgagataacctctgtcaaacagcttctacatcacaagctttgcatcaaagatcttggcaaactcaagtatttcttaggtcttgaagtatctcgaaccagtaaaggcattcatatatgccaatggaaatatgcacttgatattctttctgaatcaggaatgcttgcttctaaaccatgctctactcctatgatcaaagggaacaaactgctatatgatgatactgctcctccctatgaccaaattgcctacagaagacttattggac

SEQ ID NO: 82305 - DNA, 327 bp, Glycine max
  Peptide Sequence Number=SeqID_199083
atgttgttcatgataccttatcagctcgatggtacaacgcaattgaagccagaatacacgttgaacgacgaagattttgtttctgccacatggaatacgttaagaggaaaaaatgatgaaaaggagaaaaatgcacgtaaatggaaaagggttttgattttgaaggaaatgggaggaacgtggtcaatcgccggcgtccggcgtccggcagcaggcccttgccggaaaatggatttagcctacgggcatgcgatttggtgtcttccacgtgcaccacacgttaatgaatgtcaaattaatcgtgactataagctcaccggagtgtag

SEQ ID NO: 82306 - DNA, 468 bp, Glycine max
  Peptide Sequence Number=SeqID_199084
atgtttcattttatgaaagaagggctcgagtacgagagtgattccaaagaggccaagaagttgctacaatgcggaagtaaagccaatgacgatgaaaaatatgacaataatggtctgggttgcagtttcttaacgaaggacaaagatttggtctttacgctcattccttcaccagggtttgagttctctcttgggttcgatggccaccatctttgtctgctcgggttaaaagtagatttctccactgatttctccacagtggtgttcggctacattgccttcgacgattatgtttggccaatggttgagttggttggtgttagtttggttgtggttcgacctaaactgtgcaagattgaaagtttgaatttgttaaggaaacaaaatggaagacgttccatatttgggtctagatccaagtgttggacaagtagcctcagaaattttaagaagggggggttgaattaa

SEQ ID NO: 82307 - DNA, 369 bp, Glycine max
  Peptide Sequence Number=SeqID_199085
atgtggaaaaacaaacaagcaaagaaaaagaagaaattatccgtgcaatgcgatggatggttaagagagagagagatagagatcttggtgtcctcgtctatagaggaatcaagatcggagaggagatcgaagtacaggagtgccaactccaaatcccaaatcaatgaatttgagagagagagaggtaggcgggtcaggacggatatcaataatcccatactcgtccccgccctcgctttgggttattgggcaaaacccgaatccgaccccgaactcggtcaacacgatttttatctgtcaaagtcgagacgggttcgattcggttcccacgggatcggattccgctgtcatacctatgtgttgtggtga

SEQ ID NO: 82308 - DNA, 874 bp, Glycine max
  Peptide Sequence Number=SeqID_199086
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatacgacaaacatctcattggtgttggagggcaaggatgtgtttacaaagcagtgctgcctacaggtcaagttgttgctgtgaagaaactccattcagttccaaatggagagatgctcaatctgaaagctttcacatgtgagatccaagctttgacagaaattcgacatcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82309 - DNA, 414 bp, Glycine max
  Peptide Sequence Number=SeqID_199087
atgaagtctgaattttacatgattggtttgggtgagttggcatattttcttggcatcgagtttgtgcagactggtagagggatcatcctacatcaaaagagatacattcatgaagtcttcaagaggtttaataaggttgactacaacatagcactaacaccactagatgccaacatcaaactagtcaaagatgaggcaaaaaagttagttgacaacactttgttcaaacaattaattggctccttcagattttgtggtgcaccaatttcatggtgttcaaagaagcaagatgtagtagctttatcttcatgtgaagttgagtacatagttgactgtcattttgcatgtcaagctttggcgcttatatctttgcttgaagaaatgcatttgggactcaagagtgttatgcaatag

SEQ ID NO: 82310 - DNA, 408 bp, Glycine max
  Peptide Sequence Number=SeqID_199088
atgtcctcttgggggaagaaaaccgatcttttctccgggtttcttccctccttgagcaagattgcagctgtggttagggattcggcgagagagttggatcgtgtaaagcaaactcaaaacggcatagtgggcctaccgcggaagtacttggaaggaaaggcaagggatatggcgaatcaagaggagtgggtcccgtttgcggacgtactagctttgctaatctttggggttgtcctctttccaaacgtggacggtttggtggacctagccgtgattgatgctttccttgcatatcaccataacaaggagagtccggtggaggccgaacaatcaactggtttcctcaatggaaggaaggacaagagggagttctcttctcatgtggggactacccaaacattccgttga

SEQ ID NO: 82311 - DNA, 714 bp, Glycine max
  Peptide Sequence Number=SeqID_199089
gatctgggcgcgcgacatgttcgacacttccgtggcgtattcggcgtcctggatgcgcgaacgggcgctggacaggttgttgaccacgttgtccaggttggcgatggtcgattccaggcggttctgcaccgcgcccagctcgccggtcagcttgttcagcacggtgaaggcggcgtccagcgtcttgagtggatcggtcgttttcgtgcccttgctggtagtgtccgtcgtcagcttacccgaggcgttgacgtaggcttgggcgccgatcttgggggcgtagtcgcccccacccgtgccgcccgtgaccgtggtcttgccgcttgtcggatcgacacggtaattggtctgatagttcgcggtggtcgtgaagtcccccttgtcgtcgacgtaagtgtcggtcgatgtgccgctggtgaacttcaccgtggcgctggtgatgcccttgcccagtttgatctcgacgtcattggccggggtgttggccttgaccttcgccatcatcgcatcggaactgatggtgtcggtaaacatcaatccattgccgccggcgacgttgacgttggagtaggtcttgccaccgatcatgacgctcgacgaaccggctgcggctgtatttcccgccgcgaccgtcatgacgagggcgagcgtggccgcggtggcgctattggcgttggtcgtaaagttgccgcggtcatccaggaacgccgcctg

SEQ ID NO: 82312 - DNA, 288 bp, Glycine max
  Peptide Sequence Number=SeqID_199090
atgtcataccctaatttcgtccagggacaattgtttgttaatatttggattcttgccagccgaattgagctgcttaacactaattgtggtgcaatcccaaggggcacaagaagtcaaggaaaagttcaagacgacgaccatcaatgcccaaaaagagtgccacaaactgagagacatcaatatggccaccgtcgaagcattggaacgggaaacaaagagggcccgaaaggaagaatggggccgaaacaagttccgaggagctttgtggggaagcaacagcgagcttaa

SEQ ID NO: 82313 - DNA, 130 bp, Glycine max
  Peptide Sequence Number=SeqID_199091
atgatgtggatggataggttcactttcaccttgaatgggagtcaagagcttccaagactgctagcaaaagctaaagcgatggtggacgtgtactcgggccccgaggaagttcatgggctcctcgattatt

SEQ ID NO: 82314 - DNA, 210 bp, Glycine max
  Peptide Sequence Number=SeqID_199092
atgcttaaacaagcagatggttcttatgcttgcatagcagaaaatgcaaaccgcttcagccttggcgagcttcatactaatccattgactgatataggccaaagaggaattgttgagggtcttgggacttcaagaagaagagggaagttgtctagaatttcttcaaagaggctacaaggtgttctcttgttaattaatcagtttttgtga

SEQ ID NO: 82315 - DNA, 492 bp, Glycine max
  Peptide Sequence Number=SeqID_199093
atggaaatactggagagcctttattcttacaattccctccgtccaaaagtaatagaaccaaagggacagcttctatcaattgatggcaaaacagaggcggaggtttgtaggagtttagagagagtgctccgtactatgcggataactaccttagaacccaaggatgtggcttttgttgttgatggctgggcacttgagattgcacttacccactatcgtaaagctttcactgagctggcagttttgtcaaggactgctatatgttgtcgtgtgattgaatcactaaatactgcggatcatgctacatttgacaaccatacatcatatatgggaagtataaatggacccaagttacctctggtgtttgaagtgcagcagatgccacatgatttaactacagaaggatgtccaaagaacaattttcaaaacagttgtatattcaataaggtttgtcgatgcatcaacaaccgaatgaatgcctgctgcatttga

SEQ ID NO: 82316 - DNA, 336 bp, Glycine max
  Peptide Sequence Number=SeqID_199094
atgggatcgagtcaggcgccttcgcttaaaaagaggttctatcaagtcaaggtcaagagcctaggaatcaccagcctaaaaaagttagggcagttgatgggtcagctccagcgacaagcctttcgcaaagcttacggtaaaatctgggacctagccatggcggaggtctccaccgaggccattgcctccctcgcccagtattatgatcggccgttgaggtgcttcacctttggggactttcagttatcacccatggtggaagagtttgaagagatcctgggatgccctctaggggaaggaaaccatacctcttctcaggattctatccctctttag

SEQ ID NO: 82317 - DNA, 492 bp, Glycine max
  Peptide Sequence Number=SeqID_199095
atggggtggttggagtaccgagaaaatgtttggaggcaaaagcaagaatcttggcaggtagaggtgaatgggcccccgacaatcgacgcttttctcgcctttcatgaccgcaaggaaagctcggttgtcgctatcctagccgatctatatgacaccttcgaccgaagatgtgaaaagagcagtacaaggatttgtttgctgtactccgaccctctacgtatggttggtttcacaccttctccgccaagagcaagcaaagaaggagtgtctatcaactggttccctcgatggaaagaaggaagaaccggggttcttatttcgtgcagaggatttccaaatgttcccttgatggggacaaggggttgcatcagttacaatcccgttcttgctataagacagcttggctaccctatgagaggggcaccattagaggaagagctcgcacctattattgcacgaggtttcaataacaccaatgcggaggcactttag

SEQ ID NO: 82318 - DNA, 165 bp, Glycine max
  Peptide Sequence Number=SeqID_199096
atgcctccattgccttcatatgggtatgggagggagcatcctgggcctcgatatggcagtttgattcatggtcaacatcttacagatgttgtgataacagaggaagtgagttttgccacaaatggtatagttgcagctggattgagagctttttcattagcataa

SEQ ID NO: 82319 - DNA, 204 bp, Glycine max
  Peptide Sequence Number=SeqID_199097
atgttgggaacctacgctaagcgtgccttcgggcttcctcgtgggccttctcgtgctaagcctgggttgcacgctgagcgagactgtgcgctaagcttgaacttgcctgctaagcgagagtgcgcactgagcttggattacacgctgagcgagctgtccaattcttccaactcttcttcaattcttgcatcaattttcctctaa

SEQ ID NO: 82320 - DNA, 640 bp, Glycine max
  Peptide Sequence Number=SeqID_199098
atgaggcattggccaaggtggatacttcgtaccatctgtgctagcggctccgactgggaggaggacgaagaaggctggctggtaactggtggaactgatggtggagggactagcgatgcttctggagcggctttgactcggaccctccttggtcgtgggaagatgacggaaggatctgtcggcgaggttgaagtagctcataacactctaagtctgagccaatatggtgaggtccttcctaaacagcttccacggagctccattggcgttcagaatgaactgaccccccgatgtgcaccacttggccgcgatggcttggtggtctggataagtgtgcaagtactgggagtatgtggggtactcctccccctctgggataatgacggggatctccaaaaagtgattcaatgtcttggcgtcgaagcgaatgactttcccccgaaccctacagaacttggaggtgaaccttatcctggcttttgtgaggccatctgcaaaataacagaaacaaagaccaaggttagtaaaaatgaggttgcaaaaattaaagaacaacgcgagtggcttgctaagtccaggtccactgaagtggaggctcaacatgaagtggcgctcaacctgtgcaacaacacctcatggg

SEQ ID NO: 82321 - DNA, 570 bp, Glycine max
  Peptide Sequence Number=SeqID_199099
atggcaatgatagtagtgtcaatgatgacaataccaatgttgatggttgtggtactcataatggtggttggtggtactagtgtcggtggtggtgatagtgacgataatgatgatggtggtgatgttaatgtccatgataatgatggtagtgttaatggtggcaatgacgacaatagcagtattgtcgatggtggtagtggttgtggcaatgacattgacaacggttgtggtgttgttgacaacacgaaaggtgggagttgtggcaatgacgatgatggtgtcggtgatgatgatgatagtggtagggctgaaataatggaaacgacgatgatggtggtgcggtgtaatggtggtggtggtagtgacgatagtagtgctagaatgatgatgttggtgatgacaatggtagtggggtgtaatagtggtagtagtagcgacaacaacaatggaggcggtggaacagtgacagcgacaatggtggtggcaaaggtgaggtgtggtagtaatgacaataatggtggaatggttaaggtgatagttgttggcagtggtggaatggtggtgacaaca

SEQ ID NO: 82322 - DNA, 1453 bp, Glycine max
  Peptide Sequence Number=SeqID_199100
atgggcaaccacctctgtgtcactgtgaaggctaaaagaaaagccaccacaaagtctactccatcatctactctgaacctagaaaccatcctggaaaactacgttccccctaaccacaaattttgctgcgaatcaaggccaatatttgactcttttagccccgaaggctgttgccacttttactgcaccaaatgcaccctcagatacatagtctcaaagctccaaaacaatgtgttgaaccttaattgtcccgagtcagggtgccgcgacaatttgagtcctcatttctgcaagccatgcaattctaccgaactacgtgttcatgtggtgggagaaggcgctgtgcgagtccgtgattcccgagaaggacaagttctatttgagcctcacaagggaatgatcgttagagcctcgaactgccctcattgcaagaggattgtctgcgttcagtgtagagcaccatggcacgcggagattagttgcgacaagtttcagatgttgaagaacacgtgcgacgatctgataattgatcatgcaaagagaagaaagtggagacggtgccctaactgcaagcattacgttgagaagaaacaaggatgcgatgccatgacatgctggatgaggctagaggactactctagctcgactacatctcagtacttcaccagcatagccagaccggatgttcaggcggccaacattacttacccaaattcccttattcagctgatccaggggaatctattccatggcctgccgagtgaatatccgtatgcacatcttgcaacatacatcgagatctacaacatggtgaagatagcaggagtgccagaagatgccatcctccttaacctattctctttctccttggccggtgaagcaaaaagatggcttcacttgttcaaggggaatagcttgcggacgtgggaagaggtggtggagaagttcctaaataagtacttcccggagtctaagaccgctgagggcaaggtggaaatctcatccttccaccaatatcctgatgaatcgttgagtgaagcactagaccacttccatgggttactccggaagaatgctacacatgggtttagcgagctagtccaactcaacatcttcattgatggatcccattccaagcagctcctagatgcttccgccggtggaaagatcaagctgaagactccagaagaagccatggagctgatagagaatatggcggccaatgatcatgccattcttcatgctatgttggctcaaaacaagctcctcaccaagaccttagaaactcttacagcaactctaagtaaccttcctcaacagctgcatgtagtgcaatctcctcttacttcttcagtcatgcacagtgggggatgcaacatttatggtggtgctcacgagtcaggctcatgcatggtccacgacgatgcaaccaacgaggccaactacatgggaa

SEQ ID NO: 82323 - DNA, 1521 bp, Glycine max
  Peptide Sequence Number=SeqID_199101
atgaccgcttccaacaagaaaaaccacaaagagaaaccaattcgccgcaaggaagaaaaaccggaagaaccggaagtgccgaaatacagagatcgagctaaagagcgtagagaggatcagaatcctgattatgaacaaactgagcttggatttcatgcagttgctccacctggtactgtggatattcggtcatctgatgcgcacaagttatctattgagaagagcaaataccttggaggtgatgtggaacacacacatttggtcaaaggtttggattatgcattgctgaacaaagtaagaagtgagatagataagaagccagagactggggatgatgttgaggggaaatccaggtctgctaaggaagaccaacaagtgtcaattcgcacagcaactgcaaagggtggataccatcatgatattccaacaaccttgcaccgtagtaaagctgactgtccggtgccagaggaaatggttacagttaatgttgatggatctgttctagatcgaattgctaaaataatgtcatatcttcgtcttggttcttctgggaagatcctaaagaagaaaaaaaaggaaaaggatgcaaaagggaagattttggctgttggtaatggatttgacaaagaggataagccatcaaaggttgaaggcccagctgttgctagagcagaagatgatgacatttttgtaggtgaaggggttcactatgatgtacctggtaaagacttgagccaaagtccggtctctgaggacatggaagagtctcctaggaacaaagaaaaaccttcatatgtcacagaacctacttatggtcctgtcccaccttcaatggttcctcaagggtggcaagaaacaaatggatatgatgtaatgcaaacacaagcctttgatgctggctaccaaggagagtggcaggaataccagtatgctgaacaactggcttacccagatcagtatcttcagcaaaatatgcagccttatgatgtgcaagcaggtttaaatcttccacaagatccacgctttatgtctcaagaagaaaaggatcggggtttaggatcagtgtttaagcgagatgaccagagacttcaacagctgagggagagagatgctcgtgaaaaagatcccaacttcatctcagagagttactctgaatgttacccagggtatcaagaatataaccgtgagatagtggacagtgatgatgaagatgacttatccaaaatggatatgggtggaagggcaaagggtcgtcttcatagatgggactttgaaactgaagaggaatgggcaacttacaatgagcagaaggaagcaatgccaaaagctgcattccagttcggtgtgaagatgcaagatggccggaagacccgaaagcaaaacaaggaccagaagctcaataatgatttgcacaagatcaataagatacttgccagaaagaagatggaaaaggacacgaatggtgagggaggccaccattatgatgatgaaccaacacctggaaagaagcttcgaatatga

SEQ ID NO: 82324 - DNA, 571 bp, Glycine max
  Peptide Sequence Number=SeqID_199102
atggcaaagcaaaattttcctatggattgctcctttgtctgcataaccttaatccagttcattgcttcaatgagtttcagcaaatcccagagcctcataaacgaaactaataccagcacaactaccactactactaaggcctttttcatattaggtgactctactgtagattctggcaacaacaactacataaacactattcctgagaacaaagcagattacaagccatatggacaaaatggtttttttcaagaacccactggacgattctcagatggccgtgtcattgtagatttcatagctgaatatgctaatctgccactaattcctccgtttttacaaccaaatgctgattatagtaacggtgccaactttgcttctggtggggccggtgttcttgttgaaaccaatcagggactggtgattgaccttcaaacacaattaagtcactttgaagaagtgagaatattattatcagaaaagcttggagagaagaaggcaaaggaattgatctcagaagcaatttatttctttagcataggaagcaacgattacatgggtggttatctag

SEQ ID NO: 82325 - DNA, 294 bp, Glycine max
  Peptide Sequence Number=SeqID_199103
atggaggatgccaatatccggggagaacgcaatgagattcaaatgaagggaaccaaatttgaaatggagaagcaaatgagggcgcggaggaagaagggaataagccaatatccgggaagaagaagcacgaatggagattgttgggtgcacggggaagaagaaacaagcgcggaagcaaggggaagaagaaacaggcgtggaagaagaaggtatttttggtatttccttgaattgttgggtgcaccagcaattttgctgggtgcacctaacaacgcccatttcacagttgtttaa

SEQ ID NO: 82326 - DNA, 228 bp, Glycine max
  Peptide Sequence Number=SeqID_199104
aaaattaaagagttcagtttatgtgacaatgttggcgattttgtatggtgggattcttttcacccaacagagaagatccatgagcaattcgctaaggcgttatggaatggaccagcttcctcggtagggccatacaatttagaaaacttcttcaacaaagagatcaagctcactattgctgatgtagttgatgccccagaaattcaccatggagaatttcactactga

SEQ ID NO: 82327 - DNA, 351 bp, Glycine max
  Peptide Sequence Number=SeqID_199105
atgaatcaaaatattattaacccttttttcttaagaagccaatattattatacttcgtccttggcgggtgctaaaccttttttacatgctgatacagctaaatatgctaagctgccacaaattcctccagttttacaaccaactgttgattatagtaacggtatcaactttgcttctggtggagctggtgttcttgctgaaaccaatcaggggctggtgattgatcttccaacacaattaaggcactttgaagaagtgagaaaatcactagcagaaaagcttggagagaagaaggcaaaggaactgatcttagaagcaatttatttcattagcgtaggaaacaacgattaa

SEQ ID NO: 82328 - DNA, 606 bp, Glycine max
  Peptide Sequence Number=SeqID_199106
atggcgaagatctcaaccatacagtctactttggtgatgatggtggcgagaccagaggatgcacaaccatggaggacgagtatgggttatgaagaggaagacgaacgaagaaattttacttttgagcatgcatggttagatcaactcaaagaaaatagttctaaaagaacaaagatttatgttaatgggtattacttgttgtcacctaatccagagacactgattgaggtttcagaaagtgacacaccatcacgaatcccctgtccaatgggacaaaaggcagctaagtggaagatcaaagggaaaggaggtgcaacatctacaccgattgtggacttgtcaggcatagaagttacttatcaaggtaatccttgtggcgtctacccagacttatcttccttcactggaagtggcgtctacccagacttatcttccttcattggaagtggcatctacccggacttatcttccttcaccggaagtggcgtctatcctgacttatcttccttcactggaagtggcgtcatccaaatattcgtagcctgtatcaagcgatccgtgccccgtaagattcttatcatctggtatcagagcttcggctcttga

SEQ ID NO: 82329 - DNA, 276 bp, Glycine max
  Peptide Sequence Number=SeqID_199107
atgaaggatggggctattgtttgccctaatggatcaagttcaccaccgtcgtctcaccagattgtgtcgcaacatcgtcgtcgcatcatcgtcctctctgatttgtgcatcgtcgtcttagtagtgagcagggctttgcaatctagaaccaaatggagcaatgacggtgacatcaatccactccactgtccctcctacaccttcatgacgtcaacttcacaaccagctagaaggcgtggtggtgagcacgtcgagatggaaggtggagatgattag

SEQ ID NO: 82330 - DNA, 914 bp, Glycine max
  Peptide Sequence Number=SeqID_199108
ctgaatatgctaagctgccacaaattcctccgtttttacaaccaaatgctgattatagtaacggtgtcaactttgcttctggtggggccggtgttcttgctgaaaccaatcaaggactggcgattgatcttcaaacacaattgagccactttgaggaagtcagaaaatcactatcagaaaagcttggagagaagaagacaaaggaattgatctcagaagcaatttatttcattagcataggaagcaacgattacatgggctatctgggtaacccaaaaatgcaagaaagctacaatactgagcaatacgtttggatggtcattggaaacttgatacgggcaatccaaactttacatgagaaaggggctagaaagtttggattcttaggtttgtgtccattgggttgcttgccagcccttagagctctaaacccggtagccaacaaaagtggttgttttgaagcagcttctgctcttgctctagcacataacaacgctttgaagctttttctcccaaacctcaagccttaccttgaaggattcatgtactcttactctagtttctataattggcttcgtgatagaatagataatcccacaaaatatggttttaaggatggagtcaatgcttgctgtggaagtggaccttatgggggtgtcttcacttgtggaggtacaaagaaagttgaagagttcagcttatgtgacaatgttgaatatcatgtgtggtgggattcttttcacccaacagagaagatccatgagcaatttgctaaggaaatgtggaatggatcaccttgctcggtacgaccgtacactttagaagacttcttctccaaaaatgagatgatcaaacccactatttctaatgtagttgattccccaaaaaccgagcatgggcaatttcactactga

SEQ ID NO: 82331 - DNA, 201 bp, Glycine max
  Peptide Sequence Number=SeqID_199109
atgaggttgattaaattgaatcccaacaattctatccatggaacagagaaggaacagttctctaaggtgttatggaatggaccaccttcctcggtaggatcttacaatttaaaaacttctttcaacaatgaggtgatgaaactcactattgctgatgtagttgatgccccagaaactcagcaaggacaacttccctactga

SEQ ID NO: 82332 - DNA, 1293 bp, Glycine max
  Peptide Sequence Number=SeqID_199110
atgttgcattctcagggtgtgtcaagacattgtagtctccttgctgtcctgagtggtaaatcacgtgacattaagcaaaaacagaagcagggtactgcttctgaggatcaatttccttatccctttccagaactttcttcctctggtcgtcttgaggtcaaggtattgaccaaacctacggctgatgaactcggtcgatctcttgaacaactgcagccggattttgtttacctgcaaggtcagcagcttgaagatagcgaggaaattgggcctcttgtatgggaagattttgacctgtctgtcccagaagccttgtgtggattgttttcttccaaaatacctaatactgtttatttggaaactcctaagggagaaaaattggcagaggcactccttaataagttttccccaagactgcaaagtggtaattgcatcccaattcagggtactgtgcataccccccacttaccaatactttgtaaggccacatactgtgtaccagtaccaccagagagtattgtgaacctgggagttccatacactatctattggaaaaatgatttttcaaagtatgcagcttcacattttcgacattcttttttctctgtggcacagagtacatccagccatacatgggatgcttttcagcttgctctggcatcttttagactatactgtgtacaaaacaatgtcttaccttctaacagccataagggtgctggaaagcttgggccacaaattcttggggttcctcccaacattgatgtcagtccatgtgtagcagacatgaaggaagaggaaggttcaccggagactatttcttctctaaagatatatgatgatgatgtgaacatgagatttcttatttgtggagttccctgcacattggatgcttgcttgttggggtcattagaggatggactcaatgctcttctatttgcagaaatacgtggatgcaaacttcacaaccggacaagtgcaacaccaccacctctccaggcaggaacattctcacgtggtgtagtgactatgcgttgtgatatatcaacatgtagttctgctcatatatcacttttggtgtctggtagtgcagacacttgttttaatgatcaggcatggcttttggagaatcatattaaaaaagagctgattgagaagagtcaacttgtccaggcatttcctaatcatcaacaaagtaaagcaccttcatccgagcctcgaagatcagcctcagtagcgtgtggatctagtgtgtttgaagtttgtatgcgagttcctgcatgggcttcacag

SEQ ID NO: 82333 - DNA, 538 bp, Glycine max
  Peptide Sequence Number=SeqID_199111
tggtgatccgagagggagcagctccggcggaggcaggggatggaggagacggcggcggttggcggtggcggagggggaggaggaagaggaggtggaattgagagttccggtcgatgaattcgcggggaggagaatgctgtatttgaagcaacctagggttttcgggagcatggagttgttgcgcgttttggtgcattggtgttgggatctgaataaattcggcgaaggagaagccatggcatcgtcggagaatgaaccttcttctcactcttctcctcctgcacacgcgtgtttgcataagttcaggctctatgagactctttcgaacttttacatgataggaagggacaagagcaggacttattggagagtgttaaagattgaccgtctagatccctccgagctgaatgtgcttgaagattccaccacatatacagaaagtgaatgttctgacctgttgaggcgtatacatgaggggaacaggtccacaggtggactgaaatttgttacaacttgttttggaattgttggtatgtag

SEQ ID NO: 82334 - DNA, 533 bp, Glycine max
  Peptide Sequence Number=SeqID_199112
atggtcaagactcaagacaagggtagtaaacttgatcctagagctataaagtgtgcctttgttggatacttctatgctcaaatggggtataattcatcctccatccaagaaattgtgtccaaggatgagaacttgaacaagaagcattggctcaaaatgaatctaacgcaaatgctccaaccagacctgaaaaatacaaggtttggaaagaaattggtttacaccaaatcaaatgtcactcctaaatcgacagacgtccacgtggccaatccaactcctttagatcaggcattatctgataaaaattggaagcaagtcatggaggcattgaagaagaataaaacacgggagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcg

SEQ ID NO: 82335 - DNA, 1830 bp, Glycine max
  Peptide Sequence Number=SeqID_199113
atgttgcatatattcaacacatggatagttaatgtattgagtagcaaccttttccttatgtatttgagacgaggtgtaaatgatgagggtagagtcgctaatgacgtggagacagaacaaattgtatttgaggatgttcctgaaggtcttccggtccaaatatgctctgttgtccagaatcggggttcaatccctcttttctggtcacaggaaacttcacgtctaaatcttaagccggatattatattgtcaaagaaagatcagaattatgaagccactagacttcacttcgaaaatcttgtcaaaagatacgggcatcctgtaataattttgaatttgattaagtcacacgaaaggaaacctcgagagtccatacttcgttccgagttcggtaaggctatagatttcattaacaaagatttatcacaggagaacaggttgaggtttcttcattgggatcttaaacattttcagagcaaagctacaaatgttttgctacttctgggaaaagtggctgcatatgctttgacattaacaggttttttatattgtcaagtgccaccaactcctagacctgaagactgtataaaatgtccatctattagttttgcatacggcaatatcgataagggaagctttcaacccacaagacaatctgatgtcaacaatgaagatggtaatactttagagaggaaacctagtggagaaaacaaccttgctaacggaaaccattttgtcaagccacccatgttccagaggggggttctcagaaccaattgcatagactgcttagatcgcacaaatgttgcacaatatgcatatgggttggctgctcttggccaccagcttcatgctctgggaattattgaccaccccaaaattgaccttgatgatcctctaagtgatggtttgatgggattttatgagcggatgggtgacacacttgcacaccagtatggtggttctgctgcacacaaaaagatattctctgagaggagggggcaatggaaaactgcaacacaatcccaagagttttttaggactcttcaacgctattacagcaatgcttacatggatgctgagaagcaaaatgcaattaacatattcctggggcattttcagccacaactgggtaaacctgctctatgggatttgagctcagatcaacattatgatatagggagatatggtgatgatgatgcaagcttatgcggtaactctgaattatggctttttaggtcatttgccaaaaggtgtttctcagatggaagcattactcgcgacaattctacacctatgtcaacgccaaatccaaagcttgaaaatttctcaaagctaggtttgcaggaccaatcagaaggaagcaatactttttttgagtcatcacctgaaatatctacttcttctgggactgagagtgacatgtcattttcaaggcttttttgcatgagaactgaagtaaaaaaaaacacttcgtaccccattgcccagaggctcttcgctatgcgaaggtacactccctcaatgcctcataaacagctttttggagacatacaaagagagcgtttctttcatagtgatcatatttcctattctggacatggagattcattctgctcttccaactttattgacctggattggctgtcttcttcaggaaattcatgtgaagaagagccatttgagaggttatcaattaccaactcttcgattgctaggctttcttccaaaaatgttatcaatggagttattacgggaggagatactccctccactagtgatttggactcaaacactaagtttggagatggctcagacacagccatttaa

SEQ ID NO: 82336 - DNA, 237 bp, Glycine max
  Peptide Sequence Number=SeqID_199114
atgtgcccgcataagttcagcgaggatgaccttattctgaagaaagtgtcgcaggttcagaaggatcatcgagggaaatgggccccaaactatgaaggaccatttatggtgaagaagttgggcatgaatgtacactctcgttttttgctcactcccacgaccagtactccggagccaatggtcgaatccgcccgatcaaaagtcgcttgttcggcacgttcagtaggggtgccataa

SEQ ID NO: 82337 - DNA, 453 bp, Glycine max
  Peptide Sequence Number=SeqID_199115
atggtagatcaaggaggtgaagctttgggaagtatgggtggcccccattttgtgcagtctagtcatgcacacgtccctcaacccatgggggagacacatgaagtaccccgagaccacactctagccgaattcgagcctcacgtcggatatgccattaaggggcaagcatttggtggcgtacccctgccaaacgctttagggggccctcagtatcgcccacaaccacaactacaacccttacattttacgatgggaagactgcctcctgccatggtggaaagggaaaaatttgatcatatagaagaaaggattaggaccattgaaggaggtggagattacccttttgtcaacatggcgaaactgtgcctagtgcccgatgtcatcatttctccgaagttcaaggtgctggattgcgacagatacaaggggactactttcccaagaatcacttga

SEQ ID NO: 82338 - DNA, 378 bp, Glycine max
  Peptide Sequence Number=SeqID_199116
atggaggccggaatgattaaatgtgacagtaataaggaagatccatgcttgatgcattcaagggcattgcatgatgtagaaaggtgcccaatagctaaggagttgctggcagtactgtggaagtatagcgcacaggggcccgacggaaggcaggacgcatccgtcatgcatgttaggaatgacatgccggctgctaggatcatgaatatttctggtatgagcgacatgactcgcagtggacgtatttttgctcctcccgaactaccggcaaggtcgaaagacaaggggaaggcaaaggcagatacgggagaagacgagcctgaccgtgaatggcgaggcccctgtcagaatgtttgtagaggagggggacgaccttag

SEQ ID NO: 82339 - DNA, 111 bp, Glycine max
  Peptide Sequence Number=SeqID_199117
atgggggtcgtcttgtcgtacaccttgggtacacttaggcttcttgagtatgacatcaatgacactataacccttgttgataagcttctcaataaacttataggagcataa

SEQ ID NO: 82340 - DNA, 264 bp, Glycine max
  Peptide Sequence Number=SeqID_199118
atggttggagatcagtacctatttaatttacaaaagctccaaaacaacgttgtgaaccttacttgccccgagtcaaggtgctacggggagcttagtcctctcttcttcgagcccatgctacccaacaacgtgctggtgtggaggttgttctgtgcacagtgcaaggcaccctggaaccaagggatacgctacaaggagtttcagaaactgaagaagaacgagaaggagagacaagatatcatgctcatgatcctcgatgagtga

SEQ ID NO: 82341 - DNA, 1035 bp, Glycine max
  Peptide Sequence Number=SeqID_199119
atggttgcctcgatcacaccagtgatatttgttatcagaagcaaggaagtgtcgttcccaaatgcaagtcgacctcgccttcccaacaagagtgggaattctagcagtggtagcatcaatagcgttgcaagcgatggaagtagtagaaacccatctgatgaagaatgcaaggatgggtatgtaccagcacccagtcccaacattacacaagcccaatttcaacaactgatggctttactccaaaagacctcaactggtgatatgaacttcctccctacaccacccttaggccaagccacatcttttgaccagactacttctaaccccctagacggatccaccatatccactgaaactaaccctcccacgccacctccaacaaacgatatctctcctatgtccttaactctagaattcttaaatccatctccttcctctccttcgacttcatcttttccacccaattcgccaccacctatcaattctccacctcgccgatcaagtcgacctagacaaccaccaccttatctttctgagtacaagtgtgatcttcctcttctcaaatcagttcaatcatcttctacctgctcatatcagattcaaacatccctcacatatgatctaatttctccctctcatcatcgttacatcatgtctctgtcttctgagtctgaacccaccagatttgacgacatcgtcaaacaccgttattggagagaagccatgaattgtgaaattgaggctttaataatgaaccagacctgggatgttgttcatacccctcctcatgttcgccccatcggatgcaaatgggtttacaaaatcaaaaggttacccgatggtagtgttgagcggtacaaagcccgcctcgttgcaaaaggcttttctcaaattgaaggtgtggactacttcgaaaccttttcccttgtggattctggcatatttggatgcaaaccaccttctacacccatggacttcgacttcatgtcaattccttcggccttcttgctgatccactttcatatcgaagactga

SEQ ID NO: 82342 - DNA, 222 bp, Glycine max
  Peptide Sequence Number=SeqID_199120
atgaggactggaagtgcatgtttgtttcagcatacgattcacaatttcatggaaagacgcagaagcaagcctgagctgcttctgctgatctactttggaaaggagtatgcggctgatgcagccacaaatgcagctgcgacgcggttgcaatgcatcacaaaacctttacaatgtgggcacaattgtgtttgtggaccagaccagaatttaaaaccatgctaa

SEQ ID NO: 82343 - DNA, 1035 bp, Glycine max
  Peptide Sequence Number=SeqID_199121
gatagttcatccagtcatgcgccgcgtggttccggaacggttgctgttggcgcgaaagccgctggactggccgatgacggcggcagacccaaaagccggagaagctccggaacacggtacgcctgccctgctccagcggatcctcggcggggttgtaggcgtcgtcgaactcggccctggcaaaaggcgtcagctcacaagcacgagccaggcgctcgccatcgtctcgtgcgacacggaacagattcacgatctcaccgtccaggtcgttgtagacctctgcgtaggcgcgcggtttgcgcagcaggacgctggcgccgcccccgaagggttcgacgtagcagcgatgcgggggaaggtgctggaggatccagggcgccaggcgccatttcccgccgtggtagcggatcaaggggcgtttgggcgtcatgcagatcccctgggcgcgctactatggcgcgcaacacttccggagaagccatgaacgtccgcgagttgatcacctacatcgccaaagcctcgctgctctgcacggttgctttgctggcaggcatcggtgcgtctgcagtctttttttcctggacttccggcacctatgcgccagccaatagctcggacttggccgcatggatccaggcagtcggatctatcggcgccatcctgggggcattctggctcgcgaaccgacaagccaatgaacaaagaaaccagatccgtgagcagcgcttgctgctcgacaggcagatctgtggcgccatcgaggtcgcctactcggttgcgaatgcgatacgagaaaaggcggacggaacatcgctgactatgttcctcgaagtctggaactactacttgggcagccacacggggagacctgctgcgcaatgcaaaaccccgccgttactcccggaacctcgtgctggagcttgtccaatcggaaagtggtgtcaggccattggagttcgcacggatgtgcacgcaaatacgcatgcacgccaaaatcctcgacagctcgatctcgcgttttcggcaaatgaatga

SEQ ID NO: 82344 - DNA, 880 bp, Glycine max
  Peptide Sequence Number=SeqID_199122
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcgcagcccgcctcggccagcgcgcacagcacctgcagcttgaggctgcggtggcggcgtccgcgcagttgcgcatcggccagcaagggggcgatggcatcgcgcacggcacggcagtcgccaaagtgcagcccccagcgcagccgggcgatggcgatgtcctccacctcgtgcgggggcaggcgcaggcgttccacgcgcggccatacgccgggatcgtcggcacgctccagcgcctcggacgcggcggcccggttgccctgcagcacgaagatgcgcgcatgctccagccgcgcgctggccgtcacgcggggcagctggcgttcatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 82345 - DNA, 540 bp, Glycine max
  Peptide Sequence Number=SeqID_199123
atggcggatggtgatttggtgaaggaggcattgcagaaaggtgttggcttctactccactttcttggttgctgacaagcttatcttggagtacttggaagagacgaggatcaaggatcttgtgaagaaacactcccaattcattacccatcccatttacctgtggactgagaagacaacagagaaggaaattagtgatgatgagcctaagaaggaaggaaatgttgaggatgatgatgtggctatggagaaagattctaagaagaagatcaaggatgtttctcatgagtggcaactcattaatatttggttgcgtaagcccgaggagactaccaaggaggaggaatctgcttccttctgctctcaggatctctcattgtccaccgggttacaattgcaagcagagatggagacaaaatttgttgctgcgacaagtgaaaagcttaggaaccacatacctgatgatcttgcattctctattctgtcaaaattgtctcaagaggtttggatgtgtctgcaaatcatgggccctcttatttga

SEQ ID NO: 82346 - DNA, 168 bp, Glycine max
  Peptide Sequence Number=SeqID_199124
atgtctgcatatgctcatcaaatggagcagcagtactctgcacctagtctctcagatgattctgtgttttggggatcacaactttgtcctacccctccaatgacaacaaaagttggtgaagtcagctacatggttcacatggtgtcattcgactttgttaaagactga

SEQ ID NO: 82347 - DNA, 573 bp, Glycine max
  Peptide Sequence Number=SeqID_199125
atgtcgttgcaacaagtaagtagcagcgaggggagttccaagatggtgagagacggtgactcggtgaggtttcatgatgacgacaataacaattttgatgagaaagggattaagagcaaccccgatactattgcttcaaaagagcgtgatgggaagaaaagggtgagtagaaacgtgaagaaaaaatatggtattttctctattgaatatgcttttttcctagctcttccttccatgaagcaaattgttgactcaaacactctatttcattatgacagtatgtttgatgttatggtggatgctcctttgttcaaccttcacaggcgatatggaacttcacctcatacttggactccgacactctccaataatatgaaaagtcatgcatcttatgtttataatgattattatcagagaaagcataatagtggtggaacttgtgactttgatggtaccgctacaattactaccaaggatcctagttcttcatcctgtatatttgccagaagttataactcgagcactaggctccaatggctcttggaaattcaggcccctttggtgcgagtatga

SEQ ID NO: 82348 - DNA, 498 bp, Glycine max
  Peptide Sequence Number=SeqID_199126
atgcgatcagagaagaaaccatggtcgccactcctctgtgacgaactcatcgaggaaatcttgtctcgtcttcccgtgaaacctttgatccaattcaagtgtgtgtgcaaaggatggaactccctgatgtcagatccctatttcatcaaattgcaccttagtaaatctgctgcgaaggacgatttggaacaccttcaactgatgaaaaatgtctgcctcggatccatccctgaaatccacacggaatcgtgtgatgtaagttcgatattccattccctacaaatggaaacgttcttgttcaatttcgcaaacatgccaggctaccatctggtcggttcatgtaatgggttgcactgtggggttagcgaaataccagaaggataccgtgtttgtttctggaacaaggcgacaagggtgatatccagagaatcaccaacgctgtctttttccccgggcattggtcgtagaacaacgtctgtctcggctatgatccgtcaa

SEQ ID NO: 82349 - DNA, 387 bp, Glycine max
  Peptide Sequence Number=SeqID_199127
atggccttttcagctcaactaagcttagctttcacatcgcaagagtaccatgaagctcttgaaaaatccattatcttctttgagggacaacgatctggaaaattgccttccaaccagcaacaaacatggaggggagattctggattgtccaatggctcttcctatcatgtggacctagtatgtggttattatgatgctggagacaacggcaagtttgagttgccaatggcttttaccattacattgttagcatggagtgtgattgaatttggaagctcaatgcaggaccaaattgaaaatgccagagctgctattcggtggagcacggattaccttcttaaggcagccaccaccacctctgacgcattatatgtccaagtgatctaa

SEQ ID NO: 82350 - DNA, 279 bp, Glycine max
  Peptide Sequence Number=SeqID_199128
atggctcaaattgcgcttattgctcctgcagcaactgttatacctattattactggcatggggaaacaacaaaaactatcatatgctgcaagaagaaacaaagtgagtttagcatcactggttcctagttggaggcttgaaagggttccaaggttagccttatcaaataataataattcaggcgatgatagaaagacaagtgtcgtggtgaaggtatctgaaggaggagctatctctctccctcatggttggtcagcacaaaagctatatgccctgtga

SEQ ID NO: 82351 - DNA, 3345 bp, Glycine max
  Peptide Sequence Number=SeqID_199129
atgtccgcctcggatcctcctgggtcaatcaccaagctggaagatgctttgcttcttcttgctcaacaacacctttcactcaccaccaaaatcgatgagttacttcatcgtctacctccatcacacccttcaccctctttttctccattcgattccaccaaccctcccctccgtagcccatcccctgcaaccacacataaaatgaaattagacgtgccccggtttgatggcacagacccaaatggctggatttttaaaataaaccagttttttgaatatcacagcaccccctttgaagaccgcttgaccattgcatcctttgccatggatggacgtgcccttgcttggttccaatggatgaccagcaatgggcaacttacgtcttggtcggttttccagcaagcactacaggctcgatttgctcagtcacaatatgaggaccccacaggggccctcttcaagctcacacagaaggggactgtaggggattaccttgccgaatttgaggacctcgcgactcgtgtcgtcgggcttccaccgcccttccttctcagctgcttcgtttctggattatcccctgacatccgtcgtgacgtccaggcactgcaaccactcaccttagcccaggcggcgggccttgcgaaacttcaggaggagaagtttctggaccaccgttttccgcctaaacccaggaatcctgcacatacgacccaaccccctttcctccgcccttccccacccacttcctcacccaaatccttcttccccactcccatttcaaccgcgcctgcacctttactcactgccccgccgcgtactccgcctcctgtgaaaaggctatccccggaagaggttgcatctcgccgggaacgtggtctgtgtttttcgtgtgacgaaaaataccacagaggacataaatgtgcctctagggtttttctgcttatagctgctgacgacgaccctcatctacccaatttaaacccagctgacccagacccagacccgcctgacccacccgataacaacccggcccaaattagcctaaacactcttgcaggtaatgtagcccctgaaacgctgcgtttggtgggcatcatttccgaccaccacgtcatcctccttgttgacggcggcagcactcacagttttatacaagagcagctggtccctcaattgcagttatcatgtcaggccatacctccattacgggtcatgatcggcaacggtcaacacttggtttgcagtcacatgtgcccacgtgtccccatcacaattcagggagcccaattcacagctgatttgtatgtgcttcccattgccggagccaacgttgtcttaggagttcaatggctcaaatctttggggcccatcctaactgattatacgaccttatgtatgcaattcttccatgagggacgtttggttcaattgaatggcgacagggacgcaagcttgaacatgcttacccttcctcaatttcgccggttttgtcgccgacacgaagatgctctctacttgcatgtttctatggcatcgtcggagactcctcatcaaacaccggccccggtcccctctgcaattcaagatctcctgacccactttgcttctctgttccaggaaccacattcgttgccaccacccagggagacggaccatcacattcatctccttccccactcttgccctgtgaatgtgcgtccgtacaggtatccccattttcaaaagcgtgaaattgagcttcaggtggagttgatgcttcagaaagggttaattcagcccagtacgagtcctttctcgtccccagtcttgttggtcaggaaacaagatggatcatggcgcttttgcgtggactacagagctctgaatttagtaacggtgaaggatagatttcctatccccaccattgatgagcttcttgatgagctcggcggtgcgcgctgcttctctaaacttgatttgcttagtggttaccatcaaatccgcatgcattcagccgatattccaaagaccgcatttcgcacgcaccatgggtattacgaatttaaggtaatgccctttgggctctgcaatgcgccgtcgtcgtttcaggcgactatgaacaccatattccggccatatttgcgacagtttgtcatcgtcttcttcgatgacatcctgatatatagtggatccctggatgagcatctctctcacctacaaacgacatttcaggtattgcttgaaaaccaatttgttttgaagttctctaaatgcttctttgcgcagcctgaagttgagtatcttggccatgtggtctcgataagaggggtggaactcgttgcttctaaagtagagacaattcgtcagtggcctactcctcaatcaaccagagctttacgaagcttccttggcctcgtcggattttatcgccggtttatcagaagctacgccactatcgctgaccctctggtaaaggcaaccactaaggatcctttggtgtggacgaaacaaactcagaccgcttttactcatctgaaggaagctttatctactgctcttgttcttatccttccagactttactcaacctttcacggtggagactgacgcgtctggtgttggtatgggcgtcgttttgtcgcaacagggaagaccgatagccttctttagtaaaccttttccccctaagctgctccatgctttgacatatgtacgagaactctgcgtcgtgaccactgcagtgaagaaatggcggcaatacttgctgggtcaacgcttcacaatcctcaccgatcatcgaagccttaaggagttattaacacaggccatccaaacgctggaacagcatgtctatctcgcacgattgctgggatatgactatgtcattcactatcggtctggtctgaacaatcaagtggctgacgccctctcacggttgccggaacaatccgccactaaactcatgatactttcagtcccttctttgactttcatagaagacttgcgccatcaattgactaatcacagtgggtaccagcagatgcttcaggacattcgtgaatcaccctccactcatcctgaattttcagtaacacgagacctcatcactcataaagggcggatatggttgacccgagaccttccgattatccctgtcctcctcactgagttccatgccaccccgactgggggtcatgccggaatcgtcaagacattagcccgattaactgagaacttctattggccggggatcagagatgatgtcacaaaatttgtgactaattgtgtagaatgtcaagttactaaatatgaaacaaagagggcagcaggactactatgtccgttaccagttccgagcaaaccatga

SEQ ID NO: 82352 - DNA, 417 bp, Glycine max
  Peptide Sequence Number=SeqID_199130
atgatcggcgtcggaaagatcaagcagtacagtaacgtcctcgacaagcccctcaccaagggcaagcaagaggttagtttgagcgcattcgcgttcttgttctcggagcttgttcagtacaaccaaacgcaggtcgacaatattggcgagcttgaacgaagtttggtaattaacaatgtacatcccccagactggaggatgctggatatgcggttggggctcgagttcttgagctgctttgccacagagataagggaaacagaagggagacacggctgttgggtattctttcttttgtacacagtacagtatggaaagtattatttggaaagagacatgagatttcttagtcttgagcctttgtcatcctgttatggtatggcctttccagactggcgaaaagatctggtgttatag

SEQ ID NO: 82353 - DNA, 222 bp, Glycine max
  Peptide Sequence Number=SeqID_199131
atgacggtgtttctgtcagatgattgcacaaaggtcttcaagacagtagggttgccaaattccactgtagaaatatcaattgaacttattttgcttgaccgaattgatgctgatagactaactcccaatatgatagtgccaaatatgtgtattttactgatccgagtcaccaatgttggccaaaagtgcaaggtttactcaacaaaaacattactacattga

SEQ ID NO: 82354 - DNA, 761 bp, Glycine max
  Peptide Sequence Number=SeqID_199132
acatcccgtgttactgtgcactaaccaatagaacgttatcaggattacgatcaccaccccgagattacgagattccaggagaaggtgtaagcaaaatatttacaataattggggcatctgctaacctcgtgtttgcatttaatactggcatgcttcctgagatacaagcaacgattaaacaaccagttgtcaagaacatgatgaaagccttgtactttcagtttaccgttggagttctaccattgtaccttgttgcctttacaggatactgggcttatgggtcttccacagaagtgtatttgctgaatagtgtgaatggtgcagtttgggtgaaggctttggctaatatcacagcatttcttcaatctgtcattgcattacatatttttgcaagtccaatgtacgagtttttggatactaaatatgggatcaaaggaagtgcaatgaatgttaaaaacatgtcatttcgaatggtggtaagaggaggctacctggcctttaacacatttgtggcggctttcctgccattccttggagatttcatgagcctcacgggagctataagcacatttccccttacatttattcttgcaaaccacatgtaccttaaggcaaagaaggacaaactaaacagctcacaaaagctctggcactggctcaacattggtttcttttccattatgtctcttgcagcaacaatttcggccatacggctcattgccatagactccaaaacattccatgtttttgcagatttgtga

SEQ ID NO: 82355 - DNA, 966 bp, Glycine max
  Peptide Sequence Number=SeqID_199133
atgaagggttcgaacaaccggttcttcacggtggggttggtggcggcgtggtactcctccaacattggcgtgcttctcctgaacaagtacttgctcagcaactacggcttcaagtacccaatcttcctgaccatgtgccacatgacggcgtgctcgttgttcagttacgtcgccatagcgtggatgaaggtcgtgcctttgcagacccttcgatccaaggtgcagttcttcaagatctctgctctcagcctcgttttctgcgtctccgttgtcttcgggaacatctctctccgctacctccccgtgtcgtttaaccaagccattggcgccaccacgcccttcttcactgccgtttttgcctaccttatgacgttcaagagggaggcttggctcacttacctcacgcttgttcctgttgttactggagtcatcattgcaagtgggggggaaccgagttttcatctgtttggatttattatatgtgttgcggctacggctgcaagggctcttaaatcagtgctacaagggattttgcttgcttccgaaggatacattttcaaatgggtactgacagagttcttgtgtgtcagagagaagctgaattctatgaaccttctgctttacatggctccaatggctgtggttttccttcttcctgcaacacttataatggaagagaatgtggttggcatcacgttggctcttgccagagatgattccaagatcatttggtatctgctgtttaattcgtcacttgcatattttgtcaacctgaccaactttttggtcactaaacataccagtgctctgacccttcaggtactaggaaatgccaaaggggcagtagcagtagtagtttcaattctaatattcagaaacccagtgtcagtcactggaatgatgggttactcactcacagtctttggagttatactctacagtgaagccaaaaagagaagcaagtga

SEQ ID NO: 82356 - DNA, 135 bp, Glycine max
  Peptide Sequence Number=SeqID_199134
atgggatataagatgaggaaaccacaatttgaggcaaagttgcttgcaatgcgaatggattttccacgagcaccaaattggttggatcaaatttctaagagtaaatggactcatgcccacgatgaagaaaaataa

SEQ ID NO: 82357 - DNA, 711 bp, Glycine max
  Peptide Sequence Number=SeqID_199135
gaccccacatccctctccacggagttctccttctccgtctccggccacggccacggcctcctcctcgtcctcgccgccgccggcaacgtctcgaactacgtcggcgtggagttcgacacgtccaaggacgacaacgccggagacccgaatgcgaaccacgtcagcatcgatgtcggaagccacgtgtcggtggccatcgcaaatgtttcagatttgaatttggttctcaacaacggtgaaaagttgcaagcttgggttgattacgaagccagttctaaggttttggaagttaggttaagcaaatggggtgaacaaaagccttctgatcccattgtttctcatgacatcgatttttccaagatttggggtaagaatcctgtgattgcggctttaagttcttccaatggggcccactcggttcaggttgttagtgtctattcatggagggttagtttgaagaaggtttcaaatgggttgcattctctacctgcggatcctcatagtaataataataataataagtttgaggatgagcataagaagtcggtgtgtcccttgacggttctagcttgggttatttttggaactgggtgtgttgcattggtgacatttgtggtgctttttatgtgggtgattttcttccaaaagggtgaagaggagtctcttgtgaaaatacctgatcacccttcttcggatgtcaggagattgtga

SEQ ID NO: 82358 - DNA, 432 bp, Glycine max
  Peptide Sequence Number=SeqID_199136
atggtgaaatcgccagtagaaggaggagatttaggggtgaagtcaaagattgaattgagacaggtaaaatcgaataagaagcaaaaaacaacagacaaagaggtggaggaaagaagtcgaagaggtggccaccgatctcggctacttcgatggttacttgtccacgccatcgccttggaagtcgccgatgcggaagccgccttcagcgccagtgtcacgaaaggagtcgagccgacatcgccaccggttctcctcgacggccgcaccgacttcgtagaggtgcgcctctacggtgacgtgatgctccgctatgtcaactacaagaacgctgggctgcaggcgccacacgtagatccgacgggaccatattattgtggtactggtgctaacaaggctttcgggtgtgatattgttggaattagtcagaaatag

SEQ ID NO: 82359 - DNA, 312 bp, Glycine max
  Peptide Sequence Number=SeqID_199137
atgtcggttgcagaggataagtctcagtctgaatatgagattatggtgaagaggaattgcaggatttgctacctcagcatggacatggacatgacaaaccataacaatgaatcagctgggaatgccatgactcccattgagctgggttgttcttgtaaagaggatttggctgctgctcacaaacactgtgctgaggcttggttcaaggtcaagggtaacaaactgcttaatgtgaacatggcatgtaaagcatctcggaaactcaagctgaaatgcttgtttttaggtaaaatatggctcaaagatcaatga

SEQ ID NO: 82360 - DNA, 1167 bp, Glycine max
  Peptide Sequence Number=SeqID_199138
atgtgttacatcgttgcactcaacgttaagtgtctggtgcctttcaaagagtgcgtggaaaagctactaagtgatgtgtccgaggaagctgttgtttcgtgcttcatctcagatgctttgtgttacttcactcaagcggttgccgacaaccttcagctgcccaggattgtgttgagaactggtggagtttcttcctttgttgctttcgccgcttttccaatacttagacaaaaaggttacctacccatacaagaatgcaaattggaggagccagtggaagagctaccaccactcagagtgaaagacttacctatgattaagacagaggagccagaaaaatactatgaactattgcacatattcgtcaaagagagcaaaagctccttgggagtgatttggaactcctttgaagagttggaatcatctgcactcacaacactgagccaagaattttccataccaatgtttccaataggaccatttcacaagtactttccttcttcctcctctttttgtagcagcttaatatcacaagaccgaagttgcatctcatggttagatagtcacacacccaactcggtgatgtatgtgagttttggaagtgttgctgcaataactgagactaacttcttagagatagcttggggtttagtcaatagtaggcacccatttttgtgggtggttcgacccgggctcatcgagggctcgaaatggctcgaaccattgccaagtgggttcatggagaatttggaaggtagaggcctaatagtgaaatgggcacctcaacaagaagtgttggctcattcatcaataggtgcattttggactcataatggttggaattcaaccttggagggtatttgtgaaggggttcctatgcgatgcatgccttgtttcactgaccaaaaagtgaatgctaggtatgtgagtcacgtttggagggttggattgcagctagagaagggagtggacagaaaggaaatagagaagacaattagaagattgatggatgacaattttgaagggaaggagattagagatagagccttgaagttgaaggaagaggcaaaggtttgcttgaaacaaaatggttcctcttgctcttctttggaagttttggttgcttacattttgtcgttggagtcatttgcttttgaagcctcctaa

SEQ ID NO: 82361 - DNA, 201 bp, Glycine max
  Peptide Sequence Number=SeqID_199139
atgaaagcaaaatgcaaccaaaggtggcttgggggagcaaaaaccatgagtcccaaaactccccctccctcgttttttatattttggtgcaggggttgctcacccaggcgagctaacctaccattttgttttggcgctatcatgagcatggccctctacgggtcggcgttcgcttactcgaacccactcaaggtagattag

SEQ ID NO: 82362 - DNA, 552 bp, Glycine max
  Peptide Sequence Number=SeqID_199140
atgaaaggaatatcctatcgagggaatcatatttgcttcggaagatatgctcttcaagcacttgagccagcttggataacatctagacatatagaagcgggacggcgggcaatgtcacgaaatgttcgccgaggtggacaaatatgggtacgcatatttccagacaaaccggttacagtaagacctactgaaacacgtatgggttcaggaaaagctgataatagcggagcacgcgaactgatgtgtattcgaatcctaggagctagtaatcgacgatatgcttatattggtgacattgttgttgctgtaatcaaacaagcagtaccaaatacgaacttagaaagatcagaagtgatcagagctgtaattgtacgtacttgtaaagaactcaaacgtagcaacggtataataattcagtatgatgataatgctgcagttgtcattgatcaagaaggaaatccaaaattaactcgaatcttttgtgcaatcgcccgggaattgagacagctaaatttcactaaaatagtttcattagcacccgaggtattataa

SEQ ID NO: 82363 - DNA, 288 bp, Glycine max
  Peptide Sequence Number=SeqID_199141
atgcctcacaatcagattgacccgcgaacttgtttattcatctaccgtcgggagggaggggatgaccacggcgcccccgtgcgcccggcctcctcgtcctcgcgacaaacacaaaccccggcgcttcgtgcgccaaggaactcaaatctgttaagtgcgactcccgggggcccggagacgaatcccgtgaaccatcgagtctttgaacgcaagttgcgcccgaagccattaggccgagggcacgcctgcctgggtgtcacacatcgtttccccaacgcaaacatgtaa

SEQ ID NO: 82364 - DNA, 1060 bp, Glycine max
  Peptide Sequence Number=SeqID_199142
agggctacacgccctctccttcagagggctacacgctctctccttgagaggactacacgtcctcggcttcagaggactacacgtcctctccttcagagccctacatgctctcgccttcagagggctacacgtcctcaccttcaaagggctgcacgccctcgccttcagagggctgcaagccctcgccttcggaaggctacacgtccgcgccttcagagggctacatgtcctcgccttcagacgactatacgtcctcatcttcagagggctacacgccctctccttcagagggctacatgctgtctccttgagaggactacacgtcctcggcttcagaggattacacgtcctcactttcagagggctacacgcgctcccctttagagggctacacaccctcgccttcagtggactacacatcctcgccatcagagggttgtgtagcctcaccttcagagggctacacgctctctccttgagaggactacacgtcctcggcttcagaggactacacgtcctcggcttaagaggactatacgtcctcgccttcagagaactatacgtcctcgccttcagaggacttcacgacatcaccttcagaggactacacgtcctcgactttagaaaaactacacgttcccgctttcagaggactacacatcctcaacttctgaggactacatgtactcgccttcagagggccacacgccgtcgccttcagaggattacacgtcctgaccttcagaggactacaaacctcgccatcagaggactacacgtcctcaccttcagagggctacacgtcctctcctttagagggctacacgccctcgccttcagaggactacacatcctcaccttcagaggactacacgttcccactttcagaggactacacatcctcaacttcagaggactacacatccacaacatcagagggctacacgtcctcaccttcagagggctgcatgccctcaccctcaaacaactgcacatcctcacctttagaggactacacgtcctcaccttcagaggactacacgttcccactttcagatga

SEQ ID NO: 82365 - DNA, 213 bp, Glycine max
  Peptide Sequence Number=SeqID_199143
atgaaggtggagattgtaacttccccaacaactagagctcattctttaatggaaagcagtttagtcacacttcggacactgatgatgctaggatcttcgagtgtcaaatcgtgtgtgtcgcaacctacccttcagccagagggcgaggcaagattcaagggtgcgtcttctaaaaaagaaaatgcgcgggagtcaccaccaacatttatttga

SEQ ID NO: 82366 - DNA, 330 bp, Glycine max
  Peptide Sequence Number=SeqID_199144
atgcactctatcagcttcttgctctgccagtatctcctggctaaggtgtgcgatatatatccacgcattgaattggctaacggccaaaccaaatacgccaaatacagtgattcaaaaagcattcaaatgcctaagctgcgccgcatttcacagatgacgagagtcatgagcaaaatgacggcgacagcaacgaagtctatttcgttgaagcctttgggaagagacggcaccgtaaggcgccatttggtggaggagattccgattgtggtgcctaggtacgtcatcaagcctctggcgacggtgacattggaaagcacagaccaaaggtga

SEQ ID NO: 82367 - DNA, 426 bp, Glycine max
  Peptide Sequence Number=SeqID_199145
atggtgggagcaggtttgaaaaaggatcttagagtgtctagggttgtgccaggagggtctcttaatgccttcctttttcttctcatcggagttatttcacaaagacttgccatgttggtagagctccgctcttgcaattgggtcgttgcgattacgggttggatgtctaattgtccaggcggtaatgatagtatcttacgggctgtcaagaacgtagaggagggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 82368 - DNA, 774 bp, Glycine max
  Peptide Sequence Number=SeqID_199146
atgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgttcacctacggaaaccttgttacgacttctccttcctctaaatgataaggttcagtggacttctcacaacgtcgcgggcagcgaaccgctcacgtcgccgcaatccgaacacttcaccggaccattcaatcggtag

SEQ ID NO: 82369 - DNA, 198 bp, Glycine max
  Peptide Sequence Number=SeqID_199147
atgcgagcagatgcgctaagcgcaggggcttttaaaactcaatcatcatatggaaacgctaagcgcagttgtgcactaagcgcaccatacgaaactgctaaaaattataaggccattcgttgcatctgcccttaccttgcttcatctccctacattcctgcacctttgctattcattgcattcatctacacaatccaa

SEQ ID NO: 82370 - DNA, 1073 bp, Glycine max
  Peptide Sequence Number=SeqID_199148
atgagtattctcggtactcacgtcgccgaagtgaaaagcatgtcgggtttatacctgaactgtttacccgccgtggcggcttactttattgtcacctggtatgcaatcaaatccgctagcgagcatgcttcttcccgggtgaaagctatcggcttcgttctgcttgccgtttatttaggctggtactcaacggcaaactggctaaaaaaacgccacgaccttgaagtttattatccgctaagctcccgaattttaaccaatacgccgttttacacgggtgcagagtttattattgcccatcgtgataacgccctggcgcagaaaattagtcagcacagcgttaattatcctgccttgcagtatcaggacacgggcatcgaaaactacgttgttatcgtgggtgaatccgcgcgtcgcagcaatatgcagctctacggatttaaccaggataccacgcctgtggaagccgggctggcgaaggacgccctcatttttagcaatgctattgctcctgcgtcagccaccgttctttccgtgccgatgatattaagtaaagcggatccggaccacttcactgccgataagcttgctgacaatatcgttagcgttgctaaaaaaacgggctatcacaccgaatggattagcgcccagggtaatactggcaaaagcaacaattacattgtggcgattgcctctgtcagccagaaagcccagtggattgacacgcgttatgacaccgagcttttacctgctctggatgaggcgcttaaaacccccggcaagaaattaattttcctgcatattaacggtagccatgaaatggcctgcgatcggtatcccgcatccgcaaatattctgcataccggcaacaaatatgaagattgctacaataacgcgattttgtttaccgacgctttcattggcgaagtggttaaacgtctgcagggaagcgcgtcctctctgctctatttttcagaccatgggctggaaaaaaacccgcaactcaattccctctatatgcatggctcacgcaacccaagcaaagaggcttaccaggtcccccagtttatctg

SEQ ID NO: 82371 - DNA, 318 bp, Glycine max
  Peptide Sequence Number=SeqID_199149
atgtgtaagaaggagcatgaatctttcaaagaatacgcccaaaggtggagggatttggcagctcaagtagcgcccccaatgatggaaagggagatgatcacaatgatagtagacacgttaccggtgttctactacgagaagttggtgggttacacgccttcaagctttgccgatttagtttttgtcggcgaaaggattgaagtgggtctgagaagaggaaaatttgattatcctactttgatgaatatgaagcctggggaaaatggacagagtaagaatgagggaggaacccatgttgtgactgccattcctacatga

SEQ ID NO: 82372 - DNA, 657 bp, Glycine max
  Peptide Sequence Number=SeqID_199150
atgccagcgtccatcagcgagaaacaggcgagcgccgcgaccatccaggccaccgcgcgcgaaggggagcgttgcaggttcatggcccattatcgccgaccgcgcgccccgccgggcgccgggcatgggcgccgcgatagaatggcggccactgaattccgcggagccacgcccatgccttccttcgacgtcgtgtccgaagtcgacacccacgagctgaccaacgccatcgaccaggccaaccgcgaactggccacccgcttcgacttcaagggcgtggacgccaagttcgagcgcgatggcgatgtcatcaaccagactgcgccgaccgagttccagctcaagcagatgaacgacatcctgcgtgcacgcctggccgcgcgcggcatcgatgtgctcagcctggagttcggcgacatcgagaccaacctggcccaggcccggcagaagatcaccgtcaagcagggcatcgagcagaagatcgccaagaagatcgctgccgcgctgaaggaagccaagctgaaggtcgaaagccagatcaacggcgacaagctgcgcgtgcagggcaagaagcgcgacgacctgcaggacgccattgccgtactcaaggcaggcaagttcgagctgccgctgcagttcaacaatttccgcgattga

SEQ ID NO: 82373 - DNA, 237 bp, Glycine max
  Peptide Sequence Number=SeqID_199151
atgtcgtcgcggcatagggagtgcctgtcgcccctagcaaggtcatcaggccccccctaccaatcgagctttcatcaagaagtactgcgcccccaggcaggcgcagggcgaaacactacatcagcattgggatggccggtagcgggcaatagacacaccgccaccaactctagagttcacctcagctcatccataaaaaggttagagtgttgcctacgacacatggccgacccatag

SEQ ID NO: 82374 - DNA, 273 bp, Glycine max
  Peptide Sequence Number=SeqID_199152
atgtttgcacattcgattaaaggctgccgtcccttggggacgggcgtgtggggtgctaataccttccccgtgcgtaaatacaactccccgaacctttcactaaaaagtttcgtagatcgcgtcttttccggtttttccgaacgttttcctcaaataaacgttggtggcgactccgcgcgtattcctttcgtggaacacgcatcccgcgagtctcgcgtcgccctcccgccgaagggagtagaaccctcaccattaacactagatgaagaatga

SEQ ID NO: 82375 - DNA, 204 bp, Glycine max
  Peptide Sequence Number=SeqID_199153
gagaggtgttcggagacaggactggagtggtttgatcctttaggcgtggaaggatctgctgcctactgtggagaagtggtatctgccactagtgccggaagctctggagaagcttcaagagacttttcaaaggtggatgcagcttccatgggttacaactaccctccttttcctgatcaagggctcaggagtggaagactctga

SEQ ID NO: 82376 - DNA, 219 bp, Glycine max
  Peptide Sequence Number=SeqID_199154
atgaggataattcccaagaccggatattttaagtgtgaaatttgcaagattggacatatatacagggaccctaaagatggaaatggacttgaggttggaacattggggctagaaggaaggcctaagccactctcgtcctttagcctcgaccgaggggcttgttccgataaccataaagtttcacattgcttaggagtcaaggccaagtgtcgtttataa

SEQ ID NO: 82377 - DNA, 375 bp, Glycine max
  Peptide Sequence Number=SeqID_199155
atggtatttccaacgtgtattgatgaaatcctgttgaaaacttgggctgtcagatttaagtttcgttcacaattacgccaatcatctgtgttggatgtgagtgaagaactccatcatattcaatcattgatagccacccttgggttgaaggaacaatcaagtaagggaaaaggaatagctgttgagccagaaagttcaccaccaatttttgttcccacgccatcattgtcacagtcttctgattacgatcctggaaactctacctgtttaactccaaccaaaaggattagttgtcagcaaaccagttctgatttcgattctgatgagcatgcacagtatcagttatcaactaacaaacatatcaaggctgagtaa

SEQ ID NO: 82378 - DNA, 287 bp, Glycine max
  Peptide Sequence Number=SeqID_199156
gttctacgagtggaaattctaacctaaatcttcttagaagtcatggagttctgaacatcatgggatggagcattctaatgataataggatccataattgctcgctacttcaagcaatgggatcccacttggttttatttccatgcttccattcaagcatttagctttgtggccggcgtaattggaattatatgtggattggtcttatctaagaaactcaacactaaagtgactcatcacaaaaatataggaatcgtcattatcatccttggattcctacaggtttaa

SEQ ID NO: 82379 - DNA, 504 bp, Glycine max
  Peptide Sequence Number=SeqID_199157
atggctccttctttagttcgattatatgaacaaatgcccgaacctaaatatgttattgctatgggagcatgtacaattacaggggggatgtttagtaccgattcttatagtactgttcggggcgtggataaactaatcccagtggatgtctatttgccgggctgtccacctaaaccggaggctattatagatgctataacaaaacttcgaaagactaataccaaattcattaaaaaattcaggagaagcaaaaaaatgcaaggtcgtttgtcttcttggctagtcaaacatggactaattcatagatcattgggtttcgattaccaaggaatcgagactttacaaataaagcccgaggattggcattccattgctgtcattttatatgtatatggttacaattatctacgttcccaatgtgcctatgatgtagcaccaggaggactattagctagtgtatatcaccttccgagactagagtatggtatagatcaacccgaagag

SEQ ID NO: 82380 - DNA, 417 bp, Glycine max
  Peptide Sequence Number=SeqID_199158
atgtttcagtttatgttcctatctctatctggatatcccaagaaagatgtacggtctaatgaggctactccgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgagtcaggaacaacgaatccctttacgataaacagattcattttgcaagttcgttattacgggtagttcctacaaaggatcggactaatgacgtatacaatacttga

SEQ ID NO: 82381 - DNA, 577 bp, Glycine max
  Peptide Sequence Number=SeqID_199159
ctgggatgaccttaagagggtgttcttggagaaattcttccctgaatctaggaccactgccatcagaaaagacatttcaagcattaggcaacttagtggagagagcttgtatgagtactgggaaagattcaagaaattatgtgcaagctaccctcaccaccagatttctgagcaactccttcttcaatatttctatgagggacttagcaacatggagaggagtatgattgatgctaccagtggtggagcccttggagtccatgaggtggccacagattcatcttcatctgctgaaaataaaaagcttaagggaaaacttgatgccttggtcaacctagtaactcagcttgccatgaataaaaaatcagcacttatcgcaagaatacaatccaggttggaggaatcatccaaatctaagacgggcaagtcctccacgacaacaacagcctgccctgctttccagaatggtgttggtccaagcaagccatatgttcctcctccaatgcagcaacaacaacaacaacaacaaagacaacaagcaactaaggccccttcgcaaccttccttagaagagcta

SEQ ID NO: 82382 - DNA, 234 bp, Glycine max
  Peptide Sequence Number=SeqID_199160
atgaattcggttataatagagttgtatttcaaaggaaggatatatgaagataatgatggtgtaatatttgaaggcagtaaaaaagcgattcagattaaacgtggaattagtttcaatgctttgaagaaaaaaattggagacaaggaaaatatattgcgttgcaaatttgcgatgacgaagtcgttgaaacgatgccggaaagttttaaacaacaacaagaaatgtcagttctag

SEQ ID NO: 82383 - DNA, 402 bp, Glycine max
  Peptide Sequence Number=SeqID_199161
atgggaatgaagaaggtagcgtcgggtgtgacgatggatcacgtgctgctggcgtcgcaggagacgaaggaggcacgtgaggctcggattcggagcctcttcgatttcttcgacagagagaatctcgggttcttggactactctcacattgaggccggtctctcggcgctccagattccggctgagtataagtacgcgaaggatttgctgaacgcctgcgatgccaacaaggatgggagagtggatttccaggagttcaggaagtacatggacgacaaggaactggagctttaccgcatttttcaggccatcgatgtcgcgcacaatggctgcattttgcccgaggagctctgggaggcgcttgttagagcaggcatgtgtcttgtacctcttgtgttttaa

SEQ ID NO: 82384 - DNA, 336 bp, Glycine max
  Peptide Sequence Number=SeqID_199162
atggctaaattcgatccggatatagtcatggagttctacgctaatgcctggcctaccaaggaggggagggccagcagtgtgagtatagccagaggaggagacaggtctctggctttgatgaggaggctattgcccaactattatgcatactgggcaagattttgcccagactgccgcagggagacgggtgcggatcatgcgcaccagcatgaccatccttacacaaatatggatgacgtgagtgttgcacccacgagataccctattgaccaagagaagtccaacagggccctggggtttcccactctgatcacgggcctctgccagttctacgga

SEQ ID NO: 82385 - DNA, 1006 bp, Glycine max
  Peptide Sequence Number=SeqID_199163
agggctacacgtcctcaccttcagagggctacacgccctcgccttcagaggactacacgttctcgccttcagaggactacatgtcctcaccttcagaggactacacatcctcgctttcagagggctacacgtcctcgccttcagaggactacacgtcctcgccttcaaaggattgcacgtcctcgccttcagagggttacacgccctcgccttcagaggactacacgtcctcaccttcagaggacttcacgtcctcaccttcagagggctacacgcccttgccttcaaaggactatacgtcctcccctttagaggactacacgtcctcgccttcagagggctacacgtcctcgcctttagaggactacacgtcctcgccttcagaggactacacgtcctcaccctcagagggctacacgcccttgcctttagaggactacacatcctcgccttcagaggactacacgtcctcaccttcagagggctccacatatgcgcctttagagaactcaagttactctgccacccccctgatctcggaggagggccaactgtggaagcacaaccagagagggaggctatcatgcagctactatgcgtaccagggctagatttcacccagaccgccatagggagacgagtgcggatcatgcgcaccaccagaactccaatctccccctgccgaagtgctaggatcgtgcccataagacacctagtggacctagagaagtccagcatggctctgaggtttccaactctatttacgagcctctgtcagtcctacaggatgcccgtcccccaagcaaggtcatgccatcgtgacatagggatcgcgcctgcaagacacccagtggacctggagaagtccaacagggtcctggggtttccagctctgattacgggcctctatcagttctacagagtgcccgtcacccccagcaaagtcattaggccccctactaaccgagcttttatcaagaagtactgcgcccccaggcaggcgtag

SEQ ID NO: 82386 - DNA, 375 bp, Glycine max
  Peptide Sequence Number=SeqID_199164
atggtccacccttatgagaaatcaagagatcgactcaccgagagggccgggcttgttgaaattctgataccgatgacagatgtcgtaccggatgtcacgacatcacgcttcagaacatgcagattatatttgacaatttatgtgtccagtattttcgggcaggatgtcctggacattgtatccgacatcgtggatcctgcagcttcaattcttcacttgacttttatcttgccttgtgcattgtacagcaactccagtattttcgggcaggatgtcctggacattgtatccgacatcgtggatcctgcagcttcaattcttcatttgacattttatcttgccttgtgcattgtgcagcccgatctgattccttga

SEQ ID NO: 82387 - DNA, 346 bp, Glycine max
  Peptide Sequence Number=SeqID_199165
atggctcattttattccatgtgaaaaagttgatgatgcttcccatgtggctgatttgtttttcatggagattgtgagattccatgaaggtcaagcaaaggtagactatgtgaagaagcttcatgagagagtcaaagatcaaattgagaggaaaaataaaagctatgctaaacaagccaacaaagggagaaagaaggttgtcttcgaacccggagattgggtttgggtgcacatgagaaaagaaaggtttccggaacaaaggaaatcaaagcttcaaccaaggggagatggaccatttcaagtgtttgaaagaatcaatgacaatgcttccaaagttgagctgcccg

SEQ ID NO: 82388 - DNA, 219 bp, Glycine max
  Peptide Sequence Number=SeqID_199166
atgactgtgaaaaagaggctaagttttgaattgcaaagtgtagcagtggggataagatcagcagttgggctaagcgcatatccaccgctaagcacagcttcagcgcgcttagtgcaaaggagaatctgcttctacagatggccagggcacagaattcctgagcagacacaggcctatttggggaaaagagccctagaagcaaaaaagaggagtagttga

SEQ ID NO: 82389 - DNA, 520 bp, Glycine max
  Peptide Sequence Number=SeqID_199167
atggatggggccgtgagagggcttggtgttcatgcgcttgcggaggaaacgcaagtacttcatcttctgcctgacgagcccaccggagatgcaaatctcctcgcagcgtaccaccaccaccttctgcccattcagaagttctttcgccacgattcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 82390 - DNA, 135 bp, Glycine max
  Peptide Sequence Number=SeqID_199168
gtttggcggcaagcaacggcggctcatggtggccaccggtggtcatgggtggtggagaaagagatcttgcttagtgagctcatctcgctaagcaggagtccactttttgcacttagtgcgacaattcacgcttag

SEQ ID NO: 82391 - DNA, 264 bp, Glycine max
  Peptide Sequence Number=SeqID_199169
atgtcggccaatgatcatgccattctgagggacataaccccatcaacccataaagaagaacctattggagctaaacatcacatgatgctttgttggcatagaacaagttgtaccatgtgtggtgaagctcatgagataggccaatgcattcccactgacgataacactcaagaaattcatttcatagggaatcagcagaggcaagggtacactcaaggaggatttccaggcttccagcaaggtctttataatcaacaaggatag

SEQ ID NO: 82392 - DNA, 156 bp, Glycine max
  Peptide Sequence Number=SeqID_199170
atgttcgattggcttcatccggtgattcttttcgggatacagcgacaggccaatgtcgaccgaaacacaacggcggttgagttcccgcgaaaaaccacaggcaagctcgatggtaaacctattattgagcgaaatcaacaaggaaaatttgcttga

SEQ ID NO: 82393 - DNA, 372 bp, Glycine max
  Peptide Sequence Number=SeqID_199171
atggagaagctgagacatgccagtgtcaaagcaaccatcgagaggtacaaaaaagcatgttcagattcgtccggtgctggatctgcttctgaggctaatgcacagttttaccagcaagaagcggataaacttcgtgcacaaattagtagcctgcagaataacaacaggcaagttgaatcgcaaatgatgggtgagtctttgggccctctgactgccaaggaactcaaaaacctggagactaaattagaaaaaggaattagtaggattcgttcaaaaaagaatgagctgctatttgctgaaattgagtacatgcagaaaaggttatatttgcatatattgtcttgtcagcagctggcacttgattggtcctga

SEQ ID NO: 82394 - DNA, 177 bp, Glycine max
  Peptide Sequence Number=SeqID_199172
atgcatatgattttgatgctttctctgaagctgagcaaactgctcagggtcaagatacatttagacagtgtgatgcttgtgagtgattcaacatggatcccagttgttcaggagcttataaacaaggtgaatggcatgcatctaagcttgaccaaatggagactcagatggagatga

SEQ ID NO: 82395 - DNA, 510 bp, Glycine max
  Peptide Sequence Number=SeqID_199173
ctccagctaagccgatatgttatatttttgagggtgcgctgagcgagctgtatcccgctaagcgcctaatgaaatcgagagaaagagctagaacgggggacatcccttcatcatccactcaagctcctctcctgcaagagttggctcataacaagccaatcataactatgaagcattttcttgagcaagtagcctggcctgaagctcaacttccattggtgagacccaatgaggctgctccgcctgagcccacacctgtgcatgttgatccaaagccagctaacccacaatctccagtggtgaatccactgtcttctcctgagtgtgaagtagttcccccatctccacctctgattatcatcttcgatgcatcatcagatgaagtggctgccccccctgattcaccagcaggagaaatagctgaccttcctacttccccagttggaggaatttccgatctttctgattcgtcatctggagaagttgttgctctcacaatgtctgcttaca

SEQ ID NO: 82396 - DNA, 246 bp, Glycine max
  Peptide Sequence Number=SeqID_199174
atgagttctggatgtttgctagtagatcccaaaggtcaaaatcttgtgctgtttgaatgttgttttgctttgatgttgggaaagcttgggaggattgatggggacccggtgttgagagaaacgaggatatgggctacgtgggagtacgtgagctcagttggaggtgggcaacaggggatggtgggtttatgcgcgctttgtggatgtggaaaacttgttgtgcaccatcgcccgaccgccacctag

SEQ ID NO: 82397 - DNA, 258 bp, Glycine max
  Peptide Sequence Number=SeqID_199175
atggttagaactaaaggtctcgaacatactttaggtcgaacaataggaaaagccctaaggagtagagaggctagtgacgatgataatgatgtgccccagcggcgaaggcctatcgcatattctcgggcatttcatagcttcgagcagcttcatgttgacaacgttgtcgatatgttggtggaattactcgagctcagcgctgtagaggcaggagctgaaatgattcaatgtcatgactcttatgttcgactatcctga

SEQ ID NO: 82398 - DNA, 279 bp, Glycine max
  Peptide Sequence Number=SeqID_199176
atggtcgtcattttgcctaaggaaaatgttgtcatctggttttgttcattgcatactaggccagacaactacctcaaaggaataattaacagcatccatgtttgtattcaacagtgctttgaaggacttgacgatactccacaaagtaaatccaaggctggtgctaggttgattgttgttaaatatttcaatgatgtcagaccattggaacctgagagattgaaggcgcttcgcatccagtgggcaaagtattatttgaaagttagaaatgaaacttag

SEQ ID NO: 82399 - DNA, 703 bp, Glycine max
  Peptide Sequence Number=SeqID_199177
atgctctcactcgaacccttcacagaagatcagggtcggtcggcggtgcaaacccacagggggatcccccccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccg

SEQ ID NO: 82400 - DNA, 417 bp, Glycine max
  Peptide Sequence Number=SeqID_199178
atgctgacaactccgaaaagggtgcagatgagcacattggcctctgattgtcaatcaaacttggggtctccgaatgatgaggtgcggataactgtaaggtgtctccgcatgctaccagactctcgggtcatgatagcaaaaggtggggtggtcgacaaaagtggggcttttgctcctacgtatcctcaatttgtgatgaggaactcaaacctacacagttcttgcaaagcgttgcggataatcgtaaggtgtctccacatgctaccggactctcgggtcatgatagcaaaaggtggggtggtcgacaaaagcggggcttttactccgacgtatcctcaatttgtgatgaggaactcagacctacgtagttcttgtgagcggtgtgagactaaaatagtctcgacgttctttcactaa

SEQ ID NO: 82401 - DNA, 1206 bp, Glycine max
  Peptide Sequence Number=SeqID_199179
atggtggatcttgtgctggaaattgtactaggcttctccaaaattgtggttgtgcttatccttagtttaattcccaatataaacaggctcatgctgtatcatgtttctgctgaacgactgattattaatcttctatctcttaaacagccacttgcagatgctattttttataaaaagaatgacgtgatcaaactattggagaagcatggagcaaagcctttgatggcccctatgcatgttaatcatgcgcgtgaagtcccagagtatgaaatcaatcctaaagagcttgattttaccaacagtgtggagataacgaaggggactttctgtagtgcattgtggcgtggaacaaaggttgcagtaaaaaagcttggggaggatgtaattagtgatgaggagaaagtgaaggctttcagagatgagcttgctctgttccagaagatccggcatccaaatgtcgtccaatttctgggtgctgtgacccagagtagtccaatgatgattgtgacagaatatcttcccaagggagatcttcgtgatttcatgaaaagaaaaggagctttgaaaccatcaacagctgtgagatttgcacttgacattgctaggggagtgggttatttgcatgaaaataagccatcgcccattattcaccgtgatctcgagccttctaatatattgcgggatgattctgggcacctaaaagttgcagactttggggttagcaagttgctggcagttaaagaagacaagcctctaacttgccaagatacttcctgccgctatgtggctcctgaagttttcagacaagaagaatatgacactaaagtggatgtattttcatttgcactaattctgcaagagatgattgaaggctgccctcctttttctgcaaagcaagacgatgaagttcccaaggtatatgctgcaaaagagcgtccacctttccaagcaccagccaagcgttactcccatggaattcgagaattgattgaagagtgctggaatgagaatccagcaaagcggccaacatttaggcaaataataacaaagctggagtccatctacaacacaattggtcacaaaagacattggaaggaagaatgtatccaacaacttatccacctccccccagttaaggttagggccattgaaatgcttccaaaatctggaggccttgttgaagagagatcattcaaatggaagtag

SEQ ID NO: 82402 - DNA, 240 bp, Glycine max
  Peptide Sequence Number=SeqID_199180
tggcctaagctatgtaagccagaagctatgcaaaagaaggacgtgaacgaggtgcctgggtctcgctggtgctactggcggaatgcccagtcccagtcagcacctatatcgctggtgctactggcgataccagcccagtcaactttggttccgcttttggcaatggcggtacacatgtgtatcactgatggcagtggcgatacatgcttgccgccagtaggaatgacggaatcaacgtaa

SEQ ID NO: 82403 - DNA, 693 bp, Glycine max
  Peptide Sequence Number=SeqID_199181
atggcaggcacaaaactctccttaggatattctgttattcctatcctcgttctttttgtatcaactctctatgaagttacaagccttaatgttagcattaatctgtgcattaaggaagagagaatcaccctctttgaaataaaaaaagatctcaatgatcctggcaattccctttcttcaaggattgggaaagattgttgtaattggataggcggtgagctaaatggtgcattgacagacttgaaacatctgagtcacttggaccagagtgacaatgactttgaaggaatcgccattccagaacttttaggttctctcaataagctgcgttaccttgacctgtctcgtacaaatttctctggaatgattccggctcatcttgaaaatgtttcaaatttgcattaccttgatatctctgcaccatcacttggtatcttcacgtggattttgtcacaattacctgcacatctaatgagtagacatgacaagaaaacccgtactcgtaggtacccgtccgaatccgtcccgactttgacgggtaatacccgagttgaccgggtatgggtttgggttcgggtttttcccgataaccaaaagtcagggttggagatacccgatacccgacgggtacgggaatgggacaataaactcaaacccgtcgggtcgggtatcgagtacgagtatgatatgtga

SEQ ID NO: 82404 - DNA, 4217 bp, Glycine max
  Peptide Sequence Number=SeqID_199182
ttggtcttccctactgccattgtaatttcgcccgtcctgctttttcttttgaatcggctactaacaagtgctctgcatatatagccatggaaaagcccgaggttgtagatgtgaaagaggaagcagattttcagctggttgatgaaaataaagtggattggaaaggaagacgagctcttaaattcaaatatggggggatgtgtgcttctgtgctcatactagtgacatatgcatttactaatttcaatttggatgcagctatgattggtttcgagaatttgggaacattttcactagctgtgaactcggtgccatacttcagtgggataatgcattatagtataccagatgcagctaacatgctcaccaactacatgggaaccggttacatactcgccattccagtggctgttcttgctgacacatggattggcagatacagatctgttttaatttctggggtcttcgagtttgtgggacttgcattgcttacagcacaagcacactatcccagccttaagccacccctttgcaacatttatgatataactgctcactgcaaaacaccgagtggtggccaagaagctcttctgttcattggcctatacctgttggcttttggcactgcaggagtgaaagctgccctaccatcacatggtgcagatcagtttgatgaaaaggaccctcgagaagagaggcgaatgtccaccttcttcaacaccctcttgttagccatttgctttggtggtgcagtcagcttaacgttcattgtgtggatacagatcaacaagggttgggattggggctttggtattggcaccattgctatatttttaggtatcgttatctttgcagctggactgccactatacagatttcgtgttggtcaaggaacaaatgctttcaatgagatcattcaggtctacgttgctgcaatccgcaatagaaatcttcctcttcctgaagatccaacagaactgtacgagattgaacaagacaaggaagctgctgaggaaatagagtttctacctcatagagacactttaaggtttttagacagagcagccatccaaataaaacatggagtgcaatctgagaaaccatcaagcccatggaaactttgtagggtcacccaagtagaaaatgccaaaattgttcttggcatgatcccaatattctgctgcacaattataatgaccctttgcctagctcagctgcaaaccttttcaatccaacaaggctacaccatggacaccactttcaccaagcattttcacatccctcccgcatccctcccaatcatcccagtttctttcctaatcattattgttcctatctacgatttcatttttgtgcctgttatgcgcaaaatcactggcattccaaccggtgtcacacacttgcagcgcataggagttggtctagtactctcttgcatatccatggccgtggcttcagttatagaggtgaaaaggaaaagagtggccagagacaacaacatgcttgatgctgtgccaatacttatgccaccattgcccataagcacattttggctttcttttcagtactttatatttggcattgctgacatgtttacctatgtggggttgcttcagtttttctattcagaggcaccaaaagggcttaaatctacatcaacctgcttcctttggagctctatggcacttgggtattttgctagtaccatagtggtaaaaagtgtgaatggagccaccaagcatatcactagcagtgggggctggaagatagctaaatggaatctgttgacttctactgccttagttgtttctgagctccaactgcttactcctagttctaccaaaatgccaacacagtctctctacactgagccacccatgagatgcttgaggaggagaagcgccacgctttatagaacatcactgatccagtcaaattttcaacaatcaaacaatggcttcaaccgacaagacagcacgtgtgttccttcgccatctatagccatgacatgtctcgccagattgagacacaccactactgctccagactcagccagaacttcatccagtgtgctgtctatgataccgatgaaatcaatgctcgtctcctcgtacattgttcctgctgatgtctttgaaacctttcctcccgaggagcagaagctttggcattctcatgcttatgagattaaatcaggtctgttggtgaatctcagagttcctgaggttattgccatgccagacctcgaaaactttgcccaaacttacggcaaattctggtgtacgtggcaggttgacagagccctgatgatgtctccacaagcagtgagtcctggtttggtgagggcagacttggtgcttgagagggatgccaaatacaatatttcctcagatggcctgaaaagctcaaggttggagattccagagccagagatgatcaaccctttggcagactattggaagcaacatggcaaaggatttggcattaacattgaggagactgagatgaagtccccttggggtaatgatctcaccggcgatataattcaaatgttggagaccttgtcatcctgttgctaccaaagtctagagtttttggatttaagttccaatcaactatctgggaaattgccacattctttaggacaactcagcagactgtctcaccttgatctatcaagcaactcactctcaggtcttgtaccagcaactatgggaaacttatcaaatctagatactctgaacttggaaggcaacatgatgaatgggaaaattccagaaagtattggtcaactaacaaagttgaacccatttgccttgaaagtgacacaagattggattccaccttttaagcatttgtatcaagttgaaattcgtgattgtcaagttggccctacatttcctaactggctgagaaaccaaatgtccttggagaatgtaatcctagaaaatgttggaatttctgaggagatacttggatggctttacaacatgtcctctcatattgagcagctagatctttctcacaacaaaataagtagatacctaccaaagaaaatgaacttctcttcctcaaattcacctaaggttaactttgctttcaaccagttgaagggaccaatcccaatttggtctggtgtcactgctctctatctcaggtacagcttactgtccggaacattgccagccaatattggggaagagatgtcacatttgaaggagttggatctctcaaatgacctcttgaataggagcattccactatccataactaggattcaaaatttgagttatcttgatctatccaaaaatcatttgacaggagaaatccctgtgtttgggatgggtatgcagagactagaaatcattgatctatccaacaacagtctgtcagagatcaccaagaaccttcctttgctatcagagttactgtcaagaggcaacacactcacaggaagcattccagaggagctctgtcgtctaccttatcttcatttattggatctggcaaacaacaacctatcaggttctataccattgtgtttgggtgatgtggatggaagattaattgaatacttgaaccaaatgccagtgcattccaccattgatctttctaacaattaccttccaggagagataccagagtctttaacagagctaactcacttgggtgtccttaatttggcctgcaataggctaattgggaacatacccaacaacgttggatcattaacagatttagaaagtcttgatctttcacacaacagtctttcgggtccaatccctgcaagcatgacttccatgactttcttgagctttttgaatttgtcatacgataacctgtctgtacaaattccagttgctaatcaatttgggacctttaatgatccatcaacttatgaaggcaaccctcaactttgcgggggtcaattgccaactaatttctcattattttttcctgaaaatggagcgcaagaaaagaaacatgaagatggtgctgatgaagatgatgacaaaactgaaaggttgtggttatatgcaagcatagctatagggtacattacgggcttctggcttgtgtgtggcagtttggtgttgaagagatcttggagacatgcatatttcaagtttgtgtttgacatgagagataatcttctggtttggatcgccattaatttggcgggtgtaaaacgcaggtttggactggagagaaactga

SEQ ID NO: 82405 - DNA, 309 bp, Glycine max
  Peptide Sequence Number=SeqID_199183
atggaaaacccaacttcagattctctctctgctactcttggcaactcaatccaagctctgggtcgtggctttgatgtcacatcagatattaggcttctctactgcaagggtgctcctggctcaaggcttgttcaccttgatgaggaccacaccaagaatcttcctctctcccatgacctcgttattcccaatgtctctgtggacattgattggtcacctgggaagagagaacatgttcagggagttcacttaaagcacactttacatgacttagaccctgcattggtgtttaacaatcttaagctctga

SEQ ID NO: 82406 - DNA, 1330 bp, Glycine max
  Peptide Sequence Number=SeqID_199184
atggcaaaatatttcaatgggaggtcaggcatagcaggacagattccacttggaagctttaattccatgttcaattttacgggctgctggatggctgatgcagcagccaccaaatcccttgctatggttggatatttcattcctctggttgaagttaaattaaacaaactaaatttggtcttgactgatgaagtaaagcgtgctgttccttactcttgggatccaacatccttggctagttttattgagaattatggtacccatattgttacatctgcaactgttggtggaagagatgtagtgtatatcaggcagcaccaatcatcttctttgtctgcttcagacattgaaaactatgtaaaggacattggagatgataggtttcgtgatgttaagaacttttccggtcctggtcctttaaagtacaaggagaaggatgttactgtcatatttaggaggagaggaggggatgatcttgagcaaagtcatactaaatgggcggaaactgtcaaattggcaccagatatcattaacatgaactttacacccattgtttctcttcttgaaggagtgccaggcgtaaaatatttggcccgtgctatagatctatatctggagtacaaaccacctatcgaagacctacagtatttcttggatttccaaataactcgagtttgggcaccagagcagaataatctacaaagaaaggaacctgtctgtcagtctcttcagttcagcttgatgggacctaagctttttgtcagtccagatcaggtaacagttggacgcaagcctgtaactggacttaggcttagcctagagggcagcaaacagaatcgacttgctattcatttgcagcatttagtctcactcccgaagaaccttcaacctcactgggatgcacacatggccataggtgctcccaagtggcatggtcccgaagagcaagacagccgttggtttgaaccaatcaagtggaagaacttctcccatgtaagcactgcaccaattgagtacactgaaactagcattggggacctgtctggtgttcacatcgtcacaggtgcccagcttggtgtttgggactttggtgccaaaaatgtgttacaccttaagctccttttctctaaggtaccaggatgtacaatacgccgttccgtgtgggatcacaatccctccactcctgctgcacagaggtcggatggtgcttcatcgtcattgacaaagaaaacctccgaagataaaaaggaagatagttcaatccatattggaaaactggcaaagattgtggacatgacagaaatgtccaaaggcccccaagatattcctg

SEQ ID NO: 82407 - DNA, 1806 bp, Glycine max
  Peptide Sequence Number=SeqID_199185
atggcacccagaaaagtcaaagccatgggcattgacttgggcaccacctacagctgcgtggctgtgtggaaccataaccgcgtcgaggtcattcccaacgaccaaggcaaccgcaccaccccttcctacgttgccttcaccgacactcaaaggttgttgggcgacgctgccatcaaccagcgatccatgaatcctcaaaacaccgtcttcgacgccaaacgtttggtcggtcgcagattctccgaccagtccgtacagcaagacataaagttgtggccttttaaggttgtccctggagccagagacaagcccatgattgctgtaacatacaaagacgaagagaaactccttgcagccgaagagatatcttccatggtgctgtttaagatgaaggaggttgccgaagcccatttgggtcatttcgtaaaggatgcagtgatcactgtccctgcttacttcagcaacgcgcagagacaggccactaaggatgccgggaaaatcgcgggtttgaacgtgttgaggatcatcaacgagccaaccgcggctgctattgcttacgggttggacaagaaagggtggagagaaggtgagcagaacgtgcttgtgtttgacctcggtggtggtacttttgatgtttccctggttacaattgatgaagggatgtttaaggttaaagccacggtgggagatacccatttgggaggtgttgactttgacaacaaattggtcaactatctcgtgggtattttcaagaggaggtacaagaaggacattggtgaaaaccccaaagctcttggaaggttgaggtcagcgtgtgagaaagctaagaggattctctcttcaagttcccaaaccactattgagcttgattctttatgtggaggggctgatctacatgcaattgttacaagggccttgttcgaggaactgaacaaggacttgtttatgaagtgtatggagacggtggagaagtgcctcaaggaggcaaggattgctaaaagccaagttcatgagcttgttctggtaggagggtctactagaattccaaaggtgcagcaacttttgaaggacatgttcagtgttaatggtaacaaggaactttgtaaaagcataaaccctgatgaggccgtggcgtatggtgcggcggttcaggccgccattttgagtggcgaaggagacaagaaggtggaggagttgttgctgctggatgtgatgccgcttagtcttgggattgagactgatgctggtgaaatgtcagtgttgattcccaagaacaccatgatccccaccaagagggagagcgtcttctccactttttctgataatcaaacaagtgttttgatcaaagtgttcgagggggagcatgcaaagacagaggataacttccttcttgggaagtttgagctttctggtttcactccatcgccaaggggagttccacaaatcaatgtggggtttgatgttggtgttgatggcattgtggaagtcactgctagagataggagcacggggctgaagaagaagatcacgatcagcaacaagcatgggaggttgagtcctgaagagatgaggaggatggtgagagatgcagagaagtataaggcagaggatgaggaggtgagtaacaaggtgagggccaagaacttgcttgagaattatgcctttgaaatgagggacagagtgaagaaccttgagaaggttgtggaggagaccatagagtggcttgacagaaaccaattggctgaaactgatgagtttgagtacaagaagcaggagttggaagaaaagtttcggaagtttaggtaa

SEQ ID NO: 82408 - DNA, 864 bp, Glycine max
  Peptide Sequence Number=SeqID_199186
atggtgatttcttactctgattttgataccaatccctctaatccatactacatgcatccgaatgagaatccttctcttgttctcgttcaacctgtgcttgataacaaaaactaccagatctggtgcagatcgatgaaggtggctcttatctccaagaacaaggtcaaatttgttgatggaactctttcccctccccctatctctgatcctctctatgaaccttggcttcgttgtaataacctcgttctctcatggcttcaacgttcaatctctgaagaaatcgcaaaatctctcctctggtgtgatcgcgcttctcttgtatggaaaagtttggagaatcggttctctcagggtgatatttttcatgttgttgatattcaagagggtgatatttttcgcgttgctgatattcaagaggaagtagctcgtcttcaacaaggaactcttgacatctcttcgtatttcaccaaattgatgacgctttgggaagaaattgagaattttcgtccaattcgtgattgtacttgcgctatgccgtgttcttgtggtgctgctacagatttacgcaaattcaaggagcaagataaggtaatcaagttcttgaaaggtcttggtgatcaatactctcatgttcgctcatgtcttgctgtacggtttggtcggagaatcgttgaccaatcaaacgtttgcaacgtaggaaggggtggtgcagttgccttggtcgttggaaatgacctcgatgcggttgtgttgccacacagccacacagctgtagctggtgcccaagtcaatgcctatagctttgactttttttgttgccattggaagagtttaacagagaagaagaaaagagacgagagttag

SEQ ID NO: 82409 - DNA, 1239 bp, Glycine max
  Peptide Sequence Number=SeqID_199187
atggcaacaacatatctagttcaaaaaagaagtaatgtgttccgtttggaatgcaacaagaaagaaacgttccgcttcaacttcaaattctcagtgaaaccaattcagttcagtccaaatcccaaatccgaagtgagatttgcgatggagaggcttcagcgaatgttcgcaggtgcaggtggagctctagggcaccctcccccagattccccaactctcgattcctccgagcaggtctacatctcctcactcgctctcctcaagatgctgaagcacggaagggctggggttcccatggaagtgatgggtttgatgcttggagaattcgtggacgagtacaccgttcgtgtggttgatgtcttcgcaatgccgcagagtggtactggtgttagtgttgaagctgttgatcatgtttttcagactaatatgcttgacatgctcaaacaaaccggaagaccagagatggttgttggctggtaccattcgcatcctggatttggctgttggctctctggtgttgacatcaatacacagcagctgatgcctaaacgatatgctcagtttccctttgacaatgatgacacgaaaagttttgaggctttgaatcagcgtgcagtggctgtggttgtagatccaatacaaagtgttaaaggcaaagtggtgattgatgcttttcgattgatcaatccacagacaatgatgcttggtcaagaaccaaggcagacaacatccaatttgggacatctgaataagccatccattcaacctctttgcatatgcaagggtaaggctgcgtacaacatccctcccccataccttcgcatagcgaagagcctctgggcaatggggtacgaacagagggcgagccctggtgcagcggcattgatccatgggttgaaccggcattactattccatagccattaattacaggaagaatgaactcgaggagaagatgttgcttaatcttcacaagaagaaatggactgatggtttgacacttcggcattttgatacacattctaaaactaatgaacagactgtacaggaaatgttgaacttagctatcaaatataacaaggctgttcaagaggaggatgagctgcctccagaaaagcttgtaatagcaaatgtgggaagacaagatgcaaagaagcacctcgaagagcatgtgtcaaatttgatgtcttccaacattgttcaaactcttggaatgatgcttgacactgttgtcttctag

SEQ ID NO: 82410 - DNA, 2004 bp, Glycine max
  Peptide Sequence Number=SeqID_199188
atggtcacggtcacttacaaaggtgaggagaaactccttgcccccgaagagatatcttccatggtgctgtttaagatgaaggaagttgtcgaagcccatttgggtcatttcgtaaaggatgcagtgatcactgtccctgcttacttcagcaacgcgcagagacaggccactaaggatgtcgggaaaatcgcgggtttgaacgtgttgaggatcatcagcgaaccaactgcggctgctattgcttacgggttggacagaaaaggattgagagtgggtgagcagaacgtgcttgtgtttgatctcggtggtggtacttttgatgtttccttggtgactatttatgaagggatgtttaaggttaaggctagtgtgggagatactcatttgggtggtgtggattttgataacaaattggtgaaccatctggtgaatgtgtttagagagaagcacaagaaggatattagcgggaatgcggaagctttggtgaggttgaggtcagcgtgcgagaaagcaaagaggattctgtcttcgactgctcagacaacgattgagcttgattgtttatatgaaggggttgatctgtatgccactgtgacaagggccttgttcgaggaactgaacaaggacttgtttatgaagtgtatggagacggtggagaagtgtctccttgaggcaaggagtgataagattcaagtccatgagatcgttcttgttggtgggtctactagaattccaaaggtacaacaacttctgaaggacatgttcagtctcaatggtaccaccaaagagctttgcaaaggcatcaaccctgatgaagctgtggcgtatggtgcagcagttcaagcagcgattttgagcggtgaaggagataaaaaagtggaggaattgttgttgctggatgtgatgccaattagtattggattcgagggtgctggtggtgtgatgtcagtgttgatccccaagaacaccgcgatccccaccaagaaggagagggtttgttccatcttctacgacaatcagaaatctcttacagtcaaagtgttcgagggagaacaagttaagacaaaggataacttctttctcggcaagtttatcctctacaggttcgatccattaccaaagggagtgtcacaaatcagcgttatctttgatgtggatgctgatggcattgtggaggtaaccgcggaagatcaagccaaagggttaaaaaagaagatcacaatcaatagcaagcatggaaggctaagcccggaagagataagaagaatggtgagagattcaaagaggtacaaggcagaggatgaggtggcaaagaagaaggtgaaggcgaagaacacactcgagaattacgcttatgaaatgagggagagagcaaagaagattgaagaggcagttgaggaaaccatagagtggctagagtgtaaccaattggcagagatagaggagtttgattgcaagaagcaagagctaggaaggtacctaagagatgatccaaattatagtaacacctcaaattctggagttaaggttcctatatggtgtacatggagatgtccacctaatgggtgggtttgcctgaacacagatggttctgtgtttgagaaccatagaaacgggagtactgggagtgcgtgtggtggtctagttcgtgattcctcaggatgtttcctaggtggtttcactgttaatttaggtatcacagcggttactttagcggagctatggggggtagttcacggtctgaagttggcgcatgacccagtggctaaagacctagcttttgcgttggtttcggagatcaacgagcttgttcgcaaagagtggttggtggagttctcgcacgtgtttagagagtccaatcgtgcggctgataagttggctcacttgggacactcccactcttcggaatcgggtgcgaagcgattctcggacccaccctttgcccttcttgctattcttcaagatgacttggcaggggttgcaaagcaatgtggcgttccctag

SEQ ID NO: 82411 - DNA, 1470 bp, Glycine max
  Peptide Sequence Number=SeqID_199189
atggacccgccatcttcggtcgatcaagacgacgacgttttcctcgacgcgtttcaccaatgccctgccgagggctcaacggaaccttctgattccgcttccacgcttttggaccacaagccacactctccgccgaccacaatccggcgccggccactccgtcgaggtattccgggtacccaatcgtcagattcgagcatcgtgagcgatttgatcgatgtcgattcgagaaggagtttccggcacaaatcgaggcttagaaatctcaacaaaaacgagaattcggaggagaaacccgattcggaagaaccgcgacaagttaatgcctcgccggaagagaacaacgagggctccaccgtaacttcagctgcgaacgacgacgcagccggcgattccattgactctgcacctcgactcggcgactcgtcttcaagtctcctcgaactcgccgcggggctggtgattaacctattagggtttcaaatgaagctaattttcatgttcataacttccccgtttctgttcatgttttattcgtgcatgttcttcatggatcctttggggacaacgaggaagggcaaggatttcgtgatagggattttgaacagaatgcggtgttttgcgttttcgtgcattaggccttatgtgaatagatgggtgaaggagaacgattcgttttggagcgtggcgtttcggtgggggtgggggttcatgtggtcgattgggtttgtgatgaagtgtttggttgagaagcctattcagatgagggaagttttgaactttgattataccaagcttagtcctgtggcttatgtgcctgtaatgtcgtgtgctggtgttgttggtgggagaagttctgagaataaggttgatgcaaggaagtgggcgggtgaacgggttataccttctaagcataaggtgcaggtcactgttgagttaagggtgccagagtcaggatataacagaaaccttgggatctttcagaccagggtagatttcttattgtctaatggtaaagctatagcaagctcaagtcaaccttgcatgttaagattcagaagtgagcctatccgcctaatcacgactttcctcaagattgctcctcttcttactggctatatatccgaaacacagactctgaatgtgaagatgagaggtttcgtagaaggagatgtacctacttcgtgtttgaaagtgacccttgagcaacgagcagaatatcaaccaggtgcaggcattcctgaaatatatgatgcatctctgatcattgaatctgaacttcccttattcaagaggatgatttggctttggaagatgagcatatttatatggatcgcgatgatggcgttcttcgcggagttactttttgctcttgtgtgttgtacgcctataataattcctaaaacaaggcaaagggtagcttctggtcgcagtcctgcaaccttaaaccatcttcaggcacaacattga

SEQ ID NO: 82412 - DNA, 2199 bp, Glycine max
  Peptide Sequence Number=SeqID_199190
atggccaacatcgaattagatgatagagtgatgagtgaggaaacggaagaaacaatcaagcgtcgtttgttcaaactttgcatgaaaggcgaatgggggaaagtagttgatacatacgagagcgacaagatggctcacatggcaagaataacgagcacaggtgacactgcactgcatcttgcggtcaccgatggccaaaactacgtcgtccaacaactggtgaaagtactcatgtgtgaggagggtcaacgtaaagagtctctgatgattcagaatgatagagggaacacggccttgcactttgcggcttcaggggggagcgtggaaatgtgtgagtgcattgcttacgcagagccttcgttgttgagaatgcgcaacgttgatggcgagactcctatctttctcgctgctctccatggcagaaaagaagctttcctttgccttcactatcgctctgactacaccaaccaaatgcatttcaactacgattccaactgtacaagaaatgacggtgacaccattcttcattctgccattgccggagatttttttgaccgtgagaacgtgagtggtttcactcctcttcatctcctggcgaataagccttctgttttcaggagtggtaaccgcttgggacgatttgaagcaatgatttattacgctataactgtcaaggagctcgaagtagcacccagttatcagcagcaatgtccaacaaccggcaaagaaaaaaacagttatccgaaaaattatcagacatgcatggggtttttgaggttgataaaaatcttcaccttatttgtgactaagctcttcacacaatttctatacataaagcaacaacaagatcaaattggaactgaaagagaccttgaagcatcaacaaagattgctacaaataatggagctgaaacaaattctccaggatctgaaaccagcgatcggtcaagtccattatttccggtcaattaccaaagctgtgtggatctctacaagttcatatttattaagataatgctgacattctttgcaacagaacctaccataaggaacatacaagaaatcaaggaaaagaacgtgtggtctggtcaaataatggatgaacttctgaagcgagcttccatgtatgagtgtgatgacaaaggcagcaaacccctgcagaactggggggaacatcaagatcagacaaacccttatagttttaatgagggcgataatgctttggatgatatcatcgaaaagcagcattcttataccacccaaggagatgatgaaaagatggaaacaccggtgttaatagcggcaaagaatggtgtgacagaaatggtagagaaaatcctagaagtgtatccgatagctgttgatgacttggacgccaagaagaaaaatatagtgttattggcaatagagaacaggcaaatctacttatacgagtccttgctcagaaacaaaagcttaagggaaagtacatttaggaaagtggatagcgagggaaacaccgcattgcacttggcagccaaacttggaaactataaaccttggctcatttctggcgatgcgctgcaaatgcactgtgaattgaagtggtacctgtttgtgagggactcgatgccgtctcatttctttaggtacaagtacaacaatgaaaacaagaccccaagagatatcttcatcgaaactcacagggacctggtcagggccgctggggaatggcagaagagaacctcggaatgtagctccgtggtagcagcactaatagccaccgttgccttttcctcctccaccaacgttcccggcggcttccaagaagacgccggcaccccgattctcgaaaacaggccagaattcaaaacctttgccatctcatcgatcgttgctctttgctgctcagtggcctccatggtgtgcttcctctccatactcacatccaggtatcaagagcatgattttggcaagactcttccttggaagctcatcttcagtttgacattgctgtacgtggccattacctccagtattgtttcgttttgtgctggtcatttctatgtcgaccaactcggatctcttgcacttcctgtatatgccatcctatgcctgtcaatggcaatctttgccttgtctcaatttcccctctacattgatctcatacgggctacaaagaaagtaccagagcgtgaccaagaaacatttctacaatga

SEQ ID NO: 82413 - DNA, 957 bp, Glycine max
  Peptide Sequence Number=SeqID_199191
atggacggacccgccctctcctggtatcaatggatgcactggaatgggttattctcttcttggccggcgatgctgcaggccttagaatcccgatttgccccttcctattatgatgacccccaggggactttattcaaactccagcaaaccggatccgtcggtgactatctcacagctttcgaacgtttggccaatcgcaccattggcatcgctccctcttcattgttgagctgcttcatttccggattaatcccggaactccgccgtgaaaggagctcgcactgcgccgtgaccaggggctctgttaccattgtgacgacaaatggtcccccggtcaccgctgcaaatcacgattgcaccttctcctcgcagatgaagaccaatgccgataagcatcgccgtgacgtccagtacactgtcggcgactgggtatatctccgcctccgtccataccgccagaagtccttgaatcccacatattccaagttggccaaacgctacttcggcccttaccaggtgaccgagcgcataggccccgtggcctacaagctcgccttacccaatgattcccgtatccacaacgttttccatatttcccttttgaaggcacaccaaggagcccctccgtccgatatcattccccttcctcctttggccgtggatcatcaccccgtggtcacacctttgaccattttggactggaaattagattcttccgttacccctccccggcgcctggtcctcgttcaatggatgggtcttcctcctgaggatacttcttgggaactttgggacgatttacaacagtcctacaacctcgaggacgaggttgttttcggaggcgcgggtgttgatagcaatatgcagaacagagaaccccacaacagcatcaatggcaacaatagcaggcccaaaatggtgacccgaaaacccacttacttgaatgatttcgagtga

SEQ ID NO: 82414 - DNA, 354 bp, Glycine max
  Peptide Sequence Number=SeqID_199192
atgggttatatgacagtgactcgtcaagagcggataagatcagacatggctgagttgttgaatgttgacatagcatgcgtcaaaatattatcagaatcacatgaatgctatgcactaatacacgaggataatgcactgattgtgccaatcacaggagcatcaatgaatccagcaagaagcttagggcctgctattttgcaccatgagtacagaggaatatggatgtatttggcgtcaccaattcttggagctctggctggtacatgggtctacactttcatcagatacacaaacaagccagtgcgtgagatcacccggagtgcctctttcctcaaaggtcgcgaagctgagtga

SEQ ID NO: 82415 - DNA, 327 bp, Glycine max
  Peptide Sequence Number=SeqID_199193
atgcttcgaagcatacatcagggccagattattttgctgcagagtctccagctggtagcacctccaaattccatccctacagtagagcaatttaatgaatgggtagcctggccagggactcagcctcctcctcacagggacgacgaggatcccgccgctcaggtaccacatcagccagcggatgagtcatcagagtcttccactcctgagcccttgatcaggaagaggagggtagttgtaactcaggaagccgcagccactcctgaaaagtctcctgaggccactccagagccttcggcaccaatggcagataccacttctccatag

SEQ ID NO: 82416 - DNA, 375 bp, Glycine max
  Peptide Sequence Number=SeqID_199194
atggcctctgtggagacttctaccatggctaagtcccagattttaccatacaacgtcttgggggtagcaaagtgcctgacgtatatatttaagaaggtggcacagaccctccgttggtttgccaaagagaggggatcaagacaggacccgtgcgtgatgcatatgcgaaaggcgcaacacgggaatgtacatagtatgacaatattcacaaaatataagcaaaaagggtacatgacacttatgcatggcagtgtgaaaaatggcacgcagcgtgtccgctccgtgcccctattcaagggacctatatgggagagagctaaaagggcttttagtgataatccccaaggtggtcatatctctcttgatggtctctag

SEQ ID NO: 82417 - DNA, 222 bp, Glycine max
  Peptide Sequence Number=SeqID_199195
atgaaggttcagttagtgaggcagacacttaacaccttccttgcttggtcagcacatcttgtaaagccatacccagaacaagataaacaagtaactgagggaccgacgaaacctgtagctatgctgaatcctgacatcgatcccctctacttgatgacattgaccattccacagattttcctcaagccattaccggtgtcgtgggatgctagcgtgttttgg

SEQ ID NO: 82418 - DNA, 320 bp, Glycine max
  Peptide Sequence Number=SeqID_199196
atgctaaacaaccagaatctcatttgtggttatgagaaaatttcatcagcagattctccttccccgatagacacattgttttttgtccgaaaagcatatgttgatctgattagttggaagttttatctctttactaaagcacgttcgcattttagcgaagaaaacactgagacaatttctagtctcacaagttatcaagaactacgtaggtctgagttcctcattggaggatacgtaggagcaaaagcctcgcttttgtcgaccacaccgctttctgttaccatgacccaagagctggtagcctgcggagacaccttacg

SEQ ID NO: 82419 - DNA, 245 bp, Glycine max
  Peptide Sequence Number=SeqID_199197
tggcctaagctatgtaagccagaagctatgcaaaagaaggacgtgaaggacgtgaacgaggtgcctgggtctcgctggtgctactggcggaatgcccagtcccagtcagcacctatatcgctggtgctactggcgataccagcccagtcaactttggttccgcttttggcaatggcggtacacatgtgtatcactgatgacagtggcgatacatgcttgccgccagtaggaatgacagaatcaac

SEQ ID NO: 82420 - DNA, 246 bp, Glycine max
  Peptide Sequence Number=SeqID_199198
atgggttacgaaggtggtatccaatttcaagatgatccaatggtttgggtgtatgcaagaaaaagaaagggctttgggagagcaagaagggagaatgagtttgggaggaagagagagcaaaaaatgtacatagagaaagttgtacaagaagtcatttccttcaacaatcaaccaagtggaaggttgaagaacatagtcatcatcgaccttgatgataggctggaggaaacaccttcgttaaattaa

SEQ ID NO: 82421 - DNA, 687 bp, Glycine max
  Peptide Sequence Number=SeqID_199199
atgcagaatgctcaggtggtcagtataggtgaaatcaacaatctcagacaggattgttactgcttaactgttggaacagttgatgaaatcattattgaagctccatggagttatgacagttgtcctaactgtacaaccacatttgatccatcaaaaggtgactcagcttgtcgttcttgccataccagtgtgatcgatacagttccacagttagccataatcattttttgtactgattatttatttacacgctttcctgttttatcaaatttccctgaaatttctatggatgtcaaggctggggatgatattaaggtgtttccaacgtgtgttgacgaaattttgttcaaaacttgggttgtcagatttaagtttcattcacaattacgccaatcatctgtgttggatgtgagtgaagaactccatcatattcaatcattgatagccacccttgggttgaaggaacaatcaagtaagggaaaaggaatagctgttgagccagaaagttcaccaccaatttttgttcccatgccatcattgtcacagtcttctgattacgatcctgaaaactccagctgtttaactccaaccaaaaggattagttgtcaacaaaccagttctgatttcgattctgatgagcatacacagtatcagttatcaaataacaaacatatcaaagctgagtaa

SEQ ID NO: 82422 - DNA, 276 bp, Glycine max
  Peptide Sequence Number=SeqID_199200
atggataggtgtgagaagtgtcactatgacaaattttattgttcggattcaaatcagtggttgcgcacttgcgctaaaccaaaaaggggagaaagatcacaactttacccccaaaacccatttgtttcttctgagatgattcatggtcctgtgtttcatgtaaacattatcgctggtggtcatgttgatgaggtacacaaagacctaagagtaagcagtgccggtgaaggtggagttgatggctacgtagtagatgacactaacgaggttcaatga

SEQ ID NO: 82423 - DNA, 651 bp, Glycine max
  Peptide Sequence Number=SeqID_199201
atggagatggaagctaagactaagccttggctggacctatctcttcttctattggctgcatattgcatgcaacaatgtgtccatggacaatcgcagcaaacaccttgcatgttcatctttggaggctatttatctgacaatggaaataacaacaaccttcgaacatattcaaaatccaattacagaccatatggcatcgacttcccagcaggcacaactggtagatttaccaatggactaacgcaagctgacataattgctgagcttttgggatttacggaacgcatcccacccaatgcaaacactagtggctcggacatacttaagggtgccaactatgcatctggatcagcagggattcgccctgagaccggcacgcatctaggcgccaatatcaatttggaaagacaaatcatgaatcacagaatgaatatatattaccaaattgctccaagacttggaagtttagagaaagctggacaacaccttaacaagtgcttgtactacgtgcatataggcaacagtgattacataaataattacttccttccgctatattaccgaacaagcagagtgtatgaccttgagggatacgcgaacgatcttattaggcgctactctcgatatatacagaaaattttgaaaaagtaa

SEQ ID NO: 82424 - DNA, 441 bp, Glycine max
  Peptide Sequence Number=SeqID_199202
atgggtcgtataggctgctctccatatgccatcactacgtataaaacaaatggatcttgctatgaagtgatgaataatgctgcgggaatattcaatggcaagcttagatctctagtggaccaatacaataaccgggctcctgattccaaattcatctttgtaaacaacacagccagaaaccttggcatcgtcaataccggtggtttcactgtaacgaatgcttcttgctgcccaatagggttgaatgtgctgtgtgttcagaattcaacagcatgccagaatagggctcaacacgtgttttgggatgggctcagtaccacagaagctttcaacagattcgttgcaacccttgcttataatggttctaatccagccttcacttacccagggaatatcaagagccttgttcagtccaattacaatacgtccttaaataattaa

SEQ ID NO: 82425 - DNA, 744 bp, Glycine max
  Peptide Sequence Number=SeqID_199203
atggcttgtgaaaccaagtcatggttggttatgtttcttgttttcttggttgctaattgcatgcaacattgtgtccacggggtgtctcaagtgccttgcctttttatctttggggactctatgtctgatagtggaaacaacaatgaacttccaaccacttcaaaatctaatttcagaccatatgggatcgactttccattaggaccaactgggagatataccaatggccgaacagaaattgacataatcactcaatttctgggatttgagaaatttatcccaccctttgcaaacactagtggttcagacatacttaaaggtgttaactatgcatcaggtggatctggtatacgcaacgaaactggctggcattatagcgcttgtgttacaattctcatgcatgctactaaattaacgcaaatgcagggtgctgctatcggcttgggattacagttagcaaatcacagagtcatagtatctgaaattgctaccaaacttggaagtcctgacttagctcgacaataccttgaaaaatgcttgtattatgtgaacataggcagcaatgattacatgggcaattacttccttcccccgttctacccaacaagcaccatttataccattgaggagtttacacaagttctgattgaagagttatctctgaatttacaggctttacatgacattggagcaagaaagtatgccttggctgggttgggccttataggatgcaccccaggtatg

SEQ ID NO: 82426 - DNA, 249 bp, Glycine max
  Peptide Sequence Number=SeqID_199204
atggctacttcaatgaagctaagacagtttgttctcttgctaattgttctcacattgcttgtagtgagttcagaagcaatacaagtccctgagttctcaacattgagcaaaaagataaataggaaacttggcttacgtgaattgatcaacaatgtgcgaaatggtggtgagtggcaccaaaagaggtcaatgctaggtggaaggttggagagagtttcacctgcagggccagatagtcaacatcactag

SEQ ID NO: 82427 - DNA, 156 bp, Glycine max
  Peptide Sequence Number=SeqID_199205
atgtatatcaggtatctgaaatatttgaccaagaagtacttgaaaaagcacaatgtgagggattggcttcgcgtgattgcatccaacaaggagcggaatgtctatgagttgagatacttcaacattgctgagaacgagggtgaagaggaagactga

SEQ ID NO: 82428 - DNA, 471 bp, Glycine max
  Peptide Sequence Number=SeqID_199206
atgttttccgcaaataaaagttggtggagactccgcgcattttcctcctttggaagacgcacccgtgagcctcgcctcgctcgcccgcaaaagggtaggttgcgacaagaggtcctctctttaaggattttggcagagtccaagttgaaagattcgaagtgggcccaagcgtgcttcgatcaactcaatcttatagaaggcaagagattggcagctatgagccatgggcgcttgtatcaaagacgggtgaagaatcatttcgacaagaaggtacaccggtgcaaattcaatgaaggggatcttgtcttgaagaaagtattccatgccctaaaagacaatatgggaaagtgggctccgaactatgaaggacctttcatcatgaagaaagcattctcagaaagagcactggtgcttgccatcatggactatgaagagttgccttcacccgtgaatgccgatatcgtcaaatga

SEQ ID NO: 82429 - DNA, 261 bp, Glycine max
  Peptide Sequence Number=SeqID_199207
atggaatatgaaagcattcaaagtgttattgttggaagtgaaataccaaggtggttcaacattcagcatgtggacagtttaatgagcattgacacatctcccgttatgcatgacaataattggattggtgttgtgtgtggtgcaatattcctgctagttttggatgaactagatcacatgtggctattctatttcactagaagaaaattcattgaagggtataatctcaaaggcattccttatcttggtagccagaaatag

SEQ ID NO: 82430 - DNA, 1455 bp, Glycine max
  Peptide Sequence Number=SeqID_199208
atgaggacatatgatgtatttgtgagcttccgcagtgaagacacacgcaacaacttcactggttttcttttccaagctctctctagaaaaggcattgatgccttcaaagatgacaaagatctcaagaaaggtgaatccatagcaccagagctgctacaagccattgaaggatcttgcctttttgtcgtggtcttttcgaagaactatgcttcctcaacttggtgtttgcgggaactggcagagatctgtaattgcattgaaacatcgcagagacgtgttctgcctattttttatgatgttgatccatctgaagtgagaaagcagagtggatattttgagaaagcctttgctgaacatgagaagagattcaaagaagataaaaagaagatgcaggaagtacagggatggagagaagctctgaaacaagtgacaagtgaccaatctctctggccacaatgcgcggagattgaagaaattgttgaaaagataaaatatatattgggtcaaaacttttctagtcttccaaacgatgatttagtcgggatgaaatctcgtgttgaagaattagcacagcttttgtgtttaggggatcaacatatattgagggcacatggtgtagaagaagtttaccaagtccagccattgaatgaagatgttgttcgattgttttgtagaaatgctttcaaaaggcatcctttagcaattgaagtattgagctcatccttgttttgtcgaaatgtcctacaatggagaactgcgttggccaaatttaaaaacaataaaagtaaagatattacgaatgtgctgcgaataagttttgatgagttggaggacatagagaaggacatatttcttgatattgtttgtttcttccccatttgtggagagcaatatgcaaagaaaattctagattttcgtggatttcatcatgaatatggcctacaaattcttgttgatatatcactcatatgcatgaaaaaggggataattcatatgcatagcttgttgagcaatctcggcagatgcattgttagagaaaaatcacccaaggagccaaggaagtggagtaggttgtgggattacaaagatttccacaatgttatgtcaaacaatatgtgtttgccaccaagttttgaagcaaacaaacttgtagaattgatcttgtatgctagcaacatcaaacaattatggaaaggtagaaagtgtctacacaatttgatatatttgattctctctcactccaaaaatttaattgagatacatgatttaatagaggccctaaatcttgagcggctagatctccaaggatgtatacaacttaagaagattcatccatctattggccttctaagaaaggttattgatgcaatcttccctagaaagggaccagtcactagagccatgagcaagaggattgggctagagctgctgaagaaggccctagggttctcatga

SEQ ID NO: 82431 - DNA, 201 bp, Glycine max
  Peptide Sequence Number=SeqID_199209
atgatatttgttccatttggaataagatttgcatacagtaatgagtttggcaatgtgaaggaagtgaaaggtggaagtccatatggtgcaggaacttatgctgaaacagaggggccaacttccatagagtcgatgcatgcattcgaccatggatattactttgccaacatcacaaagcagctcaaggaagctactgcataa

SEQ ID NO: 82432 - DNA, 989 bp, Glycine max
  Peptide Sequence Number=SeqID_199210
cgttggatgcctttaaggttttcaaggcagaagtagagaaacaatgtgaaaaacaaataaagattatgagatcagaaagaggaggtgaattttacggcaaatacaccatgtctggcttgttgaatcaaaatggtgtggttgaaagaagaaatcgaacattaatggacatggtaagaagtatgcttagcaattccaaacttcctcattcattatggaatgaggctcttaagacagttgcgtacatactaaatcgggtaccaacaaaggcggtccctaaaacctcatttgaattattgaaagctgaagtaacaatttataatccaaatgaaaagaagctggacccaaggaccattagtgcatatttcattggttatgttgaaaggtctaaggggtatagattttattgtccaactcatagcactagaattgttgagtcaagaaatgtaaagtttcaagaaaatgatgtggctagtgggagtgatttaactcaaggcattggtctcgagaaaaatcaatatgagggagcagttcctacatcaagttataagttagtggttttttacaatactcaccaaaattgtgtaacacaagctccacatcaagttgatcctatcctagaagatccaattgaacaacatcaaacaaaaaatgttgaacaacatcaaacacaagatgttgaacaacctattgaacaacaaccagaagagtctcaatatgactttggagttgaaaatgatcctgagttgtttttgcaagcaattaaaaattttaattctaagctatggtatgatgctatgaaagatgaattggaatctatgacaaataataaagtatgggatcttattgagttgcctaaagggataaaacctattggatgtaaatgggttttcaaaaccaagaaggattcattaggtaatgttgagagacacaaggattcgctcaaagagaaggagtttactacagagaaaccttttctcgcgtatccatga

SEQ ID NO: 82433 - DNA, 570 bp, Glycine max
  Peptide Sequence Number=SeqID_199211
atggattttctaaatggcgacttagaagaagaagtttatatgacacaacccgagggtttttcctctagtgatggggctcacttcgtttgcaagctcaagaattcaatatatggactaaaacaggcatcacgtcaatggtatttgaaattccatagtgtcatctcttcatttggttttgttgagaacaatatggatagatgcatataccacaaggactatattaatgaagttctagaaatattttggatgaaagattgttcacccgacatggcacctattgtgaaaggtaatagattcaattcgaatcaatgtcctaaaaatgagcttgaaagggaacaaatgagaaacattccatatgcttatgttgtaggaagccttatgtatgtgcaggtgtgtacaagacctgacattgcttttgtggttggaatgcttaggagatatcaaagcaatccagaaataaagcactggacaattgcaaagagagtgttaagatatcttcaaggaaccaaagattacaagcttatatataaaaaatctgacaatttagaagttgttggctattcagactga

SEQ ID NO: 82434 - DNA, 360 bp, Glycine max
  Peptide Sequence Number=SeqID_199212
atggaaagagttatggcgggaggggttgttgaccttgactatgctctccgtaggaatgagccagctgagcttatagattctagcacttcaaaagaaattgtgttatacgaactacgggaaagatctaaccatctttccatttttttcatgaagacacatatttatgctagtatccatggttcaattccaaaatgccaaaaagtcaaagatttcatgaaagccatagatgaacagtttgaaagttttgagaaggtcttgtctagcaccctaatgtctaagttgtcatctatgaggctcattggagtcgtaggtgtgagaaacacacattatggaaatgagggatctagcagctcaacttaa

SEQ ID NO: 82435 - DNA, 189 bp, Glycine max
  Peptide Sequence Number=SeqID_199213
atggaagccattggttctgtggatgacctcttggatttttcattagacataggtgagaaagatgatgatgacgacaaacctaggaaagcctgtccttcacttaactcaaaatgcggagatccatcattgtttaacccattggtccaggttgatccaaaccattcattttctgagtgtttgagtccatga

SEQ ID NO: 82436 - DNA, 4454 bp, Glycine max
  Peptide Sequence Number=SeqID_199214
atggaggaggaagaagagattgagtgcttcgagtgcctccaacttcgaataaagtccgatttctcggagcaagtgttcttcaattatgccatctccacttctgcttttcctttcggatcctcggctatcatttctggtacagctgatggcgaagcttcgggcgctcaatttatattgcagtacatgccgagtcgtgataagaattgtttcatcaattatgtaaatgaatatattttggatagtggtgaaatcactactaggagtagtgatcctggtattggaagcagtgaagataataatgctgttaatgttagaattacatcatcagatgattctgacagtggcaaagctttttctggaagcacgagttgtagtcattctgaaaggttttcttgcttgaggacaatcacttcactcgcgcctgttgctcgtgtgggaatatcttcctattccacatttcaagaggtctctactgatttcttgtctgggttaatcgaggatcacgtcttagagtcgcttgatctcttcattgaagggaaagcgtctggacgggacagtgtaaatttccttagtttaattgggttgccatcatttgaagaggatccttttccaggctctttgaggcatcccaacatagctcctgtccttgcaatttttaaaacatctgatcacgttaatgtagtgcttccaaagaatccatacaacttggaaagtattcttcattttaaccccgatgcattaaagtctaattggaatagaatatttcttatgtatcagctactctcagccttatcgtacatacatggtttaggggtttctcatggtaatatatgcccatccaatatcatgttgactgactcattatggtcttggctgagattatggaatgaacccgtattggaatctaatttaactttgcaagagagtgaaagagttaattccgaacctgcaagaattggttgttgtaatgttggttgtcgttcttatggcctttatgctgatctaaggctttctccaacaatagattggcaatcttgctttcataaatggtggagaggagaattaagtaattttgaatatttactcatcttaaacagattagcaggaagaaggtggggggaccatacatttcatccagtaatgccttgggtaattgattttagctcaaaacctgatgataattgtgacacagggtggcgagacttgagcaagagcaaatggcgcttagcaaaaggtgatgaacaattggatttcacctattcaacatctgaaatccctcatcatgtttcagatgaatgtctgtctgaattggctgtctgtagttataaagcaagaagactccctttgagtgttctccgagtggctgttcgttcagtgtatgaacctaatgaatatccttccacaatgcagaggctctatcaatggacccctgatgaatgcattccagagttttactgtgatgcccaaatttttaagtcaatacatgatggaatggctgatttggctgtaccctcttgggcggagagtcatgaggatttcattaaattgcatcgtgatgcattagaaagtaatagggtgtcatttcaactccatcattggatagatataacctttggttacaaaatatctggccaggctgctattgctgctaagaatgttatgcttcctatatcagaacccatgatgccaagatcaacaggacgtcgtcagctctttacacaaccacatcctatccgtcatgccactaccagtacaaaacgtcatggttccaataaatatgccaaagtttggagtcaagcaaatgcaacgcaccgagagacatctcttctatctgaaactgcttatctacaagaactagagcaagcatctacattttctgaacatgctaggcatttgaatgccttttaccactatcccttgaatcaaacgagagggaagaatatctcatcttcgggagatccaacaactgagacatttagtgaaagtataagcaaactatctttgattgacagaaattaccaggtgccatataaaatgaatctaatatcttttcttcaacatatgaaagaggaagataaaggctcctcaggatatccagacttgctactctggaagcagaaattatcttcttcaagactttgctctgaagatattgctagggacatattttctgttggttgtctcttggctgaacttcatctttgcaggccgctctttgatccaatctcattggcaatatacttggaagatggaactctaccagggtatctgcaggatctacctcctgatattagattacttgttgaagcatgcatccaaaaggattggatgaggaggccatctgccaaaattcttctggaatctccttattttccaaatactgtcaaatcctcctacttgtttcttgctccacttcagcttgtagctaaagatgaaactcgtcttcgttatgctgcaaatcttgcaaagcacggagctctcagggaaatgggtacctttgcaactgaaatgtgcactacctattgcttaccgcttatagtgactgctgtgagtgatactgaagctgaatgggcatatatgctactgaaggaattcatgaaatgcttaacagtgcaagcagtttcccttctacaagattcatttgtacgggaaatatggaatcgagttggtaaacaagcatacctggaaactattcatccattggtcttgtcaaacttatacatttctccagataaaagttcagctgcctctgcttcagtgcttctaatcagttctagtgaggaactaggtgtacctattaccatccatcagactatcttgcctcttgttcactgctttgggaaaggactatgttcggatggcattgatgtgctggtcagaattggtggcatttttggggaattgtttatcgtcaaacagatggtacctttactgaaaaatgttgtccgttccttcattgatgtgtcatgcatgaataagcctgatcctgtccagagttggagtgctttagcacttattgattgcatgttgactttagatggccttgtagctttcttgacagaagaggtcattgtaaaagagcttcttgaagacctaagttgcatacacattggggttcttatgcagaaacatatggaaattgcagtgcttcaggtggctgcttctactctttttggaatttgtcagcggattggagcagatttgacagcattgcatattcttccaaaacttaaagaactatttgatgagcttgctttctcccaggaaatttctaaaggttcaactactgttggcagaaacttgaagtgggaatatgctggagaatcatcaaaaaacggctcagaaattgttcttgctagaagacctgtaatagcccatggatttacatctgaatacaatcctgcaaagctgttgcttaatggggttggatggtcaattccacaatcccaaggaagaagtgccaaaaatttgatccctcagagacaaccatttaaagttcatcaaagtccagtagcagtgcatgaagaaatgtcataccaaatgaaccatgaaccctggttttggttccctagtccagccaccatctgggatgggcctgaatttcttgggagggtgggggttcagaaagatgatcttccatggaagatcagagcaactgttatatactctatacgtgcacatcatggagcagtgaggtctctggctgttaaccaagacgaatgtactgtttttactgcaggaattggccaaggatataaaggaactgttcagaaatgggaattgagccgaactaactgtttgtccggctatcatggccatgaggaggttgtgaatgatatttgcatcttatcatctagtggaagagtggcttcttgtgatggaacaattcacatttggaatagtcaaacagggaaacaaatattagtatttgctgagtcccagacagaatctggccatcctacaagccatccatcctcttcatcaaaaattaacagtgaccaggcaaatgtgcttaatttgaatacactatccagtggaatattgtctagtgcttttgactcaagcctttatacttgtatgcatctattaaactccgctgaaactcttgtagttggaactggaaatggttctctgaggttctttgatgttgctcgaggtcaaaagcttcatatctggagaggcgaatctactgaatctagttttccttcacttatttctgctatttgttccactggctctgacaagatgcaagcaggtggaatttccacttttccatcttttattgcagctggactaagttctgggcactgtaaattatttgatgcaaagagtggaaatgtcatttcctcttggcgagctcatgatggatatgtgacaaagttggcagcacctgaggaacatctgcttgtttccagctctttggacagaactttacgagtctgggacttaagaat

SEQ ID NO: 82437 - DNA, 564 bp, Glycine max
  Peptide Sequence Number=SeqID_199215
atggcagaaagtggtgacatggggggcttaaaggatatgatgcattttaccaatggatggcatttatttaatgttcaagtattgtacatttttgtttactgtggagtgcatcttgggaccttgagtcctttggaggtgacatctgctgcggggaatactgtccacaatatcaagggaacctctggtgacaagttcagttttaaagccccaacacatggaatgtataaattttgttttcataacccttactcaacacctgagactgtttctttctacattcatgttggtcacatcccctctgagcatgatcttgccaaagatgagcatttggacccaattaatgttaagattgctgagctcagagaggcactagaatctgttacagctgaacaaaagtacttgaaagctcgtgatgcgagacatcgccatacgaatgagagcacaaggaagcgtgttgtattctacactgtgggagagtaccttctcttggctgctgttagtgcactgcaagtcatatacatcaggcgcctcttcagcaagtcagtggcctacaatcgtgtttga

SEQ ID NO: 82438 - DNA, 171 bp, Glycine max
  Peptide Sequence Number=SeqID_199216
atgatgaagattgcaagattgtttccaggattaggcaaagatcgtcgtggacatggattcaagcatctcgatctccagcagtgtgagaaatttaaggaatttggagcacctgagtttcatcatgactgcgcgaaggaactcgaaattcatagtgagttcaaagtctgttag

SEQ ID NO: 82439 - DNA, 950 bp, Glycine max
  Peptide Sequence Number=SeqID_199217
aaaacacgttttgtcttcggttcacaacaatatgcatctacgcagtgattgctcaaggcatcaatgccggagatgtgaagaagcttcaggacgcagggatatatacttgcaatggcttgatgatgcacacgaagaagaatttgactggaatcaaaggtctatccgaggctaaggttgataagatctgcgaggctgctgagaagcttgtgaatttcggttatattaccggaagtgatgctctgctcaaaagaaagtcagtgatccgaattactactggaagtcaagcgcttgatgaattgctaggaggcggggtcgagacatcggcaattacagaggcgtttggagaattccgatctgggaaaacacagctagctcacactctctgtgtttccactcagctgccaactaatatgcgtggaggcaacggaaaagttgcttacattgacacagaaggaactttccgaccagaccgaattgttcccatagctgagagatttggcatggatcctggggctgtactggacaatattatatatgctcgtgcctacacttatgagcatcagtacaacctcctccttggtttggctgcaaaaatgtccgaagaaccattcagacttctgattgtggattcggtgattgctctgtttcgagtggacttctcaggaagaggagagcttgcagatcgccagcaaaaattggcacagatgctttctcgattaataaagatagctgaggaatttaatgttgccgtctatatgacaaatcaggtcatatctgatccaggaggtggcgtgtttgtaactgatccaaagaaaccagcaggagggcatgtgctagcccatgcagccacggtaaggttgatgttcagaaaagggaaaggggaacagcgcatttgcaaagtgtttgacgcccccaacctgccagaggctgaagcaatatcctttacctga

SEQ ID NO: 82440 - DNA, 639 bp, Glycine max
  Peptide Sequence Number=SeqID_199218
atggtcagcaatttcggccccaaagtggcgatgccggtcatggctatcgccgcaatcctgggaaatctctcgcgcatcgcggtctggtggcgtgaaatcgactggcgcgccactctggcctatagccttcctggcgtgccagctgcgtcgttaggcgcgcatgtgctgctctctttacctgcctggatcactgatggcgcgctgggtctgtttttctgggtgatgattttggtcagacgcaacctgaaaaacagtcactggacgctctcgataaagcagttagggctttgtggtggcgtggtgggttttctgaccggactggttctctccaccggaccggtgagcgtgctgatttttaccgcctatggattgagccgtggcgcgtttattggcacggaagcatcgagcgccttgctgttatatttcagcaaggtcagtacgtttgcctttcagcatgcactctcaatgcagattgtgctcaccggtgtgttagtgggcagtggcattatgctgggcaccctgagcacgaaggtgatagtccagagactgtcagtcacacaatttgccgtgctgatagacgccattctgtttatttccggcgcaggattaatcgttaatgcctggtcaggagcaccataa

SEQ ID NO: 82441 - DNA, 894 bp, Glycine max
  Peptide Sequence Number=SeqID_199219
atgaaaaaacgtaacctgccgccgttgaatgcattgcggctgttcgaaacggccgcgcacgccaacagcctgagtgacgcggctgaggaattagggatgactcacggagccgttagccgtcagatcaaattgctcgaagagtggctgggacaaccgttatttgaacgtcagggacagcgcagcgtggcggcggaacatgcccgagcttttgccgcagagatcagcaccgcttttgacatcatcagcgatgctgcggtgcgctttggcaaaacacccaacacccgcacgatacgcgtcaatgcgcaaaccacctttgcgatgcactggttgatcccgcgcctgccggcattccaccgccaatatcctgacattgaaatctcggtatccacctcaaacagttcggaggtgaaagggctatctggctttgacgtattgattcgccgggatgcgctgaacaaacctgaatggcgttactttgagaagaaagcgttatttgaggaaaaactcaccctgattgccgcgccgaaactgttagccacaaaagcgctggacacccctgcagacctggcgacccacgttgtcgtgttatccagtacgcggtcaggcgagtgggaacggtggatgaagcaggctggcgtcggggaggtgcgtccggaacgttttcagcgattcgaacacaattatatcagcctgcaggcgattattgatggcgtcggtgtgggtatcggtggaatacaaatgctgggacatgatttgcagggcaaccggcttgtcaccccgttagctgttgaggcgaagggaagccgctacgtggcgttaattgcgcctgacgtggataaatcatcctcgctaaaccgctttgtcgcatggctggaacgggaagcatgcggttaa

SEQ ID NO: 82442 - DNA, 1467 bp, Glycine max
  Peptide Sequence Number=SeqID_199220
atgtctgacttaacttcttcggcgcacgtggcgctggcagggaatacgccgcagggcgagacgcagtggattcgcagtgcagccgacgtgacgcggctggtcaataacagtaacgcctcgcgcagcaatgcacgcatcgtcatcgccattgcgctgggcggggtttttctcgatgcctacgatctcggtgcgctggccttcggtattaaagatgtcacgcgcgaattcaatctgacgcccgccggcaccggcatggtggcgtcggctatcacctttggcgcgattgttggcgcgctgatcggtggctatctcaccgataaaattggccgctatcgggtcttcatggccgatatgttcttcttcgtggtggcggcactggcctgtgcctttgcgccgaacgagtacgtgctggcggcggcgcgctttgtgatggggctcggcgtcggcatcgatctgccggtggcgatggcgtttctggcggagttttcccgactgcgcggtcagggcaataaggccgccagcgtcgcgatgtggtgtcccacctggtacgcggcgatcagcatctcctatctgctggtgctgctgctgtatgcggtgctgccagagagccatactgactggctgtggcggctaatcctcggctttggcgcggtgccggcgctgttgatcatcgccatccgcagtcgttacatgagcgaatcaccgatctgggcggcaaatcagggcaacctgcagggtgcagcggcaatcctgcggcggtcgtataacatcaacgcggaggtcgcgcaggatgccgatctcactgccgcacagccagtacgtaaagccagctggcgcaactatggcgcgctgctgcagggcgtttaccgccgccgtacgctgctggcaacgataacctcgattgcctcgtctttcgcctataacgccgtggcctttggcctgccggtgatcatctccagcttcctcgcgcagtcgatgctgaccaccattctggtctcgctggcgcttaacctgctgtttgcgtttgttggcggcctgctggcggtgcggctggtgccacggctgggcgcgtggaagatgtcggtggccggttacgcctgccagtgtgcggcgctgctgggtctggcgctggttggtcgcccggccggcggcgaggaagcggccctggcgattgccatgctggcgctgttcctgttcggccaggggtttggtccgggttcgcacaccatgacctttgcctcgctgagctatccggcttcgctgcgcggcgtgggcgtcggctttaaccagacgctgatgcgcgccagttcgacggtatccctgtttgtgtttccgctgctggtcgcggcgttcggcaccggcgtgttctgggtgatcctgctcgcaccgctggccggattactggcgctgctggcgattcgctgggaaccgtcaggctatgacgtcgatgcggaagattttcagtaa

SEQ ID NO: 82443 - DNA, 1095 bp, Glycine max
  Peptide Sequence Number=SeqID_199221
atcatcagcgtcatcgacagcatcgctttccagaccaacattctggcgctcaacgcggcggtagaagcggcacgcgccggtgaacaggggcgcgggtttgccgtggtggcttcggaggtacgcaatctggcgcagcgttccgccaactcggcgcgcgaaatcaagaagctgattgaagagtcggtagctaatatcgacaccggcagccagctggtggagcaggccggacaaaccatggacgagctgatgcagggcgtcagcagcgtcacaacgctgatgagcgaaatcatgtccgccagccgcgagcagagcatggggatcgaacaggtgaacgtggcgattacccagctcgacggcagcacccagcagaacgcggcgctggtggagcaggtctcggcagcggcgcgcgccatggaggagcagagcgtgcagcttgagcaggtggtacacggcttcaaactcttactgcttatcgcgccagcgcacggaatgtgcgcgattttctccgctgccgcttccgctattgtgtacaatagtggggatttttccgaaggagttgtcatgcccgccattgaagttatcctcgttgaccacctcgatcgtcccaccggcaagatggaaaagctggaagtgcatgagaaaggattgctgcatcgtgcggtaacggtttacgtgttcaattcgcgccatgaactgttgctgcagcgccgggcgcaaagcaagtatcactgcggcggtttgtggagcaatacctgctgcagccatccctacccgcaggagccgacgcgcgatgcggctgagcgccgcctgcgcgaagagatgggactggatctggcgttaacgccggtgtttgaactgagctataacctgccgctcagcaacggtctgatcgaacacgagtacggtcacgtgtttttcgccatcagtgacgaagtgccggtgctcaaccttgatgaggctgacgactggtgttaccgctcagtcgaacagattcagcaggagatgcgcgacaatccggcaaaattcacgccgtggttcctgcacacttttccgcgcatccccaacacgctgggcgatttccgcctcaccgcctga

SEQ ID NO: 82444 - DNA, 727 bp, Glycine max
  Peptide Sequence Number=SeqID_199222
tgcgccgcttgtttgcgcactggtttccgcagctggagcgtccgctgtaccagcaggagagtttctggcagctggcgctggcccatctgttgctggtgatcagcggcagcgtgctggcgatagtggtgggcgttggctgtgcggtcttcgctacccgtcacggcggcagggcgttccgcccgctgctggagacgctggcggctgccggtcagacctttccgccggtggcggtgctggcgattgccgtgccggtcatgggctttggcgctgcgccggcggtgatggcgctgtttctatatgggctgttgccgattctgcagggcacgctggcgggactggacagcgttccggccagcagccagctggcgctggcggcaccggtgattatggcaggcgtgcgcacctctgtgatgatcaacatcggcaccgcgaccatcgcctcaaccgtcggggcggagagtctgggttcgccggtgattatcggtctgagcggcttcaataccgcctatgtgattcagggcgcgctgctggtggcgctgctggcgctgatctgcgaccggctgctggagcggttgcagcacgcactcagtggccaaccagcatcatgccgcccatgccgccaatcgccatgatggcaaacagggtgccaatgagaattttattccagttcataggtaaacctgagaaaagtcatgaagtgcggcatgataacgcgcacatgcggtaa

SEQ ID NO: 82445 - DNA, 564 bp, Glycine max
  Peptide Sequence Number=SeqID_199223
atgtctgctctaaatacggaagatcggcttgcggcacgtctggcggaattacgcctgcagcgcggctggtcgctggatgaactggctctggcaaccggcattagccgggcatcattgtcgcgcattgagcgcgccgagaccagccctaccgccgctttgcttaatcgcttgtgcgtggcctacggtttaaccatgtcgcgactgctcagcgaagtagaagaagaagcggcgctgctgctgaaagcggagcagcagccggtctggcaggatacgctcagcggcttccagcggcgcaacgtctcgccgccggccagtcagtttaaagcggagctggtggagggcgtgctgcgtccgggcgcgcgcattgattatgatgcgccgccggtacaggggctggaacagcacatctggctgcagtcgggcgagctgaccatcaccatggagacgcagagctggacgctacaggccggcgattgcctgcgcttccacctcagcggacgttcctcttttcaggcgcatgccgaaggcggcgcgcgctacattctggtggtgtgcaaaccatga

SEQ ID NO: 82446 - DNA, 788 bp, Glycine max
  Peptide Sequence Number=SeqID_199224
atggaaagtaaagtttcccagtctggaaacaatgcgaataatcgcggcgataatgcggttctggcgctgagtaatatcgacttaaaattgctgcgggtatttaaatgcgtggtggaagccggcggattaaccgctgccagtcacgaattaaatattggcctggcggcgatcagtaaacaggtttctgatctggagattcggctgggcatgacgctgtgcagccgcggccgtgaaggttttgagctgacgcagtacggcatcaatgtttatcaggccacgctggagctgttcgtatcgctcaacctgtttcgcgagcggctgcacaatagtcgcaacgagctgctgggcgacatcgcgatttgcgtggtggataacaccattagcgatccgcactcaccggtcaccagtgcggtgcaacagttgcaccagaaagcgccaaaggtgcagattcgtctgcagaccgcacagctggatgatattgaacgcggcataagcgaagggcgttttcattgcggcattgcgcccgtgtatgaaatgaaaaatgagtttgattacttcgaactttataaagaatacgcaaaattatattgcgctgcgtcacatcctctctattgcggatcttgcgataaaaatatttcggtggatgtattacgtcagcagaaaattattaatcatttatatgttaccccacgcgatgaacgccgcctgattccggtgcaggagagcggtgtgcaggcggtgcaggtggaatcggtggccatgctgattttaaccggtcactttattgg

SEQ ID NO: 82447 - DNA, 909 bp, Glycine max
  Peptide Sequence Number=SeqID_199225
atgtctgagaatgccgaactgttatggggcgcacgttttaaagcggctccggcagccagtttaaccgcgctgtcgcgtagcccggattattactttgcgctggcgccgtacgacctcgccggttgccgcgcccatgcgcgcgagctggcgcgtgccgggctattgagtgctgacgagctggataccatgctggcggcgattgacgcgctggacgccgattatcgcgctggccagctgcagccgattgccgccgatgaagacgtgcataccttcatcgaacgcgcgctgacagaacgccttggcgcgctgggcggcaagctgcgtgccggtcgttcacgcaacgatcagaccgtcaacgatctgcgtctctacctgcgggataacggccgcaagctggtgagcgcgctgttgcagctgcagcaggcgctggtgacgcaggccgcgcaacacaccgacagcgtcgcgcccggcttcacccatctgcagcaggcgcagccgattgtgtttggccatcagctgctggcgcatgcccaatccttcgcgcgtgacatcgagcgtatgcaggactgggatcgccgcagcgcacgctgtccgctgggcgcggcggcgatggccggttcggcgattgcgcgtcagccacagctggccgccgccgatctcgcttatctggcgccgtgtgaaaactcgatcgatgcggtcgccagccgcgactacgccgcggaattcctgttcgtcaccagcatgatcggcatcaacctgtcccggctgtgcgaagaggtgtgcctgtgggcgtcacggcagttccgctgggtggagctgcacgacagttacgccaccggcagctcgatcatgccgcagaagaaaaatccggacattgccgatctgacgcgcggccgcagcggccggctg

SEQ ID NO: 82448 - DNA, 3018 bp, Glycine max
  Peptide Sequence Number=SeqID_199226
atggggcctgagcgacaacggcattgccgaagctacggtgaatcagggctaaggagcgggcgtatgcaacaaccgggcgcagtgcgctggccgcagggcaagcgtggctgtatggcgctggcgtttgatcttgatggtcccactggcgatgccatgctcaatggcagcctgtggtcaacaccagagtatttcacctttggcgcctacgggccgtttcgcgcgctcggtcggctgctggatctgctgcgcgccttccaactgccggctacgttttttgtgccggcgtgggtggtggagcagtggccgcggcagtgccaggcgattatcgaacagggccacgaagtggcctatcacggttatcgccacgaatcgttctgggcgattacgccagatgaacagcgcgccgtgatggcgcgctctgccgccatctttcagcaacatcttggtatccgcgcctgcggttttcgtactccttccggcgactggcacgccgaaacgccgcagattctgcgggaagccggggtgatttactccagcagcatgcgcggtgacgatcggccgtacagcattgccgtcgccgggcatacgccgctggtggagattcccggcaaatgggagatggatgattacgcctcgctggcctacacgcgccagccggattttccgcagggcggcgaccgcatcgccagctatgcgcacaccggtgacaactggcagcgcgaatttgacggcgcgatggcggaaggactgtgcctgaccacgctgttccacccgaaaatttccgggcagcccggccgtttgctgttgctggagcagctgtttgcccacatgacggcgcgcgacgatgtgtggagcagcaacatgactgaacattcacgctggccgtcgggcaaacaatcggcggccatcattaccatcgactatcacgatattcacggcatcctgacgcaggcacctgtggtcgccgggcgcgataaaaccctgtcggtgtggcgctatggcacgctgcgcggcgttgatcgtctgctggatctactggcggagaaacagctgctggccagctggtgcttaccggccatcgtcgccgaagagcagccgcaggtgctgcagcgtattgtcgccgccgggcatgagatcgcctgtagcggtgagcgacacgaagacttctcggcgctgacgctggcgcagcagattgccagcgtgacgcgcggctgcgagcggctggcgcagctgaccggccagccgattgcagggtttcgcacgccggccggccagtggaaaccgggccttgctgcggcgctggcaacgcacggcatccgctggtcctccagctggcgcggtgatgatttaccctattttcaccccggcacccggctggtggagctgcccatgcactacacgctggaggatgcgccctattttgccttcaacctcagcccggcgattccgcccggacagtcgcgtatcgcgccctatggcgaaacgctggccaacctgacgcaggatttccacggttttcaccgtttcggcctgtgctacctgctgaggctgcacccggaaattatcggcaccgccggacgcattggcctgctgcgtcagctgctggagacgctgcagcagcatgaggtgtggatcgctactgccggccaggtgaacatgaacaccacgcttgatcggctggcggatttcatcgcgaccacccgctttgcccagctgccggaaccgctggtagcgcaggcgaagcgccatctgctggatacgctcggcgcggcgctggcgggctgtgacagcccgatctggcgcgaatgccgggcgctggtggccgaagagggcggcagcgccgtggcgcaactgtgggggtgcgcacagcaagcttccccgcgccaggcggcgtggctcaacggcgtggctgcgcacatgtatgaactggacgacaccggcggctgcgatcactccggtgccgtggtgttaccggcgctgctggcggcactgccgctggcgacgcagccggtcgacggccgggagtttctcaccgcgatggtcgtgggttatgacatcggccgtcgcgtgctggaagcctgcggggggtatgcggcgcacaacggtgcgggctggcactcgactgccagctgtggcgtttttggcgcggctgccgccgtcagttgtttgctgcggctgccggccgcgcagtgtgcctcggcgctgggcatcgctgccagcttcagtggtggcctgtggggctttattcatgatggctcacacaccataaagctgcacgcggcgcgcgcggcggaagggggcgtacaggcggcgctgctggcacagcgcggcatcagcggaccggccgcggtatttgaggcgcgctggggcggctttctgcaaacgctggccggtgaaacgcaacagcccgccgcgctcacggcccaactgggcgaggtgtggaaactggcgcgttgttccatcaagccgtacgccgcctgtcgcggtacgcatgcggcgatcgatgcgctgggtctgctgcttgagcagcatgcggtggcgaccggggacatcgcgcgcattgtggtcgggctcaatccgttcctgctggagatgtgcggcacgcgtgagctcaccagcctcgccgccgcgcaaatgagcctgccgtatgcgctgacggcgcgagcgctgttcggctctgcggagctggcgagttatgacgacagccgtcgcctgagtgcggaagctgccgcgctgatggcgcgtattgagctggagattgaccaccagcaggggcgcgatgatgagccgtgggtccggctggaaacggtgcagggccagcagtggcagcagcacgtcgcggtgccgtccggatcgccggcgaatccgctgagcgacgcggcgctgcacgccaaataccgcagcctcgccgcgcgcgtcttgccggcggcacaggtgcagcagctggaaacgctgtgtctgacgctggataacgtggcggatgtgcggcaagtcgcggcgttgctggcgacccggtaa

SEQ ID NO: 82449 - DNA, 645 bp, Glycine max
  Peptide Sequence Number=SeqID_199227
gcgccggcggcggtgatcatcgacagtgaactgctggcagccgcccctgcccgctggctggccgcgggcctcggcgatacgctggctaaatggtatgagttccgcgcggtaagcacgcgccatccggcgcgcaccggcaatgcgctgtcatcgctggcgcacagccagatctgctatgaggtgatcgcggagcacggtccggcggcttacgcagcggtgctgcgcggtgagagcggcacttcgctcgatcaggtgctggacgcgatttttacctgggccggtctgacctcgctgatgagcaatggcgcccacgccgccgctgcgcatgccatttacgaaggcttcaccttctgcgacaaaacgcgcgagtttggtcacggcctgctggtgggttacggcaatttgtgcctgctggcgctggaggatcgcagcgacgaagagctggtggatgagatgcgcctggcgcgcgactgcggcgtacccttgacgctggcagagattgccgcgctggatgagagcgagctggcgttgattatacgcgaatctgtccacgcgccggatatggcgaacatggccgaaccggtcaacgaagcgcggttgcgggcggcgatggcgcggattgaagggctggcggaacgggtttga

SEQ ID NO: 82450 - DNA, 1053 bp, Glycine max
  Peptide Sequence Number=SeqID_199228
atggcgagagtgggtagaatgaaactgggttcagaagggatggaagtgtctatgcagggtcttgggtgcatgggcatgtctgcattctacggtcctccaaagcctgaacccgatatgattgctcttatccaccatgccatccaaagtggtgtcactcttcttgacacttctaatgtctatggccctcacaccaacgaactccttctaggaaagatatatgataatgagcaggctttgaagggagggatgagacagaatgttgaattggctaccaagtttggaatcaacatagctgaagggaaacgggaggcccgtggtgatccagcattcgtgagggaatcttgttatggcagcttaaagagacttggtatcgattgcatcgatctctattaccaacatcgtgttgatactcgtgtgcctattgaagtcacgattggagagcttaaaaaacttgttaaggaggggaaaataaaatacattggtctgtctgaggcctcggcgtcaacaatccgaagagcacatgcagttcatccgataacagctgttcagttggagtggtcgctatggtcaagagatgtagaggaggaaatagttccaacgtgcagggaacttggtattggaattgttgcatatagtcctcttggacgaggattcttgtcatcgggaacaaagttgcttgagaatctgacaaaagaagactaccggcagagactgcctagatttcaacctgaaaatttggagcagaataagactatattcgagaggattgatgaactggctgcaaaaaaaagatgtacaccatctcagcttgcattagcttgggttcatcaccaaggaaaagacgtttgccctattcccggaaccaccaaacttaagaactttgaggagaacattggggcattgtctgtcaaactaacacccgaagaaatggcagaactcgagtccttcgctgccgtagatgctgtcaagggtgataggtatggcgatgatggtttttctttatggcagaactctgataccccaccactttcttcttggaaagctgcattatga

SEQ ID NO: 82451 - DNA, 213 bp, Glycine max
  Peptide Sequence Number=SeqID_199229
atgaagaaaccacatcaaattcagtgttacattctaataaccagcattaacagtgtggaatcatatgacattgatttgaaggaacagaaggtggtagtgaagggaaatgtccagccagacacagttcttgcgaccgtttccaaaactgggaagaagactaccttctgggaaggtgaagcagcagcatccgaaactagcacagcaactgcctag

SEQ ID NO: 82452 - DNA, 1269 bp, Glycine max
  Peptide Sequence Number=SeqID_199230
atgcactcctccgccgaggaagactccgacaactccgccacaaccgccaccgccagcacggagtggacgttctccgccaagtcccacgcaccctcctcggacccctcctgggacgccatacagcgcggcggcggcgccaccctggcactcggcgacctccggttcgtgcagcgcgtggggagtggcgacatcggaagcgtctacttggtggagctcaagggctccagcgggtgcctcttcgcggcgaaggtgatggacaagaaggaactcgtggccaggaacaaagacacgagggcaaaggttgagagagagatattgcaaatggtggatcatccttttttgcccactctttatgcttctctcgattcgccgcgctggtcttgcctcctcaccgagttctgccccggcggcgacctccacgtcctccgccagcgccagcccgataaacgcttccacctcgccgccgtcaggttctatgcatctgaagttgtggttgcgttggagtacctacacatgatggggataatataccgtgatttgaagcctgaaaacgtgctcataagatcagacggtcacattatgctaacagactttgacctctcattaaaaggtgacgataccgcatcaacggctcagatggtgtttgatgaagatccacccagcaacacctgttctaaggaacattcgaggaagcaatgcactcccaccatgtcatcatgcatgctgcccaattgcatcgtgccatctgtcccatgcttccacccaaaacggggtcgtagcaagaggttctctcgttgtgggtcccttgagatcatagctgagccaatagaaattcgatcaacgtcgttcgttgggacccacgagtacttggcgccagaagtgatttcgggggagggtcatggtaatgctgttgattggtggaccttgggagtgttcatttttgaaatgttctatgggatcacaccctttaaagggcttgagaatgagttaaccctagctaacattgtagctcgagcccttgagttccctaaggagccaatgatccctggaccagccagggatttgatctcacaacttttggtcaaggactcaacaatgagactagggtctacaatgggtgccctggcaattaagcaccatccatttttcaatggcgtcaattggccattgttgaggtgtgctacccctccttacatcccttcatcagacaagtgcaaggagttgcttcctctctataattgcacaaacaatgctatagacttctattag

SEQ ID NO: 82453 - DNA, 111 bp, Glycine max
  Peptide Sequence Number=SeqID_199231
atggtgtccgatgccaacaagaagaaggtcgccaacgaaatcgtagatattttagattttggattcgacttgcacctctctccagagatgttcaaatatacaaagatctaa

SEQ ID NO: 82454 - DNA, 909 bp, Glycine max
  Peptide Sequence Number=SeqID_199232
atggaagtagatgccttatcttgcttccccaagccacccagggctgcctatcaccaccttttggtttcccaatttgttttccttgaagaacttaagaaggagttacacactaacctagtcttcactgacctttgtgacaagtgtttgacttctccgacatccctccctgacttcatttatcgcggcagggtgttccatgaatccctttacggtggacatccaggtgtttccaagaatttgaaggatttgattgaaaattttctctggattgacataaggagtgatgcccaagattttgttgcccaatgtgtggacttgtcattagattttgtcactagactaccaacttctcaagggctcatgatcatccttattctagtagaccatttttcagaaggggttcaaatgggagttttccttgccaactttactgccacttgtgtcgttgagctatttgtctctatggtctgcaaacaacatggttttcccaaaagtttggtttctgatagtgatccagtgattaaccgtattattgaacaataccttagagcttttgttcaccagaagccctccatgtggcctccttcctttatttcagtttatgttgtcggttcatcctctattgaagtttgtgattttgttcttctaactcacgatgagatctttgtcatactttacaataatcttaggaaagctcaggggactctttatgctaaattagactcttcaccgccacttactttgggtaatgaccccattgtttcacctttggcaattttggattccaagggtactacttgggaaaaatgggatgaattgtgcaaagcttacaaccttaaggacaaggttgattttgaaagggggaatattgataggaatgtgccaaacattattgagcctattgattag

SEQ ID NO: 82455 - DNA, 402 bp, Glycine max
  Peptide Sequence Number=SeqID_199233
atgattgagaaaaagatgatgttgggcgataaaagcaaaaacctaagcaagatgctcgtggtgaagcttaggggatgtgttgaacaccaagatattgtaaaaaaagactatgaaacttttgcacaaaaatggtcgaaaaatgtcattcatggttgcttgaaatgtaattcgagattgatggaagctcaaggatggaagcttggtggtaggatatttggcccaaaacacgcagggcatctggggcaaaattactcgacaaagcatttaagctatgctgagtcgaataggcctctatttctggtgatgggttggattccacatcgccttaaaatggcaacaactcaccccaagtcttgtttatgtgggttatcaaggtccttcatgacaatcacaaagaaatga

SEQ ID NO: 82456 - DNA, 603 bp, Glycine max
  Peptide Sequence Number=SeqID_199234
atggaagtagatgccttatgttgcttccccaagccacccggggctgcctatcaccaccttttggtttcacaatttgttttccttgaagaacttaagaaggagttacacactaacctagtcttcattgatctttgtgacaagtgtttgacttctccaacatccctccctgacttcatttatcgcgacaagttgttattacacaaaggcgtactccaactgttgcccattcttactggtgtttgggaggacttgtcattagatttttttactagactaccaacttctcaagggctcatgatcatccttattctagtagaccattttgcagattgggttcaaatgggagctttcctcaccaactttactgccacttgtgtcattgagctatttgtctctatggcctacaaacaacatgttgatttgtgggtgtatgtcaagctttgccctcatcgtcaaactacgtggatggaattttctcccgagggtactacttgggaaaaatgggatgaattgtgcaaagcttacaaccttaaggacaaggttgattttgaaagggggaatattgataggaatgagccaaacattattgagcctattgattag

SEQ ID NO: 82457 - DNA, 243 bp, Glycine max
  Peptide Sequence Number=SeqID_199235
atggctgttgattgtgtagaaaataatgaatgcacaacctcaaaaagctcttcccagtccgtcgctgccgtgagccaccgccaaactccaacgaaggtccctgccgctgctgagaaaatatctttaaaggctatgttgataaaggaaaaaagtgaagaaagaaggaaagtgaactcacaaagccggaaaataatcattgccaagagcgtcttcacacttctgttctttcttgctactttctag

SEQ ID NO: 82458 - DNA, 684 bp, Glycine max
  Peptide Sequence Number=SeqID_199236
atgaaagcacatttcaaaattgttactcaattagaaaataggttttcagagcttgacaagttgtattactcaatgtatggtcatgtggaagcactagctagggaaatattgcgcggggctaattctgtagagggtgttgaggccaaactgtggcagatacctgagacactgccacctgaggagcttgttaggctgagagcaccaccaaagagtgatgtaccaatcattaacccttttaaactgcccgtggctgatggttttgtctttggttttccaacaagattgggaatgatggctgctcagttcaaggctttcctggattcaactcaatatctatggaaagcgcaaatgcttgcgtgcaagcctgctggaatcttctatagcaccagttgccaaggtgttggacaagagactgcgccgtttactgctatcactcaactggttcatcatggaatgatatttgttccaataggatacacattcggtcctggcatgttcgagatgaaggagccgaaaggtggaagtccttatggtgcaggaacttacactggtgatggctctaggcagccaactgagcttgagttgcagcaagcattccaccaagggaatcatatcgccaccatcataaagaagttcaaggaagatgctcacccaatttttactctacacaatagaggatattga

SEQ ID NO: 82459 - DNA, 192 bp, Glycine max
  Peptide Sequence Number=SeqID_199237
atgtgtcgtccagatcctcctaggacattgagtcaagattctttaaaacccttagcgttgttacttgttaatgtggctccttgtacagcttgtaggccttggatcttcttcatcaatgaagtcctttgcttcttgaagatcaatggcagcggaatggagaaaaaggaaaggttattggagatgccactttaa

SEQ ID NO: 82460 - DNA, 2205 bp, Glycine max
  Peptide Sequence Number=SeqID_199238
atggatggaaatgataaagctagatgcaaagatgattgcagttcttctgttgaaatggatctctatgaaagcaactttcaggaaaatgatgaaaccctttctgacggccctcataatacctcatcaagcatgttaacaagctcctcgtctagcagcagatgttttgcttcccggaagtcaggcaaacggtggaaaaggcgacatcatttacagcagaaagctcgtcaagaacgcttgaacaatagtagaaagtggaaagctgtagatcatgatgaccagttgttgagcaagaagattcacagaatttctgaaccagaaaatcatgatagtcttgcttctgaaagttgtgcagaaattgtatcagagaatgggagcctggatgataataataaaagaatatcctctgaacgagcagtaaatgacaatgcaattgataatgataacaatgatgaagtaattactgaaaagcagttttctggagaagattgctgcactaccgaaagcaaagatgaaaaagaggaatccttgtgctccttagataagaggccaagtgaacaggatgaagcatcttgtttagaacttttggagtgtgtttctaaatcaaagagacatttagatcgtgatcttgataatcctaaaccatgcaagtctagaaagtcaattagttctagttcattattgtcttgcaagtacagcaagatctcattttgtggcattgaagaccatctatcagatggcttttatgatgcaggacgagatcggctgtttatgcctcttgagtgttatgagcaaaatcattgtcttgcttctcgtgaagtcatccttttggacagaaaaatcgatgaagagttggatgctgttatgctagctgctcaggcattggtttataatttgaagaagttaaatggtttaagcagatatgggaaccaggatggggttgataacttgcagatggcatcactgcttgcactctttgtatctgatcattttggtggcagtgatagaagtggtattgtagaaaggacacggaaatctgtgtccggttcaaactataataagccttttgtctgtacatgctcagctggaagcagcaccagtataagttctcccactgaaccagttgcaaacaccatagaagatatcactctttcgaagatgtcggaaaaatctctcgactctataaaaaaaaggcgaaattcgatcataattccaattggctctgtgcagtatggtgtatgtagacatagagctctgctttttaagtatttatgtgatcacatggagccaccagttccttgtgagcttgtcaggggttacctagatttttcaccacatgcctggaatatcattctgattaagaggggtgctacatgggttcgaatgctgattgatgcttgtcgacctcttgatataagagaagagaaagatcctgaatatttttgcaggtacatacctcttaatcgaaccacaattcctatatcatctataggaagtccaggtcctgattattcttttccatctctcactacatgtgatgaacttgagacaaaggcttcaactactttagttaaatgcaaatttggatcagttgaggctgcagcaaaggtgcgtactttggaagagcaggggagttcggcagacaaaattaaaaacttcgaatataattgtttgggagaaattagaattcttggtgctttaaaacacccttgcatagtggaaatgtacggacaccaaatttcatgtcaatggtctgtctcagctgatggtaatcctgaacaccgtgtattaagatctgcaatttttatggagtatgtggaagggggctccttaaaaaattatctggagaagctgtcagaagctggtgaaaagcatgttcctgtggagttggctttgcatatcgccaaagatgtctcatgtgctttgtcagagctgcactcaaagcacataattcatcgtgacataaaaagtgaaaacatactgtttaatttggataggaagagagatgatggaactcccactgtgaagctctgtgattttgatagtgcagtgccactaagatcaactttacatgtgtgttgtattgctcatgcgggaacacctcctccctgtatatgtgttggaacacctcggtggatggctccagaggttatgcggactatgtataaaaaaaactcctatggattggtaagatcctcttcctactga

SEQ ID NO: 82461 - DNA, 906 bp, Glycine max
  Peptide Sequence Number=SeqID_199239
atggagttgaagctgaagagtaacctgagatatccaaggattattttgcaggttgtgcatgttattattgttatgaatttgaaaatgtcaatggcaagcgaatcaagctgggtcgggaggaagccagtgaaacgcattgggggaatgtccgatgctctttcaattgcagccgatcttggtttctccttgtcccctcccccatcccaggaaggacttcagaattcatcccccacaactggggaaaagggtgaggacttgatcagggttttgagagaactgactaccgtccaaagaaaaattgcagatttgcaagttgaacttcaaggtcgaaaggatgacaaaaatgttgcacatttgactcatgtgagtgaaatggaaaagaagattgagacattggcaaggattactactatactcaaagatgttattcagaacaaggatcgcattatagctcgcctacagcagccatattcccttgattgcattcctgttgaagcagaatatcagaaacaattctctgaactactgatgaaggcagctagtgattatggtgctttgacagcatcagtggcagattttcagtggagtcagaatttcaaggaacctccttcagtttggggggaaatgcttcggcccattcctgtagctttggcatcttgcactcggttctttgaagccatgtctgccacaagagagtcatttgcatcacttcaaaaactgagagttggccattttgattcccctctatctcgaacaccagctgtagattcttcccaaagagtatcgggagtttctgattatctaacaccacctccatggaaaactgaaacgaactttgatgacttgggtatcagaaaccaaaggagacaacatctagatcagcaggtggaggatctaaacagctag

SEQ ID NO: 82462 - DNA, 132 bp, Glycine max
  Peptide Sequence Number=SeqID_199240
atggattgcttgattgatatcgatgaaggaaaggaaagcacgtggaactgtattttatatgggtattttatatgtggaggtggcggctatgatttctgtgaaatcagaatggtgcaaggtggactaaagtaa

SEQ ID NO: 82463 - DNA, 130 bp, Glycine max
  Peptide Sequence Number=SeqID_199241
agcaagaattaagcagaggttggcgctttatcgtggcgttatgtccatatacatgcaattttcaaatgatgcagaagagaccttctctagagccctcaagctactattggttagtaaggttcatggataa

SEQ ID NO: 82464 - DNA, 938 bp, Glycine max
  Peptide Sequence Number=SeqID_199242
atgactgccatcgatcctaacggaggaaggagagaagaaagatgttggaccctggagacacctcatgattttcagatgcaggttgcagacccaggggagcggaaggatgtttccattccacaccttgtttgcccagacagactagtgtgggctatagagtcatcactcatcaccgttgaagaagcgcaaggccattcaggggtgtatgccagtcctaatcttcacctttgttctcagttgtgggatcatttgcgttctgttaatcttctccttcagcatccctgggtggccatcggggatacgaatgatactataagtcctcctgacgtaaaagaattctccaggcaggcagggttaaggggtttggagaaagctctggacacggttgactcagccttccttatgcagttgcttggtagcaagaacatgaccttttttcgattccagccgattttctataaaatattcttagatgatgttggagatgatgtgtggaatttcgtgaagcaaacttttgattctgggaactttgaccctctggttgctggaaccttggtggtgcttatccctaaggtgcttgttaatcggatgaaacctctcctaaatcccagtgttagccctctccaaaatagcttcattccgggaagaggaacctctgataatgggattattctccagaagcaagttctgtttgattttggtttccctgaacctaccataaatctgatgttctacccgttatccccgtacctcttcgtgttgtgcttagaaagaatgggtcattctattatggatgctaaggatagaggtctttggaaccctatttctttatctagaggtgtcactaatcacaggaaggacaagattgaaggttcaaaggaagttgctagcttggaagggtcgccttctaataggccagggagggtgactcttgtcaa

SEQ ID NO: 82465 - DNA, 1062 bp, Glycine max
  Peptide Sequence Number=SeqID_199243
ccagcacttatcaacaacaaagccaacatgccagtgaggcagatgaaagaaagttcggagcaacaccttgtgatcaaaccacatttgcagaatcctatgaatcaagccaagaagacaaccaaagctgcacaaaatggcaaaggtccaccgccacaagaaaaccataaccaaacttcgccacactcaaagaacaagggaaggagaagagggagaggtggcagaaaacctgatcaaggagatgttatgatgaggcctagttgcaggccatgcactgcaacactaacaagtactgcaaatgagaatgctgaaaatggttgcatctctgatatgggttttcccacttcaagcaagtctttgacctttgctcctaggcctggatatggacaagttgggacaaaatgcattgtgaaggctaaccacttctttgcagagttaccagacaaggacttgaaccaatatgatgttactattaccccagaagtgtcttctagaacagtaaacaggtctatcatagcagaactagtgaggctgtataaagagtctgacttggggatgagacttccagcatatgatggcagaaaaagtttgtacactgcagggcagcttccctttgcttggagagagtttaagattaagcttatagatgaagaggatggagttaatggccctaaggaaagagagtacagggtggtgatcaagttcgttgctcgggctaacttgtatcacttgggacagtttctagctggtaggcgtgctgatgcaccgcaagaggcacttcaaattcttgacattgtattaagagagctgtcaactaagaggtattgccctattgggaggtccttcttttcacctgatattagaacaccgcaacggcttggagagggattagaatcatggtgtggattttaccagagtataaggcctacacaaatgggcctttcccttaatattgatatggcgtctgctgcgtttattgagcctcttccagtagtggaatttgttggccagctattagcaaaagatgtgctgtcaaggccattgtcagatgctgatcgcattaag

SEQ ID NO: 82466 - DNA, 150 bp, Glycine max
  Peptide Sequence Number=SeqID_199244
gacgtacctcaatggataagtgccaaagacgatctccacaaacacgatctccacaatgtggttgcagtcacgaaagcgcaggcgactttgacacaaggagaaagaagaagaacgatagggttcaagcgcaaggagaaagaagaagaatga

SEQ ID NO: 82467 - DNA, 156 bp, Glycine max
  Peptide Sequence Number=SeqID_199245
atgaagatgggtagtcctagcatgggaggctcaaagagaaggctttcaagcagagggcttggaggagcccttagggagcaaagggcaaggctttacataataagaagctttcctttgatttatcctttcttttctttctttgctgttactggttga

SEQ ID NO: 82468 - DNA, 522 bp, Glycine max
  Peptide Sequence Number=SeqID_199246
atgaaatgtggctcaattagtaaaccaaactcttgtgggctgacttcacctacagtgcaaggggatttatccaacaatcagttaatgggattcatacctgatagtttggcatcttcgaatttgaagcttgtgctattgaatggtaatttattggaaggacgagttccagagcaactttattcggttggtgtgcatggtggagctattgatctctctggcaacaagggattgtgcggcgtaccatctcttccatcatgtcctatgttttgggagcatggtagattatccactcggggtaaaattgcaatagccttgtcatgtctctttgttttctgtgtggtactgctggtggcatatatctacatcaggaggaaaaggaacgattatgatttcgctctgcctcatgaactaatgtcattagctgccaagagaaatcgctatcagaggcagaaatcattgatgcttcttgagctggagagtcagcatgccaagggattgccttcaccttttactccacaataa

SEQ ID NO: 82469 - DNA, 1056 bp, Glycine max
  Peptide Sequence Number=SeqID_199247
atgcagaacagagagagcgagaatgagaccttggagagggagagtggaagggtcaacagggaccaaggcgtaattctcgatggcacaaatgagaggagccccaacagctggcacgagcttgagtgtcaagacgttatcgctcaagttcttgacggtgaaattcaaagtcaacgcggcgaaagcaccgacgtggttgtatatgtcaagcctggtgacgttgtcgtcgttgatgaagatatcgaagaccctctcccctgctttgttgacgctggaatcgatctccgcgaagtgcagccacaccgtatagtccaatttcgcgtccacactcaattcgtaccccagcggcccctccgtggtcaccgcggactgatacaacttcatcgggaaagagcggacctcgtcgcgatcttccggtattgttcggaagtcgtagtccggctgccaggagcgggagaagcggtcggtgtggttggtgaagccggcgccccagggtttggcggcagcgccgcaggaaatgcggccgtagttaacgagaatgaggttgttggagttggtgtaggcggcggggtggacttggacgagttcaatggaggagacgagaggggaatcggtggcgaagccgtagaagcagagatcgagggaggaggtgttggggagggaggcgaagaggtcggagtaggcgccattgcgggcggtggactccggccagggggagcgccagctgaagaggacggtggaggagagagagacgtcgaaggagggagggcgggacttggcgtcgtagttgtcgtagacggtgaatgtgcggaggaggtagcgggagggggaagggagagaagggaaggtgtagcagtttctcttgccggaggaggagggagggaagaagcggagggttttctcggaggggagagggaaatggagaggctcggagacgagagcggaggagccggcggagaagaagcggtcggagagccaggtggtgttgaaggagtcggtggagtcggtggaagcaccgcagttgatgtggtaggagaaggcttccacctgcggtgttga

SEQ ID NO: 82470 - DNA, 929 bp, Glycine max
  Peptide Sequence Number=SeqID_199248
gtgtcaagcaagatggaagttcttctcactttttccatcgagtaatcaaggcgtataatactggcagtcgaaagcgtcgaaaaatatgtggtcaggattttggtgatgtccgctggcacaagactggaaggactaaacctgtcatcttgaatgggatccagaaaggctgtaaaaagattatggtcctgtatataagcccagtgagaggaggaaaatctgagaaaactaattgggttatgcatcaatatcatttaggaacagaagaggatgaaaaggatggagagtatgtcatctctaaagtgttttaccagcagcagcaagtcaaatttggtgaaaaagatgaccaggatattcctgaaatcactgaagcaactacagttaaagtggatccagccactcccaaatctgtgactcctgaacctcctcgtattgaaaagcgatgttcaaatctagacctaggacaagaatcacatcacattcctcagacagattatttagatgaccttcaggctgtttgtgaagatcttgcaaaagatgatctattgatagtagaaactcaaaataatgaagcgatagataatatagaaaacaatgctgaggaagactcaaaatggtgggatagtgagtcacagaatctgttgagctcacaacaacttgtcgaagcattgttcttgtgtgatgatctccttcaaagtcaatctcccaagagggatgaggaaaatgaacacaagaaacgacccagtctttctgtttatgctgatctaggaccagagcatctgaagaaagatatcgaagagtgtcaaaatcttgtccttgaccctgcaaatgtagtgcctgagacaccaccttcagaatttcgactaagtcagctggatttcagttcacaggatagctttgtttcctggtgtgccaacaaagcaatcgactaa

SEQ ID NO: 82471 - DNA, 309 bp, Glycine max
  Peptide Sequence Number=SeqID_199249
atggctttgtcaccaattgcaaacattgcatcatatatcttggctatgacctatggacttataaatcttggtcttaatgtgaacattaaggtggattttgctatcgatcccgaacatttggaagaaaatatctacaagatcaatattttatatcaacttctaaagcaatgcaatagttgcagggaatgtcattccgttaggggtctgactcatcaacaccatgcaaaattgttggtgtcttctttaacagcatctaatctaatttatgttgacgaattaaccgagaacacgtatattctaaactggtaa

SEQ ID NO: 82472 - DNA, 228 bp, Glycine max
  Peptide Sequence Number=SeqID_199250
atgctaaagacgattttgaatctctcacacttgattgcatcattctccgacctctttcctatggcaggaccatcgtggttggtggacaaaagtagaattgcaaccaaaataaagagtgcctctggaacatgtggtaaagttatatggaaaagcaatccttccagagcttgcccaagctgtcaccatgttattgacaacagtgatagttttgacagtgatcttctatga

SEQ ID NO: 82473 - DNA, 327 bp, Glycine max
  Peptide Sequence Number=SeqID_199251
atggtaacttcaccaccagccattcccaccaccaccaaggatcgtgttctcatcatcggagcaacaggtttcataggcaagtttgtggctgaggcaagcctcacctcagaacaccccacttgtttgcttgttcggccaggacctcttgtcccttccaaggatgccattgttaaaaccttccaagacaaaggtgccattgtcattcacggtgtgataaataacaaggatttcgtggaaaagattttgaaagagtatgaaatagacattgtcattctgctattggggctaagagcttgctggatcagcttatactggtggaggccatga

SEQ ID NO: 82474 - DNA, 303 bp, Glycine max
  Peptide Sequence Number=SeqID_199252
atgttgcagaggtttttgccttcagagtttgggcacgatgtggacaaagcagatcctgtggagccaggcctaacaatgtacaaggagaagcgattggttaggcgtgtggttgaggaatctggggttccattcaccaatatatgttgcaattccattgcttcttggccttaccatgacaattgccacccctcacagcttcctccacctttggatcaattgcagatatatggtcatggcaatgtcaaagcttactttgttgatggcattgatattggaaagttcacaatgaaagttattgatgat

SEQ ID NO: 82475 - DNA, 287 bp, Glycine max
  Peptide Sequence Number=SeqID_199253
gttctggaagtatcgtggaggttaatccttatctttcacaagtggagaagcttaagcataaggttatcacaattgaacaaaaacttgcatcacatgagaaaagaattcgtctatatgatgaacaagttaaagaagtgaagaagattcttgcaaaagaagaggctcaatctcacggatatgccaatggtattgaagaactatggaaaaaaataactaagcaacaaatgaagacaaacattaagagaaagagggtaaaggtcctaagatgcattggggtcttcctatag

SEQ ID NO: 82476 - DNA, 990 bp, Glycine max
  Peptide Sequence Number=SeqID_199254
atgaatgaaacaggaaagaagaagcatgttagggaaccaccttcagttcctttcatatgggaagtaaagccaggcattcctaagaaagattggaagccagagccagagccagaggtccctaaaactccactcaaactaattgcctcagtcccctttgtttgggaagaaaagccaggaaaacctcttcccaatttctcagtggaccaccctgtgcctccaaagccattacttattcatgttgcatcatcttcagcattttcttttgcatgcaactttggccatgatcatgacaaagacaaaggaagcttaagcagcagtgacaatgaaagcataactaccttagaccttgaagcatttagctttgatgaagatgagtcttttgttagttcagttccctcattgcttgcaaattgtcttgtgccatcagctaaagtttccactgccattccactgagggaaaccaccccatcctcaccagcctcctcctcagagacagacagtggcacaagcagctatgcaactggcatgtcaagtccaattggtgctacgttccttgagtgtttatttcccttgtttccacctaagtctggcttccttgaaagggatgagaatttggaaaaagtaacttcaagcccgcaagaactaagagagaaagagcttgttcatgaaaattgtgccagtgacttggtaaggaagccaccaacacttggagagctgattatgataagccgaagaagaagctgcagaaggaaagcaattcaaatgaaaaagtgggatccaccaaagttatgtccaaccgagagttctactattttgcctctcaatattgcgcagaaaatcactagaaagcaagcgtttggatgcttctccgttgtaactgacagcaatatgattgaagggctgctaaagaggaagtactttcccaaactgaaactggtctcttgcaacttatgggtttcatgtgttaagaatgtcgaaagtggattctga

SEQ ID NO: 82477 - DNA, 444 bp, Glycine max
  Peptide Sequence Number=SeqID_199255
atgaagcttgcttctacagctaccggcaaggccgatggtccccaccagaagaaattaagaacatatttggggattgccacgcgtgataaggtggaatttcaaatcgctgaagcttctggcagtaggacaaagaagaaaattcttcagactgtcggcgagaggcggcaacagtttaaattggacttgactaggaaatgggcccttgcagctgatcaggatggtgtggatgacactgtctgtgaaaaatacggcattagcaaggagaagtgggcccagttttgtcagacatgcagatacccttcttgggagaatgggcggaaaaaggcacaggccatccagaagcaaaacactgccccccacgtgttgtctcgtgggggatatgaatatttagaacaaaagctaatggctgagaataccaaaaagaaactggaggaagctgcctag

SEQ ID NO: 82478 - DNA, 213 bp, Glycine max
  Peptide Sequence Number=SeqID_199256
atgagggttttgggcttagcgcctaggtacgcgcttagcgagttctgcaactctaattggtctgcagcttccgctaacgcatgtgatcgcttagtgagaccccatcatccactagatgaggggttggtgcgcttagcgagagtgttgctcgctcagcgcataggctatgtctggcttagcgcgggtgtcatgctgagcgagttggatgattga

SEQ ID NO: 82479 - DNA, 183 bp, Glycine max
  Peptide Sequence Number=SeqID_199257
atgggaagatttttgttattgtttgaaaatggtatacttgggagggtgaaatccatgctagaactccacctcactaaagcgacctggggtcacctagtggggtatcttcttgagtaccacctgtcagaccctaattttgtccggggattatcattcgctaatgttttgattctcgctagctga

SEQ ID NO: 82480 - DNA, 2769 bp, Glycine max
  Peptide Sequence Number=SeqID_199258
atggctatgaaggctttgttcagtaatatggcagacgttctccttgactgggatgacgcgcataatgacgacttttgctcttggcgtggagttttctgtgacaatgtcagccatactgtggtttctctgaacctgtccagtttgaaccttggtggagagatatcaccggccattggtgacttgacaaacttgcaatccatagacttgcaagggaataaactaactgggcaaatccctgatgaaattggaaactgtgcagcacttgttcatctggatttgtccgataatcagctttatggtgatatacctttctcattgtcaaagttgaagcagctcgagcttttaaatttaaagagcaatcaattgactggtcctatcccttcaactttatcccaaattcccaacctcaagactctggatcttgctcggaataggctcagtggcgagataccaagaatactctattggaatgaagtcttgcagtaccttgggttgcgtgggaacatgttgagtggtactttgtcccgtgatatctgtcaattaactggtttgtgtgatgtgagaggtaataatttgactggtactatacctgacaacattgggaactgtacaagttttgaaatcttggacatatcgtataatcagattactggggagattccatttaatattggatttctgcaagttgctactttgtcacttcaaggaaatagactaactgggaagattccagaagtgattggtttaatgcaagcccttgcaatattggatttgagtgagaatgagttagtgggctcgattccccccattcttggtaatctgactttcactggcaaattgtaccttcatggaaacatgcttacgggtcctatacctcctgaacttggcaatatgtccaaactgagctacctgcaattgaatgataacggcctagtgggtaatattccaaatgaatttgggaagctagaacatctttttgaattgaatctcgcgaacaatcatcttgatggaactatcccacataacataagctcctgcactgccttaaatcaatttaatgtgcatggtaatcagttaagcggttctattccattgagcttccgcagcctagagagtttgacatgcttaaacctctcatcaaacaacttcaaggggattataccagttgagttggggcatatcattaatctagatacattggatctatctagcaataatttttcagggcatgtgccagcatctgttggttatctagagcatctcctgaccctgaatttgagtcataaccaccttgatggttccttgcctgctgaatttgggaatctcagaagcattgagattcttgatttgtcattcaacaatatctctggtagcattcctccggaaattggacagctgcagaaccttatgtctctgtttatgaaccacaatgatctgcgtgggaagattcctgatcagttgactaattgtttcagtctaacctcactaaatttgtcctataataacctttctggtgtaattccttcaatgaagaacttctcatggttttctgctgacagcttccttggaaattctttactatgtggagattggttaggatcaaaatgccgtccttacataccaaaatcaagagcattctacagatccagccaatcgaagcaattgatgaaaggaaccagtggaactgggcaaggcatgttgaatggtcctccaaaactagttattcttcacatggatatggctatccacaccttggatgatataatcagaggtactgagaatctcagtgagaaatatatcatagggtatggtgcctctagcactgtatacaaatgtgttttgaagaattcccgaccaattgcaattaagcgactgtacaaccaacaaccacacaatataagggagtttgagaccgaacttgaaacagttggtagcattagacatagaaatcttgtcaccttgcatggatatgctcttactccctatggaaatcttcttttctatgactatatggcgaatggctcactgtgggatcttctacatggtcctttgaaggtgaaacttgattgggaaactcgcctgaggattgctgttggagcagccgaagggcttgcatatctccatcatgactgcaatccacgaatagttcacagagacatcaagtcttcaaatattctgttggatgagaactttgaggcgcatctttctgactttggcacggcaaaatgtatctcaacagcaaaaactcacgcatcaacttatgtccttggaactataggctatattgaccctgagtatgcccgaacatctaggctgaatgaaaaatcagatgtgtatagttttggaatagttctgctggagctacttactgggaagaaggccgtggacaatgagtccaatttgcatcaattgatattgtccaaggcagataacaacactgtaatggaagctgtggatccagaggtctctattacctgcactgatctggctcatgtcaagaagacctttcagcttgctttgctttgcacgaaaaagaacccttctgagaggcctagcatgcatgaagtagccagggtgctggtatcactacttccttcacctccaagtaaaatccttgcccctcctgcaaagaagttcgactatgcgcattttgtgatcgagaagggacaacagagaaaaatggaagaacaaaaacctcagcaggataacaactcatccaatgctcaatggtttgttcgctttggggatgttatctccaagagcacttga

SEQ ID NO: 82481 - DNA, 453 bp, Glycine max
  Peptide Sequence Number=SeqID_199259
gttaagtctatgagtaagggtagcaatgcagccaagactaagaagaaatcaatgctacctacttctaaggcatccccaatttcaacaccacaaagttcaaagcctgcatcaaaaactcctaccaaaacagtgacacctgcttcttcaactagaaagggaagctctccatctttgactaggagacaaattacttctagtagggagagtagaaaatttgctaacaaacctttgcacatgtctttgaccttgcctccaagtaatcctgatccagctcctcaaagtaccatgaggagatctttaattatggagaacatgggggataaggacatagtcaaacgagcatttaagacattccagaatagtttcaaccagccaaaaacttctgttgaagacaaatctttgataaagaagcagtataaatggttattcttaaactgcacaaaatcagattga

SEQ ID NO: 82482 - DNA, 201 bp, Glycine max
  Peptide Sequence Number=SeqID_199260
atggaagttgaggttgtcatagttcacaattacgaagaaaatacggttaatccaaatcgtagggctataattcaattgaactttatagatgagataagacaccttgtagccagcacaatgaacgcaccacgttgtcttcggtcccaacgctacgcaccgttcggtgccaatgtcaccgctgctcctgtcaatacatgttaa

SEQ ID NO: 82483 - DNA, 402 bp, Glycine max
  Peptide Sequence Number=SeqID_199261
atgatcaaacaggttcttcttgttctgctcttcttggcctctggattgaccctctcagtctcagagactgaatctgtttctcttctgcctcacgccgctgagtccttcaatgtcagctatatccagatgaagaacgccgggacttgttcttacttggtggttatatctactagctgttcgtctcctaggtatacaagggatcagatcagtatttcttttggggatgcttatggcaatcagttgatgtttttggcatctagcagtcaggcagatgaatcttggatttcctctctagatattttgttaggtccttctgtggttagttctttcatgtcactttcttataggttcttaagtgcacgaattgcttctatatttgtgtatagaaaggctaacggttga

SEQ ID NO: 82484 - DNA, 372 bp, Glycine max
  Peptide Sequence Number=SeqID_199262
atgcaacagggacaggcagatatcctcatagctaggttccctgaccctaactatggtgttaaaacgaaaacgaaaggtcagattagggttttcgttctctaccgaaaccgcaagccaagttggaagattccacttcggttgaagggttcctctcggtgtgggttttcaatggagaaaaatgatgcacactccagacatcttctcaaagatcccaacggtcagatcatggaaacgtgtcttgtgaagttgcaaaccaaatttcgagacgatccaacggttaacgaacgctgggcatcgtttttaccgaggcagctacatgtagttttctctagaagcttcattaagaggcttcctccagaagcttcattatga

SEQ ID NO: 82485 - DNA, 2121 bp, Glycine max
  Peptide Sequence Number=SeqID_199263
atgccttcactctctctctctgaaactgacaccaccacccctaaacctatttccaacaaaaagaaaccaaagacccaatccctcactgatcccgacctcgatggggtttcggggaagaagacgaagaagcgcaaggcttcagatttattagaaccagaggccatgcccgccgcttacagctacaacaatggggacgacgagaccagctccgacctcgtcgaacccgaacctgcttccagagaagacgacagtcagaataaaaagaaaaagaagaaaaaggttgtcaagtccgaagaaaaagaacagcctttgttggtaacggagcctaaagaagaaaagaaggatgaccccaacgcgatttccaacttcaggatttcggaaccattgagggagaaattgaaggagaagggtatcgaatcgctgtttcccattcaggccatgaccttcgacaccgttctcgatggttctgatttggttggccgtgctcgcactggtcagggtaaaactctggcatttgtgttgcccatattagagtctttaataaatggtccagcaaaatctgcgagaaagactggctacgggaggactccgagtgttctcgtgcttctacctactagggaattggcttgccaggtgcatgctgattttgaagtgtatggtggggcgatgggattgagttcatgttgtttatacggtggagctccatatcaaggtcaagaacttaagctgaggagaggtgttgatattgtcattggcacaccaggccgtgtgaaggatcatattgagaagggaaatattgacctgagccaactaaagtttcgtgtccttgatgaagccgatgaaatgctgaggatgggttttgttgaagatgttgaaatgattctaggcaaggtagaaaatgttaataaagttcagacacttcttttcagtgctactttgccagactgggttaagcaaattgctttaaaatttttgaagccagataagaaaactgctgaccttgttggaaatacaaaaatgaaggccagcaccaatgttaggcatattgttcttccttgtactagttctgccagggcccaacttatcccagatattattcgctgttatagcagtggaggccggacaattgtatttaccgagacaaaagaatgtgcttctcagcttgcagggatcttgaatggagcaaaagctctccatggtgacatacagcaatcaacacgtgaggttactctgtctggctttaggtctgggaaattcatgacattagttgccacaaatgtggcagctcgaggtcttgatatcaatgatgttcagttaattatccagtgtgaacccccacgagatgtagaagcctatatccatcgttctggacgcacaggaagagcaggtaatactggggttgctgtcatgctttatgatccaaaaagatctaacatacctagaatagaaagagagtccggtgtaaaatttgaacacgtatccgcccctcagcccgatgatattgccaaagctgttagtggggaagctgctgaaatgattatccaagtgtctgatagtgtggttcctgcattcaagtctgctgctgaagagcttttgaacagttctggtttaccagtcattgaattactggcaaaggctcttgccaaggctgttggttataccgatgtaaagcaaagatcacttctcacttccatggagaactatgttacattagtccttgagactgggaaaccaatctatacccaatcttatggctattcaatcttgaggagatttttgcctgaagagaaggttgaggctgtgaaaggtctttcactcactgctgatggaaatggcgttgtttttgatgtaccagctaaagatttagacatatatcttaatggtcaggaaaatgcctcgaatgtatgtttagaggtagtgaaaacactgccacagttgcaacagaaagagccacaatcaagaggtggcagatttggtttggtggaagaggtggaggaggcaggaatggtaggttctccaatggtggtgggcgtggcggcaactggggtggaaagagatggtgaagctgagaagggactttgggagttgagtgttttcactctgctcggtgtgggatcataa

SEQ ID NO: 82486 - DNA, 225 bp, Glycine max
  Peptide Sequence Number=SeqID_199264
atgtggatattagcacttgctgcgaaaaatgtaaaaggtgccctgtctgccgtggatccattgaagaaaggatgcctgtatatgatgtatagaccgagttcaatgaagatgtataggttaagaagagatgtttataaattaatttttgtctcgactcctaaggatgttgtaccggaacaatatccattcaccattgttggatttaaaggtctattatttgtttga

SEQ ID NO: 82487 - DNA, 183 bp, Glycine max
  Peptide Sequence Number=SeqID_199265
atggagagggttggttgggtaccatgtaagtccgaccaattgatagtagcaaaggggaagataacggaaagaaaccttgaattcgagaacaagagacctccttactacactaaagaatcgcattccattactaacagaatccacgttccaccactaacaaactatgtcactaataactactaa

SEQ ID NO: 82488 - DNA, 267 bp, Glycine max
  Peptide Sequence Number=SeqID_199266
atgagccatggaagattgtatcaaagctgggtgaagaacactttcgacaagaaggtacgcccatgtaagttcaacgaaagggatctcgtcttgaagaaagtatcccaaacgcaaaaggatcaccgcgggaagtgggctttgaattatgaagggcctttcgtcgtgaagaaagcattttcgagaggagccttgttgcttgccaacatggacaatgaagaattgccttcacccgtaaattctgatatcattaaacgatattatgcctag

SEQ ID NO: 82489 - DNA, 810 bp, Glycine max
  Peptide Sequence Number=SeqID_199267
atggggagagagagagaagtgggggtggagtgtgttccaagacacaatgattacatggtcttggggaagcataaagggtggcgtggacatagcaagagtatagaagaacgtggggggggcttgaccgaggtacgaaggaaaaggaaacgcctaaaggccaaagaagcaacaactgcaacagcagctatagaccctagggaaatgatacaggaagatcaaggacagtgttcttctcaagcgatcaataactaccaccaagcctatcaagagcagcttctccttcagcaacagatgcagcagcagcagcaacaacaacaacaaaacaatgatatctttggtggaggattgaacatgtaccctggtggtgaagtttctcaaatcatgcatcatcatcatcatcaaccatggtctatgactatgcctcatcaccatcatcatcatcatcaggttcatgacccttttcttgtccctccccaaacttcaccctatgcaagcttgttcaacagaaggggtccttctcttcagtttgcatatgatcatggttcatcttctgaccatcttaggatcatatctgaatcctttgttggaccggtggttcaacccggttcagcaccctttggcctccaaaccgagttggctaagatgactgctcaagaaatcatggaggctaaggcccttgcagcttccaagagtcacagtgaagctgaaaggagacgcagggagagaatcaataaccatcttgctaagctgcgcagcttgttgcctagcacaaccaaattccgaggaacacagctagctagaaaaaagtag

SEQ ID NO: 82490 - DNA, 357 bp, Glycine max
  Peptide Sequence Number=SeqID_199268
atggagaacaatgatggtttgtggtggctaatggtggctgtgggtgatggagaaagttcttggaactttagaaatggctttggaagaaagaaagaagaagaaatgacgtttttcctaagctacacgaaagcaaaggctgaaatgcttaaatatgagatgctctcgggaacggaagcttctagcacactccagacatcttctcaaagatcccaacagtcagatcatggacaactttctctagaagcttcattaagaggcttcctccagaagcttcctcgtggcttctttgagaagctttctcaagaggcttctttgagaagctggatccttatctgtccacacccctctattaactaa

SEQ ID NO: 82491 - DNA, 390 bp, Glycine max
  Peptide Sequence Number=SeqID_199269
atgggagaagtagaacgcggttatatcccttctttcatatcccttctttcactctccatcaacttaatttcatacaaactcagccttaggaacaacaagaggtcttatattcatgaggagtgtttggagtggattttgcacttccatgtaaagccacaaaacatacttctgaattctaactatcagccaatggtagcgaattttgggttgtccaagctgagaaacagaaatgatactagtacatactttaccttttcaaggatacgaggaacaagaggttacatgtctcctgagtgggtttttaaccaacgaatcacgtccaaagttgacgtctatagctatggaattgttgttttggaaatggtcactggaaagagcaattttttatga

SEQ ID NO: 82492 - DNA, 208 bp, Glycine max
  Peptide Sequence Number=SeqID_199270
atgggtttggaccagttggcacgcgacgcttctcaacgccataacgtggatcaatctgtgtgtctgaaggatcatggtgcactgctccacccggccatgatgatggaagaggaggagatgacaaagggtgagaagtggaagcatatgggaagatatggaggaaagtgtagagatagagagaagaatttaggagatggagttttgaaaa

SEQ ID NO: 82493 - DNA, 2058 bp, Glycine max
  Peptide Sequence Number=SeqID_199271
atgttcatgagtccaatcactccaatggaaaagatggttctcattctagctagctatctcctcttgagtacactcttttctgctaatgctgaatttgtcaagaagacttacatcattcaaatggataagtcagcaaagcccgacaccttctccaatcacctcgattggtattcatcaaaagtgaaatcaattttgtccaaatcagtagaagctgagatggacaaggaagagagaatcatttacacttaccaaactgctttccatggagtggctgccaagttgagccaagaagaagctgagaagctagaggcagaagaaggtgttgtggccatattccctgatactaagtaccaactacacaccacaagaagtccaactttccttggacttgaaccaacacaaagcaccaacaacgtgtggtcagaaaagctagccaaccatgatgtcatagtgggagtgctagacactggggtttggcctgagagtgagagcttcaatgacactggcatgagaccagtaccttctcactggaaaggtgcatgtgagactggtagaggcttcagaaaacatcactgcaacaacaagattgtgggggcaagaatgttctaccatggatatgaagcagcaactggtaaaattgatgagcaagcagaatacaaatcaccaagagaccaagatggtcatggcactcacactgcagctacagttgccggctctccagtgcatggtgctaatcttctaggttatgcttatggcacagcaagaggaatggcaccaggagcaagaattgcagcatacaaagtatgttggactggtggatgcttcagctcagatattctatcagctgttgacagagctgtggatgatggagttgatgtcctatccatctctttgggtggtggagtctcctcttactaccgtgatagtttatctgtagcctcatttggagcaatggagaaaggtgtttttgtttcatgctctgctggaaatgcaggacctgaccctgtgagcctcacaaatgtgtcaccttggatcaccacagttggagcaagcacaatggatagagattttcctgcagatgttagtcttggaaatggaagaaagataaccggaacctcactctacaaagggagaagcatgctctcagttaagaaacaataccctttagtatacatgggagatactaactcaagcatccctgatccaaaatctctgtgcttggaaggtacattggatcgtagaatggtttcaggcaagattgttatttgtgacagaggcataagtccaagagtgcagaagggtcaagtggtgaaaaatgcaggaggggtgggaatgattctcataaacactgcagccaatggagaggagctggttgctgattgtcacctccttccagcagttgcaattggagagaaagaaggaaaagagctcaaacactatgtgttaacaagtaaaaaaaaagctactgcaactctaggttttcgtgccacaaggttgggagttagaccatctcctgtagtggcagcattttcgtcaagagggcctaattttctcacccttgagattctgaagcctgatgtggtggctcctggtgtgaacattcttgctgcttggagtgaggcaattggtccatcaagtttgccaacagatcacagaagggtgaagttcaacatactctcaggaacttcaatgtcatgtcctcatgtgagtggcattgctgctttgctcaaggctaggcatccagattggagtcctgcagccataaaatcagctttgatgaccactgcttatgttcatgacaataccatcaagcctctcagagatgcctcaaatgctgaagcctcaactccttatgatcatggtgctggacacatcaaccctagaagagctcttgatccaggtttggtctatgatattcagccacaggactacattgaattcctgtgctcactgaagctgactacatctgagcttggagtttttgctaagtattcaaacagaacttgcaggcactctctttcaagtccaggcgacttgaactatccagccatatctgta

SEQ ID NO: 82494 - DNA, 348 bp, Glycine max
  Peptide Sequence Number=SeqID_199272
atgcctcacaacaacattttgaatatcacgaatcccagcatggtctatgctgcctctggtcaacacgacttaaaagtggcatctgaggaaatgggccaacagacatgtggcccaactctttctgccccaaagcttgagaaatcaattgtggacttcaacccagcctctaaaactgaccctccgccttcattaaacgaggactctatagagctgcaatgtgcccttttgaaggaaatgggcttgacttatggggaagatgataacaaggttaaggggctattgctggatatggagaataagtataatatgatggcagcagagaagggaattaaaattcaacaattatga

SEQ ID NO: 82495 - DNA, 402 bp, Glycine max
  Peptide Sequence Number=SeqID_199273
atggcagcagtggtagtgacaactgatgacaaaggtggtggcaatgacaatcatggtggggttgcaatggtagtcatggtggtggtagcgacgttgacaaaggatggcaatgatgggttcgataattataatggggctacaacggtggttatgatgttgacaacgacaatcatgatggtgatgggtcaattttcgtctttgtctcaaactggcttgcgctttcgtgactgcaaccacattgtggagatcgtgtttgtggagatcgtctctaccacttatcgattgaggtcgaagaaaactaggaaaggaaagagtcctggaaagggtactcccagggcgttcttgttgtttctccttctgcctgagttggtgtttgtcgcaaactgggctgcgcttccatga

SEQ ID NO: 82496 - DNA, 609 bp, Glycine max
  Peptide Sequence Number=SeqID_199274
gtagatgatgtgtacggtgatgcacatggttacaagagggagaagaaccggagtaggaaaagtggtggcagtgtagattcatggttcagcggggagctacgtggaattgggtggaatagttatgattcagcgacggggagtggagagatagtagcaaagagtgggggtgtgagtagcactccgagtatgaggggaacggttttctacgttgcacccgagtatggttacaatggggatgcgtcagagaagtgtgacgtgtacagcttgggggtattgttgctggttattgtatcagggaggagaccgcttcaggtgagcggttcggcgatatgggagtataagcgtgcgaatctggtgtcttgggcgaggcaatgcgagcggagagggaagcttctggaagtggtggatgagagcgttgaagggttggataaagagcaggctagtctgtgcgtgacggttgcgttgatgtgtttgctaaagtcacctgctcgtcgtccttccatgaaggaggttgtgggaatgctcagtggggagatggagcctccgcagtactcactgcagcagcaaaaggccaagttcccgttccagcctccgaaagtaggcccatga

SEQ ID NO: 82497 - DNA, 747 bp, Glycine max
  Peptide Sequence Number=SeqID_199275
atgtttcctttacaacgcggcaatgagctggtaatccatttttctaatggtctctacccgcagcacaaaatctcccaagatctcattcgggacgatcaaaatatcgatcaatctccccatgtcggctattctgataaaaaatggcgtacaagccgcccaaaaaaactattttatcatgaggctgcagctaccagccacgctaattcttctaaccaagaatatgctaaaaagatggttcatagagagattgaaaggcaaaggaggcaagaaatggctacccttcatgcctctcttagatcccttctccctcttcgcttcatcaagggaaagcgttccatatctgatcaaatgaacgaggcagtgaattacataaatcaccttcagaagaatattaaagagttgagtgacaagagggataagctgaagaagaaaccctccataaattccacccctgaaggccatgagaattgcaagcatgtatctagtggtttcactatccatcagaatagtggtggagctgtggggattgaaattagtggattcagtgaggaagaggttccactttcaaaattacttaaactagtgttagaagagagacttgaagttgttagttgtctttcaaccaaagtcaatggcagattactccacagtttgcagtgtgaggttgacaattccgacagtgtagatctatctgagctgagaaggaaattttccaatgtaattccatcacttagatgttctgagtaa

SEQ ID NO: 82498 - DNA, 555 bp, Glycine max
  Peptide Sequence Number=SeqID_199276
gatataaaggcaggagaggaaaagtgttttggtattgaagttagggattttggagacgggccttcgaattccaaaacggtgtcattacagcaagtgggtaacagcgagggaagttccaagacagtgaggtaccatgacaacgatgacaacaattttgatgagaaagagattaagagcaacctcgatattgttgcttccaaagagcatgatgtgaagaatagaacctactatgatgaaaaaagtgatttctctgccgaaatacaagacatgctaacctatcatcatagaatttacatgaagaagagatgtgcatttaatgcaagcattaaatgctctaacgaactcaagaccttagacgaagaacataatgaagaatcctaccgttgtgagacaacgaatacttggagatgttcgatagctcaccatatgattgggttgagcttaagaaattccaacctaaaagaatataaactagatctgagccaacccattttcaatgtgtggcccaatgggctggaccagactgactcgacttgtccattttatcaaacctag

SEQ ID NO: 82499 - DNA, 762 bp, Glycine max
  Peptide Sequence Number=SeqID_199277
atgaatcctttacaccccactgatgagttgtactttcagatagcaccagataataattattattccctaccaatccaaactaccccagaaaatcagatcttgcatgatcctgtgatggatggaagcgccctaatccattttacgagtcaaatgggaaccaagggcaagcaaagagaagattttaagactacaaccatagatgaaaacaagaagtggatgcatagagagactgaaaaacaaagaaggcaagaaatgaccaggctttgcaccaactttagatctctccttcctcttgaatacatcaagggaaagcgctcaatttctgatcacatgcatgagggtacaaattacatcaagtaccttcagaataaggtaaaacagttgcaagccacgagggacaaacttatgaagttgtccaatttgagtcccgttggttctgagagtggaagcttgagtactacccatcttccagtatgcgtcattgttcatccttgtccaggaggtgttcagattaagtgtagttatagcttcgggaaatatgcctgtcctttgtcaagagtgctagacatagtgcttaaggaagggcttgatgtggtaaactgtacttccaccaaaccagatgataggttcatacacactatccgatgtgaggttccgcatatgatgactgggaataattacactgaactgcaaagaaagtttgttgaagcaatatcatcttcaagtttggaggagagactgtctgcacctgaaaactgctga

SEQ ID NO: 82500 - DNA, 510 bp, Glycine max
  Peptide Sequence Number=SeqID_199278
atgtccataagcattgcactaggtgtgtggcttgcgctgccagatgcagttccagttttagtcgcagatcctgaggttggcccttcaactgctcgtgtcagcataaaggagagttgtgttgatccctcagggaacgatccaaacacgggtgactcaggcaaatacgggttgtacatcgaagaaaatcctccctgcctggttgccctaggaagactttatgagggatccacaatcgttcacaacattcctttgttgcatgatcaagtcaaggttggtgttgaggaggttagagatgcagatgctcccattcctgtacccactgaagaggttaagttagtggggcagacacttaacaccttccttgcttggccgacacatcttgtcaagcgtttatcagaacaaggagctgtcggaccggtgaaacctgtagataggccggatcatgatatagatgatcccctatatctgatgacattgaccatcccacagctttttctgaagccgttgtag

SEQ ID NO: 82501 - DNA, 168 bp, Glycine max
  Peptide Sequence Number=SeqID_199279
atgaaaatgaaaatacctaaattacatagcaggaggcctagaaaagggttgaagaactggagcagaacgcttagtgcatcaacaaccgctcagcgtgaggagctaacttggaggccaggagaggctaaaccatccattgttgggagttcagtaatcaaatactcttga

SEQ ID NO: 82502 - DNA, 1691 bp, Glycine max
  Peptide Sequence Number=SeqID_199280
atggagggctctgcagaggatttcggagcccccgagtcatgggaggtcgctgatttggacgagtccatgaaccgcttgaacctcatgctctcttccaacaacgattctaagcaacctcaccaacgtgtcgccgatgatgacgatgctatgccgcctcctattccgcctccttcgtccagtggcgacgaggtttccgatgacgtcatcaatcaggttgatcagttccttcgcgaagctattcagaaccctcgcgaacggctttcaatgaatgcctcatttcagaggatccaaatcccatatgaaagctctaccaagctgcctcctgacagtgattttgagtttgaagcatctaataagctttatgttcttagattgttatatcttgcccaactgattaaggcttctaatttgataaattcagtcttgaggatggagcaagatgttgagaattttattcgtgatcctactcaacagcagcttgaatttaagcagcttccaacatcctatttaaggctggctgcacaccgggtggctcagcattactcattgcagtcaatggttttactggataatagtttaccagatggttctgggtcaagaattattgttcgcaaaacctttgaatgtaagcttccagttatccgccttgcagacatcccagtaaaattatcaccagaaaacagtgctgtcatgaaggttgcaatcaaacagaggccgcaaaagtggacacagatgctcagcaatgcaaattcaaactctgtgaagaacaataactctaaaagtgtggaagagagaaaagaggaatataatagggcccgagctaggatttttagttcaagtaataatggtggtactgtaggtgggaagccagaatgcgagtcaaggcagcaggataactcattgcatggttccttggtggttcctcgggtggaagataaatcagcttctgtatctgatgtcacttctggtaggggcctggttgagtcttctactaataccaatagggctagaagtagaacagagaaggagccagttggtaggtacaggcaaaacaatagggtggctatatttcgggaccgtgaggttgaccgcaaagatcctgattatgacaggaactatgataggtatatgcaaagatttgatcctggttttgggttcaatggaggatcgtatgcaatacagccaatgtatacagcagtattaaattacaacactgagtttccacagcttggatctgctcacagaccccacctttctgctgaacaccaaccacgacctcttccacagcatatacctgggccctgggctgcacaatcaacacctgctggaattggatatggacatcccgagaccatgatgccaccatttaatcctaatcaagttggtgcacactcctcatcagccatcccaccagcattgatctatccctccaatctcggctttgcaaggatgcttcctgcatcttccaccacacatatactgttgatcatgaagagtaaattgaggacctcttcagaggaaatggagccaaagaagtttgtgcttgacttggatgaaggggaagaggcagaaaaaggggtggtgaaggatgaactaggcgatgcttatgctggacaacagaagtttggaatgcaatgcatgtggttggctcaacgccttggggtgccggcaaatttgcaacaacctgcagg

SEQ ID NO: 82503 - DNA, 309 bp, Glycine max
  Peptide Sequence Number=SeqID_199281
atggtcgtacttggtgaaatagctctcgagctgcaacatgccgttgcagtaggtgaagctgagattgtcgagatgggtgactgcatgcgacacgcagcaagggtgccggtccttggtgtggttgatgcaaaattggaagaggctgtagatgacgacggaagagataaggacggtgaagttgttgtgattggcgaaggcaaaggagttgacgagaaaggtgatcatgttttcgtaggcaaaacttgcactaaaatgatagttattcttaggacacttcacaaaagattaacactattagtaacggtttag

SEQ ID NO: 82504 - DNA, 1173 bp, Glycine max
  Peptide Sequence Number=SeqID_199282
atggaacttctctctgtgtctgtctcacttagcaaatgccaaacattatcctttccgaaaccaaaggcaccccaaattcacgaacttccattaaacattagattacccaacaaaacaaatcatttcagtctttcatcatcttcttctccttgttgtaattggtccattactagggtagcagcagcaacaacatacccttccttcaatccttccaccactcagaaccctcactggatggtgctcatggacacgcctcctcaaggggtcaattccaagccacaagtcattgattattacgtgaaaactctgcaaaccgttcttggcagtgagaaagatgctcaaatgtgtatatatgatgcttcatggaacactcacttcggtttttgttgtgacattgatgaagaaatatccgcccagctggccagtttacctgaggtcttgttggttaggcctgacctggagttcaactctttgaaaaaagactatagtttatcaagtggcgaggcaggccacctatcaggattacgaactagaactaatatgttgttccctgctggaaattcaaagcattggcttgttaaaatggataagcccggggttgaggctgttaccaaggctcagattgttgattattatgctcaaattttgaccaaggtcatgggaaatgagaaggatgcacagatgtgtatatatcatgtttcctggaaaaccaacttcggtttttgctgtgaacttgatgaggattgtgcacaagagcttgctggtgtgctaggtgtcttgtcagttcagccagataacaattttgagtctgaaaataaggattatgcaggcagtaacttagaaaatagttggaatgtgtccaactcttctgaagcaagtcaggaagctcccttgaaaacaaagaaactttttgtgacagggctatcgttttatacatctgagaaaaccttgcgtgcagcatttgaaggctttggcgagttagttgaagttaaagttattatggacaaaatttcaaaaaggtccaagggttatgcatttgttgaatacaccacagaggaggctgcaagtgcagcactcaaagagatgaatggcaagattatcaatggctggatgatagtggtagatgttgccaagcctaacccaccaagataccacaggaatcatgctggatga

SEQ ID NO: 82505 - DNA, 123 bp, Glycine max
  Peptide Sequence Number=SeqID_199283
atgtatatgaaacgtgttgcatctgaacttgaaatattatctggacccaagaaggaaccgaccagagagtttttgattctgcaaggagtgcattttgcttttcgtgttcatcagctaaaatga

SEQ ID NO: 82506 - DNA, 642 bp, Glycine max
  Peptide Sequence Number=SeqID_199284
atgatagtcaggttaggactcatagtagctgcttccattgcagccctcacagttaagcagctgaatgtgaatgacacaagatcagaacgcggtgaagcaaggattagaaacgatcaagatgaggctacagaagaggcgcaggtcacttgttctattgatggtcacaccgagaagagggaaaaggaagagcaagaggaggttaagctaattagcaacataatcaatcaaactgatgattttgaagatgatattctaccagaatttgaaaaacttctatttgaggagattgattttctatcgcttgatgagaagactgatgaggataagaaatggagagtttatgcaattgaaatggctaatagtgccagtgaattagaatggttgcataatcaagtgaaggaattggaggagagggaagtgaaacttgacggtgaattgcttgagtactatgttgaaattggaaagaaattgaaagctctaaatgacttggaggttgaagttgtggagcttaagagagaaaataaagaacttcaacacaaaaagcgagaaatgacattaaactcaatgctgctgaatctaaaattacagaactctccaatgtcacagaggtcacagtcattgagtagatctatttttctttag

SEQ ID NO: 82507 - DNA, 2841 bp, Glycine max
  Peptide Sequence Number=SeqID_199285
atggctacaacattatcaaataatggttttccagcacacctaccaatatttgatgggaaaaactatgatcaatggatcgcgaagatgaaggtaatattcagatttcaagatgtggttgaaatcgtgaatactggagttgctgcattacccagaaacccaactgatgatcaaaatgctgcgcacaaagaacaaaagaaaagggatggtaaagctttgttcatcattcatcaatgtttggatgcagacatttttgagaagattgtgcattgtgaaaatgcaaaagaagcttgggatactttggctaggaactattgtggagatgaaaagttaaagaaggtacgattgcaagctctaagaaggcaatatgaattgctgcagatgactgagggtgaaactgttaatcaatactttgtgaggttaacaagcttaactaatcaaatggtgagaaatggtgaaaaaatctctgatttgatgaagattgagaaggtgttgagaacactaactcctaagtttgatcacatagtagtagctaaagaagagtcaaagaatcttgatgagttgaagattgaagaacttcaagcatcgctagaggctcatgaactgagattaaatgaaagaagcaagatcaaagacaagtcaaatgaaagtgcagctgatcaagctctgcaggctcagcatcagaagaaaggaaagtataagaaaggcaaaagaaagaatcagaattcaaagaactcaaatgaaggaacaagcaaaggccatgatcacagttctcaagaaggaaataaaggtcagaagaagaagatcaacaagaaagatattcagtgttataattgtcagaagtggggtcactttgcagctgaatgcaaatctaagaaggtaccaagaggagaatctgatgaagctcaatttgttcatgacaatgagggttacgattcagaaggagctatgttaatggcaatcatcaaagaagaagatgatgatgatcaatggtatctagacacaggttgttcaaaccacatgagtgggaagaaaacctggttttgtgagcttgatgagtcagtcacaaggaagattagatttgctgatgacagtgtggtgaatgctgaaggcataggcaagatcaagattcagagcaaagatggtaaagactcattcatttctgatgttctttatgttccaaatatgaaaagtaatctcattagtattggacaattgcttgagaagggttatactgtgagaatggaagacaagatcttgagaatttttgacaataaaatgagaacaattctgaaagttcaaatgtcaagacaaagaactttcaaaattggaatcaatattgttgaaaatcagtgcttgttgacaaaagctggtaatgagaactggttatggcaccaaagatttgggcatttgaattttggagatctcaataagcttcagaagaagaaaatggtaattggattgcctcagattactgaacctgacaaggtgtgtgacaagtgttgtatttcaaagcagtcaaggagttcttacaacactgagattccaaccagagcaacaagaaagctggagacaattcactctgatgtgtgtggaccatttgaagtaaaatcaatgggaggtaataactattttgtatcattcatagatgagtttactagaaaattatggatatacttgatagttaagaaaagtgaagtccttgatgtctttaagaagtttagaataatggttcagaatgaaagtggtgaagtagtaagcaagcttagaactgatggtggtggagaatacacatctaatgagttcaggtcattttgtgaatcaaatggcattaagcatgaagtgactgcaccctatactccacaacacaatggtattgcagagagaaagaatagaaccattgtgaatatggtgagaagcatgattaaagaaaagggtttaccaacctatctgtggggtgaagcaactgctactgcagtttatttgttgaacagatgtccaaccaagagattagagtatgttacacctgaagaagcttggtcaggaatcaaaccgtgtgtgaagcatctgagagtgtttggttcattgtgttttaggcacatacctgatcaattgagaaggaagctagatgacaaggctcaagcagttgtcatggttggttatcactcaacaggttcatacaaattgtatgatcctatagagaagaaaataatgttcagcaaagatgtaaagtttgatgaagcaagtagctggaattgggaaggtagctcatcaaggaagaatagtatggtgtatctcaatgatactgaatcaccagtacaagaggtgaacacaaatcaaggaggtgcatctgaaagaccaactagaaatgtacaagctccacaaaggctgaatgattgtgtgaggtttccagatactgcagtggctgatgatggtgaactaattcaactagctatgctagctgaatctgagccagtcagtcttgaacaagcaatgaaggaagagcattggaggaatgctatgttagatgagttacagtccatagaaaagaatgaaacatggtctttggttaagttacctacgagcaagaagtgtattgatgtgaagtgggtatacaagactaaattgaagccagatggtcaagttgcaaaatataaggctaggcttgtggcaagaggttttctgcagagacaaggcctagattataatgaggtttttgcccctgtagctagaatggagacaataagattgattattgcaatagctagctggaagagttggaagatgtttcaactagatgtcaaatcagcatttttgaatggtgagctagaagaagaagtttat

SEQ ID NO: 82508 - DNA, 150 bp, Glycine max
  Peptide Sequence Number=SeqID_199286
atggagaaactcgtgcaaaatgggcatcatgttcatctcaattctgaggagtggaagccaccaatgatgcaagaaccaacaagaagcaagaaagcaaggagaatagccagagaaaaggctttgcatggaagatgcaaggttttagaataa

SEQ ID NO: 82509 - DNA, 1434 bp, Glycine max
  Peptide Sequence Number=SeqID_199287
atgaagagaatcaaagctattagtcatgccatatttgtgatgttcatattctctctgagtgcaagaagctgtggacaagaagaccttgatatattagctcctatggagaaagcagagcaggaagctctatactccaccattcaaggctttgttggtgattcctggaatggctcagatctatatccagatccttgtggttggactccaattcagggggtctcttgtgatctgtttgatggattttggtatgtaactgccttgaacattggaccggtccatgacaattctctgagttgtgctcaagatttggaatttagacaacatttatttgagctcaagcacctgaaatctctatccttcttcaattgctctcaatcacaatacatgtttccagcaaccatccccactggaaactggcagaaactggcaggcagcttagaatcactggagtttagatcaaacccgggtctcatcggaaacatcccctcaagttttggtgtcctcaagaacctccaatcactagtaatattagaaaatagtgtaacaggtgaaataccatcaagcattggcaatctcatcaagttgaagaagcttgttcttgctggaaactatcttactggtaggattccagatgtttttgatgggctaaatgagttattaatctttgacttaagtagcaattcattatctggctctttgcctttgacacttgggagcttaacttcagcattgaagcttgatgtgagcaacaaccaccttgaagggaatcttctaaatcaatttgctaatcttaagaatctgacccttatggaccttaggaataataggttcactggagggttgaccttgtctttgcaagagatgtcctccttagaggaattggttttgtccaacaatccattgggtggagacgtcagattcctaaagtgggaaaacctcaagaatttggccattttggaactatctaacatgggattgacaggggaaattcctgagtctttatcagaattaaagaggttgagatttttgggacttagtgacaacaacctcacagggaacccgtcaccaaagctggaaactctgccttgtctcaatgcactttaccttagtggaaacaatctcacaggagagcttagcttctctaaagacttttttggaaaaatgggaaggcgttttggggcttggaacaacccaaacctttgctaccaaattggactaatgtcatcaagccatgttccatatggggtaaagccatgccagaaagaggtcaatttgttagaatctgattcaaaaactgagctgatcaatggggatatgaatgagactttccatttcatagcctctaagggattttctagctgtgctactaatggcttctggtggacttttcttgaaaaaatattgatgatgggcttatttctaagtcttatttaa

SEQ ID NO: 82510 - DNA, 858 bp, Glycine max
  Peptide Sequence Number=SeqID_199288
atggcgtcgataactggaccacagattctactgcactctggttctccatggttgaaacagacgatgaaaccctcgtcatcaccctttctcctcttcccaaaacacactcctcgtcgcaccttctgctccatcaattccaattccaagggttcgagttccatcgttcccgacctcctccattacctgaaccactcctggacccaattccacgccacagccgaagctaaacgacaattactcgccgccggtttccacatgctcgacgagaaccacgactggcacctcaagcccggcggacgctacttcttcacccgcaacatgtcctgtttggttgctttcgccatcggagataagtacaatgtgggcgacggctttcacgtgatagcggcgcacaccgacagcccctgcctcaaactgaagcccaaaacggcgtcctgcaagtgtaactactccatggtgaatgtccagacttatggagctggcttgtggtacacttggtttgatagggatttgagtgttgctggcagagtcattctccgaagtagccataattcttatgtgcataagcttgtcaaaatcaatagacccattttgcgcattcccacactcgccattcatcttgaccgcacagtgaaccaggatgggtttaaaccaaatctagagactcatcttcatcctttactctcaatgaagcctgaggacacttctttggaatccaactccaaggagaagaatagtgcattgtcatccaaagctcatcatcatcggctgcttatgcagttcattacaaagcaatatgccaatgaattggttgcattagatgtttggcatgtcaatatgtgggaagatggggaatga

SEQ ID NO: 82511 - DNA, 378 bp, Glycine max
  Peptide Sequence Number=SeqID_199289
atggccaaccctattgctatcattctcaatgctcctatgattctctcgcgaaccgctggtggaagagcgttgttgtcgctgccaagaggccctcctcctcccccctcttgcccttgcctcgaacccatcaatcacaaaaagacacgtccgttattgttgatagtgttcaccaagattgggagtcaccattccatggaagactttgtcgtcagaggcaaagagtccaaagatgaggttcagatttacacctggaaggacgctactctccgagaactcaccaatcttgtcaaagaagtggctctgactgcaaggagaagaaacgccaaactctccttcgcctttgtattccccgacaaaaatgaccgtttcaaagtttaa

SEQ ID NO: 82512 - DNA, 1128 bp, Glycine max
  Peptide Sequence Number=SeqID_199290
atgacaattttctattgtggtaaggtgaatgtctatgacagagtctcgcctgataaggcacgagcaatcatgcagcttgcaacgagtccagtccagcttactcaggatgatcctttaaatggaaatgcagctgtttggacttctccttgccacttaccgatggataaggatgtcctcgttcctgttgatactacaatccttcaggttgctcaagcagataagatggtggagtatcctctgcaatatagggagaaagggagcatagctcgtgatgctggcaagaaattgactgggataacttcatctaacttcgagatgtatttgaaccttccagtgaaggtccattcctcaaatgggaattcaagccgtagcagtactagctctccaccacaacctagactgcctctagtttccagtggttcagatcagctaaaggttgcccttcccattgatctcaatgacaaagagagaacgagccagagtaagaaaggagtgtcattcatggcgattgaggcatggttgatggacgatagcaatgaagatccaaggctttctcaccgtcgcaatcccaacgaatcagtttcattggaccaattagcagaattgggtgtgttatactggaagctcaatccaactatctatgagaacgatcaagagttgaccaagattagacaagataggggatacaactacatgagcctaagactaaacatgttcttgcctgttgatgagtccatttcaataatcaaggagaacaaggacctgcttgatttatgcccagaaaaggtggaaaattatgaacagaagttgaagaacttctacactgagcacattcatcaggatgaagagattcgttattgtttggaaggaagtggctactttgacgtgcgggacaaggatgatcgctggattcgcattttgatcaaggctggtgatcttatcattttaccagcaggaatttatcatcgcttcaccctagacccaagtaactatgtgaagttaatgaggctgtttaagggcgagccagtgtggacagcatataatagaccacaggaagacaatcctgctagaaaggaatacattaagggcctaactgagaaatttggagtgccacttgcagctcattag

SEQ ID NO: 82513 - DNA, 123 bp, Glycine max
  Peptide Sequence Number=SeqID_199291
atgggggcaatagagcattcattgcataattgggttattcgacaaaccaatatcaataccatgttccatgtacgagcaaaggaaaatccagaagaggaggcagctaaacattgttggtcctga

SEQ ID NO: 82514 - DNA, 717 bp, Glycine max
  Peptide Sequence Number=SeqID_199292
atggtttcttccgacaaggatccacgagaggaagtccttcaagcatggtacatggatgatagtgatgaagatcaaagactcccccaccacaaagaacccaaggagtttgtctcgttggaccaacttgctgaacttggagtccttagctggaaattagatgctgataaccatgaaaatgatccagagctgaaaaagattcgtgaagagcgtggctacacctacatggatgtttgtgaggtctgcccagaaaagttgccaaattatgagcagaaaatcaaaagcttctttgaagaacatcttcacactgatgaggagatccgcttttgtgctgctggaagtgggtattttgatgttagggattgcaatgatgcttggattcgagtgtgggtcaagaaaggaggaatgatcatcttacctgctggaatttatcatcgctttacactagatgagagcaactacattaagttcattagtgtgagcaaaaggttccaatcttgtgtagggtttggagagggtatatgttcatgcctttacccaaggcaagtggagaggttgagcccatgccctctgggtcataaggctttgcgtttttttgttggtgagccagtttggactccacacaatcgtccaaatgaccatctccctgcaagacaacaatatgtcaaggattttgtggaaaaggatgttggcaaccatgctgttgatgccgccgcgtaa

SEQ ID NO: 82515 - DNA, 1149 bp, Glycine max
  Peptide Sequence Number=SeqID_199293
atggagaaggcacatatgcaagtcccaagagttaaactgggtaaccaaggcttagaggtttctaggttgggctttggatgtggaggactatctggaatttataatgcccccctctcgcatgaagaaggatgttcaatcattaaggaagtgttcaataagggtgttaccttctttgatacatcagatctttacggacaaaatcatgataatgaaatcatggttggtaaggtgttaaaagcacataatcatattgtattagtttcaaattgtaataacttgattagtcatttgttaacagtgcattcacaaatagatctctacctagatgaggctttgaaacaacttccccgagaaaaagtccagttggctacaaaatttggtgttacggtatcaggtccagatgggttggattttggggtaaaaggtacccctgaatatgtgcgacagtgctgtgaagctagtcttaaacggcttgatgtggaccatattgatttatactatcaacatcgtgttgacacttcagtgccaattgaagacactatgggagagctcaaacagcttgtaaatgaaggaaagataaaatatattgggttgtcagaggctaatgctgacactataaggagagcacatgctgttcatcctattactgctttgcaaatggagtattccttatggactcgtgacattgaagaagaaataattccactctgcagacaacttgggattggaatagtggcatatagtcctcttggtcgtggcttttttgcaggaaaggcagtggtagagactttgcctagtcagagcttgctgagtatgcatcccaggttcacgggagaaaatttggagaagaacaagcttttctataaacgacttgatgacttggcttctaagcatgcctgcactccttcacaattagccttagcatggcttctccatcagggaaatgacataatccctatacctgggactactaaactgaagaactttgaaaacaacattggatctctgactgtgaagcttacagaagaagatttgagggaactttctgaagcagttcctgtttatgaagttgctgggacacgagagtatgggatgttaagcaactatacttggaagtttgcaactacaccaccaaagcaattgagttga

SEQ ID NO: 82516 - DNA, 1629 bp, Glycine max
  Peptide Sequence Number=SeqID_199294
atgtcaactcaacttctctgtgggccatctcctggaccaaatgatgtgaacccctttctcgatgcagcaatggatcaggacagctctctggttggtgcagttgttcgcagattgcttctaaatttcatggtccgttctaatgttccatctaatagggctacttattccatcttgtatgatggaaatcagagtagtgtgctacagagagttggttctgcagctgcaaatattgttttatttccatttagttatctggtcagttcgggtggtgaagaatcaaaaagtcctattgcagatatcagtattcatgtgcttcttgttctcgttcattatcataaatgtcttgtgagtgaggactacgcgaatcacaaatcttccacatcagattctttactcaaagaaaatcctcacttttctgacaatccttactgcaaggccttagagcatgcaattgattgtgaatatattgagggcaatgcacatagtgctccacacataaagcttccctttgcttcattgtttgatacacttggcatatgcttagctgatgaggcagctgttctactgctttactcattgttgcaagggaattctgcctttctggagtatgtattagtgcggacagatctggatacattgttaatgccaattctggaagctctatacaatgctccaagtaggacagctaatcaaatttacatgttgctaattatacttctcatactcagtcaagattcttcttttaatgcaagcattcataagctgatattgactggtgttccatggtacaaagaacgccttctccatcagacttctcttggttccctcatggtcgtaattcttatcagaactgtacagtataatttgtcaaaactacgggatgtctatctccaaacaacatgcctggcaaccttggcaaacgtggcacctcatgttcatcgtttgagtgcatatgcatctcagagattagtcagcctttttgatatgctttcacgcaagtatatcaaattagctgaacgcagagataataagctccatactgcaaaaggcgactctgaaggaaacaaccttgtagaagatatgactcttttggtgcagtcaactgaattgcacatttatactgacttcttgaggcttgtactagaaataataaatgcaatcctgacttatgcactacctcggaatcccgaggtagtgtatgcaataatgcacaggcaggaagtctttcagccattcaagaatcatccacgcttcaatgaactgattgataacatttatactgtattagattttttcaatagtcgtatggatgctcaaagagaggatggtgactggtcagtccacgaagtgctacaagtcataattgtcaattgtcgttcttggaggggtgatggaatgaagatgtttactcaactgcgcttcacatatgaacaagagagtcatccagaggagttttttatcccatatgtctggcagctagtgctatcccgttgtggattctcattcaacacaggagccataaatttgtttccagttgatctacaaacagaaagacttgaaaatggggtggtgggaaccacactccaaaatggtgattttgacaagcctgagtatcagcttgatccataa

SEQ ID NO: 82517 - DNA, 1827 bp, Glycine max
  Peptide Sequence Number=SeqID_199295
atgaaacagaaaatgaaaataaataacattttctctaaaccaaacaagcttcaatattccctgtttcgtgtggcctttgaaattggaagtgaagggcacatgctagaggaagctaaatctatcaatctttcacttagttcactgggaaaatgtattaatgctctagcagagaacaatgctcatgttccatttcgtgattcgaagcttaccaggatgcttcgagattcttttggaggcacagctaggacttcattgattgtgactattggcccatctccacgtcatcgaggagagacttctagtaccatattgtttggccaaagggctatgaaagttgagaatatgctgaaaataaaggaagaatttgattataaaagcttgtctcgaaagcttgagatacaattagataagcttattgcagaaaatgaaagacaacagaaagcttttgaggatgaagttgaaaaagtaaattttgaggcacaatgtcgtattgctgaggttgagaggaactttgcagatgcattagagaaagagagactgaaatgccagatggagtacatggaattggtaaaggagctggagcagaagttggttttgaatcaagaacgacacgactgtaatagttttgtggctgataatgaagaggggcctgcatcatcttctacagatgacgttgctgaggtcaaaatgctgcttgaaactgaaagaaatcggaggaaggcagctgaagaagaggtagaacatctaaaaagtcagctggggaaacatacacaagcagaggcaggaggtgatgtggagattataaagcttcgcaacctcctggaggacgaggctaatcagaaaaaaagacttgaagaagaaatcatattactaaggagtcaattattgcaattgaactttgaagctgaccagatgagaaggtgtttggatggaagctctggaagcacatattctgccatggattcctccacgactcaagttaggcattcccaattcaaggatgttgcgaatggtcaaaagtcatctgttgctacactctttgagcaagttggattgcaaaagattttgtcattgctggagtcagatgatgccaatgtacgaattcatgccgtgaaagtggtggccaacttagcggctgaagaggctaatcaaaagagaattgttgaagctggtggtcttacttccttgttgatgcttcttcgaagatatgaggatgaaactgttcgcagagtagctgctggggcaattgccaatcttgctatgaatgaagcaaatcaagaacttattatggctgaaggaggaattacactgttatcaatgactgcatctgatgctgaagatccacaaactcttcgaatggttgctggagcaattgctaacctatgtggaaatgatagaatattgatgaccctgagatctcagggaggtattaaggctttactgggaattgtaagatgcggacatcctgatgttctttcccaagttgcacgaggaattgctaactttgcaaaatgcgagtctcgtgcatctaatcaagggataaaaagtggcagatcctttttgatagaagatggtgcccttccgtggatagtacaaaatgctaataatgaagctgcaccaatccggcgtcacattgagcttgcactctgccacttggcacaacatgaagtgaatgcaaaggacttgattagtggaggtgctctttgggagcttgtccggatttctcgagattgttcacgggaggacatacgaaaccttgctcgtcgaactctcagttctgtctcaacatttaaattggaattgcggcgattgcgtatagatttttaa

SEQ ID NO: 82518 - DNA, 4101 bp, Glycine max
  Peptide Sequence Number=SeqID_199296
atggccatgaaagtcctgtgtcttagcaagctgtcatgctccatttttatcagtctggtgtcaagatttagagctggattgaaggcagaaattggggtttttttccctatgattgttctcagggtcctagaaaatgtttctcaacctaattttcagcagaagatgacagtgcttcgatttctggataagctttgtgttgattcacagatattggttgacatatttatcaactatgactgtgatgtcaattcatcaaatatatttgagaggatggtcaatggacttcttaaaactgctcaaggtgtccctcctggtgtaatgaccacacttttgccacctcaagaagcaacattaaaacttgaggccatgaaaagcttggttgctgttctaaaatcaatgggagactggatgaacaaacaattgcgcattcctgaccctcattcagccaagaaagttgaagcaacagataatagccctgaaagtggaggttttaccatggtaaatgggaatggagaagaccctgttgatggttctgactcccaatcggaagtctccaatgatgtatctgatgtttcaactattgagcaacgacgggcttataaactggaactccaggaaggtatatcactttttaataggaagcctaagaaaggaattgagtttctgatcaatgccaacaaggtgggtgattcgccagaggaaatagctgcttttcttaaagatgcatctgggttgaacaagactttgattggtgattatctaggagaaagggaagagttatccttgaaggtaatgcatgcctatgtggattcctttaactttcaagggatggagtttgatgaggcaatcagggtctttcttcaaggattcagactgcctggtgaggcgcagaaaattgataggatcatggaaaagtttgctgaacgttattgcaaatgtaatccaaaggccttttctagtgctgacacagcatatgtcctagcctattctgttataatgcttaatacagatgctcacaatcctatggtgaagaataagatgtctgctaatgatttcataagaaacaatcgtggcattgatgatggaaaagatttgcctgaggaatacttgagggccttgtttgagagaatatctagaaatgagatcaaaatgaaagaaaatgatgtggctcctcaacaaaaacaggctgtgaaccctaatagactttcaggcttggatagtatattgaatattgtgatccgtaaacgcggggaagggaacatggagaccagtgatgatcttatccgtcatatgcaagaacaattcaaagaaaaagctcgcaaatctgagtcaatctattatgcagcaacagatgttgtaatcctgagattcatgattgaggtttgttgggcaccgatgttagccgctttcagtgttcctcttgatcgaagtgatgatgaggttgtaatatctctgtgtcttgaaggcttccgctatgctattcatgttacttctgtaatgtcgatgaagactcatagagatgcttttgtgacttcattagcaaagtttacctcactacattcaccagcagatattaagcagaaaaatgtcgatgcaattaaggcaatagttgttattgctgatgaggatggaaattacttacaagaagcttgggaacatatcttgacttgtgtttcccggtttgagcatctacatcttcttggagagggggctccaccagatgccacattctttgcctttcctcagaatgattcagaaaaaacaaagccggcaaagtcaaccattcttcctgttttgaagaagaagggacctgggaggatgcagtatgcagctgctactttgatgcggggttcatatgatagtgctggaattggcagtaatggttctggtgtcacatcagaacaggtgaacaatctagtctctaatttaaatatgttggaacaagttggaagctctgaaatgaatcgcatattcactcggagccagaagttgaacagtgaggccataatagattttgttaaggctctatgcaaggtctccatggaggaattgaggtctccatctgatccacgtgttttcagccttacaaagattgttgagattgcgcactataatatgaaccgcatcaggcttgtgtggtcaagcatctggcatgttctctctgatttttttgtaactattggctgttcggcaaacctttcaattgcaatttttgcaatggattccttgcgtcagttgtcaatgaaatttctagagcgggaagaactggctaattataattttcaaaatgaatttatgaagccttttgttattgttatgcgaaagagtagtgctgttgaaattagagaactaattatcagatgtgtctctcaaatggttctatctcgtgtcaacaatgtcaaatctggatggaagagcatgttcatggtattcacaacagcagcttatgatgaccacaaaaacattgtactcttagcttttgaaattatggagaagattattcgagattactttccatacatcactgagactgaaagcacaaccttcacagactgtgtgaattgcctaattgcgttcaccaatagtagattcaataaagagattagcctaaatgccattgcttttcttcggttctgtgcaacaaaactagcagcaggagaccttggctcatcatcaaggaataaggataaggaagttactggaaagatttcttcatcttcagctcaaacaggaaaggaggggaaaaaagataacggagaggtgattgacaaggatgatcatctctatttctggtttcctttattggcaggtttatctgagcttagctttgacccaagacctgagattaggaagagtgccttggaagtcctgtttgaaaccttacgtaatcatgggcatctcttttcactacctttatgggaaagagtatttgagtctatcctatttcctatattcgattatgttcgacattctattgatccttcagggagtagttcaccgatcaatgaagtagaggctgatggtgagcttgatcaagatgcttggctttacgaaacatgcacattggctctccaattggttgtagatctttttgttaacttttatgacactgtcaatccacttttaagaaaggtgctgatgctcctggttagctttataaagcgccctcatcaaagccttgctggcattggtattgctgcttttgttcgtttgatgagtaatgctggggggctgttttctgatgaaaagtggttagaagtggttttctcattaaaagaagcagcaaatgcaacacttcctaactttttgtttgttgaaagtgaggactttactaaaaatcaggaacatgcttcaacagctgaagatgatagagatcgtgccgagtctggctccccagataatttagaaagcttgaggattcgtcgtctttatactcatttaactgatgcaaaatgccgagctgctgttcaacttttattgattcaggcgatgatggagatctataacatgtatcgccctcacctttcagcaaaagccatgctagtcctgtttgatgctctgcacgatgtagcgatacatgcacaccagattaatggcaatactatattacgttcaaagcttcaagagtttggttctgtgacccaaatgcaagaccctccactgttacgccttgagaatgaatcgtaccagacctgccttacatttttacaaaaccttgtcattgacaagcctcctagttacgaggtggacgaggtcgaatcacatctcatccagctttgtcaggaggttttggagttttatattgaagttgcaggttttgaacaaaaatctgaatcttctcatggtagacagcaacattggttgattcccttgggcactgggaagaggagagaattggctgcacgttcacctctcattgtggctactctgcaggctatttgtagtttgggagatacttcttttgagaagaacttgtctcatttcttccctctcatctctagcttggtacgttgtgaacatgggtcaaaggatgtccaggttgctctcagtgacatgcttagtttatcagttggtcctattttgctacagtcatgtggatga

SEQ ID NO: 82519 - DNA, 210 bp, Glycine max
  Peptide Sequence Number=SeqID_199297
atggagttgtgtgcaagcagctctcaacgttcacctcaaccattaaaggatgaagggagtaaagggagtggagttgtcgaggagggtgacaaaagtgcatgtcatagatttttttatccttataaaatcgaagacaagtatggtaatttacaacagtccacgcatcctgctcaatcaagacctcctggtaaaggagatgtcatagattaa

SEQ ID NO: 82520 - DNA, 288 bp, Glycine max
  Peptide Sequence Number=SeqID_199298
atggaggttttgcatggtggaatctacctgaacaagtttggagtgaaggtctattactttattaaaggcagtgatataattcttttctcaaaattgaccgtggtggagacctcggaggaattacagtcatcgactcaagcttctcatgagcccaagagtgaacaaccaaacaatcacacaactgatgctcctgttacagacacaggctcagcatctgctacaagtaatgacagcaaaaaagtttcacggcaggatattgagtttgtaaggatatatattctttgctaa

SEQ ID NO: 82521 - DNA, 1293 bp, Glycine max
  Peptide Sequence Number=SeqID_199299
atgatgggcacctattgcaataacctactgtgcaacttttatcatccaaactactcaataaccaatgatgttaccaaattttgtcgagttctgaccagaggaaactcattatgccaaaaccccgtttattttggtttgcgtaaacaccgttttgattcagtattagtgagtgttggtttggaggaagttgttaaagaagaagggaaagaagacaatgacagaaggtataggtggattgaggttggcaaaaatgtcccaaaagaacaacaacaggccatatctaaacttcctttcaggatggccgatcgatgcaaagccttgatgagacagattatatgttattctgcagaaaagggctccatgtctgatcttttgagatcatgggtgaagttaatgaagcctaccagagcagactggctttcagttctgaaagagttgaaaataagggaacatcctgtttaccttgaggggaatgcagttttttcctctaaccatctaaacctcctggtctgtcgagttgcaaaacatgctcttatggaagaatcctttgaagtcaatattcgtgactacacaaagataatacattattatggcgagcacaatctattggaagatgcggaaaaatttctcacactcatgaagcaaaggggcttcatctatgatcaggtaattctgactaccatggttcacatgtacagcaaggctggcaatcatgaccgggccaaggagtactttgaagagatcaaattgctcggcaaacctttggataaaagatcatatggctcaatgatcatggcctacatcagagctggaatgcctgaagaaggagagaatttacttcaagaaatggaggcacaagaaatactcgcaggcagcgaggtttacaaggcgctgcttagagcctactctatgattggtaatgctgaaggtgcacaaagggtgtttgatgcaattcaactggccggtatcaccccagatgataagatttgtagtttggttgttaatgcttatgttatggctgggcaaagtcagaaggctctcattgcatttgaaaatatgagaagagcaggtatcaaacctagtgataaatgcatagcttcagtgttggttgcatatgagaaggaaagtaagataaatactgcattagaatttctaatagatttggagagagatggcattatggttgaggaagaagcttctgcggtactagctaagtggttccgaaaactaggggtggtggaagaggtagagcttgttttaagagactttgttactagtaatcagataagctaa

SEQ ID NO: 82522 - DNA, 222 bp, Glycine max
  Peptide Sequence Number=SeqID_199300
atggaaggaagtttagagcatacaatgcttcgcctagcagatccaggagaagaagaaagggagagcgcacaatcgatgttgccgcagcacagcgcggttggaatgacgtcatgtctgagcgtgacttccagaagttgtcgagcgctttctcagggcacatacctatacgtaaaaaatgtggcgaaaaaggacagaatgggtgatgaatgggaggttggatga

SEQ ID NO: 82523 - DNA, 447 bp, Glycine max
  Peptide Sequence Number=SeqID_199301
atgcagatgcatatgtggggacatggatcccagtataggaaaggatcgaattcattgagagggtcaaaagcaggttctctaatgctgaggctaccctgctattgctgtgaagaaggttgcaaaaacaacataaactatccaaggtcaaagccactgaaggatttcaggaccctcaaaacacactacaagaggaagcatggagagaagccattcgagtgcaggaagtgtcacaagccatttgcagtaagaggagattggagaacacacgagaagaattgtgggaaactttggttctgcgtctgtggttctgatttcaagcataagaggtcccttaaagaccatgttcgtgcattcggcaatggccatgcttcacataacttgagtgaagaaagaggggacgaaggtggagatgatgacagtgaagtggctgtttttactttcaaataa

SEQ ID NO: 82524 - DNA, 365 bp, Glycine max
  Peptide Sequence Number=SeqID_199302
aaacaaagacatacgagaatgatgatctgaaagtcactgttgtaacaagtgagatcaaccctgaggacggtagttatcctagtgagaggaaggaggcagcagtgatccctccttctgttgtgtctgataaaaggcaaggggtacctataagtaataagaaatctttcaagaaggttgcaaaacagaggtctcggccaaggccatcaagatttggacgtgtttcatctagttggttacctaactggttcctaatgtccatgacaggagtttcttcttcagggctattcctgactttccattttggggattcaagagttatggaagaaacacctaatttttctccttttcttttggttaatcggtaa

SEQ ID NO: 82525 - DNA, 767 bp, Glycine max
  Peptide Sequence Number=SeqID_199303
gattctttggaggagcaggcgccacagggatcgttcgtcccccatggacacctacagcagctgacccaacaaatcagggaccagctggaggaggacttgcactgcctccggagcctaaggttggtccctcaggtgctcgtgtcagcacaaaggagagttgtgttgatccctcagggaacaatccagagacgggtgactcagacaaatgtgggttgtacattgaagaaaatccttcccgcctggttaccctaggaagactttatgagggatccacagcggtttacaacatccctttgttgcatggacaagtgaaggttggtgttgaggaggttaaagatgcaaaggctcccgttcttgtatccactgatgaggcagctgcaaaacctccagaaagactggatcctaaggtcgatgatctcctgtatctgatgacattgaccatcccacagctttttttgaagtctctccaggttatgtgggatgctaccgtgttcgggagatctgggcaatcacaatttgaatcggaaagttacatcaagagttggatgcagagttcaaaacatgatgtctaccttggagcctaccagaatggcggacactggcaaatagtcgtcattctgcctaaggaaaaccttgttgtctggttttgttccttgcataacaggccagacaactatcttaagggaataattaagagtgcttttaaaggacttgatgatactccacaacctaaatccaaggctggtgcttggtggattgttgttaag

SEQ ID NO: 82526 - DNA, 411 bp, Glycine max
  Peptide Sequence Number=SeqID_199304
gacgacccaagaggctttttgtttttgttaatccattcggggggacgaaatctgctgtcattgtttttcgtgatcaagtcaagcctctgcttgaagacgcacaagtgcagcttacagtccaagaaactaagcatcagctccacgcaaagcaagttgttcagtcattagatttttcaaagtacgatgggattgtttgtgttagtggagatgggatcttggtcgagttcgtaccaagtaccattgtgattgtggttgtaaatggactgcttcagaggcaggactgggacactgcaattaagatgccccttggagtagttcctgcaggtacgggaaatggcatggcaaagtctcttcttgattcagttggtgatccttgtacagtacccaatgctgttcttgccatcatacgag

SEQ ID NO: 82527 - DNA, 553 bp, Glycine max
  Peptide Sequence Number=SeqID_199305
gctctcactcgaatcttgcatttgaggcattacattggatgtctttattttgtgcctgcacctggatttgaagcttacggggaccccactagttaccctggaagttctaataacaaaggcagcaatagtgaactaattgatgaggaacctttgaagttacaaaggctaggctatcaaggacctgaaattgacctggagaatcagagttggagagttttaaatggaccatttatttctgtctggcttcacaatgtggcttggggtgctgaaaacaccaaggcagcaccagatgcaaagttctcagatggttatctggacttgatcattacgaagaattgcccaaagttaccattgctgtcgttgatgtcagatttgaataatggaggtcatgtgaaagttttggtcttggaacctggtccacgcttgggggaccaagagaaggaagggatcatagatgcagatggtgaggttctggcaagggggaaagggtcgtaccaatgtgagcagaaggctttgatggcctatgataaacttcaaataacagtagatcaag

SEQ ID NO: 82528 - DNA, 846 bp, Glycine max
  Peptide Sequence Number=SeqID_199306
atgaatgacctattctcaaactcattcaagaaatacagcaacctgaagcagcaggcacacctcgatgacgtagaggccgggaaagaaaccgtgaacctcgacaaattcttcgaggacgtggagaacgtgaaagaagaaatgagaacggtcgagaagctacacagaaaactgcaggaggcgaacgaagagagtaaagtggtgcacaatgcaaaaacaatgaaggagctccgggcgaggatggacaaggacgtggagcaggtccttaagcgcgtgaaagtaatcaaggggaaattagaggccttggagcgttccaacgccgccaacagaaacatccctggctgcggtccgggttcctcggcggacagaaccagaacctcggttatggagtacaaggagaccgtggagcgaagatattttacgataaccggagagaagcccgataaggagactatagagaacttgatatggagtggggagagtgagagttttctgcagagggcgattcaggagcaggggaagggacaaataatggacacaatttcggagattcaggagcggcacgacgcggtgaaggagattgaaaagaatttgattgagttgcaccaagtgttcttggacatggcggctctggtggagtcgcaggggcagcagctaaataatatagagagccacgtggcgcatgcgagttccttcgtgagacgcggcacggatcagcttcaggatgctagagagtatcagaagagttcgaggaagtggacgtgctatgcaatcattcttggccttgtgcttcttcttgtgctcttgtttccaatcttgattaaccttttgcctcatttgttaaggtga

SEQ ID NO: 82529 - DNA, 252 bp, Glycine max
  Peptide Sequence Number=SeqID_199307
atggttctactgaaaacgacaacacaatgctggtcccgcatgccggctatatttaaaagtccaccagcaggtgtagcacatcctcgggtggctctgctgcgagagaaaatggaaacaacagagtttgcaagcccgacaactattccaactttgacttgtccacgctttggaattggacgcccagagaacctccttgggaagcttcttccaccattcatcatgccactggctcttgcacctgccattccttaa

SEQ ID NO: 82530 - DNA, 1749 bp, Glycine max
  Peptide Sequence Number=SeqID_199308
atggcattggcaaggattgctagggccaacctgagaagatcaggaggtgctttgggcagttctgctcatgagaaggatatgttcaatgtgggaggatacacaagcagatccaacataccttcccataaattttttgaatcagatcgaaagttttcatatgttccaagaattaaggaacagaactacataaacttttcaatgaggggaatatcaggaacaccatacgatcactttccttctgctagcacacagactgttatagaggagtccgagtatgagtttgagagtgatcggcaaagatatgcaggactacagccaacaaagccaggtgaaaagcctagggtggttgttattggtacgggttgggccgcgtgccggttcctcaaagggatagacaccagaatttatgatgttgtgtgcatatcaccaaggaatcacatggtctttactcctttactagcttcaacttgtgttggaaccctggaattcagaactgttgctgagcctgtatccagaatacaggattcattagcaagggaccctaactcctacttctttctagcttcttgcactggcattgacacaggcaaacatgaaatctattgtgaggcagttaacaatggtggattgcctcaagagccttaccaattcaaagtcgcgtatgacaagcttgtaattgcatcaggatctgagcctttaacttttggtatcaagggagtaaaggaaaatgctttttttcttcgcgaagtgaaccatgctcaagaaataaggaagagacttctccttaatctgatgctttctgaaaatccaggcatatcggaagaagacaagaaacgccttctacactgtgtagttattggaggtggtcctaccggagtggaatttagtggtgaattgagtgatttcatcatgagagatgttcaggagcgctatactcatgtcaaagattacattcacgtcacactcattgaggcaaacgagatactgtcatcctttgatgttagcctacggcaatatgcaacaaagcacttaacaaagtccggggtccgtcttatgcgaggtgtggtgaaggaggtgcatcccaaaaagataattctgagtgatggaacagaggttccttatggcctcttggtttggtccacaggggttggtgcctctgagtttgtgaaaacactagatcttcctaagtctcaaggtggaagaattggtgtagatgattggctgcgtgttccctcagtggaagatgtatttgcccttggagattgtgctggttttcttgaacacactggaaggcctgtgcttccagctctagctcagttgacatctatttatgtttactcccgaacatggaatgatataaagcctctttccgagtgcccttttggtagctgctcaggaggcttactaaagagggttgctgaaaggcagggaaagtttcttgtggagttgttcgacgaaatagggaatcagaatggaggcaaggcttattctgcgaaaggcatgccacttggagaaccttttgtatataagcatcttgggagcatggcatcagtaggtggctacaaagcactggttgatctacgacagtcaaaggattcaaagggattgtcacttgctggttttgttagctggatgatatggcgctctgcatatctgacacgtgtccttagctggaggaacaggttttacgtggcagtcaactgggccaccacattagtcttcggtagagacaacagcaggataggttga

SEQ ID NO: 82531 - DNA, 897 bp, Glycine max
  Peptide Sequence Number=SeqID_199309
atgggttatgagagagtgagagtgctgtttcttctgtttctgataccactgccaacggttctgggttggggcaaggagggccactatgccacttgtaagattgcacaggagtatcttagtgaagatgctctatttgcggtcaaacaattgcttccagattctgctcaaggtgatcttgctgccgtttgctcttgggctgatgaggttggccatactcaccgctatcattggagcagcgctttacattacgttgacacaccggatttcaagtgtaactatgaatactgcagagactgtcatgattcttacagacatgaacataggtgtgttagtggagcaatatacaactatacaatgcaacttaaatcagctgatgcaggcatttcatctgaatttaactataacttgaccgaggcacttatgttcttgtcacattttgttggggatattcatcagcctctacatgttggtttcactggagatctgggtggaaacacaataacagttcattggtaccgaaggaaagcaaatcttcattatgtgtgggatgacttgattattcagtctgctctaaaaacattctatgactctgatctttctattatgatacaagccattcaaaggaatattacagataattggctaaatgatgtatcaacttgggaacattgtgctcacaactacacagcctgtccaaatcggtatgcttctgaaagcattagcttagcatgcaaatttgcttacaggaatgctaccccaggaagcactttgaaagatgagtacttcctttctcggctgcctgttgtggagaaaaggctggctcaaggtggtgtgcgacttgcagctatccttaaccgtattttcacttcttccaagaccagaattgctcaagcttga

SEQ ID NO: 82532 - DNA, 234 bp, Glycine max
  Peptide Sequence Number=SeqID_199310
atgcagggattccgaaaaattgtgccagacatatgggaatttgcgaacgagcatttcaagcgagggcagaagaagcttctcttcgagatcatgcggcaaggaagttgtggatctgaaaacatgattaagttgctgaaaatacttgcgttactgggaagtggcgacaagcaagctagtggacacatgtacactgtgcttggtgatataatgagagggaataggaggagaggatga

SEQ ID NO: 82533 - DNA, 618 bp, Glycine max
  Peptide Sequence Number=SeqID_199311
atgggaaagaataggggcaacaaacaaacatacataggtattgagctatcgaacaaagctggagaagttgttgtgcttgaaatattttggaagcaaatcctttgcaaaattcacatgcttccacaccacaaaagtgttcccactttcaatatgggtgctggttattgtgatgttgttgtcactgctacatcgggtggagtatcacagattaaagccttggcaagaagtaccattggtggtgaagacttgcttcagaatatgatgcatcatctgctaccaaattctgaaaatttatttaagaaccatggggtcaaagaaattaaacagatgggcaccgtcaatggtttcgcgccaaagtacaagaacctgaccgaagctcagaagcaaccaggcccacttgggccttccagattgttcctccagaaggcggttgcttctggaggaagcaacctggctcgcctgggcgagctgggtggcaagctcctcccctattttcctataaatagagggaggagtgaagaagaaaagggttcagctcttctggtacttcgtaatcacttaaaattagtgaagaaaattgtttccgtgaagaaaatccaagccgaggcgcttccgtaa

SEQ ID NO: 82534 - DNA, 246 bp, Glycine max
  Peptide Sequence Number=SeqID_199312
atgaggttgaagcatggccatatggttcttggtcagggcttcacccatgaagaaaaacgtggttgttggtttaaagaaataagaacaaatgttgaaaaagggaaaaaaagggaacccaacaaattagaagccctccaagaggatcaaggtgaagcagattctgcaactgaacaagatcaagctgagaagaaagttaaaaaatggaagagactcgcaagagataaaagggagaaaggtagccaataa

SEQ ID NO: 82535 - DNA, 159 bp, Glycine max
  Peptide Sequence Number=SeqID_199313
atgtgggtgcggtggaagaagcttaacaacggtggcaaagaacgtgaaggagttgctgtgacatggcatcccttaaggtgttgcattcgcctcacacagaatcgaagcaaagtcatagaaagctccatttgtggtgcccttcgttgtgtaaatccttga

SEQ ID NO: 82536 - DNA, 897 bp, Glycine max
  Peptide Sequence Number=SeqID_199314
atgatcatcactgcgctcatcactgccatacttgcgggactttgcattggcccaatcaacggcaggcggcggaggaagagggccgtggcgttcttccatccgtacaccaacgacggtggcggcggggagagggtgctgtggtgcgccgtcagaggtatccaggaggagagccccgaccttgattgctacgtgtacaccggagatcatgacgccacccctcaatcgctcatggctcgtgccctcgatcgctttggggtcgctctcctctctcctccaaaggtacttcccttggaacgatcagcagaaattccagtattaatatctgttgcacaatttcgaccggagaaggcacacactctccaacttgaggctttttcagctgccattaagagattagatcctagcttgccaaaacctaagttccaaattgtgggtagctgtagaaataaatcagatgaagacagacttcaaatgttaaaagagaaagcaatcgagctgaatgtgaatgaacacatggaatttcataagaatgtaacatacagagatttggtgggacttttagggggtgctgttgctggcattcattcaatgacagatgagcattttggcattagtgtggtagaatacatggctgctggtgccattccaattgctcataattctgctggcccaaaaatggacattgtattagatgaagaaggacagcagacaggatttcttgcctgcagtgttgaagaatatgcagatgccatggtgagaattgtatcgatgccggagatggagagacttaagatggctgcagctgcaaggagacgggcagggaggttttccgagcagaggttttatgatgacttcaaagctgcagtgcatcctatcctgtgtcatatttctaggtga

SEQ ID NO: 82537 - DNA, 1119 bp, Glycine max
  Peptide Sequence Number=SeqID_199315
atgggcatcttggaagtcctttttcccttcttcgtctttcctgtcatatatgctgttgctacctcaaatgattgtcaattttccgtatgtggcaacaatagtgtccttattcgtttcccctttcaactagatggtgatcgaaatccttattgtggctatcctggtttcaacttaacttgtacgaataatagcaaaacagtgctaaaacttccatactctggtgcattctatgtgcgcagcatcaactacctcacacaaaagatacaagtctacgaccctgatgattgcctccccaaacgtcttttgaccctcaatgtctcaggttctcctttcattcccacttttactcgtgactacaccttcttaagctgcccatttcagaacgcagggtcacaattcattcccatagactgcctcagtaattccacaaattttgtatcagctgtccctactctaaacttgaccaatccattgcctgagtcttgcaatgttattacaagggtttcagtcccagtttcagggccagagcaacaatatgaggagaatcacagagatgagcttagtgaagatcttcgattaacttgggatagacctgactgcagatattgtgaatcgggacagcaattgtgtggatttgatccagataacaacggtcaactcttctgttttcctggttaccaaacagttacttcaagacgtggagcccaagttttcagaatcatcacattttgcattgctggaccagcagcagtcattgcaatagtgatggcatgctgtgtgtgctacaaggacagactaaccaacaggtctgcacttgcagctacaatatcgccggtgccacaaatcgcaaccacgggtctcgacgagtccacgatcgagtcctacgagaagatggtggtcggagagagtcgacgagttcctggacccaacaacaatggatgctgttggatatgcttgtcggagtacaacagcaaagagacaataagattgattcctgaatgcaaacactgcttccatgcagactgcatagacgagtggcttcgaataaacaccacatgcccagtttgccgcaactctccctccccttctcctcttcatgttacgtccattgacccctaa

SEQ ID NO: 82538 - DNA, 1974 bp, Glycine max
  Peptide Sequence Number=SeqID_199316
gattggaagtcactttcttcttcaagtattgaacacaatgattcttctaatggtggatttctcaaaagaaaagttcaaccaagcctaagttctgtcagtgatggatcaataacaaatttgtcttgtcggaaccatgttcttgatccacagggggcaacacttcagaagtggaacaaaatttttgtaatcacaagtgtgatggcaatctctgtggaccctcttttcttttacatcccaatgattgatgacaagaaacaatgccttgctttagatggaacactgaagattactgccagtgttctccgcacattctttgatcttttctacattcttcacatcatctttcagtttcgaaccgggtttattgcaccttcctctcgtgtgtttggaaggggtgagctagttaatgatccttgggccatcgtaatgagatacttaagctcttacttcatcattgacattctatcaattattccacttcctcagttggtcattttagctatgatcccattcccaaaatgctcagttccttatgtgggaaaggatttgttgaagtataccataatagcacagtacgtgccaagaattctgcggatctacccgttattcaaagaagtaacaagcacttctggcatattgactgagacagcatgggctggagctgcttacaatctttttctctatatgctagcaagtcatgttgttggagcattctggtatctgttttcggtagaatcaaggctgcggtgctggcgcaggcggttgaagaatactacgttcttgcatgaatcctaccttagctgtggaagtggcaattctactgttcaatcacttctcaaatcttcttgcccgttaactgatccacaacaaattcaacacctggaaactttcaattttggaatttttatagaagctctaaaggctcgcgttgtagaatcaaatacagattttcctcacaagttcttctactgcttttggtggggtttgcgcagtgtaagttctgttgggcaaggtctcgagacaagtacttatgctggggagataatctttgctatcttcattgctgtctttggattgattctatttgcatcacttattggaaacatgcagaaatatctacaatctaccactgtcagagttgaagagatgagaatcaaaaggagggatgcagaactgtggatgtcccaccgtatgctacctgatttcctgaaagaaagaattagacgttatgaacaatacaaatggcaagaaaataggggtgttgaggaggagacattaattcgcaacctccctaaagatctcaggagggacataaagcgtcatctttgcatagacctccttaaaaaagtgccaatgtttgagaacatggataatcagttgttggatgcactgtgtgataaactgaagccagtcctttacacggagaaaagttacatagttcgtgaaggggatccagttgatgaaatgctgttcataatgcgtggaaaacttgctactgccacaacaaatggtggaagaactggtttcttcaactcctttgagatcaaggctggtgacttctgtggagaagagcttctaacatgggccttggaccccaactcctcctcaaatctacccatttcaactagaacagtagaaactatatcagaagttgaagcctttgctctcatgcctgatgacttgaagttctattccttgcaatggaagacatggggtgcatgtttcatacaagcagcttggcgcagatacaaaaaaaagaaggctgagaggttgttacgtgaagcagaagaaaggatacaagctttggaaaatgaggaagggtcctcacctagctttgctgctacaatatatgcatcaaggtttgcatcaagtggattgcgccacttgcgaagtggtaaacgcaccagagtgccacagccacagagatccctgatgcctcagaagccagatgatttcactgctcagaaaaactag

SEQ ID NO: 82539 - DNA, 294 bp, Glycine max
  Peptide Sequence Number=SeqID_199317
atgtttgagaattcagggaaagtagacgaggagataatcggagcggtggtggaggacaagattgatcccaacgtggtttgggagcaaggagtaaaaggtgcagcacaatcggggaaccctccaaaagttgattctaaagttgaggtccttcataagaagccaagtgagcataatacatattcagatattgaggcttcatacaagtgtccagaagaaagttataatgtcaagcaagaagatattcctttttgggtaatctgttggcaggggccccactttggatcttgcagctag

SEQ ID NO: 82540 - DNA, 249 bp, Glycine max
  Peptide Sequence Number=SeqID_199318
atgggtgatgtctgtggtgcggtggttttggccgctgggtggggtgggggggtgctgaccatgaagaaggacaattttgtcctttacttgttattatggaggaacaacgcacattggtatggcggcggcggcggcgacagtgggtggagtctagggcaaaaaaagcgaagaaggcccctgtcccttgcggagcaattgcacggcgacactcgcaacttcttctacaacaaagagaaaggggttgtatga

SEQ ID NO: 82541 - DNA, 810 bp, Glycine max
  Peptide Sequence Number=SeqID_199319
atggatactttcttaaagatcgagaatcagttgacgacattggtggcttgtgtgtgggaaaagagcaacaggctatgtaacaccacaatcaggttacagaacaacgccctctctggccacgtccccgacctttcagcttccctccttaatctcactgtacaaaacgtcaccaacaacgaactccgtagccatgttcctgattccatgctcaccgtactctttggaaaccacgccctctcctctagctcgttcccacaaaccagtagcgtaaccgttcctaacaattcgagaaagaaagggttgagagtcggtgtcattgtggcgatcgttgtggtggcttgcgtggcggtgctggtggcgatgtcgttcgcgatggcgcattgttgtaccagaggatccacctctggttcagtagtggggagcgagactgcgaagagaaaaaatgggaatagtattaggagcgagaagatggtgtacgggaacggtggaaacttggatagagatagtgatgggacgaacactgagatggaacgaagcaagcttgtgtttttcgataggaggaaccagtttgagttagaggatctgcttcgagctttgacggaaatgctcgaaaaaggaagcttgggaacggtttacagagtggtgcttgacgatggttgcactgtggctgtgaagagactcaaagacgctaacctttgcgagaggaacgagtttgaacaatacgtggatggttgcattgtggatgttgtaagaaaaatgcctcctttgcatggattaaaaaatgcaattcaaggtgttctaagacgttga

SEQ ID NO: 82542 - DNA, 330 bp, Glycine max
  Peptide Sequence Number=SeqID_199320
atgcatgtgaacaagggatcaacttcctacgtggagcatctcgccgttagcactgacaagattgccctaggtgtatgtcactattgttgctggcggcatcagtgcctactcagcaagtatcgccaagaagaatggcggcatgagtcctacgtggagcatctcgctcgtgctgctggcgggattgctttctcgttgctcctgttggcggcttcacaaggggaatcgcttttcctgctggcggcatccctggagtcgctcatgcaattggcggcatcaaataagaaacagacccccactgcaatttctttcaaaaggaaccctgatgcgtaa

SEQ ID NO: 82543 - DNA, 231 bp, Glycine max
  Peptide Sequence Number=SeqID_199321
atgcagagttcaaaatgcgatgtctatcttggggcctacctgaatggtgctttaaaaggtcttgatgatgctccacagactaaatcaaaggctcctgctaggtggattgtcgtcaagtttaatagacaaaaaggaagtattgagtgtgactattatgtcatgcactggatgtccaccatcattttagaaagtttcaggaataactgggaagtgtattttaacgatgcttga

SEQ ID NO: 82544 - DNA, 957 bp, Glycine max
  Peptide Sequence Number=SeqID_199322
ggatgcaatgctgcgggaaatagaacaaagtgtctggatttgtatagaaaagaagtggatgtagccaaactatgtagagcacaaattcagcaagaaattgctgattatgtggcggaaattgctggcgtctgtgcagcaatgggtgaacaaccattacattttgatccaaaggcttgtggaagcttgaagaaagcacgtgaaacagttgtttcacagcttgaggagatgcgcaagctgaaaaccgataggaagaaacacttttcagaggtcttatatcagttgaagaatatttctagtgagctttatggctccatggtggctaatgcttattcagatgagaccaacttgtctttgaaaagactagaggaattacagaagcagttacttcaattacaaaatgagaagacaaaagaagaagctcttagcaggaaagaaatccttgaaaaggttgagaagtggttggttgcatgtcaagaagaaagctggttggaggagtacaatagggatgataatcgttataatgctggaagaggtgcacatcttaccttaaaacgcgctgagaaggcccgtgctttgttaagcaaaattcctggaaaggataactctaaagctagtggtcattcagtgaagactgcaagcagttcagaaaacggcattgaaattcagtcatcattcactaggaagcccctctctcctgtttctcccgcagtcctatctaaagccaacatatcaaatttgggtcatgattctctgatgccatatatagctggcgatgaagaaaacatgacaccaaagaatatggcacttccagtgcctaccactcctttgactttggtccctatgttgactgccaatacaccagacagtgtgtattctggtgctactgctgcttcaaagactagtcaatcatttgaatattcatttgaggaggggctatccaaaacctatgctcaatga

SEQ ID NO: 82545 - DNA, 1392 bp, Glycine max
  Peptide Sequence Number=SeqID_199323
atgtcggcgtcggagattcttcgggaactggattcgctgaaggacgaaaagaccaaaattgagcacaaaatctctgcgcttgaagctcaactcagagagattaatctccaaaacgacgccgcacctcccaatgcttcttcttcttcatcgtaccccaccaacggattgacccaggacatgattcacagatacagtcgccaccttgtgctcccttcctttggtgttcaagggcaggcaaatctattgaagtcgtcaatcttagttgtgggagctggaggtttgggtgcacctgcattgttatactttgcagcttctggtgttggtaacatgacctctgtctatatgcttggtgttattgaccatgacgtggttgagctgaataatatgcataggcaggttatccacaccgaagcatatgttggtaagccaaaagtgaaatctgccgctgctgcttgtggctcgatcaactccactattcaagttgtggaacatgaagaagctttgcagacttccaacgctttggaaattctcagcaaatatgatataatagtagatgcaacagataatgctcctacccgatacttgatcagtgattgctgtgtggttctaggaaagcctcttgtatcaggtgctgcactgggattggaagggcagcttactgtctacaattacaatggtggtccttgctatcgatgcctctttccaactccaccacctagaacagcatgccaaagttgtgctgagggtggagttctaggagtagttcctggtataattggctgtctccaagctcttgaggctattaagattgcagcttctgttggtgagccactctcaggaaggatgcttctcttggatgcattgtctggacggattcgtattgtcaaaattagaggaaggtctatgcagtgtgaagcttgtggagaaaatgcaacatttacccaacagcaattccgagaatttgattatgagaagttcactcagactcccttgcgtgtgcctcctttgaagttaaatctacttcccagagaatcaagaatcagcagcaaggagtacagtgaagtaattattaagaagggacctcatgtgctggttgatgttagaccagcacaccatttcaagattgcatctctaccaaagtctctgaacattccactctcaacattagaggctaggctgcctgaagtatcatcagctttgaagaaagaggaagaggaaagtggtgcagtttctgggtcaagtgcacaattgtatgtagtatgtagaaggggaaatgattctcaaagggctgttcagtatcttcacaaaatgggtttcacttctgccaaggatattgttggtggcttagaatcttgggcccacaatgtggaccatcagttccctacatattag

SEQ ID NO: 82546 - DNA, 237 bp, Glycine max
  Peptide Sequence Number=SeqID_199324
atggtcggtggtcaattctacactcttctccatgccacttcaagatcctcactggtaaagtctagcagtagtaggccattcttcaacaacaccattaaggttttcatttttctgcataaggcggttgttgaaagtggaaatctacacttgagaaatggattaaagttggaaaattatgggcaagcgagtagccatttgatggaagagagggcactttccatggctaaagagttgtag

SEQ ID NO: 82547 - DNA, 270 bp, Glycine max
  Peptide Sequence Number=SeqID_199325
atgtggtgtaggatgaagaacaaatttgggaaatgcttactgctttctatgaagaattgtttcacatcaaaccctcaagatcaagaaagtgtggctcggtttatggaaatgagagttacccccctaatgagtgatattctggttgttgactttacaaaagaagagatcaaagtagcacttgtccagatgcatccaacaaaaacaccgaggcgtaagaccacaggaaaacaggggttgatggctcttaaacttgacatgtccaaagcatag

SEQ ID NO: 82548 - DNA, 630 bp, Glycine max
  Peptide Sequence Number=SeqID_199326
atgggtaatgagaagtcaaataagcactgggaggaaaaaattccaccaaattttgatagaagtaaattgggaattgagaagtttatccgtgacaagtatgtggagaaaagatgggcttcaaaagaagaactgcaatcaacttcaaggacaggtgaaataatctataattttgatgagtcaccaaatggaggggctaggagtggtattctgaagaacaacaggagactttctcttgaagaaagtattcttgctaaccacgtggcacaaattctacctccaataacaagatctcgtgggggttttacttttatagacacgcaaaagaagaattcacctccattaaaaaggccatcctcatcagttgattttgacaagtccacaggaaagagcaatggcactggtgacattttcaacttgctttgcatctatgatgataaccagaacttctcaaccatgcctccttcaagttgggcaacatttgattgtattccttacagaatcatgaagttccaagccagtaaagatgagatgtgccagcgttttaagtttatagcttgttcaactaatccttggtgtagaagtcacaagattatagttacagatgacgctgtgaagtggcatgagcattga

SEQ ID NO: 82549 - DNA, 2406 bp, Glycine max
  Peptide Sequence Number=SeqID_199327
atggcgaacacaataccggcatgttatgaggtatctgtgcttaatcctagtcgaatctggcaaactgataacgtcctaaaatcggagctccctattctcgcctttcaaattgtcttcactgttgcattgtctcgtcttttcttctttatctataaacctctccatcaacctcgtcttatttcacaaatctctgttggtttcctactaactccaccgttacttgggagatatacagcaatttttgagttcatatttcctgtaaatggggttcttaatgtcgaagtcctttcacacattggcctgatctactatgcattcctcagtggtttggaagtgaacttagataccattctacaagtaaaaaagaagcctgcaagcatcgcggctgccgggatcatctttcccatggtgatggcaccaggcttgtatgctctacatcgaaaattttacgacaataaggcggcaaatcagcttgaagaaagtacaagttttcctgtcgtagctcacacactttctgagctcaaactcctttataccggtcttggcaaagccgccttaacagcagccatgatcagtgaaacctatggttggattcttttcactttactggttccattttcaattaatggtaaaatagctgtctactcggtgttaagcactatattattcattgttgtctgcatctttgtgttacgtcccatctttctccgacttattgatcgcaagacagacaaggaggagttggatgataagcagtcactctttgtgcttatgggggttttagcttgttcatacattacagatattctaggcacacatggcattgttggggcttttgtatacggattaattttgcctcatgggagatttgctgagtttatcatgtcaatttctgatgattttgcttgtgggtttctagcaccgctcttctttagtggcaatggaatgagacttatgttgaccagcattttttaccaggcccattggcccttaacactgctgattgtactcttgttgtgtgttccaaaaattttaagcactttatttgccactttcttctttggtatgcgcactcgagatggtttagctttaggcttgcttctgaatacgaagggcgccatggcactaataatgctaaacattgcttgggatcgagcgattgtttctataccaacctatgccgttattacttctgctgttcttttaatgactgtagtagtgtctcctatcatcaacgccatctacaaaccaagaaagagatttgagcagaacaaactaaagactatacaaaaactaagacttgatgcagagcttcgaattcaagcatgtgtccacaatactcgccaagccacaggcatgatcagcataatcgaatcttttaatgccaccagactttcccctatacacgtttttgccctgtaccttactgaacttactggacgtgctgttgcccttcttgctgcacatatggagaagcctagtagccaacccggagtacaaaatctcaccaaatcagaggcagagttacaaagcattgccaatgcctttgatgcatttggagaggcacatgacgctgtcagacttgagaccttaaatgtggtgtcagcctatgcaaccattcatgaggacatacacaactctgcaaatgagaaacgcacaagcttaatcctccttcccttccacaaacaattaagttcagaaggtgcgcttgaagtaaccagtgttgtatacaaagatataaaccaaaatgtaatgcaacatgcaccttgctctgtgggaatctttgttgatcgtgattttgggtcaattcccaaaatgaaccttcgtattcttatgccctttgttgggggacctgatgaccgtgaagctttggctattgcgtggaggatggcaggacatccaggaattcacctatcagtggttcgaattattttgtttgatgaagcaacagaagtagatacttcaattgaagctgaagcacaaggaatattatctactgtagtggatagtgagaagcagaaagagttagatgacgagtatataagttcatttagacttacggcagtgaacaatgatgattctataaccttctcagagattgatgcccatgctgatgaagatatccccgcaatccttaatgagctagaaaaaaatggttgtgatttatacatagttggacaagggaattgtaggaattctcgggtcttctcaaatttgttaaaatggtgtgattgtccagaactaggagttataggggatattttggcatcaaatgattttggttcgcgctcatctttgctagttgttcaacagtatgggtatggaggaatggtctttggaaagaatctcaaccaagtaaccaccaataatgttggctttgagtcgcttgtcgtgaagacagaataa

SEQ ID NO: 82550 - DNA, 324 bp, Glycine max
  Peptide Sequence Number=SeqID_199328
atggcaaacgcaaatgacgcaattaagccaggagccaggggaaaaaagaaagaagaaattccttcgactcaagtcataaaaaaagttgaggaaaatggatcgaattgtcgaaacttgattagaatagaggaacacaaatacatcaaagaggcaatggaaatgagtgtcacttctcctattcatgcatggctcgaatacaaaagacagagcaacttaaaagcgtcaagcaataattatcataaaagcataactttgaatttgataaaatctgttaaaacagaaccagcatatggattgatgaaaccttggcgtgcttggcattga

SEQ ID NO: 82551 - DNA, 282 bp, Glycine max
  Peptide Sequence Number=SeqID_199329
atggcatatgtcaactggttaagaaaggataacaggttttccaacatcttggttcagatatctccatcagaaaaaggacatacctttccaatattgaagttgcgttataagtcttcattagtacagtttgaaggtggtatgtcacatctttcatttcttgatccttcaatgagggcaatggcttatcaccttcagaatggagagatagattggaagcaatcaataaaactgatcttactggaaaagataacccaaacagaaattacattctattggatgtga

SEQ ID NO: 82552 - DNA, 171 bp, Glycine max
  Peptide Sequence Number=SeqID_199330
gttacccaaggtggagattgggtattttgtcactcaggtgtggcaggttatgagtgggatattggacattttcatggggctcaacgacctagtgtggactgctttaggaacacttcatttggtctgtctcaggaagaggttgggccattatctgatgtgtcagggacctaa

SEQ ID NO: 82553 - DNA, 216 bp, Glycine max
  Peptide Sequence Number=SeqID_199331
atgccatgcgaccggcagcagggatttcaaaatttgtataccctgaagggaggcgtttctcactatctaaagaatgaagtccctgcagaatgggtaggaaatttatttgtatttgactcccgtctatctctccctccttctatttactataccggggccacaactcaagcagagtcaaatccagtttctggagatgataattttgcaaaatgctac

SEQ ID NO: 82554 - DNA, 135 bp, Glycine max
  Peptide Sequence Number=SeqID_199332
atgaaggatctttgcaactttcttgcgggagtactgggaatgaaaagaactcaggaagctggggaatgcaaggcacacttagttatctggcaaactgctagcttgttcttccgcaagctcagaggccattcctga

SEQ ID NO: 82555 - DNA, 2139 bp, Glycine max
  Peptide Sequence Number=SeqID_199333
atggagtacggtagcggaggcggtgggtcacagtccccaggggagcaagatggctcagattcccaagagaggaggaagcgctatcatcgtcatactgccaatcagattcagaggcttgagtcaatgttcaaagagtgcccccatccggatgagaaacaaaggttgcaattaagcagggagttaggcctggccccgaggcagatcaagttctggttccaaaataggaggacccaaatgaaggcccaacacgaaagagctgacaattgtgctcttcgagctgacaatgacaagatacgttgcgagaacatagccatcagggaggccttgaagaatgttatctgcccttcttgtggtgccccacctctcaatgacgattgttattttgatgaccaaaagttgcgattagagaacgcccacctcaaagaagagcttgatagagtatctagcattgctgccaagtacattggaagaccaatttcccaactcccgccggtccagcctattcatatatcgtctctggacttatcaatggcgagttatggaaaccaagggatggttggtcctgctccttcttcccttaatcttgatcttcttcctgctgcagggacttcctcatcatccatgccttatcatcccccttgcctttcggacatggacaagtccctcatgtcagacattgcttccaatgccatggaagaatttctaaggctcgtgcagacaaacgaacccttgtggcttaaatcaaacgtcgatgctagagatgttcttagttgtgatgcctacgaaagaatgttccacaagcccaatactcgccccaagaatcctaacgttcgcattgaagcatcccgagattctggagttgtattaatgaatactttagctttggttgatatgtttatggacccaaacaagtggatacaactttttcccactattgtctctgtggcaaggactattcaagtcatatcttctgggatgatgggcagttgcagtggttctttacaattgggaacatgggcagtaatggacgtttcttatgattttccccaagatagccactatgctcctcaatttcggtctcatcgttgtccttctggttgcttgatccaggacatgcctgatgggcattccaagattacttgggttgaacacgtagagattgaagataagactcttcctcaccggctttatagaaatcttatttatagtgggatggcatttggagctgaaagatggcttactaccctccagaggatgtgtgaaagacttacttatctgatggctacaagcaatcctacccgggataatctaggaggagtaatttcatctcctgagggcaagaggagcatgatgaaacttgctcaaaggatggtcaccaatttttgtgccaacattagcacatcaagtggccatcgatggaccacgctctctggattgaatgaaatcgtagtaagagtcactgtccacaaaagctcagatcctggacaacctaatggtgtggtgctaagtgcagccactactatttggctccccacccctcctcacgctgtctttaatttcttcaaggatgaaaacaaaagacctcagtgggatgttctttccaacggtaatgccgttcaagaggttgccaacatagcaaatggtttgcaccctggtaacagtatatcagttcttcgagctttcaacaacagtactcagaacatgttaatactacaagaaagctgcatagattcctatggttcatttgtggtttattgcccagttgatctgccatccatcaacttagcaatgagtggtgaagacccttcatacattcccctactaccaaatggatttaccattttgcctgatggtcagcctgaccaggaaggagatgatggagcatcaaccagctctaacaacgcaaacaggaatatagtaaggtctggtggttcactagttacaattgcattccaaattcttgtgagcagcttgccatctgctaaactcaatatggagtcggtgacaactgttaacaatcttattggctccactgagtcaagaacgaaccatatatggcctttatcttctccacatttccagattaaccaacagtcgaagaaaaatgtgtatggttcgggtattgacttctgttcatga

SEQ ID NO: 82556 - DNA, 3111 bp, Glycine max
  Peptide Sequence Number=SeqID_199334
atggccaagagatcagattttgcccagaagctactggatgatctgcgcctaaggaaagaacgaatggcttcatctcagactctgagctcaaaccaatcccaccatttgcctatagatgcatatgcttacaccaaacaaacatacagaggatccagaaatacaaaggctactgaaattgtcagtaccagaactggggagatgctgaatagttctagtagaagctacagatcagtaaacaacgggcaaatttccaatcagatggttccatatgggaaagctcagagctcaaggcaaacgggtgatctgtcccttgccctggcttttgcatttgagaatggagggaaactaagaaggaatgattcaattatgggtttccttcaccaaattaaaaggggaacattggaattcagcatgtcagaaagacaatttgcttcaactagcaactaccctatgcagataaacgagatatccaaaggtgcacaaaaactaaatcagatattgagagccggctccaatggtcttaacatggactcatattcaatacaatttgcaaaggaactattacaaggagctattgatttggaagagtccctcaggatgctagtagaccagcaaaataattcacagtttatgattacatcacagaagaaaaatagaataacactattagaggaggataatgatgataacaatgacacagggatggaaatgcaactggcacaaccaactctctcttttgacaagcatactactgagaacatccaacaatttgggaagactattttcatgcagaggccaattactcttaccagctctaaggaaggcagaaactcaaataatgaaaacaaaaatgtgaagaaacaagtttctcagaagcgatcaactaaaactagctctgacattaagaatgtcaatgctatttcagaagggaaaaaccagatggcctccaacccagagaagggcaggattccaaatgtgatagccaaactaatggggctggacatccttcctgacaaagtggaaaaggaatcaaaacaggcaatgctagtgaaaagagaaggaacatctcccaagcatactgctaaaggaagcattaagaagactgaactgaagagcaaagaaacggataatttgatgcctatgaaaaaccaaaaagtgatagaagccttcaaagtgccttcaactcagggtgaagagatgatatttggagcaaataaaaatttgcttgtcgagaagactagctctgaggtggctgttcggaatggaataaaaacactgaaaggatttgacaaacccagcataaaaatagacaagcctactaaaagttcccctcaaaagaaccttaccagagaaagtcaaaaggatgttcaggaaataggaagaaaacagaataacccaaataacaataacagggaacagaaaggcacagttaagggcagaaccaacgatccaattcccaacaatatgctgtcccagctggaacaagtgcgtgaaagatcacaagttaagtccttaactcaggaagacaaggaaatcaatggaaatattgttcagcccgaaaaaagacacacaaacacactcgccatgaacaacgaaaagaagccttggaacaatgttggagttcaaaagtcatatgtactctccaaaaatgggcctcatgaagaaaagcatcgcagagaacagcaactccagctgagggaagaacatatgttgatgatgagaccacaaggaaggagtgaaatgacttccatgaattcaccaaaatcccctcatcaattgatcaatcctcagaagaagcagctatccacgaaccaggtcacactgtttaagaaaaactctggagaaaaaaatgtcgcttctatgaaatcggagggcttcttaactaatcactatgatccagtcagagatgaagcatccaatgccacaaatgagaatgtaaaagaaattatccataggaagtcaggccaaatttcctctccaagagatcaagaatttgaacgagctaagcgaagtggcatcaaaactttgatggatgaaaaacacatcaataaactggccagcaagaaaataaagaatactagaaaacaaaaagttgacatgtctggaaagattgatcaaatgttgactggaagaaatggagccaagctcatcactgaacaaggaaaacaacagattcccactcctgacaaattccaagttttgaatgaagcggaacatgaaagggttagcatgctcagagaaacagatgtgcacatcattaactccaatgaaccagtatctgtggctgtgactgaaccattggatatgaggcaccaaccccataaagaagctgaactgcctcctacattatccagttctgttggtggagaacttcaaagccaacaagaattggtagcagtagttcccaatgatttgcattgccaagatgtgcaatcgttgcaagatcaagctgctcctatggcagcagatgaaggattcgtaactggtgaagtcgaattacataaaacaaatggacttgatgaaaagagattgtgtgttaacaactcaaacctgaatatttcggaaaaaagcatccgacagccactaacagaaagtgaaaactgcctcaagttgattctggtcatgagtcaactattcgtcaacactgcagaagcacttttcaaactcaacatcccatttaacgttcttcaaggtggtgatcgggaaaatcaagacgaaggtagcaaactcacattagactgtgggtatgaagtgatgaaaagaaaggggatactacaggaactcaaagttcattgttattcaaggatatcaatgggaagcatgaacataatatccttagatgacttaattaggcagctgaataaagacatggagaagcttaagttgtacggaaggaaaaaaagttgccaagctgatgatgttgaggactacctgtctaaaatgcttgaacatgatatttatgatagacatccagacatgaactgcatgtgggatttaggttggaatgatgagacagttgcatttatcgagaaatatgatgttataagggatacagaaaagcatatccttagtcttcttctggatgagatcaccgtagatttttgcatgtga

SEQ ID NO: 82557 - DNA, 567 bp, Glycine max
  Peptide Sequence Number=SeqID_199335
atggctgttgatttaatatttttagctaaaagggtatttgttgtgaaattgtgggggcacaattgctggtctgtcactaggatcgtcattgagtacattgaaagcaaaggtatatcttccattaagacaactcacataacccatgtttttgtacatgcattctctgtttgtgatgacccagattacttccacaacttcactcaaggcttgcttgatggactcaaagctggcgttagctcgagagatattgtccacattcagaacgccaagggtcttggctatgcaatgaatacatccgaggagcttaattttgttaaagaagttgctacggcaactggtgttgttcatgacccagtataccgtggtaaggctgcttatgcaatggtgaaagatatgtctgaaaatccaaagaagtgggaagggagaaagatcctcttcatacatacgggtggcctcctaggattgtatgacaaggtcgatcaattggcttcttttgttgggaattggcaacgaatggatgtcaatgaatctgttcctaagcatgatggtattggaaagatgttctag

SEQ ID NO: 82558 - DNA, 336 bp, Glycine max
  Peptide Sequence Number=SeqID_199336
atgtccttgattgtggttgcacacacaatcatggttcagatgggagttgtcaatgggaacgtctttaaaggcgaagacgaccttggatgggtcatcgggagaagattaaagggagaagtagtttttgttgttcttgaagtgatattgacggggaagaaaaaaaaaggagtgataaatggaaacaaatatggggttaaaagcgatggtaaggtcgataaagtggaagaggagggagggacaagagaggttgggagaggtgggagtagaggaaggagatcaagaataggaagagcacaatgcatgggtagaacaaagcacttaactcatagaatgtga

SEQ ID NO: 82559 - DNA, 1137 bp, Glycine max
  Peptide Sequence Number=SeqID_199337
atgtgggtatgggttgaaaacgggaaagatttaaggtggtgttatgttaatttaaacagagagagaaccgagcgagaaggaggcgaaggaggcagagcagcagtgcacaacaacggaactcttttcagagaagaatcagaatggtctgggctttgtcatctcaactctttctcgtttaggctgaggctgggcttcactatgtctatggcggacacaaatacaaactcagttgacgtgattttggactttcttaggaggaaccgattcaccagagctgaggctgctttgctcagtgagatcagtaatcgtccggacttgaatgccttccttcagaagcctcaaggtcaaggtcaagaactcattgtcaaggaaattgagtgtggaaccaaatggaaaacaacttcggaggatttatactcctggaagttcaaccccaccaatggtcctgtcaaggccactgtatccaaatgtcaaactgttgatgtaattgcagccaataccaattcaaagtctgggtcaggggaggaaaatgctgacaaaaaatccacgtggcctgcaagtagtagtaaagcctctgttgtgcaaagcaaagaacctagggaacttgatcgccaacttaaattcaatagttcatctcttgaagtgaacttcacagataatccctgcccaagaaaggatgagaatgtgaattcgtcttcagactccagcaaagattgttctgtcaagactgtcttccccttctcaaaaggggacgtgtctacaagctttgatggtgccacttattcttacaaaatagaggagaaaaaaaaggtagaaattagtgatactaggacatctattgaagagcaggtgggtgaattggggaggcctatttacttggtcaagacaccaggcagttctgaacagaagatgataggaagcttaagttttcctctcccccctgaaaatctgaaggaagagattcctaggcttcctccggttaaactcaagtcagatgacaagcccttggttgttaattgggaggagaagtttgagcgagatggaccaacctcaaaactccctggtgctgatagcactttgcttgttggttcatatctggatgtacctattggacaggaaattaacccttcaggttag

SEQ ID NO: 82560 - DNA, 870 bp, Glycine max
  Peptide Sequence Number=SeqID_199338
atgactgcaactggagtggccgtgtcgttggggttggggacattctctaactgttactgttacccagtgcctgtaaaggaattgcttttttctacaacgcgcattcgcaatcggagtaggaagaagcgttttggttttggtcaaaaaaggttttgcgttggagctgcaaatgcaaatcatgagtttgatccagagctgcgatctgtgcttgaacttgccaccgattctgagttgtacgagattgaaacaatccttttcgggccaagctacttgagtcctttgctcaaatccatcccattggcattcacaaacacaaacacaaatgatgacctcgaccgttccatgattggagtcgaccttggactacgccaacaatttatagcagctctcgagtcccgattcttcttccttgctgctgatgcccgctctaccttaaggggttggaggccttcttatagaaatgtcttgcttcaaataaggaaaaaattaaatattccttgctcaacccaattgtctactcacgaccttgaacttgaaattttcctccaccttttgcactgcaactcaactgaagaagaatcctctcaaggtcaggccactctacaacatggacttagtcaatggaaagtgcagtcaaaagttggggcccaagacattccatcaattcttttaaagggaggtggtgtatttacactgtccaagatataccaattgttagcaaggaaattatctgggaaagttcttgtagaagctgccaattaccaggttaagaaagagttagtgaagaaggtatacattggtactggtgagagttctggtagccttagtatttcccaagaacaacttcagcattcattttgtgctgtatga

SEQ ID NO: 82561 - DNA, 2660 bp, Glycine max
  Peptide Sequence Number=SeqID_199339
atgaggaaggctacagggggctgttggttatctgtaagtcaagggatagcggaggatacatctgatcttgtatcaggatttgctacagttggtgatgagttgagtgaatctattgattatccgaatgaatattgggactccgatgaatatgatgatgatgaggatgttgggtacatgagacaacctattgaggatgaggcctggtttttggcgcatgaaattgattaccctagtgacaatgaaaaggggactggacatggaagtgttccagatcctcaggaaagaggtccagccaaagatgaggatgacgatcaatcctttgctgaggaggattcttacttttccggggagcgatatcttcaggaaaataatgttgaacctgtcacagctactgatgatcctattggtctaacacacactgagtatggaaggactaatgataatgatttaatggctcaatatgatggacaattgatggatgaagaagaattgaacctaatgtgtgcagaaccggtctggcggggctttgtccctcagacaaatgaactcatcatgctaggagatgggagggttttgaatgataatgtaagatcacggctagaggacatcagtatggatgatgatcaacatggttcagttaggtcaattggggtagggatcaacagtgatgctgcagatattggtagtgaagtgcgtgaaagtttggttggtggtagtagtgaaggagatttagaatatttccgtgatcgtgatgcaggacttggtggttctaggcactctcatcatgattttgataagaaatctactaacaaatcaaacaaaaataagaactacgaaaagagtgaatcaaataaatatgtcataggatgtgataaagatgcaccgttgcagatgaaaactcatggtgatggaaacttctcatttcccctatctttgaaggatggccagatgattcaggcttccaccaataagtccctgtggtcaaataacggcaacacagatgaagctgatgactgtcttcatgcatttgtgggaactgatgacatgcttgctttgtggaggcgaaagagcagtgattcttcacctgttaaaagttatgagaataatgccgacattgtaagatccacaaactcttctccaacaacagtctcaaattatgggtattctgaaagagagcatgtgaaagtagaagaagatgaaaagactggaattgcaagggaagatgatcttggagcatcgctagaggatgaagaggtagctgctgtgcaagagcaagatcttaatgagattgtggtgattttttgctatgctgtaaaaactggctttgaggaggacaagaatttccatgttgttttaaattctgtaatagctgggaggtatcatgttactgagtatttgggatctgctgcatttagcaaagctatacaagctcatgacctacatacaggcatggatgtttgtgttaaaattataaagaacaacaaggacttttttgaccaaagtcttgacgagatcaagcttctcaagtatgtcaataagcatgatcctgcagacaagtatcacattcttcgattatacgattatttctattatcgagagcatttgttaatagtatgtgagctacttaaagcaaacttgtatgagtttcataaatttaatagagaatcaggtggtgaagtgtactttacaatgccaagattgcagtcaattaccattcagtgtttggaagctcttcagtttttgcatagccttggactaatacactgcgacttgaaaccagagaatattttggttaaaagctatagtaggtgtgaggtgaaggtcattgatcttggaagtagttgttttgaaacagatcacctttgctcttatgttcagtcaaggtcctatcgtgctcctgaggttattttgggacttccatacgacaagaagattgatatctggtctcttggctgcatcttggcagaactttgtactggcaatgtcctcttccaaaatgattcacctgcaacattacttgctcgggtgattgggatcattggtccaattgatcaaaatatgcttgcaaaaggacgggacacatataagtacttcaccaaaaatcacatgctttatgaaaggaatcagcaagctggagacgctccaccaccacctctgccatttcgcacagttgaaggagttggagatcgaagaggtgtgcaaggctcactgccaggacttcatcctcgccgtcaacaacctccgatccctcctctccaagccatcaactcggtccacacggacaaaccaccacttagtggacgacaacttctgatcaagcgtgagtatggacaaaacggtgtcggccatgctgaagcagatgccggagaagattatagagattcaatcctacatgagagggaagcgaacaaggtccctctgtacctcttttacttcaaaacaccaaagcttgaatcatttcccaagtggcggtataacccaagtcacacgttgcagcattcacaagaaaccaaccggttagaatacttgattccgaaaaagacatccctgaggcatagattgccaatgggagaccaaggcttcattgactttgttgctcacttgcttgaagtcaaccctaagaagcggccctctgcatctgaggccctgaagcatccatg

SEQ ID NO: 82562 - DNA, 348 bp, Glycine max
  Peptide Sequence Number=SeqID_199340
atgagggcacctggctcgtgttacatggatcatcatgacacgacaacaaatgaatggagtttctgtgctttcttgaatctccaagcattttcacacacaacagaaattaaaagtccttcaggcaagggagagaccaatgttggtcatggtggaggtcttgcccatgcctcccttgccagaggtgatgatggcaacccaaggggtggagccagagagctcgagcttgcagttccgctggaggagggaccgaaggagaggggaatgaggcaggaggaagaatgtgaagttgggggcggtggtggcgccgggaagaagtttaagaaaggtccaacgaaattggtgctataa

SEQ ID NO: 82563 - DNA, 189 bp, Glycine max
  Peptide Sequence Number=SeqID_199341
atggcagatggcggaagactgaaattctgccatataaacatgccattgctttggggaacgtttttggctgatcttgtcattcaaatgcttggaacagattatgctagaatcttgcgaacaatttatgctttggctcagattcgagtcatccgcacatatcggctgtcttcggaagtcactgatgaatag

SEQ ID NO: 82564 - DNA, 585 bp, Glycine max
  Peptide Sequence Number=SeqID_199342
atggcttactgtttccataactcacatttggttaagatgaaagcggaagaactgccagaagagctttttacaatgaaacagaaatcactgcaatcatggtcatgtcttggtgccaacttaagggtcaagatggataaatatcagtatacaatgtcaggcagcaagcatcggtgtctcgagcaaaagtggaagtgcaaggaaattttgcattttgtacagtccagtcagcctaccgctgtattagatttgagacatcgcatagaagctaatggaacaaacagcacctcgaatgctgcgatatttgtaggtgtggattactccccatgtgtgctttggaacatgatatggaacaggacaacaacactaatcatggggatcatggaacaagagcaacaatggaaatccaaaaaatgggcaatgtctttttaccaaccggatcatgcacaaccttgtcccaatatttgggttcataattcatatgagacattgcaaatctgccaactgaggccatttaaaccaataaaccaagccaaagtctatggacaaacaaattgccatttccacatgatctctgtttcgttatga

SEQ ID NO: 82565 - DNA, 204 bp, Glycine max
  Peptide Sequence Number=SeqID_199343
atgacgggagacacatcaaaattcacacatatctctcctaagaaaagcggacatgtaacttatggtgacaacaacaaaggtagaattcttggagttggaaaaataggtacaaattcttcaacctccattgaaaatgttcaacttgttgaaggtcttaaacatagtctgcttagtgtgattcaattatgtgacaaaggctatctg

SEQ ID NO: 82566 - DNA, 567 bp, Glycine max
  Peptide Sequence Number=SeqID_199344
atggttgaaataaacgggctacgcttggctggaaatgacagaaacaaatacttgggtgtagaattatgccttcggtggtacttgatggaaatttgtaatattggccgttttgagatactttcattgtctggatcattcatgcctactgacaaccaaggatcaagaagcaggtcgggtgggatgagcgtttcattgtcaagtccagatggtcgtgttgtaggtggtggagttgctggtctccttgtagctgccggtcctgtgcaggtggtggtgggaagctttttgccaaacaaccagcaagatcagaaaccaaagaagccaaagtctgactatgcaccagctaatgtcactccttccattacggtgtcttctgcaccaccccctactaatggtgaaaaggaggatgtcattggtggacacctactacacaacaactcaggcacaacccttaactcaaaccttactcctccctcggcctttcgacgcgaaaactgggttaacatgcactccttgacagactcgatgaagtcggctactgacattaacatatctcttcctgatagttga

SEQ ID NO: 82567 - DNA, 438 bp, Glycine max
  Peptide Sequence Number=SeqID_199345
atgaccgttccccttgattctgcttatggcaccacgaaaattaaagtagtgggccaaaactcagtcctgtctactcaagttctaagtggtcctcgtgaggtgcaggtgagtttgactcgctctaactcgtcgctgactcggtcattaaggccgttgagtgaagatgaaacgaggctgcacacgccggttgtgatttcgtgtaacgaagatagaagagaggttttagctgttcagaatatcgccaacaaacagatcgatagaaccttcgcatttgacaaggttttatccagcttcagatacctgaaaagagaagagcgagatggcgtcggtggtgaagaacgaactcaaatccgtcagagaaaagggtttcggcgctttcctcagagagctcaaggatggaggctacctgtttgtcccttttctttccttcgctcttaa

SEQ ID NO: 82568 - DNA, 523 bp, Glycine max
  Peptide Sequence Number=SeqID_199346
tgttagaggaactatcgataggtacaagaaagcatgtgctgcctccacaaatgcagaatctgtctctgaagctaatacacaggacgaagtgaatgcgatagaggtacaacaaacagagttggaggagaataggatgttgcaggattatcctgataaactaatatggattcactctgattcttggaacctctccctcaagaaactcaggtttgacaacgccatggttactcttcaatcagccaagtgcttgattttggcctcggttcaactcattggtaatcttagcaaaggtactatgaggtctttcatagctgatttaagcattctaaaggcttttaatgttacggtgcaccctcttaaagctttttccatccttctagttgattggattcccccgccttgttcttgggttaaatgtaacaccatgatgctgctaaaggccaccctgatcccacggcctgtggtggggttggaatcgtctttggctggaaaacgactcgttgctggtcatccaagcatttag

SEQ ID NO: 82569 - DNA, 624 bp, Glycine max
  Peptide Sequence Number=SeqID_199347
atgcttgatgatggctttctacaacctgttctaaatttgatttctaattcagggactgacatcattctttggcatggaaaaactgggaagagtgttgggcatgttgatacaaatcaattgaaaaataacatggctactatatcacccaatggtcgttttattgcagcagcagcatttactgcagacgtgaagatctgggagattgtatatgctaaggatggatctgtgaaggaagttttaaatgttatgcagcttaaggggcataagagtgctgtgacttggttatgctttatgccaaactctgagcaaataatcactgcatccaaggatggttcaatgagactatggaatatcaatgttcgttatcatcttgatgaggatccgaagacgctgaaggtgttcctaattcctcttcatgattcttccggtactacactgcactatgaccgcctgagtgtttcccctgatggaaaaattttggctgcgacccatggctccacactgcagtggttatgtgttgagactggaaaggttctggatacagctgaaaaagcccatgatagtgacatttcatgcatttcatgggctcctaaacccattccaatgggtaagctgctactctga

SEQ ID NO: 82570 - DNA, 192 bp, Glycine max
  Peptide Sequence Number=SeqID_199348
ttttatcagcaggaagcgtccaaatttaaaagacaaatcagagacattcagaatctaaacaggcacatccttggtgaagctcttagctctcttagtctaaaggaattaaagaacctggagagtagactggagaaaggtttaagcagagttagatccagaaaggtattatactaccagcatgaagcatcttaa

SEQ ID NO: 82571 - DNA, 705 bp, Glycine max
  Peptide Sequence Number=SeqID_199349
atggatccagcgttacccattgtagcgttatcgcttctcttgggtgccatcatcgcatttctctttttcagcacctactaccggaagcggcaatccgaaatccaatctatcgccgatcccaatcccaaacccttatcctccaaagcccctcccaagaagcctctctccaaaccccattcctccgacaaggatcaaaacaagcgacatcatccgttggatttgaataccttgaagggtcatggtgatgcagtgacagggatatgcttctcccccgatggacgaaatttggcaacagcttgtgctgatggagttgtgagagtatttaagttggatgatgcttcaagtaaaagtttcaagtttctgaggattaatttgccagccggtggtcatccaacagcagttgcattttctgatgatgcatcctccattgttgtggcgtcttatactctgtccggctgttcattatacatgtatggagaagagaaacctaaaacctctgaagataaaccacaaacaaagcttcctctcccagaaattaagtgggagcatcacaaagttcatgataagaaatcaataattactatgtttggagcctccgcaacttatggcactgcggatggaagtacaattgttgcctcatgttcagaaggtatctttacgacatcattgcccattagaatctatgcagaaattgttctatcataa

SEQ ID NO: 82572 - DNA, 525 bp, Glycine max
  Peptide Sequence Number=SeqID_199350
atggtagaagaatttgaagagatcttaggatgccctctaagaggaaggaaaccatacctcttctcagatgggttggtggacctagcagcgatcgacgcttttctcgcctatcatgaccgcaaggaaagcccggttgttgctatactggccgatctatatgacaccttcgatcgaagatgtgagaagagcagtacaaggattgtttgctgtactccggccctctctgtatggttggcttcgcacctttttcgccaagaggtgaggcatccttgcccactagaaagccatcgttcgtgcatagagaaaagaggggcaaattgggaccaactcttagcaagcaaagaaggagcatctgtcaacgggttccctcgttggaaagaagggataactggggttcttatttcatgcggaggatttccgaatgttcccttgatggggacgaggggttgcatcagttacagtctcgttcttgctataagacaacttggttaccctatgagaggggcgccactggaggcactttag

SEQ ID NO: 82573 - DNA, 1104 bp, Glycine max
  Peptide Sequence Number=SeqID_199351
gtgggtgacggcgacactgatcattactgttggcagcggccggaggacatgacgacatcacggcgagcttataaggttgacgccaacaaccccggctcggatgtcgcgggcgagacggcggcagcattggcagcggcatccattttgtttaggagaacaaacccacattactctcaactacttttgcatcatgcacaacagttgtttgagtttggtgacaagtacaagggcaagtatgatgagagtgttggagtggctaaagggtattatgcttcggttagtggctacatggatgagttgctctgggcagcagcttatgactttggtgggaccacttgggccatgactgaattcagctgggacgttaagtacgctggtcttcaagccattgcttccatgttccttatggaagaaaagaagcacaagaaacacgaagtcatactcaaacagtatcgttcaaaagccgagcactatctatgcgcgtgtctcaacctcaacagcgttactaacgtggagcgcaccccaggagggttactatacgtccgccaatggaacaacatgcaatacgtagcaacggcgtcgtttcttctcacggtgtattctgatcatctcctagccactgatcagaagctgcattgccaaaaaggggaggtgggtccccatgagatgttggcctttgcaaaatcacaggttgattatattttgggctcgaatccaatggctatgagttacttgggttatgataattggtatggacgcgttgaacccaatccaaatgtactcattggggcactcgttggtgggcctgacatcaaagaccaatttaaagatgagagacgaaattacgttcaaacagaggcttgtacctacaatactgcagcactagtagggggacgtgggaaatcagttgtttgtgaagcaattatcaaagaagaagtggtgcagaaggtattgaaaaccaacgtgtctgccctggtggagcttaacatgctcaaaaaccttgctggttctgctagtaacattgtttctgccatctttataaccatcaatgatgggaggcaccttcacatctcagtgaccatgccttacattgaggtgatttag

SEQ ID NO: 82574 - DNA, 480 bp, Glycine max
  Peptide Sequence Number=SeqID_199352
atgaagaaaggcaacgttcaaaagaacaacatacggtgttcgacactatgcattgcttcactctctctcatcacaatcttcattattcccttttgtgagtccttcaactatggccaagccctgtcccagagcctcctctatttcgagtcacagcgttcaggtcgcttaccctacaatcaaagggtcacttggcgtcaccattctgccctcactgatggcctagaacaaggggtggacttggtgggagggtactatgatgcaggggacaatgtgaaatttgggttgccaatggctttcaccataacactcctctcatggggtgctatagaatacggcgaacaaatcgctgctgccggcgagtacgctcacgctctggaggccatcaagtggggaaccgattatttcatcaaggcacacactcaaccaaatgttctttggcttgaggtattaatttccattccagtgaatattcttttctaa

SEQ ID NO: 82575 - DNA, 156 bp, Glycine max
  Peptide Sequence Number=SeqID_199353
atgggagaagaaattgagataaaaataaagttcttgatatttagagcattaatttggccttggcggatccctcatgaccgtgtcgatatgcaccacaagacgctcatgcagctgctagagttggcgcttaccggagaggcagaacaacgatggtag

SEQ ID NO: 82576 - DNA, 336 bp, Glycine max
  Peptide Sequence Number=SeqID_199354
atggaatttagctccattagatttggagatataagctacttgcaggagaaacaacgtagaaacaaggagaaaagctttgcaagagaggaaacatttccagacttaagggaatctgaagttcgtgcgtctaaagcacatatcatggctgaagatcaacaacagagggtgacttttgaggactattctagctctaccgtgccgcaatcttttacaagtattgcgcggccggaagaccaagctcacaacatcacatatccccattccttgatccagctaattcaaggaaatttgtttcatggattgccaaatgatcgaggtcgtactcgaatcaaataa

SEQ ID NO: 82577 - DNA, 1206 bp, Glycine max
  Peptide Sequence Number=SeqID_199355
atgatcgacatgttagtgatccataactcattacctcccacttctgaggccgagaatggtactgctgctactgccactaataaaaggaagagaaggcctgcaggaacaccagatccagatgcagaagtagtgtccctctcacccaaaaccttgctggaatcagatcgttatgtgtgtgagatctgcaaccagggatttcagagggaccagaaccttcagatgcaccggcggcggcacaaggtgccatggaagctgttgaagagggaaactacagcggtggtgaagaagcgagtgtttgtatgcccggagcctagttgtttgcaccatgacccatgccatgctctgggtgatcttgtcggcataaagaagcatttcagaaggaaacacaacaatcacaagcaatgggtctgcgagagatgctccaaaggctatgcggtgcagtctgattacaaagcacatctcaaaacttgtggcacccgaggacactcttgcgattgtggccgcgttttctcaagggtggagagctttattgagcaccaagacgcgtgcaacgtagggaggctggggccagaaacacaatcacaggcacaggcagtgcaagcagctgcatgcttgtctcgaacagcttcaagcgaaaccaatttcagcactggttccccttggccacaaagcggtactataataattccaaatcccaccgttacggtagtagaaccctcctcatacaccattgtcactgccgaaaccaacaacaaagtccaccccaacctggagcttcagctctctaataccactcctactgcatcatcacaggaagaaagggttcatcaagagcagttgaggattgcgaaggcgaagaaagcgttggcggaagaggcaaggaagcaagccaagaggcaaatcgaactggccgaacttgagttcactaacgccaagaggataagacaagaagcgcttgcggaacttgacaaagcctatgccttcaaggaccatgcaatcaaacacatcaattcaatcatgcttcaaatcacttgccgagcttgcaagcaccattttcattcgccaaccgacgaccaaatcttctcctacataacacaagctcgccaacttgtgccatgttatttaaatgcagactataatatgatgagcaggttttgctggatatctttgttggtggaaagcggagaagtccttgacaagcattaa

SEQ ID NO: 82578 - DNA, 585 bp, Glycine max
  Peptide Sequence Number=SeqID_199356
atggcgttagattttgtggaaggtggtggctgtttgatgtataggactatgggtataccgcgtgagataaggaaggaagatgatgatgcagaagaaaatacaattacattacatacctatagttctttcggccaggtttcgtttttttgcaatatgcctcaaacttccacggttgatctcatgaattttgcaagatggtcgtatattgtcttgaaaaatctccttgaggtaaaagacttgagtctccaacgtaagcttttggtatcagaattcaacctgactattggcaacatggaaacagagctggcaacgaggatgaactgtgctgctcatgatggtcatcttgatcttgtgaaacgtttgattggatttggggcagatcccaataagactgattacgatggcagaacacccttgcatatctctagcatcaaaaataaatttggcagcactcccttgcttgaagccatcaagaatggacacggagaagtagcatctatacttgttgatgcaggagctaatatctttaccattgatgatttcagggtcggtccaaggattattccatcctttattctcatttga

SEQ ID NO: 82579 - DNA, 939 bp, Glycine max
  Peptide Sequence Number=SeqID_199357
atggccaccttgaatgttccccctcttcctccttcaccgagagacgatgccatacaactttacgctgctttcaaaggatttggatgcgatactagcgttgtgatcaatatacttgctcatcgagatgctacccagcgtgcctacatccaacaagaatacaaagcaatgtattctggggatcttctcaaacgcttatcttcagagctttctggcaagttggagactgcactactgctttggatgcacgaccctgccggacgtgatgcaatcatccttaggcagtctctaaccctgcccaaaaatcttgaagctgccactcaacttatatgttctcgaactccatcccagcttcattatttaagacagatttatcattctaaatttggtgtttatcttgagcatgacattgaaacaaacacctccggggatcataaaaagattttgcttgcatatgtaaccacaccacgtcatgaaggccctgaggtaaatagagagatggctgagaaggatgcaaaggttctctacaaagcaggggagaagagactgggaaccgatgagaagacttttgtgcaaatattcagcgaacggagtgcggctcatttggctgctataacttcttattaccatagcatgtatggacactcgttgaaaaaggcagtaaagaaggaaacatcaggaaattttgctcttgcacttctgacaatagttcaatgtgctgagaatcctgcaaagtattttgccaaggtatttttcccttggattgaattttgtgtaatttcttctcgtaataccattatacttggatggagatgtttgcattcaatgataactcctcatcttgtaagaaacaaggatgatggggtcaggactcaggagcctctcaagggtaaaaatcactgcagagagtgcagtgttgatgagaaggctgacatttattga

SEQ ID NO: 82580 - DNA, 450 bp, Glycine max
  Peptide Sequence Number=SeqID_199358
atgggtggtttgggaatatggatgggtttgattagcctgtgttttgtgtctgtatcagctagatcaggtctgctccaacgcctagagcaccctgttaaagctgatggctcacttagccttgtggtcattggagaccggggaaggaaaggaacatacaaccaatctcaagttgccactcaggtcttcatcctctatttagtgggaacttgtgttccagtattagtctaccaaatccagttcttaaccagtggtggaggttcaaaggcatggaaaggagacatggataaagataagacagatgggatcaagttttattatgatggacaaggatttatgtccgcggagctggaagaaaccaatgtcaaagttgtttattatgatattttggggaaagttttgcatgttgtgaatctgcccaaggggttaggtacttctgtctctgccatatag

SEQ ID NO: 82581 - DNA, 849 bp, Glycine max
  Peptide Sequence Number=SeqID_199359
atgtaccttccttaccacaccttcatggctgaatctactcactcgaaaacgaacctggactggattgaggaagcaattgccaaattggcttccaataagcttcacgtcactaccaagctcaatgagcttatcaagcgcatcatggttctcaaaaccaaccagcaacaatcttcttcgccttcgtcttcctccaccaaccctccccacgttaccccttcttctcacctccctcacatgaagctagaagtgccctgtttagatgggacagatccctccgggtggatattcaagattaatcagttctttgtgtaccatgtcacaccggaacccaaatgtctcacaatcgcctccttctatatggaggggccgactctcgcatggttccagtggatgatgagaaatggacaattgacttcatggtctggattgcttcaagctcttgaagtgcgttttgcccctttccagtacgaggatccaacatcacatcatcacacaacacatttcagtcattttcacaacattcacgtactcaaggatcaaaatacaatgtcatcaagtcaatcaatattgatcaatacacaagaattatgcaacatatacactaagactcaatcctatatgcaatgtggtatcctgtcaatgaaaaaccacgtcgggcgcctaggagtacatgataagacaaaccacacactagcaagtcaggccactctcactagaatgctccaaccatatgggatcaacataggcttaaaggagcactcaaaccgggtgacccccaaggcctacactccgaagagtccgtcagggtgtctccctcctgatttaggtctaacccagaaaacattttag

SEQ ID NO: 82582 - DNA, 1293 bp, Glycine max
  Peptide Sequence Number=SeqID_199360
atgacagttcgttggacacaagaggtcagaattgctaatcatactcgatattgcaaatgcaaaggaatagtgtattactacttaatcatgaatcccgagagcggagatggagaaaggtttccagttagagccatgtccatgtcctttctctttacctttaccatcatcatcagctttggcttgtgcattctttatgcatctgcagaactccagagattatcacactcttccaaacatgatggtgctcttagcttcttggtgcttggtgactggggaagaagaggcgcttacaaccaatcacaagtttctttccagatgggaaaggttggagagaagcttgatatcgactttgtagtttccactggagacaacttctatgacaatggactaactagtgaccatgacaacgcgtttcaagagtcattcactcaaatttacacagcaaaaagcttgcaaaagcagtggtacagcgtgttaggcaaccacgactataggggtgatgcagaggcccaattgagcccggtccttagagaaattgatagcagatggctttgcttaaggtcctttattgtagattcagagctggttgagattttctttgtagacaccactccttttgttgaagagtacttcactgaaccacaggaacacaagtatgattggcggggcattggcccacaaaaaccttatattactaacttactcaaggacctagaattggcactgagggaatcaacagcaaaatggaagattgttgttggtcatcatgccattagaagtgttgggcatcatggtgatactcaagaacttataaatcagcttctccctatccttcaggcaaataacattgacttctacatgaacgggcatgatcattgtcttgagcacattagtgacacggagagccccattcagttcctgactagcggggcagggtcaaaggcttggagaggagacattaaaggaatgaaccgaagagacgtaaatttcttctatgatggacaaggcttcatgtctgtgaaattgactcagacggatgccaccattgagttctatgataatgtgatgccacatttagaggataatggatttgtaaggatggccaaatcaatggaagcatacgtttctgatatccaatatattaacacctggaagacatcacaaggacaaaagggggatatggtccaaactgcaatacctgatgtgaatttgcgaagattaagaacagagaactcctcaggtgatggtacaaaaggaaattctcaacctttgaatctgttactgttggcgtga

SEQ ID NO: 82583 - DNA, 1353 bp, Glycine max
  Peptide Sequence Number=SeqID_199361
atggacgtcgcagtcactgccttccggtcaccgctgatcatcctccgaagaccggtcaacgagtctgcctcagctcggttcggttccacttttgggttttccagaaagcaacggttcagttcagtatgtatccccaaacacaagcacaagcaaggtcgtagaagagggtttgtagttagagcttctgcatcctcatctccggagtcggatgatgccaagattgctcctcttcagtttgaatcctcaattgggcagttcctttctcagattttgaaagatcatccgcatcttgtgcctgctgccgttgaccagcagctccagcaactccaaactgaccgcgatgctcatcaacaaaacgaacaaccttctgcttcaaccactgatttagttttgtacaggagaattgctgaggtgaaggctaatgaaaggaggaaagctctggaagagatcttgtatgcattggtagtgcagaagttcatggatgctaatatttctttgataccctctgtaaccccagatctttctggtaaggttgatttgtggccaaatgaagatggtaaacttgagctgcttcactcacacgaagcatatgagatgattcaaaaccacctggctctcattctcggtaacagagctggagatttaacatcaatagctgaaatcagcaaattcagggtagggcaggtctacgcagcatcagtgatgtatggttattttcttagacgagttgaccaaaggttccagttggagaagacaatgaaagttcttccaaatgcaacagaaaaagagaatagtgctcatcaaactacaatggacaatgcaagacccagtattgaagaggacacttctcaagtgatgtctcatcctgaagtatctacctggcctggtggtgatgtccgtcccggtggatttggctatggtgtaaaggcaaccaggttgcgtaactacgtgatgtcctttgatggtgatacactacaaagatatgcaacaattagatccaaagaggctgtcagcatcatcgagaagcacacagaagcattgtttggaagacctgaaattgttgtaacacctgagggggcagtctctaaggatgaaaacatcaaaattagctttggtggtttaaagaagcttgttttagaggctgtgacatttggttcttttctctgggatgttgagagctatgtggactcaagatcccaccaggtgggagggaacctcgtgcattcagttgtccttttgagttctgtttgctctcatacatcacaaggcatagtttatagtgtgttggtactgactgatggagtaaatttgaatgtaacttcggtgttaaaagtccaaatattgtttcactaa

SEQ ID NO: 82584 - DNA, 228 bp, Glycine max
  Peptide Sequence Number=SeqID_199362
atggaaactgacgacgatgatgacatgacaacgataacacagagaaagaggaggaagaagctacattgtggtgaaagcattacggaatgcacgagggaaatgagagggagagggagtaataggaccatagacacattgagtgccgagtttattaacttcagaattattcaggttatgctactggctggctcagtgactcttatgtccacgacaagcatatgcaagtaa

SEQ ID NO: 82585 - DNA, 177 bp, Glycine max
  Peptide Sequence Number=SeqID_199363
atgcttgagatgacagagacggaggacactaagaataagatgatggcctttatagaccctacatggctacattacattgcagtgtctaaattaaaacagcaatcacattgtgatcttcacgcagtagggagggaatgccgggctgacgtggacacactcacagagagcgacgtgtaa

SEQ ID NO: 82586 - DNA, 2325 bp, Glycine max
  Peptide Sequence Number=SeqID_199364
atggattctcatcttgatgcaatctttgatgaagatcacaagaagaaaacatggaagcaaacaactctgctatcctttcaaattgtgggaatagtttatggtcaactgagcactgcacctttatatgtatttgggacaatgcaaaagggagatcttgcatcagaagaagtcgtttatgaactattttccttcattttctggacactcacaataatatctttggtcaagtatgcctctatagtgttgaaagcagatgatgaaggagagggtggtattgttgctttatactcactgttgtgtagaaatgcaaaagttgggctgctcccatgcgacaaaagtgccaatgaagttgtgctttatgaagagagaagtggttcaaagctcaaagcagattcaagagcacgaagggccattgagaaacacaagatctgtcactatttaatattgttcttagccctctttggttcctgtatgaccattggggacgcagtgctcactccagcgctttcagtgtactcagcttcgaccggcgttcagagatccctgacagacatattgacagacatatttgcctggtcaccagatactcagcagaacgtgtcaaatggtctaagaagatatgtacctgttccctctgcgtgtgttatattggttgggctgttcatgctgcagcactgcggtacacgtaaaattgggatcatgtttgctccaatcatcactgcttggttgttgtttgttgctggggtgggaacgtataatgttttccactgggatgtaaaaattatttataaaatatccccagtctacatatacaaattcatcacacatattgacatccacagatggaggttgttagggagcgtcattttatgtgtagcaggatcggaggcaatgtttgcagatctaggccatttctccaagaaatcaattaagattacctttatatgcttgatctacccgcttcttcttctatgctatgctggtcaggctgcatatatctccaaaaatttacatgctccagattttaatcatcttagtcaatctatgccacctgtgggaagccaagcaaccataacagcgtgtttctccatcattaaccagtgtctggcattaaattgctttcccagagttaaagttattcacacatcaaaaacgattcatgggcagatttacatccccgatgtcaactggttattgatgatttttagcctcactgtcaccattggtttcagagacattgtgaaaattggcaatgcaacaggtttggctataatttgtggaatgcttgtgacaactagtctgatgtcactgatcattgctctgtattgggagaagaatttgatggtatctgcgtgctttcttgtatgttttgggttccttgaggctgcatatctttcagcatgtctgctagaattccacaaaggagcttggtatctggttgtcctattggcagtgtcaatgacagtgatgctttcatggcattatggaacaatgaagaagtacgagtttgatttgcaaaacaaggtatcaaccgaatggctaatagatattagtccaggccttgggatttccagggtacccggaatcggcttcatttacaccgacatagtagcaggaatcccagctttcttttcacattttataactaatcttcctgcatttcatcaagtgttgatcttggtgtctttcaagtctatagctgtgccttatgtaccagaaagtgaaaggtatctcattggtaggattgggccaaaggattacaaaatatatcgttgcattgtcagaagtggatattgtgaccacataagggacactggtcattttgaggagcagataattcgttctattggggaattcatatccattgaacagaatgacattgagtccatggtatccccagatgaaagaatgatcattattggaaattcaaattcaagactagatggaaatgctttagttcctcttgatgaagtagactcatcatcatgcatggtgaacaatgaatctcagataagtccagtagatcatgacgcattggagagtaggaacaagagaaaaaaggttcggttcatgttgcctgagaatagtcctaaaatgcaggtatctgtgaggaaggagcttttggagctaattgatgccagggagagtggcagtgcctatttcttggggcagtcacatttagtggtgcgtgatggcactaactttctcaagagattcttaatcatggtctatcgtttcagtgaaaaaaattgtcgggaatctcctgttgctcttaagatccctcatgctgctcttgtagaagttggtgtgatatgtactatataa

SEQ ID NO: 82587 - DNA, 2385 bp, Glycine max
  Peptide Sequence Number=SeqID_199365
atggcgaggccagaaaggacagcaggtagaaataaaagtttagagactctaatggactcggacaaaccaggaatcggaagaaatgtgaaccaacttaagattcagaagtccattccagggtatggccttgaattcagtaacctctcctatagtatcataaagaagcagaaaaaggatggagtttggatcaacaaagaatcatatcttcttcatgatatctctggccaggcaattaaaggtgaagttatggcaatcatgggacctagtggtgctggcaagtccacctttcttgatgcattggccggtcgaattgcaaaagggagtctagaaggatcagttagaattgatggaaaaccagttactacaagctacatgaaaatggtgtcatcatatgtgatgcaagatgaccagctcttccctatgctgacagtttttgagacatttatgtttgcagctgaagttaggcttcctccttccatttccaggagtgaaaagaagaagagggtctatgagctccttgaccaattgggcttacagagtgctacacatacctatattggtgacgaagggagaagaggagtgtcaggaggggaacgacgaagggtgtctattggcatagacatcattcataagccatcacttctgttccttgacgaacctacttcaggccttgattctacaagtgcttacagtgttgtagaaaaggttaaagacatagctcgaggaggaagcattgtccttatgaccatacaccagccttcatttagaattcaaatgctcctggaccagatcaccgtccttgcaaggggaagactgatatacatgggaaaggcagatgaagttcaggctcacatgtcaagatttggaaggcctgtacctgatggagaaaacagtattgagtatctcctagatgttatcagtgaatatgatcaagcaacggttgggcttgatccccttgtccaattccaacgtgatggcctcaaacctcacccggcagccatgacgccggttccaagaacaccttacaaaaggaacacacctgcatccaaacacatgattagcctacgcagccaaggatttactgccggaacacaacagcctgattctgcggacgacgaagacgacgacgatgctgaggattttgataactcccttgaaaggaaaagtgctccaacaccaaggaatatgactagtggtgttcaccaacgtttggcttctcagttctaccaagatttctcggccaaagatttctctgtctggctttaccatggggtagtaggaaccccacgtcgccaaccatcatggactccagcaagaactccaggatggacacctgggaaaacacccatgtcaggaccaacaagtgcagtttccaaccaatattctgcagctccttttgtggttggccagtctatggactactccgcaacttcatatgaaggatttgagattgaggaagtgcttgatgagccaaactttggatccaagtatgcaaacccatggttgcgtgaggttgcagtgctctcatggcgaacagcactcaatgtaattcgcaccccagaactcttcctctcccgtgagattgtgttagctgttatggcacttatcctgtccagcatttttggaaatctgagtcatccttttttcgaagacatcaataggctcctcaatttctacatctttgcagtgtgccttgttttcttttcttccaatgatgcagtcccatcttttatcatggagaggttcatcttcataagggagacttcacataatgcttaccgtgcttcttcatatgtcatttcttccctcattgtttacctcccattttttgccgttcaaggcttcacatttgctgtcataaccaaaaagatgctccacttgagaagcagcctattgtatttctggctaatactttatgcctcgcttattactaccaatgcatatgtgatgcttgttagtgcacttgtgcctagttacatcacagggtatgcagtagtcatagccacaacagcactcttctttttgacctgtggtttcttcctcaagcgaactcagatacccttttactggatgtggcttcactatatttctgcaatcaaatatccatttgaggcattgctcacaaatgaattcaataacctcaactgctacacaggaaatttagcagaattatcccatggaccattaggagacctgaagctcagcaaacaccataactccagtctgcccgctaactgtttattagggaaagatatcttgtcctcgatggatattacaatggataacatatggtatgacatcttaatcctgctagcttgggatgttctttacaggttcttcttctatttggttttgagattttactccaagaatgagaggaaatga

SEQ ID NO: 82588 - DNA, 2841 bp, Glycine max
  Peptide Sequence Number=SeqID_199366
atgggaatagaagtaaattatgtaaagtttatgaagggaatgagattaattagggcaaagggaaaggaaaaaaagaagttgagtgatgactttagtgtatctgagcaatctcctccttctccctcagaattcgcaatgctgcctcagaagcacactctggtggcgacactggctgtggtgctcgcagtagcacaagcagtagatctggcttccgagcgagccgcattgctcgctctccgttccgccgtgggaggccgaaccctcttctggaacgccaccagggagagcccctgcaattgggccggggtccaatgcgagcacgaccacgtcgtcgagcttcacctccccggtgtcgctctctccggcgaaatcccggtcggtatattcgggaatctgacccagctccgaacccttagtctccgtttcaacgcactccgaggttccctcccttcagatctggcctcctgcgtcaacctccgcaacctctacattcagcgcaacttgctcagcggccaaatcccaccctttctgtttgattttgcggacctggttcgcttgaacttgggcttcaacaacttctccgggccctttcccaccgccttcaacagcctcacccgcttgaaaactttgtttctcgaaaacaaccagctctccggcccaatccccgacctggacaaactcaccctcgaccagttcaacgtctccgacaacctcctcaacggctctgtccctcttaagcttcaggcattccctccggactcttttctaggtaactccctctgtggccgcccactctctctctgtcccggagatgttgccgatcctctctccgtcgacaacaacgccaaggacagcaacaccaacaacaagagcaagttgtccgggggcgccatagcgggaattgttgtcggatcggtggtgtttcttctcttgcttgtgttcctcttcattttcctgtgcaggaacaagagtgccaagaataccagcgccgtcgacattgccactgtcaaacatcctgagacggagtccaaagttcttgccgacaagggggtctccgatgtcgagaacggcgctggtcatgctaatggcaactctgcggtcgcagctgtggcggtggggaatggcggtagcaaggcggcggaagggaacgcgaagaagttggtgttttttgggaatgcggcgagggcgtttgatttggaagatttgcttagggcttcggcggaggttttggggaaagggactttcgggacggcgtacaaggcggtgttggaggcggggccggtggtggccgtgaagaggttgaaggacgtgaccatttcggagaaggaatttagggagaagattgaggcggtgggagcgatggatcacgagagtttggtgcctctcagggcttactatttcagcagggatgagaagctcctcgtctatgattacatgtccatgggaagcttgtctgcgcttttacatggaaacaaaggagctggtaggacaccactgaattgggaagtgagatcaggcattgcacttggagctgcccgtggcattgagtacctacattcacgagggcctaatgtttctcatggaaatatcaagtcatcaaacatcctcttaaccaaatcatatgatgccagagtgtctgactttggccttgcacaccttgttagcccctcctctacccctaaccgtgtggccggctaccgtgcaccggaggtgactgatcctcgcaaggtgtctcagaaggtagatgtgtacagttttggtgtgttgctcttggaacttctgactgggaaggcacctacccatgctctcctgaatgaggaaggagtggacctccccagatgggttcaatctgtggttagagaagagtggacttctgaggtctttgatcttgagctccttaggtatcagaatgtggaagaggagatggttcagttgttgcaacttgcagtagattgtgcagcacaataccctgacatgcgcccttcaatgtctgaagtgtgggcagataggaaccctaaattgcagtttgacctagagaggccgagcgagagagcgagggagcatggaggagggaaaattgagagagctgaagcaattcatagagatatgcaagtccaatccctcacttctccacaatccatctctttcattcttcaagacttatcttctcaggaaccaggtgattttgatgacaagtcagatcctcctttatccgcacaaaatgacattgtagaatctgatatagagttggataatgctgatgttgttgaacctgataatgaccctcctcaaaagatgggagatccttctgctgaaataacggaagaacaaagggatgctgcacaactagcaaaatcaaaagcagtcgatgctatttggccaattgacttttctttaatgatttttccaggtaatttggatgaagcactggcccaactgacagaagccattttgttgaatccgcaatcagctatactttatgctactagagctagcatctatatgaaattgaagaaaccaaatgctgctatacgtgatgctgacactgccttgaagattaacccagactcagctaaaggctacaaaatacgaggaatgtcaagggctatgttgggactatgggaagaagcagcaagtgaccttcacgtggcttcaaagttagattacgatgaagagattagtatggcacttaaaaaggttgaacctaatgcccttaaaatcgaggagcataggagaaaatatgaacgcttaagaaagcaaaagcaacagaaaagagctcctatcaagactgaagctcctattaagaaggagcaagaaactgaagcccaagtaagtatatag

SEQ ID NO: 82589 - DNA, 1125 bp, Glycine max
  Peptide Sequence Number=SeqID_199367
atgactgaaaatgtcaacatctcaccattgataaccattcatgatatatctgggtctcagtcatcatctgcttgccccacttctcctccacattttcaagaagaccttcttcatcgccggcaacacttggtggaggaaattttgcagctttcagcagattccttttcagtggcatcttctgatagtaacacaagctgtagtgaagttgattgcagtgaatttgagtcatcagtgcctaaagttgataatttcccgtgcaaatattatatgaatggaagtgttgatggtcatttatctcaaaatctgctcaaggaaaagttttacaacccaagacaaggaattcttcatgcaagagaaaatggaaattctttatctagtcctacctgtgacccaacttctaagcagcattcaattgactttgctgctggtgctgacaatgctgagagtgcattttgtgctagccaagacactggtttgttggagaaaagaaaaattagaaaaaaagccaagaagagaattatttcaatattagaagagaatttagatggtgatgcatctgatcatacacaagaacagataagtcaaggacagatttctccaaatttaaaacaagaattggacattgatgattctactgaattttctgggcgcaattactctacccaagagaatgatgatttgattgtgacatatttcaatacaagtattgctgattctgaagctagtgaggaatcatggctatcgagatcactctttgtgattggagggaatgtgcttatatgcattgaagatcttaagcagctgtactcattatcatcaaatgcgtctgcctctccatacttcagaattgattcatgttgctccattgctgacattgctgagatggttattgaggttggtggcagctgctgtgtgactttaggtctgacttgtccacgggcagaactccatccatctacccaaatgaaccttcaaaccgtcaatcatgaaaatactgctcccgggtctcttaaattgaagcttcagtggttctctaaagatcaccttgtgaagtttgtgtcattgttgaagacaatccatgaaaaagaaacggggtcacctttggtagtaagatgtatatcgtaa

SEQ ID NO: 82590 - DNA, 1188 bp, Glycine max
  Peptide Sequence Number=SeqID_199368
atggacgagtctctacagcttcttcctgcggttgaaacgcttgaccttagcaggaacaagtttgcaaaggtggataatctacataagtgtaccaaattgaagcatttggaccttggtttcaatcacttgagaacatttgcacccttcacccagatgttctggtttgaaacgttaaagggaccattcgtgaaattgttgagaagaaagcctacacaagtttcctgtcttattgttaaactagttttgaggaacaatgctctaactactttgcgtgggattgagaatttgaagtcacttgaaggacttgatgtttcctacaatattatttccaatttttcagagctagaatttgttgcggggcttccatatcttcaaagcttgtggttggaaggaaatcctttgtgttgtgctcgatggtatagagcacaagtattcagcttcttctcctacccagaaaggttgaagttagatgagaaagaaattaacactagtgatttttggaagagacaaataattattgccagtatgcataagcaacctgccagttttgggatttatgtgcctgcaaaggatgaagctgtcattgaaggtggcaatatcagaaggaaaaaggtctctcgtcttgtcagtataaaaaatgaagagaccactagcatatgttctgacgaggactctgcctcttgtgcaaatgatattcaaaatagacaggatcctgatttatctgacaatgaagctgaaattgtagatttgataaatagagttgaacatatgaagaaagagcgttctattcattggttgagggaatttaaagactggatggatactgcttctgacaaatcagtagaaactagaaaggaaggcggtgcttccctgcatcatcagaaggaaaattacatcaggaagaagacaaatcaggagcagtctggtgacatctcaagatatgcttcagactcagttctagcctcgggagatgacagtagcatgaatattttagaatctgatagttcttttgtagatatgtcagctagttatcatagacagcagcactttgactatagaggtttgcttggtaatgttagtggggcttcacattttgactcaagaggagtggacatggagcgccttaaatcctcacttgagggaattagtagttctctctcacaacctagaagttctcattctgacact

SEQ ID NO: 82591 - DNA, 306 bp, Glycine max
  Peptide Sequence Number=SeqID_199369
atggcatatacttgttcaccatacccgttcttctcgtggtgtttagtgctgaggttgggagcctcagcaaagaggacctatggaagaagctttgggaagacgcgcgttacgaccttgctacggttcttgcttcctttggggtcttcgttttcaccttgtccgtctacttcatgtcgaggccacgtcccatttacctcattgattttgcatgttataaacccgatgacgaactcaaggtactactccttaccgtttatgaaaaagaatgcttttgctttttctttgaatacaccaacgtcttcctaa

SEQ ID NO: 82592 - DNA, 507 bp, Glycine max
  Peptide Sequence Number=SeqID_199370
atgggaaatgcagcttcatgcactccttccttgatatctaataatggggtcttgaagatcctattatcagatgggaggttagaggcctacaaaaaaccaatgagagctgcagaactgatgctagaataccctggacagtttgtttgtgactcttgctacctcaaagtgggacaccgcattcatgggctcctagctgatgaccaacttgaaaggcgcaagttttacttccttctaccaatggagctgctctactctgtgctaacccatgaagaaatgagctctcttaattacaaagcatccagggcaaccaagcacgcaacttttaacaacttgggaaagatttttccagtctttagtgaactttgtatgttcccttccgagcttaagagattagaagaagctgataatcagcttcagttggtaagggagccagaaccacctgtccaaaggtactccaagcagagatcttggagaccggcactggagaccgttgatgaaactctctga

SEQ ID NO: 82593 - DNA, 340 bp, Glycine max
  Peptide Sequence Number=SeqID_199371
atggagtcggctacgattgctggcttcgctcaagctggtgcagttcgtggagaaccaggcgggtcctctgatcgaaggagccttggtgttgaagctaaatccggcgggtctccactacgtgcaatccagactggaggcgctgcacgagctcgaaagccttctcgccggcgctccggtggactacctccgagcctacgtgtcggacctcggcgaccaccgcgccctggagcagctccggcggatcctgcgcctcctcacatcgctgaaagtcgtttcggtgctgcctcatcccatcagggatcccacgcccttgtcgttcttgccgtttgtgcgcttgaag

SEQ ID NO: 82594 - DNA, 864 bp, Glycine max
  Peptide Sequence Number=SeqID_199372
atgaatttcaatgggatcaatagcagatccctactccctgggcaaagtgatccgcaatctgaaactgaaaacaattgggctggcccaaatttcacaaagaaagatgagttaagcaaggtgacatggcaaattcctagtggagccgaaaacgtggcaagcgaagttgaagattataattgcaataatacccctagcattgcatttcccattctgttcgcgattccgattgttgtgatccgtacaacacagcacaacaccatggctggccccaaccccatccccaagtggttgtttctctctctgactctgatcctcagtctctctgtctccgtcggcgcccgccacttcgtcctcgtcctctcccaggaagactacaaggacgacccccccgccgatcccgactccgccgccgagtgggacgagttcggcgacggagactcccacaaatccgaggacgacctcgaccccggctcatggcgccccatcttcgagccccccgccggagatccccaacccctccccgaatccgacgccgcctaccactccgccgtccacaagctcatgtccggcgaccccgacctgatccaggacggcgccgccgagatcggcgccttggccgagaccgggcaccccgcgtctcaatcggtgctagggtttttgtggggaatggggcttttgagggagcgaagcaaggggaaggcctttctgtaccaccactttgccgcggagggtggcaacatgcaatcgaagatggcattggcatacagctacacgaggcaggacatgttcgacaaaggtgtaaatctgtatggcgaattagccgaagtggccgtgaacagctttctgatatcgaaggagtctcct

SEQ ID NO: 82595 - DNA, 213 bp, Glycine max
  Peptide Sequence Number=SeqID_199373
atgagaaatgagtttgattttggagaaggtgatacctcggtgtcaagatcagaggaggaaatggatgaattggtgggtgaagatggtggtggcaccaattcagtagctggatctaccattcttggctcttttaagcgaagaaacaccaaggagaagaagaaagaccagcatggtgtgacatataatcttgtctactatgtgataagaagttag

SEQ ID NO: 82596 - DNA, 385 bp, Glycine max
  Peptide Sequence Number=SeqID_199374
gttcaagggaggaagtaaaacagtttatgaatatgtacttcaagttccttgcaaaaaggaagaaattggtgtcattcgttaccatatggtacatgtggatgatgtcgctagagcacatatcttcctgcttgagcatcctaatccaaaagggaggtataactgctcaccattcattgtacccattgaagagatgggtgaaattctttcagccaaatatccagaatatcaaataccaacagtagacgagctgaagggaattaaaggtgtcaagcaaccacatttaacctccaagaaacttgaggatgctggttttgagttcaagtatagcttggaggacatgtttcaggatgcaattgaatgctgcaaggaaaagggttatctttaa

SEQ ID NO: 82597 - DNA, 544 bp, Glycine max
  Peptide Sequence Number=SeqID_199375
atgatagtcaccgctttaggagcgctgaacaccagcagcgcttcgaggccatcaagggatggtcattttctccgggagcgacgcgtccagctcagggacgatgagtataccgatttccagaaaggagatagttcgccggcggtgggcatcactggtcacccccatggccaatggatcccgtttgatgcagatgctatcggccagctcctgggatatcctttagtgctggaagagggtcaggagtgtgagtatggccagaggaggaaccggtccgatgggttcgatgaggaggccatcgcccatttgctatgtataccggggcaggattttgcccggactactgccgggagacgggtgcggatcatgcgcaccaacatgaccaccctgactcagatctggatgactttgctgctcagcaacatccagcccagcgaccataattccgacctccccttgccgaagtgtcagctggtgtacgccatcctgacgcagatgagcattcacgtggctcagttaatcgctgatgtcatctatctattcgcag

SEQ ID NO: 82598 - DNA, 237 bp, Glycine max
  Peptide Sequence Number=SeqID_199376
atgaagagcggtggtggtggtggtggtggtatgggcgcggttccgtcgtacggcgtccccgcgaaacggcggtggagagggctcgtaattgcggtgctcggtcttgtcattctctccatgctcgtccctctcgtcttcttgctcggtctccacaatggtttccactcctccgaattggagtttcacctcagtaatttacgtcgcattaaatgtcatcatgatgcgttaccgaagtaa

SEQ ID NO: 82599 - DNA, 1161 bp, Glycine max
  Peptide Sequence Number=SeqID_199377
atgtatagatctggagctggaatggcttggaacgtgtttaggttctgcactgccctgcgaggattaggctcgatcatgatactaatggttcttggggttgtgggtgttacctattacgctgttgtgttgactaattttggacctgccttgtttgttggaggccttgatactcttatctccttcgtggtgttgatcttgtttcattgtttgggaagaagttgtgaggagaaaagagaccttgtccaagagcaaaagtgtaatctgtgtcttctaggtctacccctcagcctgaagcattgtggcgcgaagaggctaaatatgtacccagagagctggaggggtacaggtttatatggtgggttagagtatattattttggtgatgattttggaaagtttgaattttcttagcaagtatgacaacaatagttttgtgccactaagtgagttggttatgttattgtggtgttactttgctgttgtgtttacggatccggggactgtacctcctaactggaagcctgctgttgatgaggagagaggagaggttgatccattgaacggggtagaattaagtaatctgcagtctgatacttcaaatcaacggttcagatactgtcggaagtgcagtcagcccaagccgccacgatgtcatcattgttctgtttgtggacgttgtgtactgaagatggaccaccattgtgtctgggtagttaactgtgttggggcatcaaattacaagtatttcctccttttcttgttctacactctccttgagaccactattgtgactatatcattactgccacatttcaaaacattctttactgatgaagaaattcctggaacacccggcactcttgccacaacttttcttactttcgttttgaatctggccttttccttgagtgtcttgggatttcttgtcttgcacatgtcattggtagcttctaatacaaccactattgaggcatatgaaaagaaaactgcttcaaaatggcattatgaccttggtcgtagaaaaaattttgaacaggtttttgggatggacaagggatactggttcatccctgcttattcagaagaagatatacgaaggatgcccgtacttcagggccttgagtatccaacgacaccagacttcaatgcccaagagttttga

SEQ ID NO: 82600 - DNA, 1269 bp, Glycine max
  Peptide Sequence Number=SeqID_199378
atggaaaaaacaataaccagggtaaaatcaattcctgtggtttgcgacaatgtggacaagaaattgagacaaatatttgatttgactgaggatgaagccaacttccacatgaaacagagtgcattcttgtataagcttaatgttcagacaatgccaaagagtcatcactgcctgtcactaaaactaactgtagaatatttcaaatcctcgcataatgacgaaaaggctgacgaagaaaagtttattgattcttcattgcaccattatgttattttctctaataatgtgcttgcagcttcagtagttatcaactcaactgtatttcatgcgaaagaaagttcgaatctggtttttcatgttttgactgatggagaaaattattatgcaatcaaactctggttcttgagaaatcattataaggaagctgctgttcaagtgctaaatgttgagctggacagccaaaaggaaaatccattgcttctatccttgcctgaggagttccgcatttcatttcgtgataatccatccaggaaccggattagaacggaatacctttcaattttttctgattcacactatttacttcctcatttattcagcaatttgaataaagttgtggttctggatgatgatgttgttatccaacaagacttatctgccttgtggaatatagatttgggacacaaagttaacggtgcagtgcagttctgctcagtaaagctgggtaaactgaaaagttatctgggtgagaaaggtttcagtcagaattcctgtgcttggatgtcagggttgaacataattgacctggtgaggtggagagagcttggtcttactcaaacttacagaaagttgataaaagagtttaccatgcaggaaggatctgttgagggtattgcatggcgggcaagcttgctcacctttgagaatgaaatatatccactcaatgagtcatgggttgtgtctggaatgggtcatgattatacaattggtactcaacccattaagactgcttcggtgctacactacaatgggaaaatgaaaccttggcttgatctgggaattcctcagtataaaagctattggaagaagtttctgaacaaagaagatcatctcttaagcgaatgcaatggttcagctcttaaacaagaggatgcctgtgctttgggtgctcaattttctactctagttttcgaaggggttttgtggaagaatcaatggtggaccggtggtgatgagtttaacacaccagttataaaaattaatcagtga

SEQ ID NO: 82601 - DNA, 569 bp, Glycine max
  Peptide Sequence Number=SeqID_199379
tacccatcgccttaagagggctgcacgtcctcgccttaagagggttgcacgtcctcaccttcagaggactacacgtcctcgactttagagggctacacgtcctcgccttaaaagggttggacgttcttgccttaagaaggctgcacgtcctcgccttaagagggctgcacatcctcgccttcagaggactacacgtcctcgactttagagggctacacgtcatcaccttaagagggctgcacgccctcgcctttagaggattgcacgtcctcggcttcagaggactacacgtcctcgcctttagagggctacacgccctcactgtaagcgggctgcatatcctcgcctttagagggttgcatgtcctcaccgtaaaagggctacacacccccgccttcagaggactgcacgtcctcgccttcagaaggcttcacgtgctcgcctttagagggctagtcgcccttgtcgtaagaggactgcacgtcctcgcctttagagggcatcatatcctcgccttcagagggctgcaggtcctcgacttcgtaaggctactatccacgcctttatag

SEQ ID NO: 82602 - DNA, 192 bp, Glycine max
  Peptide Sequence Number=SeqID_199380
atgtatatagaaagcagagttaaagacagaacactagatcgcacacctaaaccaggattttcaactgaagaattaaaattaaaactcacaacgattcggtctccgatgctgaaatccttctgctcgctcagaagaaacccgagaattaactgggaaaacgggaagaagaagaaaaaagcgcggttaggttag

SEQ ID NO: 82603 - DNA, 1041 bp, Glycine max
  Peptide Sequence Number=SeqID_199381
atgctgctggagatttctcagttgtcaacacccttcggcacttcagcacagcgtgtggcagcatatttctcagaagccatatcagcaaggttggtgagttcatgcttagggatatatgccactttgccacacactcaccaaagccacaaggtggcttcggcttttcaagtgttcaatggtattagtcctttcgtgaagttctcacacttcacagcaaaccaagctattcaagaagctttcgagagggaagagagggtgcacatcatagatcttgacataatgcaagggttgcagtggcctggtttgtttcacattctagcttcaagacctggtggagcaccttatgtgaggctcacagggcttggtacctctatggaagcacttgaagccacgggaaaacgcttgtctgattttgcaaacaaacttggccttccctttgagttcttccctgtggctgagaaagttgggaaccttgaccctgagaggctcaatgtttgcaaaaccgaagctgttgctgttcactggttgcaacattccctctatgatgtcactggctcagacaccaacaccttgtggctcttgcagaggctggcacctaaagtggtgactgtggtggagcaggacctaagcaacactggttcattcttggggaggtttgtggaagccatacactactactcagcattatttgactctcttgggtcaagctatggggaggagagtgaggagaggcatgtggtggaacagcaactattgtctagggagattcgaaatgtgctagctgttggggggccatcaaggactggagagccaaagtttcataactggagggaaaagcttcaacagtgtgggtttagaggcatatctctagctggtaatgctgccacacaagctagtctactccttggtatgttcccatctgagggctataccttggtggaggacaatggcattcttaaacttggttggaaggacctttgcttgctcactgcttcagcttggagaccacccttccatagtgccattacccatcacaactag

SEQ ID NO: 82604 - DNA, 207 bp, Glycine max
  Peptide Sequence Number=SeqID_199382
atgggggatgagaaagtagggagagggggggcatggccaaagttacaagcagataacgttgtgaagattgggacagtggtttataggattcccaatattgacacacctctctccaacacgattctctatgccttttgccttttggatggttgcaaaatgagggtgttgtgttggggagggatgtatggcactagccacggcggttag

SEQ ID NO: 82605 - DNA, 852 bp, Glycine max
  Peptide Sequence Number=SeqID_199383
atggctgcttgtgctttgttcagtgctggcggtaacattaccgaagatggcaatgttaatggaagtggaagtgcttctagtactcctttgacaagtgcctctaactctagcagcatgagcaacgaagaaaaaaaacacaacctacatggtggtggcatcatgccacagcctcattgtgaaagaaaaatggtgagaaaaagaatggcttctgagatggaagttaacgttcacgcaactccaccacacaactcttcctccacaacaagtgattatcctaggtttcctcgtcgaagcagcaccaacatgaacatgttagaaaaagggtccaccagtaccaccacagcaacaacaacaacattagccgaagataacgttgctattccaaattaccccactgtgacggtcacaaccaactactccactatgttgctaccttcatccaccaccaccactatcaattcctctggtgttgctccaaactacatcactcaccaccaacaccatcatttccaaggactcgttgaaagccaggaccatcagcaaaaccctgtgcctgcagtttgtggattctcagggttaccactttttccatctcaaagccaaagaaaccgagacagcaacaacacccccaccaccaacaacataagaaacagtggtggaaatattgttgacgtggttgcttcttcttcttcttcttcttccatggatgacacttcagcagcagcagcaacaagtggttggatcgatggtatattgaaggatctcattcacagttccaacagtgtttcgattcctcaactaatcagcaacgtgagggagatcatatacccttgcaaccccaaccttgcaatg

SEQ ID NO: 82606 - DNA, 154 bp, Glycine max
  Peptide Sequence Number=SeqID_199384
acagtatggtcgtagtattcttcatctacccagacagacatacagacagactctcatctctacctcttccttaccaaaagacaggatccctcaacaaggaacaccccggttccccaacaatcccctactgcacacccggtctgttcttatgtaa

SEQ ID NO: 82607 - DNA, 388 bp, Glycine max
  Peptide Sequence Number=SeqID_199385
tgagagatcttgggatcttgaacgtctcaatcttttgctctctccccaagtagttgaagatatcagaaactttaaacctcctattggaagtatggatcatgactttgtgcaatggagaagaacggttgatggtagtttttccacgaaatctgcttttgagagcctcattgatcaatctattcaaacgtttaggagtgtttgcgatcaaaagttcttcttgaatgttagagtatctgatgtgagatcagcttgtggtggagaggtccgtgatttccagggtcattttattatgggttatgcttgttctcttgatccttgtgatgtgaataaggttgaaaatatggctattttccatggactgaaacaggcttatgaacatgggttatga

SEQ ID NO: 82608 - DNA, 330 bp, Glycine max
  Peptide Sequence Number=SeqID_199386
atgcctcaccagtgcatgagggagtgtgagacatcttttgcagctggttcctccataaacttgcccgaaatcaatgttccagctaatcctttactcagatgtacctcacttcgcctactaattgtcttctatttgtcggcaaatgatatctttgaggtaggaagcagtgacagtccaagcatgagtagcattgaagatgctcttaagacctgggacgctgaatttagaactgctcttcaatctgctttgaaaattgtcaagaatcatgaaacttgtcttgcattgccatgctactatgctagagcatcgtttgaagtgggtgtgcaatga

SEQ ID NO: 82609 - DNA, 573 bp, Glycine max
  Peptide Sequence Number=SeqID_199387
atggctggtgtgatgaggagaagaagtgcgtttgagaaaggcaaaaaccatggaaatgatgggaagaagaagatcaagaacaagagtgcaagaagagaggcaaaggctcgtggtgatgccacgtggcatggttggagtggaagagtgaatgcttcaccggttgttggatgtggattggtggcttttgctgtgtttattgattgtgtgttgttaaatggtggcgccatggctgctatagcagaatggcgtggtggactttttgccaactgccacaggaaatttgtgaagggaggcccgctatggcggcgccataggccacacttgtgtgtctatatggctgaaatttggccttccgccatccgccatccgccattgataactttgcggagaaaacttcctttaggactagatcagtcatctggtaaagagcaatccaatggtaaagaagaaaattcactaacatccgaatcttctagaaatgcttcagctaaacgtgtgctaaagactgaagtagctactggtcaaatttcatctaagaagaaaggaaatgatggggtgagttaccttttatga

SEQ ID NO: 82610 - DNA, 513 bp, Glycine max
  Peptide Sequence Number=SeqID_199388
atgatcttgaggcttgctagggatcttggagattttcttcttgttggaatacacactgatcagacagtcagattttgctgcccttgcccattctgccatcatactggtacatattggcaattggggatttgtgcaactagaggatcgcatcgtcctatcatgaatcttcatgaaagaagtctaagtgttttagcatgtcgctatgtggatgaggttataattggtgccccatgggagatttccaaagatatgctcactacatttaacatctcattagttgttcatggaaccattgcagaaagtaatgattttcagaaggaagaatgcaatccatatgctgttcctattagcatgggcatcttcaaagttttagaaagtcctttagatataactactactacaataattagaaggattgtttcaaatcatgaggcataccagaaccgaaataagaagaagggtgaaagtgagaaaagatactacgagggcaagagtcatgtgtctgaagaataa

SEQ ID NO: 82611 - DNA, 333 bp, Glycine max
  Peptide Sequence Number=SeqID_199389
atgaccgttagttgctccaactcatacaagacgattacaaaaattctatcttcaaggttacgaacgattatgcaaaagcttgtcaatccctgccaaagcagttttataccaaatcgcaatagcaacggcaatataattatcgcccaagaggttatccactcaatgaagaataagaaattaaggtggaaatggatggatggtgatcaagaggaaggatactattgggtacaggttattcgggatgaatataagtgtggtcaagatcctatgcctatcattgatgatctgagaaaaggcactaatttctggaagggaatccgaagttgcaagtag

SEQ ID NO: 82612 - DNA, 2562 bp, Glycine max
  Peptide Sequence Number=SeqID_199390
atgcattcgaattccttcaagctcatcttcctttttacccttattattttgttcaatttcccaactactaaagcacaggagtcccacgattatcttaaccaactgtgcactgacagccaaacccctgccaacagcacctatgaaaagaacctgaggactctcttatcttccttatcttcgaaggcaaccgccaaaacattcttctacgacacagtggtgggcagaaactcctttgacacggtgtatggtatgttcatgtgcaggggtgatgtaccctctcaactctgtgggcagtgtgtggaaaatgcaacccacatcaaatattcagagccagattgttccaggtccatatgggatgtaatttggtacgaggagtgcatggttcggtattccaacgtctctttcttctccaaagtggccacacatcccttcggttacgagtcgagcttggccaatatctcctccaacccagcaagtttcatgagtttgttgtacaacaccatgaaccaaactgcacatgaagcagccatttctggtaacatgtactccacaaagcaagcaaactattctaattctgagaccctatactgtctggctcagtgcacacaagacctctcaccccaaaactgcacagcctgtcttactcaagcaatagagtacctcccagactgctgtgaaggaaagcaaggaggtagagttgtgtttcccagttgtaacattaggtttgaattgtaccctttcttccgcaatgtcacggatgaggcactaccagaaggaattgttcctgagacaaaatattcacacacggattcagaatattcagaagatcctggctatatttctcacaactgctcaaccgaccaaatcattaacgatactgctttcgaatcaaacctcaagaccctcttctctgacttgacttccaacgccaccagtggcaacagaaacagaaaaaaagcgggaacactgcaaggcttcttcacgtgtcgtgtcgacctttctcgtaccctttgtggagaatgcgtccaaaacgcaacggagaaaatattctccacgtgtggtttggctgcggagggtgtgatttggtacaatcactgctggcttcgctattcaaatcgatcctttgccatggaaacaagtcccagctatgtggatctgaatgtcaccgacaccgataatcgggtgcaatattcctctcatgctttgacattgatatccaataaattagctgcaatggcggatggcacgggccaaattcttgacaaatatcaaaatggaacattgatattgaataataaacaaagggtttatattcttgctcagtgtgcattggatctaactagtgatgattgcggtgcctgcctaagtgatatgattggatcagcaattccatggactcgtttgggaagcctaggtggcagagttctgtatcctacctgtattctccgctttgaactgttccagttttacgatctgattcccaccacagcaattactcatccacttctactagcaccagcatcaggaaaaggtcgatcacgaactattatcttgatccttacctccgccatcattgttttgggggtacttttcaccttttgctactattcgattagaagaaaagcaaggaataataaaactattctcagagaaaactttggacatgaaagttcctccatagagtcattgcaattcaatttgccaacaattgtagcagctacaaacaacttttcatatgagaacaagattggcaaaggaggatttggggaagtttataagggcattcttagtgatggaagaccaatagcagtaaagaggctctcaagaacttcaaagcaagatactaaactagaaaaggttttgacttggtctgagcgttacaaaatcatagaaggaattgctcgaggaattctatatttacacgaatattctcgacttaaaattatacatcgtgatcttaaacctagtaatgtactattagacaaaaatatgaatccaaagatttcagattttggactagctaaaattgttgaactagatcaacaagaaggaagtacaaatagaattattggaacatacggctttatggctccagagtatgctatgtttggacaattttctgagaaatcggatgtatacagttttggagttatggttctcgagattattagtgggaaaaagaatataagttcatatgaaccacgtcgtgttgttgatgatggccttttaaaatttttctggagacattggagggatgaaacaccattcaacacattagatgcaaaattaaaggaaagttattctgaaattgaagtcatcaaatgcattcaaattggtttattatgtgttcaagaagatccaaatgctagaccaacaatgatgtcaattgtctcatatctcaacaatcactcgattgagttgccaactccacatgaaccaacctttttcttatacaatagaatggatccaattgcctatgaatcaaattcagggcaatcttccaacagtttcatatcatcctctatcaatgaaatgtctataagtacattctaccctagataa

SEQ ID NO: 82613 - DNA, 2748 bp, Glycine max
  Peptide Sequence Number=SeqID_199391
atggcttcttctaattccttcaatcttctcttcctctacatcttcttcaatttcacaaccaccaaagcacaagtctctcccatcatcatgtacccattttgccaagacaccaccaccaacaccacttaccaagcaaacctcaagaccctcttgtcttccttggtttcaaacgccattttcaacagattctacaacgacacaatccaaaacacagtcttcggcctattcatgtgcagaggcgacgtgtcccacatactctgccaacaatgcgtccaaaacgcgaccaacaaactatcctcgtacccacaatgctccgtctccaaacaagccgtaacctactacgacgagtgcatggttcgctactccaacgcctcgttcttctccaccctcaccaccgaacccagcgtacgcgaattcaacaaagccaacatctccagcaacgaaaccatcttcacgagcctcttatccgacaccatgaaccaaaccatacacgcagcaacaaatcccatgacatggggcagtaactactacgccgccagacacgcgaacgtgtcggacattcagacgctctactgtgtggcgcagtgcaccatggacctctcgcgtcaagattgcgccacctgtctcgccaacgcaacaaccacgcttctgttgttatacgaggagaaacaaggaggaagagttttgtaccctagctgcaacgttaggtttgaactataccctttctatcaagaaaccaaaaatagcttagattctaacggattaggtggactcgttcccgaaaccagatatgaatatccactttcagatccaaaatattctggatacatttcccataactgttcctcaaaccttgccattcttcaaaacgatgacgtttcattcaaaccatacacaaacctcacgactcttttttcttacttgatttctaatgccaccgacggcgctgaatttcaaatgcaagttgggaatctgtatggcttgttcatgtgtcgcggtgacgtggataaccgtgccgtttgtggagaatgcgtgcgaaacgcgtcggagagggtggtctcggagtgtcgttttgccaacgagggtgtgatttggttcgagtactgtttggttcggttttcggatcgggattttttctccgtagtggagaggaatccgaggtttcagaagttgaacgtgacgaaccatgacgagcgggatgatgaaaactcgtttacttctacggtttcgaataagttggcttggatggagagccaaacaggaggtagtggttccaggtaccggaatgcgacggtggcgttgaaccagatccaaacgctttatattgtggctcagtgcacgcgagatctttccagcgacgattgtgaagtgtgcttaagtgatgtggtatcggcgattccttggcgtcgtttggggagcgttggtggaagagttctgtaccctagctgttttctcaggtttgaacagtttcagtttttgaaccattggatggccccatcgctgtctccgtcgccgctgccgccttcgccgccgtctaccccgcaacgtccagaaataagaagttcgtcacgaacaactgtctctattgttgttcccgtcattatcatttcggtgatactcttctcttttggatgctacttcatacgtacaaaagcaaagaattacaagaccattctcaaagaaaattttggagctgaaagtactaatgtagagccattgcaatttgatttggttataatcaaagcagcaacaaacaacttttcagatgagaataagattggcaaaggtggatttggtgaagtttacaagggcattcttactgatggaagacatattgcggtaaaaagactgtcaaaaacttctaggcaaggtgcacaagagttcagaaatgaggttttattaatagcgaagcttcaacatagaaatctcgtggaattcattggattttgtctagatgaagaagaaaaaatacttatatatgaatacgtgtcaaacaagagtttggattacttcttatttggtactcaattgcaaaaggtattcaattggtcggagcgttacacaattataggaggaattgctcgaggaattctttatttacatgaatattctcgacttaaagttatacatcgtgatcttaaacctagtaatatattattagacgaaaatatgaacccaaaaatttccgattttggtcttgctagaattgttgaaatagatcaacaagaaggaagtacaaacagaattattggaacatatgggtatatgtctccagagtatgcaatgtttggacaattttctgagaaatcagatgtttacagttttggagttatgattttggagattatcaccggaagaaagaatgtgggttcttatgaatcatatggtgttgttgatggtcttctaagttttgtttggagacaatggacggaccaaacaccgctgaacatattagacccaaaattgagaggagattattccaaaattgaagtcattaagtgcattcaaattggtttattatgtgttcaagaaaatccggatgctagaccttcaatgttggcaattgcttcatatcttagcaatcactcaattgaattgccacctccactagaaccagcaatctttatcttgaatagtaaaatgaatccacagatagttacacatgaatcaagttccagtcaatctgccaagaattccactccattatcaatcaatgaaatgactataagtgacttctatcctcggtag

SEQ ID NO: 82614 - DNA, 657 bp, Glycine max
  Peptide Sequence Number=SeqID_199392
atgaatccaaagatttcagattttggacttgctaaaattgttgaactagatcaacaagaaggaagtacaaatagaattattggaacatacggctttatggctccagagtatgctatgtttggacaattttctgagaaatcggatgtatacagttttggagttatggttctcgagattattagtgggaaaaagaatataagttcatatgaaccacgtcgtgttgttgatgatggccttttaaaatttttctggagacattggagggatgaaacaccattcaacacattagacgaaaaattaaaggaaagttattctgaaattgaagtcatcaaatgcattcaaattggtttattatgtgttcaagaagatccaaatgctagaccaacaatgatgtcaattgtctcatatctcaataatcactcgattgagttgccaactccacatgaaccaacctttttcttatacaatagaatggatccaattgcctatgaatcaaattcagggcaatcttccaacagtttcatatcatcctctatcaatgaaatattggctatagcagaaaacaaaggtggatggagtgctcttagtaaccactctttggagtatctggttatcaggaatgatgaactcgtttttgttataccagcttgtgtctaa

SEQ ID NO: 82615 - DNA, 1389 bp, Glycine max
  Peptide Sequence Number=SeqID_199393
atgaaaatctgctcctcggagaaaattgctagtagtaccccacaaccaccatcaccaccatcaccaccaccaccaccgccaccgccgccaccgcaacaacaattgctccgacgacttgttcagcagcttcaccatgcgacgtcgttgggcgcgagtgcgaggagccagaatgcaggtagcgagaagaagcacggtcacggtcacggtcacaggcacaatctgagcgagtgcgcttcggatctgagcgagtcctgttccacaccgcacggtaacaatagcaacaacacgctgctctacacgcacgtgatcgccttcacgctctacgagttggagaccataacgaagagcttccgcggcgactatatcctcggtgagggaggcttcggcaccgtttacaaaggttacattgatgagaacgtcagagtcggactcaaatcgctccctgtcgctgtcaaagtgttaaacaaagagggtttacaaggacatcgagagtggcttacggaggtgaattttctagggcagctgaggcatcctaatctggtgaagttgattgggtactgctgcgaagatgatcacaggctgcttgtgtatgagttcatgtttcgagggagtttggaaaatcacttgttccgaaaggcaactgtccctttatcatgggctacaagaatgatgattgctcttggagcagccaaaggacttgcctttctccacaatgctgaaaggcctgtaatctatcgtgacttcaaaacgtctaatatattattggactccgactatacagccaaactttctgattttggactagctaaagcaggaccacaaggtgatgaaacccatgtatccacccgagtgatgggtacatatggttatgctgcccctgaatatgtaatgactggccacctgacggctaggagtgatgtctatagctttggcgttgttcttttggaacttttaacggggaggaaatctgttgacaagaccagacctggaaaggaacagagcttggtagattgggcacggccgaagctcaatgacaagagaaagctccttcaaataattgatcctagattggagaatcaatactcagtgagggcagcacaaaaagcatgtagcttggcttattactgtttgagtcaaaatcccaaagcaaggccactaatgagtgatgtggttgagacattggagcccttgcaaagttcaagtgttggtccaggtgaagtctcattatctggatcaaatagtgggagtgctgggccttttgctatgaacaaaatctctgactaccggatgcgccacaagttttcaaacaacgttggtcccggtgctacttgtcggtctccgaacccgaattgctcaccaggtggcccagcaacattacgggtcagatga

SEQ ID NO: 82616 - DNA, 360 bp, Glycine max
  Peptide Sequence Number=SeqID_199394
atgccgaatgaggcagtgacagagagaaagagagatgatgcattttacaaaagaaaaggaacaagatcattttacatgtggttgaagcctggaggaaaaattctaattacagattactgcaaaagtgctggaagtccatctttagaatttgatgagtacattaaaaaaggaggatattatccccatgacattaaagcgtataggcagatgctcgaggatgctggatttgatgatgtcattgctgaggatcgaactgatcgggaagactacaatgagattgtggaaagatggaaggcaaagcagaccaggggtgcatctagagagcagatgtggggtttgttcattgccaagaaaaattga

SEQ ID NO: 82617 - DNA, 1098 bp, Glycine max
  Peptide Sequence Number=SeqID_199395
atggctgttaacatttttgaggaaaatgtagaaagacttccccgtgttgctgctgttggggatgtaattgtgctttgttgtgttgaggtaaaatcatttaaaggggaagtaaatgctactttcgataagagattttcatcttttggtttatataaaggcaaagatggtgatgatttggatccttatcatgtttcttcttattttcaccacatacgtgaagatgagagcttaatagttaagcttagaaaatggctgatgaattttcagcctcacgaagattcatgtaatttccccatgttaagagaaatcaaggaagaaacttctgttaatttggcatgcaagatccttcatttttgtgaggctgctaaagatgagtggattatatttgcttgggatggtactaacactccaccaaatgtcatatgttcaaagcttgaagaagaaattaactctccacttcctctacaactagaacccttgcctttgtcaagagaggttttatgtactttgcccgttgttggatccatcttgaggatgacgtttgatgcagaccttgtgaaaaatcatttacaccttttaaatgttgataaatgggtcaagtttatgaatatgcgtcttaaggtggttgatggactatggctcggcgtttttacccctcaatcaaagcttcaatatacaccaaatgaggacggtctgattgttgaacgtcaaaggttgtctgaagagtggctattccctaagccttcatttattacagaagaagttaatcaagatcatgctatccctgttactttaatgactgtcctcactcattcagaggtggtgactgctaaattcaagtgtgttgttcgagtggtagcagcaacgccatgccaagctgaaaatctgttatctagtactggggaatatagaatgcggcttacactagaggattcaacagctagaattcatgcttttgtaactgccaaggatggggaggttctttttgatggttatccggacattgatgagttgacaaggaagctaaacatattacttggagtaaatgaggtaaaggatgctccaagaaatccaccatgggttcacagaataggctaa

SEQ ID NO: 82618 - DNA, 330 bp, Glycine max
  Peptide Sequence Number=SeqID_199396
cttcttactttaaagaggatagacctcatctatgggtggctaggtatcaacttccctctaaaaagatttcagaaaggtgataagttggtggaatcaaatgggtcttctcctacaattctgagggacaaagtacacaatgcagaggcagatagtgatccgaaggaagtcttggtcctcctggatggcctcatgagcgttataaatagttggggacagcctagggcctttaaaatattttggactttagtctacaaagaaatattggacttttccttgttcaggcaaactacgtttgttaccaatttattacctgctttaaataaattttaa

SEQ ID NO: 82619 - DNA, 1146 bp, Glycine max
  Peptide Sequence Number=SeqID_199397
atggatttggaaccctgggaagcacttgacgtggatgacaccaatctctccgccttcctccgcccttgcaactctaattccgattcctcttccctcattcccggtcctgccggcgccgtccaggccgtgatgaggaaccggcgccaccatgaccccctctccactcaagaatttctaaagcgagttgagcgccaaagtgaccgcgatttcaacaccaatccctggctctgtgccctccaattcgtgcacttgcagggtggtgatgatgacgtggcacacggcactccgttgagctcaatccagaacaacgccgagactgagagagtaccgttgatcgtggcccttgtcaaatcctccactcccaatggtttcggagacatcacggttaacctcaaggatcctacagccactcttactgccactgtccatcgcaaagttttttcacatccagatcttaggaaggaaattttaactgttggttcagttttaattctccaaaaggttgctgtgttctctcccaatcgcaatacccgttatctcaacataacattgcacaacattgtcaaggtatttcccaaggacagtggacctccatcacaacaactaacatatcctgcatgcccagtgatacgcactacacctagtatggaaagacatgaaaggttattgacaccaggcagtacattctctctgccactggaaagaaccgaaggaatcatgtctaatctcaggtttgattcaagctttagacaagtagcagatagtgacaggcagaggagtgaagttttggcttcaacgagctttcgcagtgataatggaaacgatcaaaaccgagaaactgtttcagaaggagagaacttatcattgagtctggataatgctggacctgtgaaagtaaactgtggtggtgagcttgaaagtgaggtggaagatcaacccaacccccctaaattggatgaaggaggagacattctagcacggattgctcaaggcaatagttctgcaacaaactcaattcctacatctcatggtgaaaaaactgggatggagaatcactttgaaagacagacgcagatggtaaataaaaaatgttcgttcccacattggacagaggaacagctggatgagcttttagcatttgattga

SEQ ID NO: 82620 - DNA, 666 bp, Glycine max
  Peptide Sequence Number=SeqID_199398
atggatggagacaatggtaccggcagtgtctgggaactgctcagagatcaacaatctggcgcctctgtactcgaacatgaagagcatcaaggtgtaccagatgatgcactggaggaccacaatttggaccatcagactccccgagaactcgccgtacatgcctttgagcaaggggattcccatcacaagcgtgtttgggagggtggagatggagaacagcgttatggtccactccaagcaccctctcttgctcacgttcgcccagatgcccaggacaaccaacacgatcatcttctggagcgtgtcggcggcgatgaaccggaagttcatttcgtaggggttgttggaggctatgaagtggaacgagagcagagggaccgcaaacagagcaacgaaccggttgatgccagagcattggtccggggagaagattttccaccatttcacggagccgtaggcgagtatcatggccacgtacagtggcaccattgcggtcatcacatgatgagtggggggtggtggtatttgatgcttggttggttgggttgggggatagcagcatacttagttcacgagatcagcttaatggtgaataggggtggaaataggtcaggtcggtctacaggggcctacgacctgacctacataaagactggtctgaactga

SEQ ID NO: 82621 - DNA, 1706 bp, Glycine max
  Peptide Sequence Number=SeqID_199399
atggtgccactgtacgtggccatgatactcgcctacggctccgtgaaatggtggaaaatcttctccccggaccaatgctctggcatcaaccggttcgttgctctgtttgcggtccctctgctctcgttccacttcatagcctccaacaacccctacgaaatgaacttccggttcatcgccgccgacacgctccagaagatgatcgtgttggttgtcctgggcatctgggcgaacgtgagcaagagagggtgcttggagtggaccataacgctgttctccatctccaccctcccaaacacgcttgtgatgggaatccccttgctcaaaggcatgtacggcgagttctcggggagtctgatggtccaaattgtggtcctccagtgcatcatctggtacaccttgatgctcttcatgttcgagtacagaggcgccagattgttgatctctgagcagttcccagacactgccggtaccattgtctccatccatgtcgactctgatgtcatgtctcttgacggacgacagcaccctctggaaaccgatgcccaaatcaaagaggacggcaagctccacgtcactgtcagaaaatccaacgcttccagatccgacatcttttctagaaggtcccagggcttctcttccaccacccctcgcccttccaatctcaccaatgctgagatttactctcttcagtcctctcgaaaccctactccacgtggctccagtttcaaccacaccgatttctactccatgatggctgctggtcgtaattctaactttggtgccaacgatgtttatggcctttctgcttccagaggaccaactcccagaccttccaattacgacgaggatgcttctaataataacaatgggaagccgaggtaccactaccctgctgctggaacaggaacaggaacaggaacaggaacgggaacgggaacagggcactaccctgctcctaaccctggcatgttctctcccactgcttctaaaaacgtcgccaagaagccagacgatccaaataaggaccttcatatgttcgtttggagttcaagtgcttccccggtttcggatgtgtttggtggtggacatgaatatgatcataaagaactcaagttaactgtatctccaggaaaagtggagggtaatattaatagagacactcaagaggagtaccagccagagaaagatgaatttagttttggaaacagagggattgaggatgagcatgaaggtgagaaagttggaaacggaaatccaaaaacaatgcctccagcaagtgtaatgacgaggcttattttgatcatggtgtggaggaaacttatcagaaaccccaacacctactccagcctaatcggcctaacttggtcactcatttcattcaggtggaacgtaaaaatgccagccataattgccaagtctatttcgatattgtcagatgcagggcttgggatggccatgtttagtcttggtctgttcatggctttgcaaccgaggatcatagcatgtggaaattccacagcagctttttctatggccgtgagattccttacaggtccagctgtcatggcagctgcttccattgctgttggactcaaaggcgttctcttgcacgttgctattgttcaggcagctcttcctcaaggaattgtcccatttgtctttgccaaggaatacaatgtacatcctgatattctcagtacggg

SEQ ID NO: 82622 - DNA, 1627 bp, Glycine max
  Peptide Sequence Number=SeqID_199400
aatctacaagcttgatggatttctcagaaatcttgttccttctccttccaccagagccatcagcaacatgaagaaaggcgagaaattgaaattgaaggatgagcacagagagtatatgaggaacgtaattgggaaaatttacaagacgctaaagtattcaagttgggaaagcgccgagcaagagctgaataatatgtctttgaggtgggactcttacacggtgaaccaggttctcaagtcccaccctccaatggagaaagcgtggttgttcttcaactgggcctcttccctcagaggcttcaagcacgaccactacacttacactaccatgcttgatattttcggagaagctggcagagtctcttccatcaagcttgattctgttacctacacttccatgatgcattggctttccagttccgggaacgtcgagatcaggctatgcaaatgtggcaccaaatcaaatccaagactactcaaagaggccactcgtgtttacaaggagatgattagctccggtgttgctcctaattgccacacttacaccgttctaatggactatcttattgcctctggaaaatgcaaagaggccctagagatttttgaaaagatgcaagaggctggggcgcaacctgataaagctgcatgcaatattttgattcagaggtgttctaaagttggtgggactgagttcatgacccatatccttcagtacatgaaagaaaaccgtctagttcttcgctaccctgtttttgttgaagcattggaagctttaaaatttctggatgcaagtaatagtatcacggttgctgcagattgtcctactaatatagataacgagcttctatttgttctcttgaaaaatagaaatgttgttgctattgaccatttacttacagggatgatggataagaaaatatatttagaacataaggttgtctcaaccattattgaggtaaattgtagtcattgtcgacctaaaggtgctttgttggctttcaagtacagtgttacaatgggaataagtattgagagaacaggatatctttccttaatcggcttgttgatcagatcaaatatgttttcaaagctggtggaaattgttgaggaaatgactagagctgggtattctcttggaacctatttggcttcacttttgatcattaggcttggttgtgctaaaaagcacactttggccatgaagattttcaacttattacctgataaccataagtgcactgctacctttactgctttaattagtgtttacttctctgttagaagagttaccaaggctcttgagatttacaaaatcatgtgcaccaaaggattttgtcccgtgttaggtacttatgatgtactaatagctggttttgaaacaaatggtaaatatgctgaagcagaacattataggaaagcaaagaagagcaagagcttacatgccaatagtggttctcaagaaattgagggcatgctgaatagttgctactggatagtggagatgccaacaagtctaactgtcatgtgccatctatctgttctgtatgtgcaaattcttgtagacaatgctaatgctaccaatggtcatgattttgttctcctagtcaaagacgggcaggaagagtga

SEQ ID NO: 82623 - DNA, 1431 bp, Glycine max
  Peptide Sequence Number=SeqID_199401
atgactaatcgtttgcttattcattccaagcaagccagtgctgcagtgacagttgaaaaaagagttaattttgcccctcatccaagccagaatatgcgtgagattcttcacattcagggagggcaatgcgggaaccaaataggaacaaagttctgggaagtggtgtgtgatgagcatgggattgataccacagggcagtacgtaggcaactccgaacttcagcttgaaagagtgaatgtttattacaatgagggaagcaatggacgttacgtgccacgggcagtgctgatggaccttgagcctggcaccatggatgctgcccgcaccggcccttatggccagattttccggccggacaactttgttttcggtcagtcgggcgccggaaacaactttgcaaagggccattacactgagggtgctgagcttattgactccgtccttgatgttgttaggaaggaggttgagaattgtgactgcttgcaaggatttcaagtgtgccactccttgggtgggggaacgggttctggaatgggaactctgctgatttcgaagatcagagaggaataccctgatcgaatgatgctcacattctctgtgtttccatctccaaaggtgtcagacacggttgttgagccttataatgctacactttctgttcaccagttggtggagaatgctgatgagtgtatggtccttgataatgaagcgctatatgacatctgcttcaggaccctcaagctcgctacgcctagctttggagacttgaatcatttgatatcagcaacaatgagtggagttacttgttgcttaagattcccgggtcagctcaactcagacttaaggaagctagcagtgaacttgatcccatttccaagactccactttttcatggtgggttttgctcccctaacttctcgaggatcacagaactaccgcgcactttctgtcccggaactgacacaacagatgtgggatgccaagaacatgatgtgtgcagctgatccacgccacggtcgttacttgacagcctcagcagtgttcagaggcaaaatgagcacaaaagaggtggatgaacagatgttaagcgtgcagaacaagaactcttcctactttgttgagtggattcccaacaatgtcaagtctagcgtctgtgacatccctcccagaggcctttccatggcttcaacttttgtcggtaactcaacttctatacaggagatgttcagaagagtgagtgagcagttcacagccatgttcagaaggaaagccttcttgcactggtacacgggagaaggaatggatgagatggagtttactgaagcagagagtaacatgaatgatcttgtagctgagtatcaacagtaccaggatgcggcggctgatgaagatggtgattctgaagaagaagatgagggtgctgagagctga

SEQ ID NO: 82624 - DNA, 945 bp, Glycine max
  Peptide Sequence Number=SeqID_199402
atggtaaaatcaacatatgagaaattttcaaaggactttgtgatggggggagtagcagcaatcatatcaaagagtgcagcggcaccaattgagagagtgaagcttttattgccaaaccaaggtgaaatgattaaaagaggacagctcaaaaaaccatacttgggtgtgtctgatggctttaagagggtcttcatggaagagggtttgattgccttttggagaggacaccaggccaatattatccgatatttccccacacaagctttcaattttgcattcaaaggttacttcaaaagcatttttgggtattccaaagagagagacgggtacattaagtggtttgctgggaatgtggcttcaggcagtgctgcaggagcgactacatcactacttctgtatcatttagattatgcacgtactaggttgggcaccgatgcaatagagtgccgtgttaccagtcaacgccagtttaaaggactaattgatgtataccggaagaccttatcaagtgatggaattgctggcttgtacaggggatttgggatttcaatatggggaatcaccttgtatcgagggatgtactttgggatctatgacaccatgaagcctattgttttagttgggccttttgaggggaagtttcttgctagtttcttattaggttggagcatcacaactttttcaggggtttgtgcataccctttcgacacattgcgccggcgaatgatgctcacctctgggcatccaaacaagtactgtactgcaatacatgcatttcaagagattgttcgacaggagggtttccgagctctatttcgaggagttaccgcaaatatgcttcttggcatggcaggagctggggtgcttgctggatacgatcagctgaaccgtatctcatctagacacagtcactataatgagacaaaccaaagagttctgaaatga

SEQ ID NO: 82625 - DNA, 987 bp, Glycine max
  Peptide Sequence Number=SeqID_199403
atggagaccaaagaggagataatgcttccatcaccgtccaaaggccttgctaataatggcgaacagtgttctccgggtgatgactccgggagcttctatatgaaactcgctgtgttgttggagtcctctggactcagtctcatcttcaatgtccgagaaacattgctggacttgtacctattttacttggaggtgactagaagagaaggatatcaccaggttgatcgagaaaagaaatggggtgaagtagtatttgccctgaaattggaagggaatagtgtaaagttatgtgctcaagctgaaaagttttacgcacatcttctctaccaatttgagcaattgtacttctacaggcgtcctgcaaagcaagctggatctaacagcaccaaagaacttaagacatttcagcagcttcaatatatgatgtttcagtcagaaaatgttatgcttaaattacttgaagggctttttttttcccttgtcacatcctcctctttctttaaaggtccacttcagaagaagcggaaatcaacagctagtttacctcatacaatggatattaaagatggtcataagaagaccacagagatgtccaaggactactcttgcaacatgacagcagtggtctttagaggtgcttatacaatgctttggattccaaccaagcaggtgctgggtatgtggttttaccgccaccctcacatgtcaaagaaaccaagaaacaccgaggccttagaaggccagaaaatcctacgtttggctatcgatgcatggaggaatatgtctacaattgagaaaaagccatatgaggaggaaagcaagaagaacaaggaagcaatgattggtaacaagaaggaggagaagtggcatagtctgagtggtgataatcttgtaacttcacaacctgagacagatgactccaagcttgtcaagaaagcaactgaaaaatcgccaacggatccttccttcatcttcatatataattga

SEQ ID NO: 82626 - DNA, 702 bp, Glycine max
  Peptide Sequence Number=SeqID_199404
atggatgatcaacttcttgatgctatatgtgaacggcttgcgtcatcactgagcaccgaaggaacctacctatttcgagagggtgatccagtggatgaaatgttgtttatcattagaggtcaattggagagctccacaaccaacggaggaaggtctggattcttcaattccatctcactccggcctggtgacttttgtggggaggaattgttgacatgggccttaatgccaaactcaaacctcaacctaccttcttctacacgcacagtcaaagcacttactgaagttgaagcttttgcactacaggcagaggatctgaaatctgtggcaagtcagttcaagcgtcttcacagcaagaaacttcagcatgcatttaggtactattcccatcaatggaggacatgggcttcttgcttcatacaagctgcttggagacggcatcagaagagaaaagcaacaagggagttatccctcaaagagggtctctactacctggcattgtctgaggctgagagggatggaagtggaaattatgagatcgaggaatcctcagggagtgtgaaaaaggttcagaatctaggtccaactgtttttgcctcaaagtttgctgccaatacaaagaaaggaaaccataagctacaagatcctgtgccccaattgttcaagccagatgaacctgatttttctctagaccacgaacaa

SEQ ID NO: 82627 - DNA, 279 bp, Glycine max
  Peptide Sequence Number=SeqID_199405
atgcaacaaaaggaaacagagcggatgcatttaaactctttggagaaggtagggtttataacattagggtatgatccacatctttcaaaaatcttaagggctaagactaggacgtgtcactcaagaggcgtcaagcatcaccaggagctttttaagggtaatttccattttccaagctggttgcttagctacctatttggtactctgttagtccctacagcatctagtccacagttgcagaaactaaaatccaagcaagccagggatccgtcgctttaa

SEQ ID NO: 82628 - DNA, 267 bp, Glycine max
  Peptide Sequence Number=SeqID_199406
atgcagacgtacttgtcatcaatgtcagttagacttgaagaatggaggattcggaaaagagatactgaagagtggatgaggcatcgccagttaccacaggatttgcaggaacgtgtccgtcgttttgctcaatacaaatggcttgcaacaagaggagtcaatgaagaagccatacttctttcactacctttggatcttcgtcgagaaattcaacatcacttgtgtctttctcttgtgcgccgtgtatgtctctctcccttggcttga

SEQ ID NO: 82629 - DNA, 258 bp, Glycine max
  Peptide Sequence Number=SeqID_199407
atggaggcttggggctgctggaaacgagagctctcacttgaagatcccaatgagtcctcaggtgatgaggacatgaccaagagtaagggcaaggatccacttgaaggacttggagggcctatgacaagggctagaggaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 82630 - DNA, 516 bp, Glycine max
  Peptide Sequence Number=SeqID_199408
atgggggcagaaggtgaccaaatagttagctttggtgcaagtagcgatgctggtggggtcatcataggcataggagtaggccttggggcatgcggtcttgaagatcttggaatagacggtgggcttgcaggcctgtgggcttccataggagcccgtgcagcagccaacggggcacatggtgttgaggtcgctcacgcacccggcgtagctgcattttccggatcccttgaagggggtgatggagatggggtgaactccgccagggtcgccggtgggcttccgccgatgccgttgcagaacagggacccgccgcagtccccgggagtaggcccggtttggggcgagcttgaagcctccgcgggccagaacgggctttcctgcgctgggctggatcccgggccacactggaaaatcactgaggatgatgctgaaaccttgagcactgtgagtgtgagaaagaagatggtggtgagaaagggtctgagactgagcagcattgagcccatcatggccatg

SEQ ID NO: 82631 - DNA, 327 bp, Glycine max
  Peptide Sequence Number=SeqID_199409
atgttctctcgaggccacagatgctcttccaaactcttcctgttgatcgcggatgacgacaatctttcgtcaagcgacaccttcattgcggattggggaaccgagttagcggagaatgaagccctagctcaagtgctgatcttaattgatggggtatcacccacaagaatgcttggtttcggctttgggcctcagcactcagcccactacacccttacagctgacctcgtcttaggagtgcagtggcttaagtctcttgaccctgtcgtcaccgattatatggatttaacgatgaatttacgtattagctatagctttagtaattga

SEQ ID NO: 82632 - DNA, 195 bp, Glycine max
  Peptide Sequence Number=SeqID_199410
atgaaacggaggacgaggggttttatagggaagaaggaagtgccagcttctcgtgaaacacactcctcggataggcgcgttgtagtaaaaaaagagacccatagagtggtcgcgcctggcaggccaccacttcctccccctgtcccacctcccctgtcacctagtcacatcatgtcacgtgtcagcttctcgtga

SEQ ID NO: 82633 - DNA, 237 bp, Glycine max
  Peptide Sequence Number=SeqID_199411
atggctgatgcatttgatgaagagtgtgattatctcttcaaagctgttttgatcggagactccggagttgggaaatcaaatctgctctcaaggtttgcaaaagatgaattccggttggattccaaacccaccattggagttgaatttgcttaccggaacatcaaggttggagacaaactcatcaaagctcaaatatgggacactgctggccaagaaagattcattagctcagaataa

SEQ ID NO: 82634 - DNA, 633 bp, Glycine max
  Peptide Sequence Number=SeqID_199412
atgcaattcaatctaaatagcgtaactattaggcgaggcgggtccaggacgtgggcttgttcaacttgtgttagagaaagaaacatgaaagtgattgagagaaaggcactccaaggagatatagatttgccttatttacgtgtgcagagctatcaatgcctttcaaaaactagtatattcttacgtaagctaaggtttagagcaatcacaagttcatactatagaggagccttaggggcaatgctagtgtatgacataagcaggagatcaagttatgagaatgtgagcaaatggctactggagctgagggagtttggaggcgaggacatggtggttgttctggtgggaaacaaatgtgatctggatggtcaatcaagagaagttgacaaagaagaaggaaaagggtttgcggaaacagaaggattatgcttcatggaaacctctgctttgaagaatctcaacgttgaggaagttttcttacaaatgatcacaaggatttatgacatgacaagccagaaaaatttggcagctaaaatggacgagaaaccgattaatcttttgaatgggaaggagatccatatagctgatgaagtcactgcaactaaacaatctagtacttgctgttcaagatga

SEQ ID NO: 82635 - DNA, 1344 bp, Glycine max
  Peptide Sequence Number=SeqID_199413
atggttcagatcgatcagcaagcggctgaatcgcttcgcaagaacgaggattttcggttggaggaaccgagcattgatgctcccttcaaatcagggagcggtgtgtctctgaaggatcaattgaagaagaagccattagagagcaatgagtatcgtggaaaattgcgcagtgatcccaattttgatgggcttaaagctacagcaagtgcacccaaactatctcccaaatctggccctaccctaacagatgatgattggactgaactcctaagtgcaccatcacctactcagtctatagcttctgcttctgggggcaatcacggtaatgggttacctgcaccgcgtggtttgggcagaagcagtagtaggaagcagaagggtttgtcttcagggtcattggcgacagatgtaaaaaggaatccaagaactggtaacagtggtctgaggtccttgcagaagtcggactctgtcaaagaagttaaattgagtagaaaagccagtgatgatgggaaggaatctacctcttcgacttcgacggggaggaattttgctgttgaatcggagaccgatggtaaatggggtaaaggactggagtatgctgacaaggacagttctgagaagcttgtggttgaggaaaagagaaatgaagaaaatcagcaccgttttaattatagggacatttctccaccagaattgttgcaggaagacgacaaaactttggctgcagaaacattactagcatggggggtggatgaggaccaagaagctaagattgtggaagatgttgatggtaatcaatcgagaagcatgatacaagggaggcatgaacttaattcaatatctgatgatttgaaaaggggttctcctgtggctagtgatggaatttctgattcagatacagattctggttcaacatctgattctgaaagtgaacatgagagggaggaaaggagaaagaggagggaaaggattctggctgagaaagtagcagctaaagcaataaatgctatcaaggagcgggagaatatagtggccaaattagagggggagaaggaaagtctagagaaaatacttgaggagcgagctaaacaacaagcacaagaggcttcacagcttcagagcactatgatggaaacaatggaagctgttgagttagaaaagcagaaacataataatactagaatggaagttcttgcacgtttagctaaactggagactgtcaatgctgatcttgcaagatcccttgcagctgtgcagtggagccttgaagttgagtctcatgaagctgataagggccatctgtctcaagaccttatccctgttactgactccgatggtgtctag

SEQ ID NO: 82636 - DNA, 852 bp, Glycine max
  Peptide Sequence Number=SeqID_199414
atgattgatcctttaatgttttgtagaactcagaaggcgaatgaagaatcctcgtcaaactggagcttcacaaaatcaatattccgtgcttgggactttaagaggaagctagtttcaaaaagcgttgagttggaacgggaaatccacgaggcagagcactctttaattaataataaagttgcacagttgcaggaaaaggcaaggaagctagaagctgatattgaaatgacaaggaaggagatagaagagccaacagaagtggaagttgagctcaagcgaaggcttcaacaaatgactgaccatttaatacagaaacaagcaaaggtgcgtgtttcatacatccatttggttgtaattgtgtgtgaatgctcatggatcactgttttaaattcagactggacctgtctgtctgatcagtcagtccaacaggttgagtcactctcttctgagaaggcaagtcttgtattcagaattgaggctgtctcaaggttgctggatgagaacatgtcagcatcaggtgcagcaaacatgaatcctgcctcttcatcaagtgacttagaatcaggattgtgggagctctccaattcaaagttgaagcctatgctaaaagccagaattcattctggcaagatacagcttggatcattgcttcaacaacttgattatatttttgtgactggagcactttttctgaaaaggaactcaacggcaaaattgtgggctttgatatatcttgtttgccttcatttctgggtgttttatattcttttatcacattctagcccatcaaatgagggtagatctggtgcccagatctcactggagaacattaataacactggtggagtatga

SEQ ID NO: 82637 - DNA, 420 bp, Glycine max
  Peptide Sequence Number=SeqID_199415
atggcgtcgttggaatccagaaggatcttctccgccattgacaccagttggaaaatgatcgctccacgtgaccatcgcctcgccgtctcagacaggctaccagatccaaatcgtgttgcggcgtctcaaagcactctcacttctccgattctcgagaacgtgtctcacggccagcttcaaactcgatcgtctgtgccttttgatttcgcaatgacagtgactcgcgccattgatggccatggagaagcaatgggtctatcagtggcaaagagtggagatgacggaggagcagtggatcgcggtggtggcagacagtggtggtgcacggaggtgtcggatatggatagaagaaaaaaggaaaggagaaaaaactccgacggcggccaactggttgtttgcggtggagacgatgagagatga

SEQ ID NO: 82638 - DNA, 1749 bp, Glycine max
  Peptide Sequence Number=SeqID_199416
atgggtgaaaggcggcggagggttgctgagttgaagaagaagaagaagaaatcaggcattggtattggtgagagagtgagagagaagatgctgaatggaagtaggtatgtcctccctcgcagcattcacatactctttttttctcaacatgtgaggttctttggtcatttgcatccccctaaatttcacactgtagacgatacccttctttccttcaatcgcatgctccgaaagcaccctcccccacccattttcgtattcgacaagcttctgggagccattgtaaggatgggtcattaccccaccgccatttccctcttctcccaacttcactcaaagggaatcaccccttccatcgccactctcaccatcttgatcaattgctactgccaccaggctcacctctctttcgccttctctcttctgggaaccattctcaagatggggtttcagcccaacatggtcactttcaacactctcatcaacggtttctgcatcaatggtatggtctctaaagctatggcctttcgcctcgaccttatggcaaaagggtatcctttggatgagttctcatatggctctttgatcaatggcctgtgtaaaaatggacaaactagagatgcccttcaattgctgcaaaagatggaagaggatttggttcggcctaatctcattacctatagcacagtcattgatgggctgtgcaaagatagacttatagccgatgccctccgtttgttttctctggtcacttcaagggggattttggttgatgttgtcgcctacaattctctcatccatggctgttgtagtgtcggtcaatggcgagaagcaactcgattgctaactatgatggtgcgggggaacatcaacccagatgattatacctttaacatattggttgatgcgttgtgtaaagaaggaaggattgtggaagctcaaggcgtgttcgctgtgatgatgaaaagaggcgagaagcctgacattgttacttacaatgccttgatggaagggttttgtttaagcaataatgttagtgaggcaagagaactattcaacaggatggtcaaaagaggcttggaacctgatgtcttgaattataatgtcttgattaatggttattgcaagattgacatggtagatgaagccatggttctctttaaagagatacgttgtaaaaatttagtccctaatcttgctacttataattctcttattgatggcttatgcaaattggggagaatgtcatgtgtgcaggagcttgttgatgaaatgtgtgataggggccaatcccctgatatagtcacttacaacatttttttagatgctttttgcaaaagcaaaccttatgagaaggcaatctcattatttcgacaaattgtccaaggaatttggcctgatttttacatgtatgatgtgattgtagaaaatttctgcaaaggtgaaaaattaaagattgcagaagaagctcttcaacatcttttgatacatggctgttgtccaaatgtccgaacgtataccattatgatcaatgccctttgtaaagactgctcttttgatgaagctatgaccttgctttcaaaaatggatgacaatgattgcccccctgatgctgtcacttttgaaacaattattggtgctctccaagaaagaaatgagactgataaggcagagaaacttcgtctggaaatgattgaaagaggtcttgtaaacgatgaagcaaggtctgataatttagttccatgttag

SEQ ID NO: 82639 - DNA, 324 bp, Glycine max
  Peptide Sequence Number=SeqID_199417
atgggatgcagcttaataattttgcagtggggagaggaccggcgcttcgatgaaatgcgtagtaatttgggtagactggccatattttggatatttcaggctgtctgggtgtgggttgtgagtttacctgttacgttggttaatgcaagcgacagaaatcccttcctacaggtacagcagatcaacaaaagctgcatttcaaaagatcttcagaaaatagagggaagtggtgtaatgttggactatggaaatattctcgtcatcctaactattttggtgaagatgtatatggaggagcttcagcagcaattagggtatgcctag

SEQ ID NO: 82640 - DNA, 132 bp, Glycine max
  Peptide Sequence Number=SeqID_199418
atggtgaattggacacagattccacactttcacacttcacaccagaacaacacaagtatgttactatggaaccctcttgaaggcacagcatttaacaaaatgcagcacataaaagccaagaacgtgaattga

SEQ ID NO: 82641 - DNA, 204 bp, Glycine max
  Peptide Sequence Number=SeqID_199419
atgacaaatcctggcagcaagaagtgcaagtcaagatttcggtctacactgctcttttcttccctgccagtgctggcttttagtctgcttgacctttcctaccctgcatttttcctttcctataagccaattactttatttctggtccttggagattgtgaagaatcagtgcatagccttgtggaatttgccagatacatgtga

SEQ ID NO: 82642 - DNA, 2082 bp, Glycine max
  Peptide Sequence Number=SeqID_199420
atggctccaaggttggacttttccaattggtggaccaaggatacacagaagggaacaccagtggtggtgaaaatggagaaccccactttctctgttgtggagatcaatggtgctgatgctgcattcaggccagtggagaaaagccgtggcaagaatgctaaacaagtcacgtgggtgttgcttctcagggctcaccgtgctgttggctgtgtcacatggctcgccgccgtgctttgggctttgctcggagccattaagaagcggttgattcatggacagggtgtgtctgtggagagtgagagtgacaagttggaaaagggaaagttgctgtttagagtcattagagtgttccttgtgacttcattggcggttttggcctttgaggttgttgcttaccttcaaggttggcattttgggaaccccaatttgcacattcctcgtacctctgatttggaaggcttgctccacttggcttatgttgcttggttaacgtttcgtgccgagtacattgcccctcctatacaggcactttccaagttttgtgttgttttgtttcttatccagtctgcggatcgcatgctcctttgcttggggtgcttttggatcaaatacaggaaggttaagcctaggattgaagggggtccgttcgagagcgacgacgttgaaggatctgaaagctattatcccatggttctggttcaaattccaatgtgcaatgagagggaggtgtatgatcaatccatttctgcagtctgcggcattgattggccaagagatcgtttactgattcaagtacttgatgattctgatgatgagagcatacagtggttaattaaggcagaggtctctaaatggagccaaaagggaatcaatataatctataggcatcgcttagtcaggactggatataaagcgggaaatcttaactctgcaatgagctgtgactatgtgaaagactatgagtttgttgcaatttttgatgcagactttcaaccaaatcctgattttcttacgcaaactgtgccacatttcaaggacaatcccgaactaggtttagtccaagcaaggtggtcttttgtaaacaaggatgagaatttgttgactcgtctccaaaatattaacttatgcttccattttgaggtagaacagcaggtcaatgggatatttctcaatttttttggtttcaatggaactgctggtgtttggagaatcaaggccctggaagagtctgggggatggttagagaggacaactgtagaagatatggacattgctgtccgagctcatctcaatggttggaaatttatcttcctaaatgatgtaaaggtaccttgtgaagttcctgaatcatatgaagcttataggaagcagcaacaccgttggcattcaggtcctatgcaactttttaggttgtgtcttccagcaattgtgagatctaaggtgtctccatggaagaaagcaaacttaatactgctattttttctactgaggaaactgatccttcccttttactccttcaccttattttgcataattcttcctctaaccatgtttgtaccagaggcagagcttccattgtgggtgatctgctatgtgcctgtatttatgtcactccttaatattctacctgctccaaaatcttttcctttcattgtcccctacctccttttcgaaaacaccatgtccgtcacaaaattcaatgcaatggtatctggtctcttccaattgggcagctcttatgaatgggttgtcaccaagaaagccggcaggtcatcagagtctgatttactggctgctgcagaaagggaagccaagtcaatagaacaaaagattcatagaggagcttctgacagtgaccttattgagtcacaccaattgaaggaacacaaagaagcagctccaaaaaaagttaagaaatctaataagatatatacaaaagagctgactttggcgttcctccttctcaccgcttctgtcaggagtctgttatctgcacaaggagttcacttctactttctacttttccaaggggtgaccttcctccttgtggggcttgatttgattggagagcagatgagctag

SEQ ID NO: 82643 - DNA, 2181 bp, Glycine max
  Peptide Sequence Number=SeqID_199421
atggagctaaaaaatgagaagctagtcaggttcgccaatgatgaaaaacacactcttgaacctctttgggaaaagatagatgctcacaaacaccatgagaaggcattccatgtctacccagaattcaaaattagtaatggtgaaaagaacagaatgagtatcaaaattccctcgcttgaaaagttgaaggttttcccagagaaacacgagccatggaagaagagaattcttgatcctggcagtgatgtcattttggagtggaaccgggctttcctgtttgcttgcattctagcactttttgttgatccactctttttctacctcccctcagtagcaaatgatggcaagtcattgtgtatggccactgatttgaatttaggaattgttgtgacgtgtttccggacatttgctgatgttttctatctactcaacatggccatcaagttcagaactgcctatgtgtctccaagttcaagggtttttggcaggggagagcttgttatggatcctaggctgattgcaaggcggtatttgagatcagagttcttcctagatcttgttgctacattgcctcttccccagattgtgatttggtttattatgccagcaattagaagctcccatgctgatcataccaacaatgcacttgtactgattgttctgcttcaatatgtccccagattgtatatgattttcccattaagctctcagattattaaaaccaccggtgtggttacaaagacagcttgggctggagctgcttacaatcttctactttacatgttagctagtcatgttttgggtgcatcctggtacttgttatcaattgaaaggcatgctacttgctggaaatccgaatgcagaaatgaaagcctccctgtgaaatgtgctcttaagtacttagattgcagtactttaaaccacgatgatcgcatgaagtgggtaaacactacttctgtgtttggtaactgcaatcccgaaagtagcaccagtttcaactatggaatttttggaaatgcagtggaaaataatgttgtctcctctgcatttgtagagaagtatctctattgtctgtggtggggcttgcagaacttaagttcctatggccagagtttgactacaagcacattcgtttgggaaactgcatttgcaatactcatagctattctgggtctggttctgtttgcccacttaattggtaacatgcagacctatttgcaatccattactgtgaggcttgaagagtggaggctcaagcgacgtgacactgaagagtggatgagccatcgccagctcccacaaaatctcagagagcgtgtccgaagatttgttcagtacaagtggcttgcaactcgcggggttgatgaagaaacaatcctgcgtggccttcctactgacctacgtagagatatccaacgccacctttgcttggaccttgttcgacgtgttccctttttctcacaaatggatgatcagctacttgatgcaatatgtgagagattggtatcatcattgagtactcaaggcacgaacatagttagagaaggagacccggttacagagatgcttttcatcatcagagggagacttgaaagctcaaccacaaatggaggcagaactggtttcttcaactccattactttgaggcctggtgatttctgtggagaagagttacttgcttgggcattgcttccaaaatccactcttaacttgccttcttctacaagaactgttaaggcccttgtggaagtggaagcctttgcactaagagcagaagatcttaaatttgtggccaaccagttccgacgtctccacagcaagaagttgcagcacactttccgtttctactctcaccattggaggacatgggcagcgtgcttcattcaggctgcgtggcgccggttcaagaagagaatgctgacaaagagccttagcttgagggaatgccagtccttcaatcacgacgaacaagtcggggatgaaatggaacatggggaagaagagcacagtgcagtgacttcaaacactgcacaagtgaaacagaacctaggtgtcactatacttgcttcaagatttgctgcaaacacaaggagaggggttcagaagattaaggatgtagagttgcccaagtttcaaaagcctgaagagccagacttttcagtagagcctgatgatggataa

SEQ ID NO: 82644 - DNA, 1026 bp, Glycine max
  Peptide Sequence Number=SeqID_199422
atgtcagagatcatgtatggctgccacaaggatcttcgcaagggagacttccagaaggcttttgacattattgtgtctcttgatgtatggaaatttgtgagaaatcgagacacggtacttgaaatgctaaaggacaaaatcaaggaggaggcattgaggacatacctctttaccttttcttcatcttatgaatcgttgagcctggatcagctcacaaaattttttgatctctctgtttcgcgcactcatagcattgtcagtaggatgatgatcaatgaggagcttcatgcaagctgggaccagccaactgggtgcattcttttccaagatgtcgaacactccaggctgcaggcattggtattccaattgacagagaaattatctgtccttgcagagagtaatgaaaaagcaacagaggccagggtaggtggtggtggattggatctgcctctaaggcggagagatggccaggactatgctgccgccgctgctgccggcagtggaacagcctctacaggtggtaggtggcaagacctgtccccttctcagccaaggcaaggcagtgggcgtgcagggtatggtggaagaccaatgacattaggccaagcagctgggagtggctattcaaggggacgaggaagaggttcgtatggaggttcagggaggacttctcaaaggggttcagcattgaggggaccccagggcgatggacctgctcgcatgatttgccttgctcatttacgtgagaaattaatgtctttcgcacaaacgtatattttcaagcgagctaagacccttttccgtttctggctgctcttccactgcctccaaaggctccgtccagatgcacccaccatcgtcccaaatgctgcaggaagtgctcctcccccaaaatcagatccaaacttggagttctacgatagcctcgacatcgtcgggctttggttgtcgcgttggctagagagaatgacgaggtcaacgatgttaggaagtgaggaggtgccgaagatgaggaagaagacctaa

SEQ ID NO: 82645 - DNA, 285 bp, Glycine max
  Peptide Sequence Number=SeqID_199423
atgggtaccgtcatcgagtcccatttcttagccttcactgcccttgtcactattgcctatcagtttctgtttttcgtcgtcactgcgctcctcaaattcgacaaagtcactgattttgctggaagtacgaatttcatcataattgctgcattgaccctggtcatcaaagcctcctggtattttcgacagataatcctcactttgtttgttgggacatggggacttcgcctctgccttttcctcctattcaggtatcatgatggcaccgtggtattaggtttatag

SEQ ID NO: 82646 - DNA, 405 bp, Glycine max
  Peptide Sequence Number=SeqID_199424
atgtttcaggctgagtggatggctccagaagtgttgagaaatgaactttcagatgaaaagtgtgacgtttttagctatggggtcatactatgggagctctctactttgcagcaaccctggggaggaatgaatccgatgcaagtagtgggtgctgttggtttccaacatcgccgccttgacattccagataatgtagaccctgccattgcagatattatcagacaatgctggcagacatgtatgactcagtatgctacttttctgcattatagtgatccaaagttgaggcccacgtttactgaaatcatggctgctttaaagccattgcagaagccaattactgcttctcaagtgcatagactaagtgttcagtcatcacgagttgctgaagaccccgcaggatag

SEQ ID NO: 82647 - DNA, 1992 bp, Glycine max
  Peptide Sequence Number=SeqID_199425
atggcttcaagattctggacccagggtggaagtgattccgaggaggaggagagtgattatgatgaggaggttgataccacagtgggtgaagcttctggtcaagcagtgacaagcaggtacctgcaggataatgcaagtgacagtgatgactctgatggccaaaagcgcgttgtgaggtctgcaaaagataagcgttttgaggagatggcttccactgtcgaccagatgaagaatgccatgaagatcaatgattgggtgagcttgcaagagagttttgacaagattaacaaacagcttgagaaggtcatgcgtgtcactgagtctgaaagggtccccaatctttacatcaaggctctcgtgatgttggaagatttcttggctcaggctttggctaataaggatgccaagaagaaaatgagcagtagcaatgctaaagccttgaactcaatgaagcagaagctgaagaagaataataagcagtatgaggacttgattaataagtgcagggagaaccctgagagcgaggaggaaaaagaagaagaggagagcgatgaagagtatgacagtgatggtgagattattgatccggatcagcttcaaaaacccgaagcaaaatctgattcggaagcctctcaatatgaagatgaaaagccagatgctggtgaaggtccttgggaccaaaagcttagcaagaaggacaggcttttggatagacagttcatgaaaaaccctagtgagatcacgtgggatgcggttaacaagaagtttaaagaggttgtggctgccaggggaagaaagggaactggtaggtttgaacaggttgagcagctcaccttcttaacaaaagttgctaagacacctgcacagaagctggaaattctgttcagtgtggtttctgctcagtttgatgttaatccgggcctcaatgggcatatgcccatcaatgtatggaaaaaatgtgtacagaacatgctgatcattcttgatattttggtgcagtacccaaacataatggttgatgattccgtggaaccggatgagaatgaaactcagaaaggtgctgaacataatggaacaattcgggtttggggtaacttagttgcttttttagaaagaattgatgtcgagtttttcaagagcctgcagtgcatagatcctcatacgcgtgactatgttgagagacttagggatgagcccacgtttctggttcttgcccagaatgtccaggaatatcttgaaagagttggaaatttcaaagccgcttctaaggttgccttgaggagggttgagctcatttactacaaaccccaagaggtttatgatgccatgagaaaattgactgaattgacagaagatggagataatggaggggaggcaagtgagaaggaatttgaggaatcaaggattcctactgcatttgtagttaccccagaggttgttacacggaaacccaccttccctgagaatagcaggaccctaatggatatattggtatctatgatatacaaatatggagatgagcgaactaaagcacgtgcaatgctctgtgatatatatcatcatgctcttcttgatgagttttcaatagcccgtgatctgcttcttatgagccatttgcaagacagtgttcagcatatggacatttcaacgcagatactttttaacagggccatgtcacagttaggtttatgtgcttttcgggttggactgatttctgaagcacatggctgtctgtctgaactctactctggtggaagggtgaaggagttgctggcacaaggcgtttcacaaagtcgttatcatgagaagactcctgaacaggaaaggttggaaagaagacgacagatgccgtatcatatgcacatcaatctagagctcctagaggcagtacatctcgtatctgctatgctgctggaagtgcccaatatggcagccaatgttcatgatgccaaacggaaggtcattagtaagactttccgtcgcttgcttgag

SEQ ID NO: 82648 - DNA, 1785 bp, Glycine max
  Peptide Sequence Number=SeqID_199426
atgtatctggaagttgtgattgatgacgatatgaatttcagggagtacattgttgacctaatggcagctcctggaacacttattccatctgatgctactggatcacacattgagtgtgacgattcttcctttgtagccagtccttcatcaagagagcttgattctcatgtagcatcgttcagcagtggggttggaagttcatctgaagaagcttctgactctggtactctggataaagataataaatcaaagtattttggctatgcaaggaaagaatccaatgtaagcggggctgctacgggcaaggaagaattgaagagaccatcaaatgaatccaataataccccctatgaggagaagatcatactgcaagaatcccctatcagatctaattatccatatatgcatggaagatctccttcttggactgaagggatcagttcccctgccgtgcgtagaatgaaagtcaaagatgtttcccaatatatgattgatgctgctaaggagaaccctaacttggctcaaaaacttcatgatattttgcttgaaagtggtgttgttgcacctccaaacttattttctgaaatttatcatgggcagttaagtaccccaaccgaggccaattttccaactgaacaaaaagatgaaaataaacaaggaagtgtgcagcaagaaactaagactgatgacaatctagttcctgctcgatttttgcctcctttgcctcaccaccgagttcaccgcaaagtaactcctagcagtagcagtcagctggagcattctaagcctgttgagggcttaggaattggccttcctcttgattcaggggaagctgctggacagcacatatcatcacaggtagaagcaactcaggtaaagtatgggaaaaatatgccagttgcggcagctgcagctgcagctgctgctgttgttgcatcttctatggtagttgctgtaacaaagtcgaacgctgactcgaatcttgagattcctgtagcagcagctgctactgctactgctgcagctgttgtagcaaccactgctgctgtaagtaagcagtatgagcagggaagttggagtggtggtgatacagagggtgctggttgtgagccgaagtgtagtggtgatggagagcataatgctttaggagaaaacacagaaggcgagagaaaatctgatcgatcagtaagtaatgacagcacaaagtctgattcagcgctagatgatgttgctgagtatgatattccgtgggatgaaattgcggtgggagagcgtattggacttgaaaaactcaattgcaactatgtagcttgtatttggcatgcaggatcatatggggaagtttaccgtggtgaatggcatggaactgaagttgctgtaaaaaagcttctatatcaagatatctctggtgaattacttgaagaattcaaaagtgaggtccaaataatgaaaagactgaggcatccaaatgttgttctcttcatgggagctgtaactcgacctccaaatctttcaattgtttctgaatttcttcctagagggagtttgtatagattaattcaccgacctaacaatcaattagatgagcgaaggaggttgcagatggcccttgatgctgctcgaggaatgaactatctgcacaactgcactccagtgatagtgcatcgtgatttgaagtccccaaatcttcttgttgacaaaaactgggtagtaaaggtatgtgattttggcttatcacgaatgaagcatagtacattcctttcttccagatcaacggcaggaaca

SEQ ID NO: 82649 - DNA, 288 bp, Glycine max
  Peptide Sequence Number=SeqID_199427
atgcagagcctacaccgagggcaggtcattattatgcagagcttccagagcttaggcctaccatctatcatgagtgtggatgagtttcttgcacaggtggcttggctaggagtccagctttctctttctagaggggtagctcaagagcatacttctccagttcctatctctccaacacccatatctgaggacaccatgccatcagcaccagccatggagccagagcagcccattcttcaggatgtaccagctgctccagtgttggatttaaatgaagatcagccatag

SEQ ID NO: 82650 - DNA, 453 bp, Glycine max
  Peptide Sequence Number=SeqID_199428
atggtgttggcgatatatgctccttgtctcgccaacactgcttgcgagagaccaaagaccatagtctggctgctactccctgcactgctactctgcaagcatagcctgcctgacctgtcccgtccttggcctgcacgttgctcaagctggcctgcacgctgctcaaaccaagtcgccacccatatttttgatgagctaaaaatatgctctaagttcgagtttggtcagaacctgttcgaatcgaaaagagagaagagtcgtttgaaagggattcccaggttcaaggaagtatttgcgaagtacaaggctaggacaagaaagagggcttcgaatcattgggcgattcgaactggtgtatactctagtcgaagtcgaggcagccagatttctggacttagcgcaatttctgacaaaacttcacaaaatcagttcgacttcgagcaatgtggataa

SEQ ID NO: 82651 - DNA, 249 bp, Glycine max
  Peptide Sequence Number=SeqID_199429
atgggaagtgaagaattaaaggaccaagatgaagaaggcaaagctcgtttaagatgcacctccttagaactagaagagtccctaaggagaggaaagggagaacctaggtacaactcaggaagtggaagagggatgtatggtttccctcaacaagttcagaaacacttgacgagagacctcttggaaaacttgaagccccaaacagaaaaaccttggattttgattggggatttcaatcaaactctctaa

SEQ ID NO: 82652 - DNA, 546 bp, Glycine max
  Peptide Sequence Number=SeqID_199430
atggagaaagcttcacacatagcctacatcctagggaaatacaaaagagcttctggtctgaagtggtggcgcttgctcacccaacctaaatcgctcatggccagaactctcaaagccaaatacttcccatcatcttgtgctctaacagctacaaggggccactcacctagtttctcttgggtgagcatattgtcaacaactcgtggaggaagggaccatgtggaagattactccaccagatcttggaaacaatccaccatcaagaataccttcactgagcaccaaatctttcaatcaagaaccatcaacaagctcaacatcagatgctttttggaagtggatttggaaggtgaatgttgccccaaagtgttgaaacttggtatgtatagcttgccaaaatatccttctgtaaagaaaaatcttcaaaagaaaattaatagagggttgtctaaagagcataagaaccttgaagagatggccaatatatgctccaatgacaaggtcaaaagccaagcttctacaagaagagatggccaagaggattaa

SEQ ID NO: 82653 - DNA, 261 bp, Glycine max
  Peptide Sequence Number=SeqID_199431
atggtgtggaaggaaaagggagagaggaacgaacacgaacttgttcgatctgggagggttggtggtgaggttggggagttacgaagtggtggagtgggagacgaagaagaatgcgtgagactgagagtgttatttcaaatttttggggttttgttttggacactctctgcacgcagagtcaagcacgttggatttcacgctccgtggatgcgaatgctttcatgccactccatcactctaagtcctaacccctttttttaa

SEQ ID NO: 82654 - DNA, 670 bp, Glycine max
  Peptide Sequence Number=SeqID_199432
gatagatatccctcctctgtcccaagtcgaagtatttagcatgcctcaagcaagctattttaaaggagtaactctaccatccaatctcgttagcacttcacttacttctaggctcaggaatccattcgtatcaggaatcattgatacctcattacctcctacatggaagggagtcactttggacaagtattatggtactactgacctagacaaacacattggcatttatgttgcgcaagttggactctacattatggatgatttcgtcctatgcaaggcattactaacctcgcttaaaggtgtacctcctcaaaccttcactggtgctgacttcaaaggtatggatcccacacaagatgatcccatggatggctacaaagatgttatggtcaagtatgtggttattcatgccaatacctcttataacattttgattgtccagccattaatcaatgttatagaagctattgtgtccaccttgcatctcgccgtgaagttcctaaccgatgatgggttgattgttacagttcatgtggatcaaaaagcaacccaagaatgctacatgtctagcttgaagcttacacacattaaagaagtacttagatcccaagcaatcaatgtggtaacctgggtagaaatggataaggcagagtctctagacctaggttag

SEQ ID NO: 82655 - DNA, 831 bp, Glycine max
  Peptide Sequence Number=SeqID_199433
atgcatgatgagattgtcagaactttaatcgaggtttgtcatgttctagggcttaagaaaaatctagtttttgtgggtgccatggattcaaaaggtttttctggcttggttgaaagtgaagttatacaaataagagggaaagagaagtctatggggccttcgagagttccatcattgggaggggcaaggtacttcctctccatcatcgatgattactccaggatgacatggaatcaaataggaaagataaggaagtgtcttaggactaacaatggcttggaattctattctacaaaacccaatgaattctgtaagggtgaagacattgcaagacaacgtactgttgaggtggttagcacatgttatctcgtgaatcgttcatcgtccactgccatagatttcaggatacctattgaggtatggtctaacaaacctgttgagtactcaatgttgaaggtgtttgagtgtccaacatattatcatgtaagagaaagtaagctggagcctagagccaagaaaggtgtctttatgggctatggagatggagtcaaaggatttagaatctggttgccgtcgggaagaaaggtcattgtgagcacaaatgtcatttttgatgaactctctatgtttcattctaaatctgaagaagattcaggaaaagctaaggatgccactaagttggtgaagtttgagagccccacaataaaaaatttagtgattagaagaagtttgaagcacctaatgagattgattaggaacttcaaatgcaacctcaacattagaattcaacaccaattgaggagtttgattagacaagtcagaaccatctga

SEQ ID NO: 82656 - DNA, 975 bp, Glycine max
  Peptide Sequence Number=SeqID_199434
atgactagaccaacaactcgaagtaaaaataaaaggcagagacagggggatgatgatggtggtggcacttctgacatatggaggaaaattcacataacgggtgcggtgactgaagatgatatgaatcaactgtatatgatttggaagccagtctgttcaggctgtcgtgttaatactaaagacaacccgaattgcttctgtgcattggttccacctgcgaatggtacccgaaagtctggtttatggcagaagatggccgactttgtcgaaagtcttggtcccgacccaaatatggatcttcgtgtttctgatagttcacctgcaggtctgacaaatcttggcgcaacatgctatgccaacagtatactacagtgcttgtatatgaataaatctttccgagaaggcatattttctgtagaaccggatgttttacaacaacaaccagtgttagatcaactgactcaactttttgtacatttgcatgctagtaaaatggctttcatagattcttctccatttgtaaaaacattggagctagacaatggaattcagcaggatagccacgagttcttgacattgcttctgtcattacttgagcgttgtttgagccattccaaaattgccaaggcaagaacaatagttcaagatctttttcgaggaagaaaatgcccaaagaacaattatcttgggaatgatgttcatgttgctagcatgtgttcgcaatgtggaagagactctgaggcttcttccaaaatggaagacttctatgggttagagttgaatatcaagggactgaaaggtttagatgagagcctagatgattatcttgctattgaagagcttcatggagacaatcaatatttctgtgagtcatgtaaaacaagagttgatgctactcgcagcatcaagctgtgtacattgcctgatgtacttaattttcaacttaaacgttatgtcttccttccacaggtttaa

SEQ ID NO: 82657 - DNA, 2301 bp, Glycine max
  Peptide Sequence Number=SeqID_199435
atgaagaagaaagttacttctgcattttcatttcctgctgaacttgatatgcgccatagattgtctgagccatctcagtttgaattgatatatgacttgtcagctgtactgattcacaaaggaactgctgttaatagtggtcattacattgcccatatcaaggatgtaaacactgggcaatggtgggagtttgatgacgagaatgttactaacttgggttgccatccatttggggaaggaacttcttctacttctaaatctgttaagacagatgtacttcattctaattgctctgaagcaatgctagctgacagtaatggtttagatgccactcatgcgcaatctttgcttgtggagacattttcatctagtgatgcttacatgttgatgtaccatcttaagcatagcaaaaatgttggtgaaaaggggggaatcgtttatggtgctaaccttgaagtagagggcaatgcagttactgcacaagacagtgcttgtcttccttctcatttttgcaaagagattcaaaatttcaatgcttcatatcttgattcttgcgagcagtacaaacataggaaagagttagaattgagccatatcaatgagaggagacaggaagttcgatccattttagctgaagctcctactcaaccactggagcaaccgtatttttggatttgtagtgactggcttcgccagtgggctgacaacattattccaattgctcttgacaatacatctatccaatgttcacatgggaaagtcccagtgtcaaaggttacctcaatgaagcgattatcttctaaagcatgggataaattattgtctaagtatggtgggggaccaactctttctcatgaagactgttgttgggattgtctgattgatggggctcagaatgtggtgtcagctgacacttatcgggatcaaagagaatcattgaagcgacttgcacgggatattctcgatggaaattgtgaagacggaatgtactatgtgtctagaccatggttgcagcaatggtggaaaagaaaagttgttgatgctccatctgaagctgatgctggaccaacagcagccatttgttgtccacatgggcaacttatgcctgagcaagctgttggtgctaagcggttgcttgttcctgaggatttctggcttttcttatataaagatgccatttctgtaaaacctgatgatcctctaggttgccctacttttcctttagactccagaaggtgttcccaatgcagtgatgaattatctgaagaggcttgcttggaggactctttgagattagtaaaacaaatgcaacgccaaaatcatgagaaattatttgttggtaaaagtatgccgctttctctacattgcaagtatttcttagttccttcttcgtggatttcaaaatggagaaattacattaatttggctgtcaagaattcagataaacctgaaactttagatggggtaatcgattcactgatgtgtgaaaagcattcacggctcattgaaaggcctcctgaactggttttcagacgtggtgctataattgccagagaatcttctgtaagtggcttaaccatcatatctgagaatgattggaaatgcttctgtgaagaatggagtggtattgagaccaaaggaatatctgcaagaattgagaatgttaatgattcagaaaatgctttgactggatcctgcagagagatgccaatatgtgaggatcaacttaacacttgggataaagtgaataatgaaagtgggaatggacacattgtgattaagacttgtcctgaggtttgtgaaagttgcgttggagaaaaggaaagctgtgagttaatgcagaaacttaactattgcaatcaggacattagtgtaattcttgtccgtggaaaggaggtccctaaatcaatcttagaggcttcaaagggctttgttgaaatagacaggcgggtttccaaacgttcccggaagactaaaaatgggagttccattagtctaaaagtttctgcttcaacatctatttaccagctgaaaatgatgatatgggaatcctttgcggttgtcaaagaaaaccagatactacaaaaaggtgatagaacaattgatgttgataatgaatatgctacgcttgtggatgcaaacatatttgctggagatcagattattgtgagggactccgagatccatgaaaatcgagatattgcagatgagctttgtgatgaggaaatggaaacacaacataccgaggcaggatttcgtggaacactcttaacatcgaacgtttcatctcaggtggtttag

SEQ ID NO: 82658 - DNA, 627 bp, Glycine max
  Peptide Sequence Number=SeqID_199436
atgacttccaaagttttcgactccggcaagagcttgtttggaaagatattctcggcattgatgaagcctctggatatgttgggcgatgacttggttttgaagtgtaatcttgaagaccctgttgtagggttttctaatgatctatcacaacagatgctcccaagcatattcatacagctgatcttatggggatcattgaagagatttcaacttatggggacaccatactgccttacaacacaagcacttcttactccaagccaagttattgaaccttttcctttctgggattcccatcccaagctattgagcagcttgtcacagaaatgttatttcatcttcttgcacaggaacatttttcagcacgatattacaacaaagtcttcagttgtgaccctcgtacaacttgcaggaattgaaatattgaacttcaagcaaacagcaacaaaagcattggaaaaaaatttcacaaattggacaaaggcagttactgatgcaggaggtatttttgagcttgcaaagctttgggagatctttcccagcatgaaggaaatgctagatctagtgactagtgcctctgtttctgcatgtcgtgcattgttgaagatcagccaactgaagaaatga

SEQ ID NO: 82659 - DNA, 267 bp, Glycine max
  Peptide Sequence Number=SeqID_199437
atggggtgccagtggatctacaagaagaaattcgggtcaaccaatgataagtcatcaacaactctagacatggagttagagcaactcgatgtcaaaacaacctttctccatggaagactggaggaatacattccgatgcaacaacttgaaggttttgtggtgcaaggaaagaaattatatttggagaatccaactgatatgttcatgaagcctgttccaagaagcaaattcatgcaccgtctggatctacttaacgtagattgctga

SEQ ID NO: 82660 - DNA, 276 bp, Glycine max
  Peptide Sequence Number=SeqID_199438
atgaccacacccaccaccatatcaatcactgttgctatcacgaacatcactattctaatcgttattgtcactatcatcatcgtgactaatgtcataaccactattattgtcaccaacaaggtcgctattgttgttgtcaccactgctagtggcggcgatgacaacaacggtcatattggtagcaatggcggtagtcatgacgatgatcataatgatggtggtggtaacgacgacgacgacagtgataattatggtgatgatcttgatacaaattaa

SEQ ID NO: 82661 - DNA, 561 bp, Glycine max
  Peptide Sequence Number=SeqID_199439
atgctccaaccatatgggatcagcataggcttaaaggaacactcaaacccggtgacccccaaggcctacactccgaagagtccgccagggcctttccttccggattctgttgtgagagccttgcagtactctacaatcacttgccctgaactgagctatgcagttaataaagtgtgtcaatttaagtcacaccctcttgaagctcattggacaaccatcaagagaatattgagatacctaaaaggtactcttcatcatggattacacttaaggtcgacactttcgaccaattctattcctatcaaaggcctttgtgatgctgattgggcttcagatccagaagatcacatatccacctcagtgctccactctcgaactaagcatatggagattgatgtgttctttgttcgtgagagagttctagcaaagcaacttctgactcgacacattccaactattgatcaatgggcaaatgctttggcaaagcctttggcaccttctaggtttatgtttctgggagacaaactggctgaatttcattctggaagtcacccaccttga

SEQ ID NO: 82662 - DNA, 243 bp, Glycine max
  Peptide Sequence Number=SeqID_199440
atggcaatggcatggcagagaagggttatcaatatcaagagtctacgcaaactcgtgagagcttctacgagtcaactcgtagagtcgactccttttgatctagatactttaatttttgtggaacctaatgatgatgcacaatctgaggaagaccttgatgatgatgatggagatggagatgatgatgaaagtgatgatattcatggagatgatcctattagaggattgaacatgcttctttga

SEQ ID NO: 82663 - DNA, 1335 bp, Glycine max
  Peptide Sequence Number=SeqID_199441
atggcgctgctttccaggataacaacatcctcattactactatccctatcctccaaacccatttgcaacgcctttctgctttctcgttcaaccgccacaacctgcacaaaacatcagaacaagaagaaaaaggaaaacgccaaagcagcgttggcgaaggagaagcgcagaacccgttccgacaaacagttcaaccacgacgcaataatcgagcgttgcaacataaacgacactgacaccgacaccaagttctctcacgttcctgtgatgctgggcgaagtcttggacgtgttctcctctactttcttaacctccttcgtcgattgcactctcggcgccgcaggccactccaccgccggattgaggaatggaatgaaacaggtgatcaaggggcatcaagagttgaagtatttcgtggggatggacgtggactctgtcgcacacgacattgcccagcctcgtcttgatgccgttttgaacggtggtgtcaaagcgattaccgttttgaggaattttagagacgtcaagtctgtgcttagagaatttgatgagctaaagttgggggttgacggcatcttaatggacttggggatttcctctatgcaggtagatgatcctgtgagaggattcagtgtgcttggtgatggaccacttgatatgcggatggatcctcagggacgcattttagagggaaagtgtggagttataaccattgattggaaatcaatggcaagtcttaaagcagaagacatattaaattcctggccagattctgaagtgggccgtatcctaagggagtacggggaagaaagtaattggcgaactctgcaaaagaaaattgtcaatgcccgattacatggtggattgcattcgactagtgacttgctcgatcttattcggcgcgtggctcctccaatgagaggtggacggcaaggttggataaagacggcaacccgggtgtttcaagctctgagaatcgctgttaatgatgaactgaagacacttgaggattctctctattattgttttgattgccttgcacctgggggtaggcttgctgtcatatcttttcatagtctagaggacagaattgtgaaacagacatttcttaacataatcaaagggagcaaagatgtggaagaaagggagagcctcaacagtgatttgaggaagactagtgatgaaatcaaagaaaaagaagcatggataaagcaagtaatatatggatcaaatggaacaattctcactaaaagaccaatcacgccatcaggagaagaagaaaaattaaaccggcgaagtagaagtgcaaagctcagggttattcagaagcactga

SEQ ID NO: 82664 - DNA, 336 bp, Glycine max
  Peptide Sequence Number=SeqID_199442
atggtggaaacatggttacgacgcttacctcgacggtggacggtgacgaagctccctcgacggtggatggtggcgttgctcttcatggaaacctcctcaatgcacctcgcaacctcttcacgacaacaatggttggtggctgaagaagaagaagaacctttcccgacaatggtgacaaatggagacgccggtgaggtgagcaagaacaatacaaaaatggctgaggtgaggaagaagaaggaaacggtcttaggaagaagagaggaaaacgctggacattacgggcttttcacctcaattgttgagtgcacctacaaaaatgctggatgcacctag

SEQ ID NO: 82665 - DNA, 177 bp, Glycine max
  Peptide Sequence Number=SeqID_199443
atgacgaacaaggccaaaggaaaaggcaaagaggtcgccggaaaaggttctgccggcaagtgcaagggcgccttcgacgatgacaagaccagtggcgtccaaaagagaaacaagccctgttcgaatgaaccggtgtctcctgttattttttttggattcgttgacgtgcaaacatga

SEQ ID NO: 82666 - DNA, 384 bp, Glycine max
  Peptide Sequence Number=SeqID_199444
atgcaatcacagggcctcgcactgcctcctaagtctgaggttggtccttcagctacacatgtcagcacaaaggaaagttgtatcgatcccttagggaacgatccagacacgggtgactcagagaaatacaggttgtgcattgaagaaaatcctccccgcctagttgccctaggaaaactttatgaggttggcgttgagaaagttagagatgcagatgctcccattcctgtacccactgaagaggttcagttagtggggcatgcacataacaccttcgttgcttggccgacgcatcttgtgaagcgtttatcagaacagagtcctgaatggccagttcacaactctgttcggagtcatttctttctcactgctcataatctctaa

SEQ ID NO: 82667 - DNA, 243 bp, Glycine max
  Peptide Sequence Number=SeqID_199445
atggtattcatgcaggaattcgaatgtgggcccactaaaaatacggtcgtgggaaccagaccgaggcctgagccgtccaatacggaggagagagacagagaggatttagattttagactgatgcatccatttctcaaggtcacgcgcgaggccatggcgcgtgtaataatcagcccgtgtaaacgagtgcaagtttcagaaaccctgcaggaatgtccacgtggctccatctgtggaacgtga

SEQ ID NO: 82668 - DNA, 420 bp, Glycine max
  Peptide Sequence Number=SeqID_199446
atggcggagcgtgtccatggaatgtattacacgccacaaacatttgctgagtatcccacacagatgtatcagtatccttttcagggtcatcacactgatacttctgccagccagcaaccgttcggtggttttgcggaaacacaagctcatttttcatggcccacaatgaccccttcacagcaatatcatggcccaattccaacacctaatgccccgttaggaacacaatggaatgtaccgggacaaatacctaatacgggtgacttattcggtgttgatttgcgtcacgcattttctgcggaggctaacgaagaagaagcggggaggcattggggcagaagaaatccttatcgccaagcacgaagatgggatcgaccatgtggcacatcctcacggcatcacggacaccaaaatgaatga

SEQ ID NO: 82669 - DNA, 228 bp, Glycine max
  Peptide Sequence Number=SeqID_199447
atgccccaaccacatgggatcaacatgggcttaaaggagcactcaaaccgagtatctttacccccaaggcctagactccgaagaatctgtttgggcctcaccttcctgattcaggtccaacccctaaaacaattttacacgcagacactgctcatgaattatacaatacccacgacttcatactcggggttcaactcacaacacaagtattgtcacatcaagtattaa

SEQ ID NO: 82670 - DNA, 910 bp, Glycine max
  Peptide Sequence Number=SeqID_199448
atggcagacaacacacgcatgaaggagcttacaggggatgtcaaaaggatcctggagacgatggaaaaccgcaataaagaatatgctgctcggtttgagaccttagaaacaacactggagatgacactcaaggataaaactagagatcccgggagtatatcactggctatgaacaatcacccttttaaggttgtgccctggtaccaaatgatgactcatgaaaattcattcacaacatggattgcttttacgcgagccttagagacagaatttggcccatcaccgtgtgaatgtcctagatctcagttgtttaaactcactcaaattggttcagttcagtcatattacgtgcagttcacgtctttagctaatcgagtacaaggaattacacaagaagctctattggattgctttgtaggaggattaaaacctaatatcagaatggatgtcattgcacaatcacctacatcacttctcagaacaatttcgttggccaaactctatgaagagaaatatacacctaaactcaaacctttttcttcgagtttttcttccaaaacacaaacctcaaacacaaactcaaacctaaacacaaaccaaaacagccctcaatccctaaaatccacaagcttacccccactattacccacaccatacatcaaacctatcaatgttaagaaaatgacatcgacagaaatgcagttgagaagggaaaggggcctaagctttacttgtgatgacaagttttcccctagccatcgttgtcctaataagcaacattttgttctacagtgggaagaagaggatgatcctgcatttcaaccagatccaccagacgaggttgagacagctggtgaccccagtttgcaagatcatcatttgtcttataatgctttaaaaggctcatcag

SEQ ID NO: 82671 - DNA, 717 bp, Glycine max
  Peptide Sequence Number=SeqID_199449
atggcaggccgagtccgagcgcttcgggcgagtagagggctaccagggcgcggtgcctcgcttgcccgcgccgccactgcccagggtgcggatggtgccccggcgcaatgctccgaccgccaatcctggctacgcgacgccgtgatcgtttcgtatatccggtccaccgcgtggatgggctttctgcgtcaatggtggaccgaaccggtgccgacgggttggctgcgcggcttccttcatgcgcgcaagctcgaccggaccgttcgcaatctcatcggcggatacgcgctgattttcgccgcgatctgtattgccgttcagttcagcgataccggtccgcgcagcatgatcggtcgcgtcatcgtcgggctgtgcgcggtcggctcgttggggtgggcgctgcgttgggtggtggggccgtggccgtccctacgactccgatccactcgcgggcttggtgggcacggtgcttttcacgcccgtcggcgcctacgtgagcttcttcctggcgaaccggctgctggtggcccacgtcgcctggtgcgcgccgatgatcatcgcgctgtcgtctcgcctgttcgccgagggtaccgtcggcgctgcgatgaccgcgctggtgaaggtgaccagcatgctgttggtcgtggtgctgatcccggcggtcattcaattcgggattgcggtggtgcgatgggacgcacttgccgcgcagcgtga

SEQ ID NO: 82672 - DNA, 742 bp, Glycine max
  Peptide Sequence Number=SeqID_199450
atggatccggtcaagttgtatcactttatcgagcgacagcagcccagcgtgattcaagcgacacctaccgtctggagcaccatcgtccaccatctgccggcggcgggccagcgccccctgaccgtgctgtgcggcggcgagaagatgccggcggccttgttgacgcaattgcgacgcatcgcgacacgggtgctgcaggtgtatggcccgacggaaaccaccatctggtcgacctgcgccgatctgactcacgaaggcgcgagcgactgtatcggcacgccgatacagtcgactgacgttctggtcatggatcaggccggcaacccgatgccaagcggcgcatttggtgagctatggctgggcggcgcaggggtatcaccggggtattggcgcaacccgacgctgagcgataaggtctttctacggcgccaggcgttcggcaccgagcgctatatgtaccgcaccggcgacattgtgcggtttaatcgtcaggggcagctggaatacctcggccggaacgatcaccaggtcaaaattcgcggccaccgcatcgaattgagcgaaatcgatctcagtttatcctctctcgacaatatcgagcggtcgctcagcttaattgtcggtgaaggccagcaggcccgcatcgtcagctacctgcagttaacgccgggagaggagctgaatgaaaaagcggtgcgcacggcgctgaaagctcgtttgccgaatatcatgatcccgtccg

SEQ ID NO: 82673 - DNA, 246 bp, Glycine max
  Peptide Sequence Number=SeqID_199451
atggagctccacggtgcttggagttggagaatggagattgagttgcggtcctttgggggtgaaggaagcaaaaagggggtgcaggaagtaaaagcatcattgcccttttatgtcaactctcacactcaaccgacaacaggtgcttctagttgtggaactgtcatggagctgggaatcacccccagtctcacttctaggatgctaatgcaaattctttgtaactcaagtggacaacaacaatgttag

SEQ ID NO: 82674 - DNA, 462 bp, Glycine max
  Peptide Sequence Number=SeqID_199452
atgtttgagttgggctttagacaaaattataggaagaaccctaaggagagaaatgatgaggtccatgatcatcctgaagaagcagctactgatgatgcagttactgatgccgagggtttttcaggcgaaccccacgacacatcagttttgatggactatcaacgtcttgagttgaagttatcctcccatggaaggaaagttgagaaatttggcaggcctgctccagagattaaaggcttagtggctgccacacgattaagtcctctgattgcatgttcgttggacactagtgatcagggacttatatcggcattcatggagaggagaggtaactattaccttcgacgatgtggcatcgttgttacatatgcccataacagggtcttccacagcttccaggctcttcatgtggatgaagtcatcttgctgttagttgaattgcttgaagttagttcaaaataa

SEQ ID NO: 82675 - DNA, 276 bp, Glycine max
  Peptide Sequence Number=SeqID_199453
atgggtcaaatatgtgttgtgcctagaaagtgttcaacagactacatggagttgttctacataatatctcatcccttcatgagtccagcacagccaagggatcctcctagacttccgcccaaggtgcacgatgacacatttgttgaaccagatgttcctcagcacccggactatattgatgatcttagtgtcgaggaggaagaccctttcgaggatgtgagtgatgctaaagagacattagagatcgaggaagatccatttaagaattattcttag

SEQ ID NO: 82676 - DNA, 1149 bp, Glycine max
  Peptide Sequence Number=SeqID_199454
atgcctctttatttttttgttgatacatacacataccaaagagacagatgtgcacatgctgctttacctaatgattatgcacctgttgtctttcctaatgtttcccatgaattaaaaattgcagaatacagtcctacaatgtctttggagaaaaaaagtgacaggagacataggagaaaacaggatactaatggccaaagtgatatttctggaaatttgaaagtctcagatagagttcaaggtcaagttaaagaaggaaaattgctttcctctggttctaggaataatcttgaggagcagctgaagaaagtagattcagatatcagcactcttcagaaccgaaaattccagctagaggtctatcttgatgagagtgttcaagaagtggatagccttaattctagaattcgggaacttgaagctcaactatgcaaagaggatgaggagtgcaaaagatcacaagtccgacttcaaaggtttggagatcagcttgtctcagacatttctagaattggtgccaacgaagaagatttaagcattgatattataagcaatggtgaaaatactggtcttcatccaatcgctaaacataatgtggagcacaatgatgcatcttcccacaaaaaaaggctgcatattgaacatgatgctttggaagagttaaaacaggatagatcaaaagatgggcatttggttgagacagctagaactaggaagcgttctcgctggaatttatcagatcaattgaaagaggagtctcttggtactccagacaatggaactgaagttactagatctctagatcttgaaggcaagcacaagaaaggattgaagcaacccagaattgaagcgccatcaaccagcatggcagctcatgtggttgacgaggatgttgatattgaacgttatgatggaaatgatatcaatgaaactgcaaatacggaaaatgataatggagcggcatataagctttgctacctcgtagcaattacctgcagtatgaaggcaacgacgagaatgttgatgtggatggttgatgaagaggcaacaggggcacgcatagggagcggtaccttgttcaatgtaggaaagtctctagacttccaattacttcactccaaagtaactgagtggggttatgcgaaataa

SEQ ID NO: 82677 - DNA, 654 bp, Glycine max
  Peptide Sequence Number=SeqID_199455
atgttggaagagattcgatgttatgcaatgagatctatgagtggccataaattgaagttagctgcaagaagtggaccattgtgccctatgcagcaatccaaattagatagggaaaagaaattgagtaacaattggagacctgagtgggctggtgatgacaatggtgcaaggtttaaagtgcattgtgttggaaagaaagttgatgtggatttggatatgcatacatgtttgccatgtatgcatgcatgtgctgcaattaattggaggcgtaaacgccctgaggagttttgcaatcattggttgactttgggtgcatacaatgctacatatcaatttttttttatcaaaccaacccatggagcacaatattggacacctactgagtatgaaaaaccacaacctccaaacaaaaagtcacaaagaggaagaccaaagaagatgagaagaaaggatactgatgaagagctaatttcaaggaagaaactgaagagacaactgagaccacctggtgttgtagcacagccaccaggttcacagcaaccaatgcctaatgttcccttcaacatgtttggatcttcttcaaggtatagaccacctccaattcagcccaactacaacattttgattcgtaatccatcaacatcccagcaataa

SEQ ID NO: 82678 - DNA, 1074 bp, Glycine max
  Peptide Sequence Number=SeqID_199456
atggacagctcaagtgtgcaacaggataatgcatgtaggctcacatgcatatatagacttaattctctggcaattaaggtctcagctaaatacgcacaaatgggtagccagagttgcttcaaggctttgattatttgccttatagcattaattggatcaactcaagctcaattgcagcttggtttctatgccaaaagttgtccaaaggccgagaaaataattttgaagtatgttgtagagcatatccgcaatgctccatcactagcagctgctctcataagaatgcacttccatgattgttttgtcaatggttgtgatggatcagtgcttgtggactcaacaccaggcaatcaagctgaaaaggactctattccaaatcttacactccgaggctttggtttcattgacgcaataaagaggcttgttgaagctgaatgccctggggtagtctcttgtgctgatatcttggccttgaccgccagagactctattcatgccactggtggaccctattggaatgttccaacaggacgaagggatgggctcatctctagagcagcagatccgttacgcagcctgcctgctccatttcacaacctcactacccaactaacactctttggcaatgttggacttgatgcaaacgaccttgtcttgcttgttggtgctcacacaattggtgttgcccattgttcatcaattgcaactcgtctatacaatttcactggcaagggtgacatagacccaacactagacagtgaatatgcaaaaaatatcaaaacttttaagtgtaagaacatcaatgataatacaattattgagatggatcctggaagtcgcgatacatttgatcttggattttataaacaagttgttaagagaaggggcttgtttcagtcagatgctgaatttcttactagtcctatcacaaggtctattatcgatagacaacttcaatcaactcaaggattctttgaggaatttgccaagtctatcgagaaaatgggacgaattaatgtcaagcttggaactgaaggggagataaggaaacattgtgcacgagttaataactaa

SEQ ID NO: 82679 - DNA, 1242 bp, Glycine max
  Peptide Sequence Number=SeqID_199457
atgactcacctggtcactcgcactcaactcgctagagtcacgcagctctctcatcgccccaaacccctcttcttcacaccaaaaccaacactttatcgttcccaaaccctctctctcccccaactctccacactctcctccgccaccttccgccgccgaacgcaccctctcctccgcccgacgatggacccgcaaccgccggaaccttccgcgcccgccgcctcggcggaggacttcgtccacgtcacggatctgaagatggagagcctctccgagagcatggttcgaatcgacgagccttccgaagccgacgccgctccctccgctccggactccgatcgccgtccagccacgctctcgccggagctctcaagaaacgtgctcgtcctgtcgtgcgagtccgctgccgaaggcggcgtctgcgacgtttacttggtcggcaccgctcatgtctccgaggaatcgagcagagaagttcaagctatagtgaattttctgaaacctcaggttgtcttcctggaattgtgctcgagtcgggtggcagtgcttacccttcaaaatcttaaggtacccaccatgggagaaatggttacaatgttgaagaaaaaacataacatgtttgaaattgctagtaagcttgaggtatttcctggctctgagtttcgtgtggcatatgaagaagccatcaagtatggtggcagagtgatacttggtgatcgtcctgtacagattacattgaggagaacatggagtaagatgccactttggcataagacaaaattgttatactctttacttttccaagcagtatttttgcccagctctgatgatcttaataagatgctgaaggaaatggatgacagtgacatgctaactcttgttattcaggaaatgagcaaggagtttccaactttaatggagactcttgtgcatgaacgagatcagtacatgtcctccacattattaaaagtggcgagtgagaatagctcagttgttgctgttgttggaaagggccatctacagggaataaagaagcattggaagcaacctgtcgtggtgggggaacatttagttacttattttcttagctcaatttaccttactggttttcagatgaaggatctaatgacagttccatctcccaaaccagctgtctctgcaacaagaatcgttacgtctattggtgttgccgtagccggcgtggccattatatcgggcatttatctttcatgcaagaaataa

SEQ ID NO: 82680 - DNA, 660 bp, Glycine max
  Peptide Sequence Number=SeqID_199458
atgagcgttttaggcaataccttggctgatctacctgttaatgattctgcacaaccacaggaatgtgcaaagatgccaagtcaattgcaaccagaagatgtaaagagacgaatttcaaatttgaaagtggcaaacaaatgtactatagaggatgggaacgtgggcttgaactatattctagaagaaagacgcgttgatggattgaaccgctcactacagacgttaatcaggcccaataggctttgttgggaaagcctaagtgaaagtggaagtaaggtggataaaaaatataatagaagtgggtctggtaatgctaatataacatatgggtcagctgggtgcatgattgtattaacgaaccacaaaaagttgacgaggaaagtggggctattgagggaggctacgttgttggcaatttgggctctggaaagagcagcaaaagaaaaaagaaaggaagaagaagaggctagcaagttaattctttctggaaggcacatggggatggcactacctagaggagaaaaggaggtgatcgataggatggcaatcaaagagaaaaaagacaaaatgggaattgaggaggtcaaaaggaagcatgggaaaagggaatgtgcaaggattaaatggtatgatgagggaggtggtgaagaagacgtttga

SEQ ID NO: 82681 - DNA, 768 bp, Glycine max
  Peptide Sequence Number=SeqID_199459
atggagcaaccgaccaatgaccacaatgaagacattcatgacgctattcccccatccattaacattttagggagacaactattgcattttaagaacccttttgtccctagcatcatggaagcaactcttccttccaactataagaacttgactatcgagaagaatgatgataccacagacccaaacgaacacatggatgtgtacatcacccaggtgagcctatacaccacggatgatgcaatcctttaccagtcagcctcaccacctaacgtttgtggccatcgccaacatccagcaggagaagaaggaatcatttcggaccaagtgtgggacgatgtctacacctctagtgctgataagatcgagttacaagatccgtgttatgctcattacactccccttactgccactatatcccacatcatggatcaggccttggccgaatgtagcgccttgaaagacaagatagaagaactcatcaagcttggccacctaaaggagtttgtccacacgccacagtcctcgagggagaaaaaagaaagacccattgaccaaccgagacaggtcataaacaccatcgctagaggtttcattggggatgaccccatggttatcagtgttgagataactagcatagtcaagaagatccttgtagaccaaggaagctcgaccaacatgttattttggaacaccttcaagcatatggatatacccgaatccgaaatcctcccaaatgatgacccattgttcagttttgctgaggaatag

SEQ ID NO: 82682 - DNA, 975 bp, Glycine max
  Peptide Sequence Number=SeqID_199460
atgaagaatgtaaaaagtgacattggcaacatcgcccatcttgtcaaaatcgaataccaacaagaagttgattgtctatctttcgatctcgacaaaggccacaagcacgatactggtgcaggaggagggggccagtattggagtagagctgggcttatcttggaaggacccaacgacatggccatggcacaattgttacacttcggcttcaaagccacgttcaacgataaactcgacaagttggtcggttggcaacctcccttaaacctgggtagcttaaaatgttcattctccattcagttcccaaactcagtatctcaggaaaagaatgcttgtacacctcactggccagcaaactatataggagatggttctcctcacctcttctcaaatgtcttgaccaagaaggctaactatgtcttctacgaactacataagggtgtttgcgatttgcattccggtgagaggaccatggccactagagttctaagggggatgtacattctcaggacctttcctacaaccccaaggctgaggagattattgctagtggcaattaattacttcatgaaatgggttgaggctgaaccactaacaaatatcacagtccaagttgtccaaaagttcttctggagaaatatcatcacacgcttcggaattccaaacacgctaatcatagacaatggcatacagttcacagaccgaaaactcaatgagttcttgaggggtcacggcaagtttaagaaacggctggatggagccaagagaagatgggtcgaagagcttgtggagattctatgggcatataggtgcacccctcaatctacaacccaggagatccctttccggctgacatatgggatagatgccaagttttcgattgagaatccagcacaatttgaagaatggagcataaaagttagaataactattcgagaaggtcatcccgagtacttgggaactccaggaatttaa

SEQ ID NO: 82683 - DNA, 480 bp, Glycine max
  Peptide Sequence Number=SeqID_199461
atggatcaagcacttacccttacgccgaagggtcttctattgtgccgaagggtcttctctagtgatttcttgctgaatcctctggtgtgtgagtccgaaagagcggcgacggggggaagggttacttgcaaaaggcattccatcactcaagtcgggcttactgggtctgaggtttgtgagcctgcacatcttgattgccagttgagaaatacacctcttaatcatgcttacgcacttctaatcaaggagtcggttggagacgattttgaggttcgtgggtacaacaacgaagtttttgaagtgttgtcgactctcgctcccgggggtcagatttttctagttccattgacctatcgacaaccaaggggtctagtgacctttgttaactcgttggcaagtgtaccaaatttgtcacaagtcgtaaagtactcggaagtccgagtgtcgaatccacagggactttgtttgtacttagattaa

SEQ ID NO: 82684 - DNA, 516 bp, Glycine max
  Peptide Sequence Number=SeqID_199462
atggagaaagttcaatacaaaagcttaggcaaatttacgtcagagggatctgtttcgaaagtatttacgaaggggatctgttttacatggaagctgtcactgccattggcggtaaagggtgacccgccattgcgaatgacgatacatgcgctgacgtggatggtcctgccatttgcactggcgataaaggctgacctggagtgtctcgccagaagtattggcgatataggttgcagcctagggagaggcgaggtcagaggttcacatgcatgcatacgtagagagtctcaccagaagcattggcgatataggttgcaggctagggcagaggcgcagaagtcaggggttcaaatgcatgcatgtttctcgccattcccagtggcgagactggtgcagtctggattcgccattccaagtggcgagactggtgtagatataagcacttgtgccttgaaaatttccatttccagtggttcctcaagagaagaaagaagaaagcgtgtttcaagtttctga

SEQ ID NO: 82685 - DNA, 244 bp, Glycine max
  Peptide Sequence Number=SeqID_199463
atgaatgcaaagagaaaagaatatatggttggtgtgcttccaaagagaagaatattgatgcggcatggggagtcgcagggaaaccaggacatggcggcttctacgtatccactacgctcgcacccaattgatgctctacgagttcagacggtgtttcttgaagaagaggctcctcggcgtgagagaagagtcacgagttcgagaacgaaattttggaaactttcaggtggaagagaggatgaag

SEQ ID NO: 82686 - DNA, 678 bp, Glycine max
  Peptide Sequence Number=SeqID_199464
atggcggtcgttgctgagactgggacttccctgggagctacatctcggcctaagaggctcccaatgctaaaggagaagcactcgcctcctctgatcatacttttagggtacacgtgggtggacacagaggggatgaacacggatttcttttacatgtatgattgcttgcttcgtgatctgcatgtaagagtcccgtttgatgacttcatgatgggcgtgctctgcatactcaacatggccccgacacagcttcattcgaacgagtggtcgaccatgcaagcgttccatgcactctgcttgtatagcttggggtcttcaaaagccaatcccttgaaggatcggttgcgtgtgctgacgaacgatgccaaagggttggagatgtgtgccataaatgttgaggccttggttaggtctcttaatgctgaggaaatagaggaggctattgctgatacagaaaggattcagcataaggcctttgatgatgtacacaatgcacatgaggccaccttcaaccactgcatttggaaggtgttgcatctatgtaaagtttctgacccgagtgtcttcgatatcaacaaggatgtatatgaaggggagttggtattgattgatgacatcctggaagaggatgttgccccttcacccgagaggccatcgactctagtggaggacccatag

SEQ ID NO: 82687 - DNA, 378 bp, Glycine max
  Peptide Sequence Number=SeqID_199465
atgtcgtacaacatacttcttggttgtccttcactcaaagccctaggcacagttgtttcaacccttcacctcacgatgaagttccagtcggacactgggatcatcataactgtgcatgctgaccagaggacggctagagaatgctatatggcgagccttaggttatgccttcatacaatggaaggagcttcaaaagtcggccattgcatggaggctaggatgaaagttgaggaggtagaggaactagagctcgaccccaaaactaatgatgacaaccaagtgaaactagtagaaaagacatccgccttccagcttggacctaaggaaggatggatcattcaattggaaaaccagttacccaataatgacaacagctga

SEQ ID NO: 82688 - DNA, 228 bp, Glycine max
  Peptide Sequence Number=SeqID_199466
atgcatgggagatgcaagcatatcgatgtaaggtttcacttcttaagagatcttgcaaaagaaggagttgtaaaactgaagcattgcagcactcaagagcaactggctgacataatgaccaaagccttgaaacttgacagtttttgcaaactaagggaggagttgagcatgtgtgatgttaaagattgtaagggaggatttgttaggataagagaagcttgggcttag

SEQ ID NO: 82689 - DNA, 378 bp, Glycine max
  Peptide Sequence Number=SeqID_199467
atgacggtttccaaactcagaaatgatgcaaagacaagttggaagattccgcttcggttgaagggttcctctcggtgtgggatttcaacgaagaacaacggtggtttatggtggctaatggtggctgtgggtgatggagaaagtgcttgggacgttggaaatggttttggaagaaagaagaagaaaaaaaatggtgtttttccaaagctacttggactacaaggcacaaaacgcacaaatgagcaatgctctcggaaacggaaacttcgtgcacactcaaaacatcttctcaaagatcccaacggtcagatcttggacaagtgttctgtgaagatccagaccaaatttcgagaagatccaacggttaatgaaggctga

SEQ ID NO: 82690 - DNA, 999 bp, Glycine max
  Peptide Sequence Number=SeqID_199468
atggatcgagtcgtcatctctattggtatttcctcatttgaggatattcatcgtggtgcctctgatagcgagtcctcctcttcggagaaagtaaggtctcgtatcggactggtgggggcacttcctatccttgcgggaggagaggtagcgacaatggagatgccagggcgtctccccacgtgtgatgtagccatagtgctgggtcactgtcatccacccctcttgtcgctagctatgaatggtgatgacttcccattcttgagggcagcgttgggcagcctgcctttctttttcatgtataaatgtctatttgaggtcttgggtctcattctccccttgaccactttccaatgtgctctgcttgagcacttgaatgaggccccttctcaatgccacctaaatagttggacaatgttgactgacaagattagatgggtctccttgaaccgtgtgtccaagaagttgtttgagtttgactcaaacatctttcatcattttaaggattgtttctttaaggtcttagttactgatgtcgtggctgatggtatgccactgattttcaatagggatgcgaagccccacttcccattctactggccactcgtgaagcaggtcagacttgtaggtgggaatatgccatcgtttactgctgcacttgttggagaagaaggtcaacctactggtgaggttggccctattgctattgttactgaggttaaccccaacgctctttcctctattttggcaaagaggaagtgggatgatggtgctgggtcgtctggtcgtaagaagtcgaaggcccctatgagcctttgtgccctgaggcaggttgcagggttgacgcccagtgcgggtcacccttctatcgtgctggatgtgcctccaactccatcaaccattgaggctcctgtggccgctcctgttatcattgaagttagggtgctagctgttttggctggttttgttgtggcgtcgtcctccaccgttgctgcaccttag

SEQ ID NO: 82691 - DNA, 471 bp, Glycine max
  Peptide Sequence Number=SeqID_199469
atgaagggcttgcccatcaacgacattaggaatacttggcaaaggatggcattggtcgtggtgtacaggctcacctgggtaatgtacacgatcaggtgctcgtctgagtctgtggtgtcgtcgtacttatcaatggtcaagttcttccagttggaaggaagagttgcctccatgatgctagggatgaaggagttctttaattgcaacaactgtcttcctaggcctcaggttgtcgtgacctatgtgcctcccgaaggtgagcgctctcgcgtcgaaggctggttgctttattgcggcggtgttcattccagttatggttatacccataaattcttggggtcaggatatatgttacttggccctataatgggtgccaaaaatgttcctgtcacaaatggattgggtactcgtccttctaccgaagggtcttctactgtgccaagaggtcgtttgctttttgttcctagttaa

SEQ ID NO: 82692 - DNA, 924 bp, Glycine max
  Peptide Sequence Number=SeqID_199470
atggaggcaactcttccttccaactggaagaacttgaccattgataagtacgacgacaccacagactcagacgagcacctgatcgtgtacattacccagctacccccaaactccatggacttgttcgacaccttggtcgctcgctttggcacaaaggttgcagtgaatatccaaaacttgaactcagtagtggctatgcaccacttgataatgatgttacaatcgataccttttgtcaacagtttatgcaaaaaacctgcatctaaccttgacgaattacaaatgagagtgaccaaatacatgccgatgaacgaattggatgaataccaaaaccaggtgcgggccgaggcagtgtcagccaagaaagataatgacaagcctggctctaacagaggccatgacgaagggaggagggatcgaccaccacaagagtcgcattttacccagtacatccctcttaccgccaacaaatcccatatcatggatcaggccttagttgtcaatattttgaccatgctcaagaaaaccaacaccccatcgaaggctgactactcaaaacattatcggtatcattgcaattgtggacattcaacagaaaaatgtagtgctctaaaggataagatacaggagttcatccagcttggccacctgaagaaggagaaagaagaaagaccctttgaccaatcgaggcgggtcataaacaacatagttggaggcttcactgggggtggggccacttcctccacacaaaaaagacaccttcagcaattccagtttgtcaacatgatctcctggcaccaagtgcctaacatgccgcctataaccttcacaatcaaggacttcaaggcaattgaaccagtgcaatacaacccaatggttgtgggcgtggagatagctaactgcatcatcaagaagaccttgtag

SEQ ID NO: 82693 - DNA, 603 bp, Glycine max
  Peptide Sequence Number=SeqID_199471
atgggtgctgaatggcgtgaagacactgtgcaaagtactgtacaaacactgcacgtcactatgaagcgttggaaatcctccgattacattgtgcatgacactatgcacgtcattgtgctcgttagaaatcctgcagagacattgcaaatcattatgttggccacgattcctgcagagacactatgcacgccactgtccgcgtcattgtgctcgtcaggaatcctaccaagacattgtgctcgtcactgtgcccatcaggattcctacagagacactatgcacgtcattgtgtgcgtcactatgctcgtcaggaatcttgcagagacactgtacttgtcactatgtccatcaggaatcatgcagacactgcgcgtgtcactatactcgtcaggaatcctgcaaggacactgcccatcaggaatcctgcaaaaacactacacgtcactgtctgtgtcactgtgctcgataggaatcctgcagaggcattgtgcttgtcactgtccctgtcaggaatcgtacaaagacactatgcgcgtcattgtgcttgtcatgaatcctgcacagacacgatgcttgtcattatgtccgtcattattactgtag

SEQ ID NO: 82694 - DNA, 399 bp, Glycine max
  Peptide Sequence Number=SeqID_199472
atgcatcgagtttggaaagatatttggaattcaagacataacatgttgtattctgccgatgttgctgatgatgctacactacacttgtcatttcattcaaactatatggtacgatatcgagttcgaacaagacgatggatcaacaaggaaagagtaagggtaggttatacggctgatacagcaaagcgaatgcatcatattgcgactccacaacaccgacaaggtaacgttgttaacgaagttagaagtggtgtcggaaatgtattgcaagctctgaatgaaatggatcgtatagtcgtgccaacacaacaagcccctccagaaacacatcattttccacaatcatcggataatgttgataccggcgcgggtcataaggaaggacgtggacttcattga

SEQ ID NO: 82695 - DNA, 507 bp, Glycine max
  Peptide Sequence Number=SeqID_199473
atgaatgtggctcccaaatgcaaagatatggtctggcgagcatgttgtaaaattttccctgttaaagcgaacttgagaaggaaaatcaacacaatggatcctattttcccttgttgtggagagaaggaagaaaacatggagcatctctttctgaggtgtaatgatgttagaagggtgtggtttgggagccagttgggtgtaagaatcaaccagcctaacatgtcttctaacctttggctctcgaagtggttaaggaaaatagatgatgtcgcggcccaacaagtttttggccttctctggaagagaacactatgctttttcagagctagtagcatcacaagatatcttgtggaccccaccaaacaggaaaaggctggtaaaatcaattttgatgctactatgagacaagacactggcgttgggatgggtatcgtttgtatgaattactgtgggcaggtcttaacatcaccacaaagatgttacctcactatcaaagtccttaagtag

SEQ ID NO: 82696 - DNA, 357 bp, Glycine max
  Peptide Sequence Number=SeqID_199474
atggtggatgagccacgctcgagaccaatcacgtgcgagccggtcagttctggacccatcgacgaccctttgcgtgcacgcacggctcccaacgagacctcagtctggagaagcgtcctcagtggcggaccgggcccaagtcccctggaaggggcgccagagagggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaagtaccgcgagggaaagatgaaaaggactttgaaaagagagtcaaagagtgcttga

SEQ ID NO: 82697 - DNA, 333 bp, Glycine max
  Peptide Sequence Number=SeqID_199475
atggcgctgcggcgaattcttttccaccgcgacggcgtcgtgcagcagtaccgccgcacagagaatgcgccggtcgccgccttccagcttgctgatccggcggcagttcttccagacccggtgcagatgcgccacgtcatgcgaaccgtcgtccgactcgaggctcttgcgtcagcgagggtaaagacacgttcagctcctgttgggggaaatcggtcaatcagcatagccgcgccggatgccgggagaatgacagaaaaacggctattgtttactaaagtgcaacccactattgtcataactgcggtttttgcagcgaaacaagcaacctag

SEQ ID NO: 82698 - DNA, 403 bp, Glycine max
  Peptide Sequence Number=SeqID_199476
atggcggcggagcaagccacgctgacgctgacccggctggaatgggcgccggcggatatcgcggcggtggctcacgccatcgaagcgcacagtttttccgccggcatccccccgcaaacgctggaggcgaagatcctgcaggatgccgatcgcctcgacgccataggtcttatcggcgtggcgcgctgcttctatatcggcggccgcatgcgcagcgcgctgtacgacgccgccgatccgcgggccgagcatcgtcaatatgacgacaagcgtttcagcctggatcacttcgaaaccaagctgttcaaactgcaaagacggcttccagaccgccgccgggcggcacatggccgagcagcgcaccgaacgcatgcggcgctttgtcgacgatctgctggaagag

SEQ ID NO: 82699 - DNA, 156 bp, Glycine max
  Peptide Sequence Number=SeqID_199477
atgccgttcgctgtcctgataggggccggtatgccgcgggttagcggtgacgaacaggctgacggtggcggttttcaacgccacggcgaggtggagcgggccggtatcgcccggtcaccagtacctgcagattggcgatcgtcgccagcagttgcg

SEQ ID NO: 82700 - DNA, 1074 bp, Glycine max
  Peptide Sequence Number=SeqID_199478
atgcacgtgccggttgacagcgccgcgctgagtgccgctgagcgacgccaaccgctcagcatcatcgcggcggaacagcataaacagaaacaggcccgcctcccaacgccgccctgcgcgccagtgcgcgatggcgagccgcgcgccgtatcccagcagcgccagcaacaacaggaaccccacgcagccgcccttcagcaacgcgccaaggtacaggctgtgcgtggtgtggttcagctcgccggtgtaattgagaaagttaagctgcttgtcaaagccgtagccgaagaacggcgcctgttcgatcagcgccaagctgtggcgccagatgctgatgcgaacaaagctctgttgatacagctcgccaaagcgcgtcagcaacatttcgccgatcgcactgtaaacgacggcgagaaccacagccagcgcgccgggcaacagaaaccacagccaccgtcccggccggtgtcgataaggcatcgccaccaccaccgcgagcgccagcgcgatcagcgggccgcggctttgcgtcagcaccatgaatgccagcagcggcgggataaagcacagcgccgctttttgcccggtatcgcggaaaatcatcaggctcaacaaaatggcgatggcggcgtaaccggccagatcgatcacgttgctcggccccggattgcgggcggtggtttcccgcagatgataaatcgacggggcgtcgaccagcgtcagatacaagcacagcgccgtcatgccggccagcatcgcccactgcagttgatgacgccgctcaccgtcgagcagcgtcaccagccaggcgagatagagcaggatataagcgctgtgggtcagggccgacggcatgtcgcccggcgtctcgccccacaacgcgctgagggaataataaagcaaaaatatcagcgccagcccgccgcccctgcgcgcctgacgattgtcccacagctgccgccgcagcggcggccaggtgaacacggcggccagccacagcagcgccgccagatgaaacaggttattgacgcgggtctgcccgcaaaagatcgcgctgaaaaacgcgaaggctaa

SEQ ID NO: 82701 - DNA, 586 bp, Glycine max
  Peptide Sequence Number=SeqID_199479
tggagatgtggtcgatagggaggaccagaagaaatttctagatagtgttgattttctctctcagcatggtatgcctgccttgatttctgatatggaagcagcaacaaaagaagttctcaaaggaaagcagttgagtactttcttcaacagcacaacgcttcatgaaactatcatgcagatactcaacaccttcatgagcatggggactccaaattcctggataaagtatatgatacctgaagatgttagaccgtattccacaacctctggcagtgatgacccggtaccatttgacgtgactgaatttgaacaacttatgattgaagcacgggcagtattatcaagtgctgaatttggaagcattgtagagatatctctgaaagcagtggtggatacactggtggagcttatgaggactaaatttagtggaggaagtgtagctgagggcatgccgctggccagagtgttgcctcaagttgcacagatattgcctttcaaatgttctaacagtgctagtgtttgctcttgtagattctacatcatgatgagatatgcaagagttgttcaatggtgtccaatattttga

SEQ ID NO: 82702 - DNA, 981 bp, Glycine max
  Peptide Sequence Number=SeqID_199480
atggcaaaaagggtcttgtacaaggatttggttccttttggggccatggtggccacagagtgcctcaacgttgccttgaatacgctgttcaaagcagctaccttgagagggatgagttaccatgtctttgttgtttatgcttatgctgttgctgctattgttctcattcctgcaccctttatctcccaaagatcaagagtgcttcctccgctcagtttccccctactacgcaaaattggtcttcttgggctaatagggtgggtgtgcatctcagatcgtgggatacactggcatcaatttcagttcccccactctctcctcggcaataagcaacttggtgcccgcttttacttttttgcttgccatcattttcaggatggaaaaggtgattgtaagaaatacaagttgccaagccaagatccaagttgggcaattggtggccttctactgacagcagagtatattctggttccattgtggtacattgtacaggtgcaaatcatgaaggtgtaccccaatgaactaattgtcatcttcttttacaatttatgtgttagcattatggctgcaattgtagctatatttactgagacaaatgcaggcgcttggaaaataggagtggatacagcattggcttccatagtttgctctggaatttttggttcattcgtgaacaatgtagttcacacatgggtactgcgtataaaggggcctgtctatgtagcaatgttcaagccactctcaattgccatagctgttgccttgggagtcatgttcctgggtgatacactccaccttggaagtatagttggagccacaattatatcgattggattttatactgtaatgtggggaaaagcaaccgaagagaatgtgggggaagatgtccctggccagcaatcaccaaccacagaaaacgttcctctcttgcaaagctgtaaaactgatacagctgagaagaaaatgcatggaagtgtataa

SEQ ID NO: 82703 - DNA, 861 bp, Glycine max
  Peptide Sequence Number=SeqID_199481
atggcggatggaagcaacgggggagttctaatgctggaagccccaccgtcttacggtaggcctaccggttctaacgcggaaataatcgacgcattgccttacattgatgacgactacgcagaccccagagtcaaacttgaggttgaccgtctcgtggaggatgagatgcgtcgcagcaccaagaagcccaccgatttcctcaaagatttccctcctcttcccaactccaatttccagcagaactacccaatgattgcgagagagtacgaacgtgtgagagccggaagacctcccgttgctcttgatagatcgcgctacgaattggaaatgccgccggcgaataaaaggaacgacgaaactgcttggaagcaagctcttcatagagctcaacacctgctgcaatatcagattatgaggatggaaaatttggatttgatgttaaaatatggtcccgatacctggaaacaacacaaccaaagattggaagtatacttatcaagaatgcagaaattagctcaggaacaaaatgaaaagattgaaaaagtaaaccgtgaaaggaaatatcatcagcaaaacactgcatatgagcttaatgcgttgtccatgcaatggaaggagctttgtcagaagaatatagacatcagtgctgcctgtgcttcagttgaaaatcgcataaatgaattgaaaagaggagcagcagaaagtacagatctgggtttcactaatccagttctagtccagcctaccatcatcctcatttcctccaatggcttccatttcgactacatgttcaagtccccaactcacaacatccaccgtttaatcctaaacggcactgaggccgaattaatagcatcatag

SEQ ID NO: 82704 - DNA, 399 bp, Glycine max
  Peptide Sequence Number=SeqID_199482
atgctttctgtgagggatttttggaggcggcataggaggaaggttttcgtcactgttggtgttttaggaagtgggtatcttttgtataagctctacggtgctcacaggcatggggttcaggaacttgaaagagaactcgcagttcagagggaaactgaggagcttatgaaggctcagatgcaagctcactttgagaatattcagaggatgtctgatgtaacattgccgcatgctatgcacgagttaagttgtcggatcacagaagagttggatctttctcaccttcttgaaaggttaatacaaggaaagggtcaaccaaacaccttaacccaatcagagaaactagatttatggagtagactcaaaattctaagtatgaatctggttttacaagaatga

SEQ ID NO: 82705 - DNA, 288 bp, Glycine max
  Peptide Sequence Number=SeqID_199483
atggagttgcggcggaagataaaggagaagaggaatattctaagaatatgcctaaggcatcttagtatattccctttagatgccacaagcatgaagcatggaaggtgtgactctagcacatgggaagcttctttgagaagcaagaaaggtagcttccttgagaagctagggggggggggggacgtgcatttcttccttgggaaggaaggaagacaagttgggcttggcccaggaggaagaaaggacgaccaaaattcatctggcttggggaggcccaagtctagatga

SEQ ID NO: 82706 - DNA, 1251 bp, Glycine max
  Peptide Sequence Number=SeqID_199484
atgatgaacctccagaaccccctaaacgtgtccgtgtacggggaccacgcctaccccgccaccgtggcgcgcttttcccccaacggcgagtgggtggcctccgccgacgcctccggctccgtcaggatctggggcacgcgaaacgacttcgttttgaagaaggagtttagagtcctctccgctcgcatcgacgaccttcagtggtcccccgatggtctcagaatcgttgcctgcggcgaaggcaaagggaagtccttcgtccgcgcttttatgtgggattcggggactaatgttggtgaattcgatggtcactcacgtcgggttttgagttgtgcttataaacccacgaggccttttcgcgttgtcacttgtggagaggattttctgcttaacttttatgagggacctccctttagatttaagctgtctcacagggatcattcaaattttgtgaattgtgtaagatattctccggatggcagtaaatttataagtgtaagttctgacaagaagggtatcatattcgatggaaacagtgcagagaagattggtgagttgtcttctgaaggtgggcatactggtagtatttatgctgttagctggagtcctgatggaaagctggtgctgactgtatctgccgacaagtctgcaaaagtatgggacattactgaggacaataacggaaaggtgaagaaaacattgacttgtcctggcactggtggagttgaagacatgctagtggggtgcctatggttgaatgattatcttgtcactgtttctcttggtgggacaatatctatatttttagcaagtgatcttgataaagccccgacagcattttctggacatatgaaaaatgtttcctccttaactattcttagaagtaaccctagagtgctcttatctagcagttatgatggcttaatagttaagtggattcaagggattggatatagtgaaaaactacaaaggaaggaaaattctcaaatcaaatgcttagcagctgtagaagaagagattgttacatctggattcgataataagtatattggtagtaaagtttctgacagggcacttgggtatggagctggattagaaaataaggtggaacagtacttggaccaattgttggatttggacccaagcacaaacaagcctaagatctggaaagtttattccaggagacagcaaaagggaatagggagaattagttatgctgacttagcaaattggttagggtcaagtagttga

SEQ ID NO: 82707 - DNA, 834 bp, Glycine max
  Peptide Sequence Number=SeqID_199485
ggtttggggaaagatgctgcttaccaccaactagacagagactatagactaaagtgtgtcaaactcactatgatactgacactactgcctcctccaaaatcaccattcttgaatacccttttgctcctctgcactactctcctcctcccaccttgctacctggctctccctgaccctgatgctgatgcggttcagccaatcatcccaaacccctcatcttcaacaggaacaatccctgcattcccagaacaagctgatgctgcagggtgccctctcagcctctcagatgagcactacgaaggcataaagagtgcatgtggctccaacaaacatgctgcagatgatgatgatgacctccaccgtagcagatgctgtcctgtgctggcagcgtggctctattctgcatactcagccactgcccttagtggtggaatgcaacatgaacgtgcctcaaagggccataccacatcctatgacatgcccttgttgcctgatgattcagaaacatgtgtgagtgacttggggaaggccttgaaaattagaggaatccagctttttcagcccaatgagacttgtgatctggtctattgctactgtggcattaggcttcaccctttgacctgtcctgagtcattctcagttactccaagtggaactcttgttgtcaatcaaagtgtgaaaagattggagagggattgcttcagtagcagcaccaatgtcaataagtttcccggcctgggaggatgctccaagtgcttgcatagtctctattcgccatttgtattagcagatagcagtagccctcctcctaccgcccctcctttgataatctag

SEQ ID NO: 82708 - DNA, 517 bp, Glycine max
  Peptide Sequence Number=SeqID_199486
atggtggcgtctctggtgctctctagagctcctcctctgattgctctgttagggttcttttctccctcaggaactggtcttggaaatcctgtcatggcttctgatgcgactcggtgcaccttggaagatcttccagaaacacctccgtcctctacacaacgtttactgaacgacccatcatccatagttgattatggtggtggctccccaaccaatcacaattatgaggtcattgaagtctgcaatggagacctatatctcatcaacagagagactgtgtcctattttggaaccccgctactaggagacacctacaaagtggttgaggattgcaactcactggaaacggaagtgagaattcaccgtctgggtcacaattgttggaggatcgttgtaagatggagtggttttcctaaattaaggaatgttcatggggctgtttatgcctctgtgtcaccacggaaatcattatttctctgtttggcaaatgaaggagtcttggactacattgctgaat

SEQ ID NO: 82709 - DNA, 213 bp, Glycine max
  Peptide Sequence Number=SeqID_199487
atgccccaaccacatgggatcaacatgggcttaaaggagcactcaaaccgagtatctttacccccaaggcctagactccgaagaatccgtttgggcctcaccttcctgattcagacactgtttatgagttatataatacccacgacctcactcttatatttcaacatatttaacaaaatgcgctacagtttaacccttcaggatcctaactag

SEQ ID NO: 82710 - DNA, 1947 bp, Glycine max
  Peptide Sequence Number=SeqID_199488
atgggtggtggaggaacactcgtggaagggattcgacgcttgtttcaacgacgcgcttcttcttcttcttcttctgaccatcacgaccacaacaatgtcaatgccaataatagtctcgtcttagtgagagatttgcgcgcgcaattggcttcaattccaaacacgcttcaccccgattccgattccgatttcgatttcgatttctctaccttgaagcccatcaaagttccctcacaaatccccttcagaccctcttccatggatcatcacaaaaagggtgcaccagagacagagttttttaccgagtatggagaggcaagtcaatatcagatccaagaggttgttggaaaaggaagttatggtgttgtgggttctgccattgatactcacacaggtgaaaaggttgcaatcaagaaaatcaatgatgtttttgagcatgtatctgatgccacgcggatccttagagaaattaagctcttgcggttgcttaggcatcctgatatcgtggaaattaagcatattatgcttcctccttcacggagagagttcagggatatctatgttgtgtttgagttgatggaatctgacctccatcaagtaatcaaggcaaatgacgatcttactcctgagcaccatcagtttttcttgtaccaacttcttaggggcctgaaatatatacatacagcaaatgtgtttcatcgtgatttgaagccaaaaaacattcttgctaacgctgattgcaaactaaaaatatgtgattttgggcttgctcgagtttcatttaatgatgctccatcagctatattctggactgactatgttgcaactcggtggtaccgtgcacctgaattatgtggttcttttttctcaaaatacacccctgcaattgatatttggagcattgggtgcatatttgcagaaatgctcactgggaagccattgtttcctgggaaaaatgttgtgcaccaattggatctcatgactgatttgcttgggactcctcctcctgagtccattgcaagggcttgtgacatgattcgaaatgaaaaggctaaaaggtatcttaatagcatgaggaaaaaacaaccaattccattctcccaaaaatttccaaatgcagatccattggctcttcgtttgctggagcgcctacttgcatttgatccaaaagatcgtccatcagctgaagaggcattatctgatccttacttcactggcttggcgaacatggaccgtgaaccatccactcaacccatttcaaaacttgagtttgaatttgagagaaggaaattgaccaaagatgatgttagagagttgatttatcgagagattttggagtatcatccccagatgctccaggagtatcttcgtggtggagatcaaactagcttcatgtatccaagtggggttgatcggttcaagcgacagtttgcacatcttgaggagcattatggcaaaggtgaacgaagcactccaccattgcagagacagcatgcctccttacctaggcaagtagagcgagtttgtgctcccaaggatgaaagtaaacaaaacaacgattctgaaaagccaagtggatcaaatcttcagcagagtcctccaggttctgatgagacaggtgctcaaaatggaacctccaaaccaaactacagtgcacgtagcttgttgaagagtgccagcattagtgcttccaagtgtgtagttttgaaacaaaataaagatccagaggtagctaactctatcttttcaagtgcatggctatttgctgagagaagttattatatggtcaagcaagagccaattacggaggtaaatgatgaggcagtggatggagtgacaggagacaatgttagcaaaacatgctcttcccctgtcgttggaggcctcagatacaacgcattcgactccgctaagaaactgcaggttgtgcagttgtgggtttattaa

SEQ ID NO: 82711 - DNA, 4553 bp, Glycine max
  Peptide Sequence Number=SeqID_199489
ctgttacggtatctattagtggaataagctgttatgatcctactattaagcatgctacctacaaactcgaatctaatgctagacatggaagaaggtggctactagtggtagtaggtgtaaaaacgatgcgcgggaagtttaacctgagacagttacatagcagcatctttcatgttcaacgaccaaccaattatccaaaaccccatttcgaagacccacacactgtgaaatgcaccaaagccatctctacccacatgcgcaatggccactgcgacttggctctctgtgtcttcgacgccatgccgcttcgaaactctgtctcttacaacgccatgatttctggatacttgaggaacgcaaagttctcccttgcaagggacctgtttgacaaaatgccccacaaagacttgttttcatggaatctaatgctaactgggtatgccaggaaccgcagactccgtgatgcccgcatgttgtttgattcaatgcccgaaaaagatgttgtttcctggaatgccatgttgtctggttatgtccggagtgggcacgttgatgaggcaagggatgtttttgataggatgcctcacaagaattccatttcctggaatgggttgcttgcagcatacgttcggagtgggagactcgaggaggctcgtcgcttgtttgagtccaaatcagactgggaattgatttcttgtaattgtttgatgggtgggtatgtgaagagaaacatgttaggtgatgctaggcagctttttgaccaaattcctgttagggatttaatctcctggaataccatgatttcaggttatgcacaggatggagatttgtcacaggctaggaggttgtttgaggagtctccagttagggatgttttcacgtggacagcgatggtgtatgcatatgtgcaggatgggatgttggatgaagcgaggagagtttttgatgaaatgccacagaaaagagagatgtcgtacaatgtcatgattgctggttatgcacaatacaagagaatggacatgggaagggagttgtttgaggaaatgccttttccgaatataggttcgtggaatatcatgataagcggctattgtcagaacggagatctagcgcaagctaggaacttgttcgatatgatgcctcagcgtgattctgtatcttgggcagctattattgcaggttatgctcagaatggtctctatgaagaagctatgaatatgcttgtggagatgaaacgagatggagaaagtttaaatagatctaccttttgttgtgctttgagcgcatgtgctgatatagctgctttggagttaggtaaacaagttcatggacaggtggtgaggacagggtatgagaaagggtgtttagtggggaatgcacttgttggaatgtattgtaaatgtggctgcatagatgaagcttatgatgtgtttcaaggagtacaacataaagatatcgtctcttggaacacaatgttagctggctatgctaggcatggatttggaagacaggctttaactgtatttgagtcgatgatcacagcaggtgttaaaccggatgagattaccatggtggttcttgcattgataagagtcatacagtgtttcccttctatattggctattttcttttctaaagttatcccaatctttcagctaggttttctttctgcaggagcaagtgaggttggtgttctgtcggcttgcagtcatactggcttaacagacaggggtactgaatattttcactcaatgaataaggattatggtataacaccaaattcaaaacactatgcttgcatgattgatcttctcggtagagctggttgtctggaagaagcacaaaacttaatcagaaacatgccttttgagccagatgctgcaacatggggagctctattaggtgcgagtcggattcatggcaatatggaactgggtgagcaggcagctgagatggttttcaagatggaacctcataactcaggaatgtatgttcttctttcaaatttatatgcagcttcaggcagatgggtcgatgttagtaagatgagattaaaaatgaggcagattggtgttcagaaaacaccagggtatagttgggttgaggtacaaaacaagattcatacattcacagttggggattgttttcacccagaaaaaggtagaatatatgccttcttagaagagttagatctaaaaatgaaacatgaggggtatgtttcttcaacaaaattggttttgcatgatgtggaagaggaggagaagaagcatatgctcaagtatcacagtgagaaattagctgtagcatttggaattctgactatgccctctgggattctcatcgctatcaccacttcagtgagggtatttgttcttgtcgggattactgaccctgacattgttacatggaacaaagccatttcttcccacatgcgcaacggccactgcgactccgctctccgtgtcttcaactccatgcctcgccggagctctgtctcctacaacgccatgatatctgggtacttgaggaacgccaagttctccctcgcaagggacctgtttgataaaatgcctgagagggacttgttttcctggaatgttatgctcactggatatgtcaggaaccgcaggctcggcgaggcccacaagttgtttgatctaatgcccaaaaaggatgttgtttcctggaatgccatgttgtctgggtatgcccagaatgggtttgttgatgaggcaagggaggttttcaataagatgcctcataggaattccatctcctggaatgggctgcttgcagcttatgttcataatgggagactcaaggaggcacgtcgcttgtttgagtcccaatcaaactgggaattgatttcttggaattgtttgatgggcgggtatgtgaagagaaacatgttgggtgatgctaggcagctttttgaccgaatgcctgttagggatgtcatctcctggaacactatgatttccggttatgcccaggttggagatttgtctcaagctaagaggttgttcaatgaatctccaattcgggatgtgttcacatggacagcgatggtgtctggatatgtgcagaatggaatggtggatgaagcaagaaaatattttgatgaaatgcctgttaaaaatgaaatttcttacaatgcaatgcttgcgggctatgtgcaatacaaaaaaatggtcattgcaggggagttgtttgaggcaatgccttgtcggaatataagttcatggaataccatgattaccggctatggtcagaatggtggtatagctcaagctaggaaattgtttgatatgatgcctcagcgcgattgtgtatcttgggcggctattatttctggttatgctcagaatggtcactatgaagaggctctaaacatgtttgttgagatgaaacgagatggggaaagttcaaataggtctacttttagttgtgctttgagcacatgtgccgatattgctgccttggagttagggaagcaagttcatgggcaggtggtgaaggcaggatttgagactgggtgttttgtgggaaatgcacttcttgggatgtattttaaatgtggcagcacagatgaggctaatgatgtgtttgaaggaatagaggagaaagatgtcgtctcttggaacacaatgattgctggttatgctaggcatggatttggcagacaggctttagttttatttgagtcaatgaagaaagcaggtgttaaacctgatgagattacaatggttggtgttctgtctgcttgtagtcactctggcttgatagacaggggaactgaatacttttattcaatggatagggattacaatgtaaaaccaacttcaaaacattatacttgcatgattgatcttcttggaagagctggccgcctggaagaagcagagaatttaatgagaaacatgccttttgacccaggtgctgcatcatggggagctctactaggtgcaagccggattcacggcaatactgaactgggtgagaaggctgctgagatggtttttaagatggaacctcagaactcagggatgtatgtccttctttcaaatctatatgcagcttctggcaggtgggttgatgttggcaagatgagatcaaaaatgagggaagctggtgtgcagaaagtaactggatatagttgggttgaggtacaaaacaagattcatacattctcggttggggattgtttccacccagaaaaggatagaatatatgccttcttagaagagctagatttgaaaatgaggcgtgaggggtatgtttcttcaacaaaactggttttgcatgatgtggaagaggaagaaaaggagcatatgctcaagtatcacagtgagaaattagctgtagcatttggaattctgactataccagctggcagaccaatacgcgtcatgaaaaacttgcgtgtttgtcaagactgtcataatgccatcaaacacatatccaagattgttggaaggttgataatcttaagggattctcaccgctttcaccacttcagtgagggtatttgttcctgtggggattattggtaa

SEQ ID NO: 82712 - DNA, 357 bp, Glycine max
  Peptide Sequence Number=SeqID_199490
atggcaataaagaacccatctcactcctctacctcagatagtgaaaacattccctcaccctcaccttctacccataaacataaagggaaaggaaaggcaatagaaggtgttgcgataagttcaccaaagaagaagagctctatgaaagtaaagaagtctggacaaaagagaaggaggccacaatatgaggttgctgccttgttcaaagataggaagttgttggagaagtttgatatcagatggaggtggatgagggtctttgatgtccatgaacctaaccacccgaggctggttagagccttctttgctgctattgtggtcgacagtagtaacttcacagtgaagactactttgaag

SEQ ID NO: 82713 - DNA, 366 bp, Glycine max
  Peptide Sequence Number=SeqID_199491
atgatcaaaggagttggtaaaattgaaatagcatctggagtcaatacaagaacttctttgaacaaagaaaaagggatgatggcactcttctcaacaattgagccaaaatcattgataaaagcactgagcaaatattcttgggttatttccatggaaaaggaattgagtcatttcataaagaacaaggtctggagccttgtgccccctcctaagagtttgtcagtgattggaagcaaatgggttttcaagaacaggcttaacaaatatggagaagtagtaaaaaaaaggcaagattgttggctcaaggatacgattaaaaggaagggattaactatgaagaaacccttgcaccagtatcaagactag

SEQ ID NO: 82714 - DNA, 279 bp, Glycine max
  Peptide Sequence Number=SeqID_199492
atgagcatgatgggaaagctaaagttctttcaaggacttcaaatcattcagaaagatgatgacattttcattgatcaagagaaatacacagaggaccttctaaagaggtttagaatggatgaagccagaccaatggctacccgtatgcgtccatccactacctttcacaaggatgagaaaggctattgtgatgctgattttgttggtgataaaatagaaagaaagagaacatgtggtgcttgtcaattcctagggaaattgctatgtaatggtctttaa

SEQ ID NO: 82715 - DNA, 1735 bp, Glycine max
  Peptide Sequence Number=SeqID_199493
atggctgatgcatttgatgaagagtgtgattatctcttcaaggctgttttgatcggagactctggagttgggaaatcaaatatgctctcaaggtttgcaaaagatgaattccgcttggattccaaacccaccataggagttgaattcgcttaccggaacatcagggttggagacaaactcatcaaagctcaaatatgggacactgccggccaagaaaggtttagagcaatcacgagttcatactacagaggagccttaggggcaatgctagtgtatgacataagcatgagatcaagttatgagaatgtgagcaaatggctactggagctaagggagtttggaggtgaagacatggtggttgttctggtgggaaacaaatgtgatcttgatgaatcaagagaagttgagaaagaagaaggaaaagggtttgcggaaacagaagggttatgcttcatggaaacctctgctttaaagaatctgaatgttgaggaagtgttcttacaaatgatcacaaggatttatgacatgacaagccagaaaaatttggcagccaaaatggaggagcaaccgattaatcttttgaatgggaaagagatccatatagctgatgaaggcaagatcatgggaccgaaactgaagcagtgtgattcactcaacatcgattggcccaacaaaacacgtttccatcacccgcatcaagcggctgaatcgcttcgcaagaacgagggttttcggtcggaggaaccgagcattgatgctcccgccaaatcagggagcggtgtgtctctgaaagatcaattgaagaagaagccactggagagcaatgagtatcgtggaaaattgcgcagtgatcttaattttaatgggcttaaagctacagcaagtgcacccaaactatctcccaaatctggccctaccctaacagatgatgattggactgaactcctaagtgcacctacacctactcagtctgtagcttctgcttctgggggcaaccacggtaatgggttacctgcaccacgtggtttgagcagaaatagtagtaggaagcagaagggtttgtcttcagggttgttggcgatggatgtaaaaaggaatccaagaaatggtaacagtggtcctaggcccttgcagaagtcggactctgtcaaagaagttaaattgagtggaaaagcctgtgatgatgggaaggaatctacctctttgacgtcgacggggaggaattcggtggttgaatcaaagattgatggtaaatggggtaaagggctggagtatgctgacaaggacagttctgcgaagcttgtggttgaggaaaagggaaatgaagaaaaccagcaccgttttaattatagggacatttctccaccagaattgttgcaggaagatggaaaaactttggctgcagaaacattaccagcatggggggtggatgaggaccaagaagctaagattgtggaagatgttgacggcaatcaattgagaagtgtggtactagggaggcatgagcttaattcaatatctgatgatttgaaaaggggttctcctgtggctagtgatggaagttctgattcagatacagattctggttcgacatctgattctgaaagtgaacatgagagggaggaaaggagaaagaggagggaaaggattctggctgagaaagcagcagctaaagcaataaatgctatcaaggaacgggagaatatagtggccaaattagagggggagaaggaaa

SEQ ID NO: 82716 - DNA, 924 bp, Glycine max
  Peptide Sequence Number=SeqID_199494
atggaagctgttgagttagaaaagcagaaacataataatactagaatggaagttcttgcacgtttagctaaactggagactgccaatgctgatcttgcaagatcccttgcagctgtgcagtggaaccttgaagttgaggttaaacaggtggcagaactcagacagcaaatcacttcgaaggagttgtttcacgaagaactcagaaggagaatgacgaatcctcgtcaaactggagcttcacaaaatcaattttccaagctggggactttaagagggaggtctctgctagcttcaaaaggtgttgagttggaacgggaaattctcgaagcagagcactctttaattaatgataaagttgcacaattgcaggaaaaggcaaggaagctagaagctgacattgaaatgacaaggaaggagatagaagagcccacagaagttgaagttgagctcaagcgaaggcttcaacaaatgactgaccatttaatacagaaacaagcaaaggttgagtcactctcttctgagaaggcaagtcttgtattcagaattgaggctgtctcaagattgctggatgagaacatgtcagcatcaggtgcagcaaatatgaatcctgcctcttcatcaagtgacttagaatcaggattatgggagctctccaattcaaagttgaagcctatgctaaaagccagaattcattctggcaagagacagcttggatcattgcttcaacaactagattatatttttgtgactggagcactttttctgaaaaggaactcaacggcaaaattgtgggctttgatatatcttgtttgccttcatttctgggtgttctatattcttttatcacattctagcccatcaaatgagggtagatctggtgcccagatctcattggagaacatcaataacactggaggagtatga

SEQ ID NO: 82717 - DNA, 165 bp, Glycine max
  Peptide Sequence Number=SeqID_199495
atggaagcagagaagaaaaatcattttcaaaggtacctacctccagccattgctatcaacctttcttcagccatcacagttttagctttccagacccttactcgctcaaactcgatgagctctatccatcacaaagctcaacagaacgtgggtattattttttaa

SEQ ID NO: 82718 - DNA, 500 bp, Glycine max
  Peptide Sequence Number=SeqID_199496
atcgggatcttgccgttcgggttcagcgccaggaattccggcgtccaggtttcgttgttaccgatgtcgatcaggtgcgcctcatagggcaggccgatctcttccagcatgatggacactttgacgccgttcggcgtcggcagggaatagagctgcagcctttcaggatgctgagccggccagcgtttgacgatcgggaattgggtggaatcgagcatggaaactcctcgggttggcggggtggcctaagcgtaccccttgagtattgcagtaaaactaccccgccgccgggttacaccctgcaactcgcggctgtcgagccggcggacgatccagccgcggtggataaaggcggccaacagtgcggcgcccagcgcgccgccgaggtgagagcggcgttcgctccagtccaggcagccgcaggcgaagcggcggcgggtgggggcgggggagcaatcgacgcccagccgcgccagcgcggcctgaccggcgtcgcttaa

SEQ ID NO: 82719 - DNA, 618 bp, Glycine max
  Peptide Sequence Number=SeqID_199497
atgggcaccatcatcgactcccatttcttggccttcactgcccttgtcactattgcctatcagtttttgtttttcgtcgtcactgcgctcctcaaattcgacaaagtcactgattttgctggaagtacgaatttcattataattgctgcattgaccctggtcatcaaaggctcctggtattttcgacagataatcctcactttgtttgttgggatatggggaattcgcctcggccttttcctcctattcagaattttgcagtggggagaggaccgacgctttgatgaaatgcgcagtaatttgggtagactggccatattttggatatttcaggctgtctgggtgtgggctgtgagtttacctgttacagtggttaatgcaagcgacagaaatcccttcctacaggttgttgatatagtagggtggattttgtgggctgtgggttttattgtggaaggtacagcagatcaacaaaagctgcatttcaaaagatcttcagaaaatagagggaagtggtgtaatgttggactttggaaatattctcgtcatcctaactattttggtgaagatgtatatggaggagcttgtaagtttagttggatttatgaatacggctag

SEQ ID NO: 82720 - DNA, 2712 bp, Glycine max
  Peptide Sequence Number=SeqID_199498
atgccttctcttgtagatctgcaaggaacaccaacctcagatgatgtcacatgggaagcagtcttggtcaacagggctgctgattccagtttgttgaaacttgaacaagaagccatggagatggctgtcaattcaagaaaagattttgaagtacttgtagatagtgatttggtacacaagcttgcaataatagtggctgactatatgggtggatcagttgaagatcccgaaagcatgtcaagagcatggaggagtcttagttacagtctaaaagctaccctcggtagcatggttttgccacttggttcactgaccattggattggctcggcatcgcgcattgttattcaaggtacttttcccaacattcttttttctggtttacattttaatgagaacggtctggttgataatgacattattgttaggaagtcccacatcgcctacctcagttcttgggatgtcagcttatatatctgttagacaacttcacttagtgtcaatggttttagctgacagtttgggcatcccgtgtcgattggtgaaaggactgcagtatatgggttccaatgatgtggcaatgaactttgtcaagatagatggaagggagtacattgttgacctaatggcagctcctggaacacttattccatctgatgctactggatcacacattgagtttgatgattcttcctttgtagccagtccttcatcaagagagcttgattcgtctcacgtagcatcattcagcagtggggttggaagttcatctgaagaagcttcagactctgggactctggataaagataataaatcaaagtattttggctatgcagggaaagaatccgatgtaagcgggcctactacgggcaaggaagaattgaagaaaccatcaaatgaatccaaaaataccccctatgaggagaagatcatagtgcgagattcccctagcagacctaattatccatatatgcatggaagatctccttcttggactgaaggaatcagttctcctgcagtgcgtagaatgaaagtcaaagatgtttcccaatatatgattgatgctgctaaggagaaccctaacttggctcaaaaacttcatgatgttttgcttgaaagtggtgttgttgcacctccaaacttattttctgaaatttatcatgggcagttaagtaccctgactgaggccaattttccaactgaacaaaaagatgaaaataaacaaggaagtgtgcagcgagaaactaagactgatgacaatctagttcctgctcgatttttgcctcctttgcctcactaccgagttcagcgcaaagcaactcctagcactagcagtcacctggagcattctaagcctgttgatggcttaggaactggccttcctcttgattcaggggaagctgctggacagcacatatcatcacaggtagaagcaactcaggtaaagtatggaaaaaatatgccagttgcggcagctgcagctgcagctgctgctgttgttgcatcttctatggtagttgctgtaacgaagtcaaatgctgactcgaatcttgagattcctgtagcagcagctgctactgctactgctgcagctgttgtagcaaccactgctgctgtaagtaagcagtacgagcagggcagtcggagtgatggtgatgcagagggtgctggttgtgaatcgaagggtagtggtgatggagagcataatgctttaggagaaaactcagaaggcgagagaaaatctgatagatcagtaagtaatgacagcacaaaatctgattcagcgctagatgatgttgctgagtatgatattccatgggaggaaattgcagtgggagagcgtattggacttgaaaaactcaattgcaactgtgtggctggtatttggcatgcaggatcatatggggaagtttaccgtggtgaatggcatggaactgaagttgctgtaaaaaagtttctatatcaagatatctctggtgaattacttgaagaattcaaaagtgaggtccaaataatgaaaagactgaggcatccaaatgttgttctcttcatgggagcagtaactcgacctccaaatctttcaattgtttctgaatttcttcctagagggagtttgtatagattaattcaccgacctaacaatcaattagatgagcgaaggcggttgcggatggcccttgatgctgctcgaggaatgaactatctgcacaactgcactccagtgattgtgcatcgtgatttaaagtccccaaatcttcttgttgacaaaaactgggtagtaaaggtatgtgattttggcttatcacgaatgaagcacagtacattcctttcttccagatcaactgcaggaacagctgagtggatggctccagaagtgttgagaaatgaactttcagatgaaaagtgtgacgtttttagctatggggtcatattatgggagctctctactttgcagcaaccctggggaggaatgaatccgatgcaagtagttggtgctgtgggttttcaacatcgccgtcttgacattccagataatgtagaccctgccattgccgatattatcagacaatgctggcagactgatccaaagttgaggcccacgtttgctgaaatcatggctgctttgaagccattgcagaagccaattactgtttctcaagtgcatagaccaattgctcagtcatcacgaattgctgaggaccccgcaggatag

SEQ ID NO: 82721 - DNA, 2811 bp, Glycine max
  Peptide Sequence Number=SeqID_199499
atggcttcaagattctggacccagggtggaagtgattccgaggaggaggagagtgattatgatgaggaggttgataccacggtgggtgaatctggtagtcaagcagtgacaagcaggtacctgcaggataatgcaagtgacagtgatgactctgatggccaaaagcgcattgtgaggtcagcaaaggataaacgtttcgaggagatggcttccactgtcgaccagatgaagaatgccatgaagatcaatgactgggtgagcttgcaagagagttttgacaagattaacaaacagcttgagaaggtcatgcgtgtcactgagtctgagaaggtccccaatctttacatcaaggcactcgtgatgttggaagatttcttggctcaggctttggctaataaggatgccaagaagaaaatgagcagtagcaatgctaaagccttgaactcaatgaagcagaagctgaagaagaataataagcagtatgaggacttgattaataagtgcagggagaaccctgagagcgaggaggaaaaagaagaggagagcgaggaagagtatgacagtgatggtgagattattgatccagatcagcttcaaaaaccagaagcaaaatctgattcggaggcctctcaatatgaagatgaaaagccagatgctggtgaaggtccttgggaccaaaagcttagcaagaaggacaggcttttggatagacagttcatgaaaaaccctagtgagatcacgtgggacgcggttaacaagaagtttaaagaggttgtggctgccaggggaagaaagggaactggtaggttcgaacaggttgagcagctcactttcttaacaaaagttgctaagacacctgcacagaagttggaaattctgttcagtgtggtttctgctcagtttgatgttaatccgggcctcaatgggcatgtgcccataaatgtatggaaaaaatgtgtgcagaacatgctgatcattcttgatattttagtgcagtacccaaatatagtggctgatgatttggttgaaccagacgagaatgaaactcagaaaggtcctgaacataatggaacaattcgggtttggggtaacttagttgcttttttagaaagaattgatgtcgagtttttcaagagcctgcagtgcatagatcctcatacacgtgactatgttgagagacttagggatgagcccacgtttctggttcttgctcagaatgtccaggaatatcttgaaagagttggaaatttcaaagccgcttctaaggtggccttgaggagggttgagctcatttactacaaaccacaagaggtttatgatgccatgagaaaattgactgaattgacagaagatggagataatggaggggaggcaagtgagaaggaatttgaggaatcaagaattcctactgcatttgttgttaccccagaggttgttgcgcggaaacccaccttccctgagaatagcaggaccctaatggatgtattggtatctatgatatacaaatatggagatgagcgaactaaagcacgtgcaatgctctgtgatatatatcatcatgctctacttgatgagttctcaacagcccgtgatctgcttcttatgagccatttgcaagatagtgttcagcatatggacatttcaacgcagatactttttaacagggccatgtcacagttaggtttatgtgcttttcgggttggactgatttctgaagcacatggctgtttgtctgaactctactctggtggaagggtgaaggagttgctggcacaaggcgtgtcacaaagtcgttatcacgagaagactccagaacagatgtacactaatagtataatcaacaccaaagaggaaaggttggaaagaagacgacagatgccctatcatatgcacatcaatctagagctcctggaggcagtacatcttgtttctgctatgctgctggaagttcccaatatggcagccaatgttcatgatgccaaacggaaggtcattagtaagactttccgtcgcctgcttgaggtaagtgagaaacaaacatttactggtccaccggaaaatgtcagagatcatgttatggctgccacaagggttcttaacaagggagacttccagaaggcttttgacattattgtgtctcttgatgtgtggaaatttgtgagaaatcgagacaccgtacttgaaatgctgaaggacaaaatcaaggaggaggcattgaggacatacctctttaccttctcttcatcttatgaatcgttgagcctggatcaactcacaaaattttttgatctctctgtttgtcgcactcatagcattgtcagtaggatgatgatcaatgaggagcttcatgcaagctgggatcagccaactgggtgcattcttttccaagatgttgaacactccaggcttcaggcattggcattccaattgaccgagaaattatctgtccttgcagagagtaatgaaaaagcagcagaggccagggtaggtggtggtggattggatctgcctctaaggcgtagagatggccaggactatgctgccgccgcggctgccggcagtggtacagcctcttccggtggtaggtggcaagacctgtccctttctcagccaaggcaaggcagtgggcgtgcagggtatggtggaaggccaatggcattgggccaagcagctgggagtggctattcaaggggacgaggaaggggttcgtatggaggttcagggaggactgctcaaaggggttcagcattgaggggaccccagggagatggatctactcgcatggttagccttaagggagttcgtgcctga

SEQ ID NO: 82722 - DNA, 234 bp, Glycine max
  Peptide Sequence Number=SeqID_199500
atggcaatggccccgaacccatgggatccgtcccggactcgtcctgattttgacaagaaaaactcgaatggactgggatcatggttgggttcgggttttcctcgacagccaaagtcgggggagagggaaaaaaatgaagagtcggggacggggcaggataagcaaaatccgaccccaacctgccccgttgttatgcctaatttttgcccaagaaaagagcaaactgcaaagtga

SEQ ID NO: 82723 - DNA, 1085 bp, Glycine max
  Peptide Sequence Number=SeqID_199501
ctagagtgatgagtgaaatagaggaggtgcaagaaaagatgaaggctgacatggaggccatgaaagagcaaatgacctcaatgatggaagtcatgatgagtatgagaaggatgatggaggtcaatctggttacagttgttgccgcaagtaccgccacagaattggacccgagtcacccacctggcttcaatcaagtaaatcatctagcctcggatatggtaggtcagggaggcaaagcgttgggaagtacgggtggcccccattttgtgcaggtccagagcacgcattcctttccaccatatggcttgcctcccaactatacaccatttaatgttgcacacattcccgatgagaatgtcgacaactctgctcccatacccattgagagtcaacatccccaatttggtcatgcacaggtttctcaactcatgggggagacacatgaagcacctcgagaccataatctagtcgactttgggcctcactatcgcccacaaccacaacccttgcattttgcggttggaagagtctctcctgctatggtgtgtagacaaaggatcaagctgaatgttttgatgatgccaaaggattacatgaatcacatgcttctcaaagatttattcaagacaaagatattctgcttccttcactatttaattgtgcggcgtcaactcgactgggcacacttagtcagatatcgcatgcataaggcattgcgattaaatgctccactaccatatccacagcttgttactctatttcttcgtcattttgaaattcctcttgattctgaatcttatattccaatcaagagatcctttttaattggtgctgctgcaattgcttcttttggttaccgcaaagagcgcaacctcccagatgaagataattccacttttcttcgcaggcttatggacaagtttgatggacttcagacttttgttggtgacaagtttgatgccatggaattacaagttgacatgaggttcgatgctatggaatcaaggatcaccagagttgaagaagatgtctctttcatccgaacttgttttgatccaccacctccgcctccttcatcctcttag

SEQ ID NO: 82724 - DNA, 330 bp, Glycine max
  Peptide Sequence Number=SeqID_199502
atgtgttttaatgagttgatatttgcaggttcacagatctgtgagtatgagaaagctgcttctatctcgagtagtcatgatcctcctattgttttggctaaagtagatgccaatgaggagaagaacaggagcagtgagatggataaaactccaaaagagaaggagtcaaagacaccgccaccaccacctacgtcacaggagcagtcttcgaccaccagcagtggaacaattaatcctgagtggcctggctttcaggcatattctcctatagctccacatggtttcttggcatcaagtccccaggctcacccttatatgtggggtgtccag

SEQ ID NO: 82725 - DNA, 576 bp, Glycine max
  Peptide Sequence Number=SeqID_199503
atggtaagatatgctagagaagatacacattatctgctatacatatatgatttaatgaggattgagttattttccatgcttaatgagcctgaaagtgttgacgctccactggtagaggtctacaagtgcagttataaggttgcaaggcgctggtttcactgctcaacaactagtcattgtttcgctaaacagatgcctgtcactgcaaacaaccttcgtctattggtgaactcgaggcacccatatgttgaacacaatttggatagtcttgtcgacataattaggcattctattcagaatacttcagcatttgaagaaattgctcaattattgaaaacaggacatgatgttgctaccattgctcaacaattgactcgacatcctgcccaggaacataacaggcaccccattaggatcggcagccaagtgatggagggtaattttcacaaagtattaggttcaaatatcattcatcattggcggaggcatggtgttgtaagtcatcaattgtttgactggcaacatgtgcttgtgcacttttcaactcctgttgtacagtcctgccgctactattga

SEQ ID NO: 82726 - DNA, 906 bp, Glycine max
  Peptide Sequence Number=SeqID_199504
atggccatctccttcagtcccaaaaaccctccttacgatgagatgatatacacagcaatcggagctctgaaggagagggatggttcgagcaagcgagccataggaaagtacatagaacaagtctacaaggaccttccacccactcaccctgctttgttgactcaccatctcaaccgattgaaatcctctgccctcctcgtcctcgtcaagaaatcctacaagcttccttggatctcatcatctgcctgcgctccagccccaaaagacccgtggtcgtcctcccaagcccaagccccaccccgccccggtcgtcctaaaaagattggtgtcagcccgccaggcccaaggggtcgtccacccgggactgggagatctaagctgcccaagaggcctggccgtccccccaagcccaaatccgtctcggcgatctccagtggtctcaaacgacgtcctggacgcccacccaaagcccaatccaacgtaaacgtcatccccttcgcagccccagttgctcccggcctgcctactgtgcagcccatccttcctactgcttccgtgcccaatggatctcccaggccccgaggaaggcctaaaaagagttttactgctgcgggggctccggcgctatctgccgttgccggtgcagcgcgtggtcgtggccgcggacgtccacgtggggtcttcccggtggttaggcccggccggcctcagaagctcgccgtaggaaggtccaagaatcctggatcgacagctgctgcaatcacagcacataaggctgctaatgaagatctaaggaagaagcttgaacactttcaatcaaaagtgaaggagtcccttggcacgcttaagccttattttaaccatgaaagcccagtcactgcaattgcggcaattcaagagttggaa

SEQ ID NO: 82727 - DNA, 102 bp, Glycine max
  Peptide Sequence Number=SeqID_199505
atgactagcggtggtgttagatggtgcgacataggtgggatgcggtggttatggaggtttgatgaccagggtttgcttgggagatgcaagagtgcctggtga

SEQ ID NO: 82728 - DNA, 1942 bp, Glycine max
  Peptide Sequence Number=SeqID_199506
cttaatgttctttatgctagatatgcatcactttgccatgcacataagctgtttgaagaaacaccttgtaaaactgtctatctatggaatgctttacttaggagctattttttggaaggaaaatgggtagagacgttatctctattccatcaaatgaacgctgatgcagtaactgaggaaagacctgacaattacacagtgtctattgctttgaaatcatgttctggtttgcagaagcttgagctgggaaaaatgattcatggatttctcaagaagaagatagatagtgacatgtttgtagggtctgcattgattgagttgtattcaaagtgtggacaaatgaatgatgctgtgaaagtgtttacagagtatccaaaaccagacgtggttttatggacttcaataattactgggtatgagcagaatggaagtcctgaacttgcacttgcgtttttctcccgaatggttgtgttggagcaagtaagtcctgatccagtaacacttgttagtgctgcttctgcttgtgcccagttatctgattttaaccttggaagaagtgtacatggatttgtaaaacgaaggggttttgatactaagttatgtttggccaattctattctaaatttatatggaaaaactggttccatcaggattgcagctaatttgttcagggaaatgccatataaagatattatatcttggagctcaatggttgcctgttatgctgataatggagctgaaactaatgcgttaaatcttttcaatgaaatgatagataagagaattgaactcaacagggttactgtcattagtgcattgcgagcttgtgcttccagttcaaatttggaagaaggtaagcagattcataaattagccgtcaattatggttttgagttggatattactgtctctacagctcttatggacatgtacctgaagtgcttctcacctgaaaatgcaattgaacttttcaacagaatgcccaagaaggatgtagtttcttgggctgttttgtttagtggctatgctgaaattggaatggcacacaaatccctgggggttttctgcaacatgttatctaatggaacacgacctgatgctattgctctagtgaagattcttgctgctagttcagaattggggattgttcaacaagctttatgtcttcatgcttttgtaactaaaagtggatttgacaataatgaatttattggagcgtcactcatagagttgtatgcaaaatgtagtagcatagataatgctaacaaggttttcaaaggactgagacatacagatgttgttacctggagctcaataattgcagcttacggattccatgggcaaggagaagaggctttgaaattattttatcagatgtctaatcattcagatgttaagcctaatgatgtaaccttcgtctcaattctatctgcctgtagtcatgcaggtttgattgaagaagggataaagatgtttcatgtcatggtgaatgaataccaattgatgcccaatatagagcattacgggataatggttgatcttcttggtcgaatgggagagttggataaggccttggatatgattaataacatgcccatgcaagctgggcctcatgtatggggagccttacttggtgcttgtcgcatacatcaaaatattaagataggggagcttgccgctctgaatcttttcctgttagaccctaatcacgcagggtattatacgcttttatcaaatatatattgtgtggacaagaattggcatgatgctgcaaaactcaggacattgataaaggagaataggttgaagaagattgttggtcaaagcatggttgagataaaaaatgaggttcacagtttcatagctagtgatagattccatggtgaatctgatcagatttatgaaatgctgagaaaattagatgcaagaatgagagaagaag

SEQ ID NO: 82729 - DNA, 159 bp, Glycine max
  Peptide Sequence Number=SeqID_199507
atggacttacgtgttgaattgagaagaggaaaaggaaggggacagatagccgacgagggggctcgagatctcctgaaccttaagaacaatccataccaaaacgttaacatgttcgctttttttccttacacttctattgtcaaggcctgcaagtattaa

SEQ ID NO: 82730 - DNA, 528 bp, Glycine max
  Peptide Sequence Number=SeqID_199508
atgggggcagaaggtgaggaaatagttagctttggtgcaagtagcaatgctggtggggtcatcataggcataggagtaggccttggggcatgcggtcttgaagatcttggaatagacggtgggcttgcaggcctgtgggcttccataggagccggtgcagcagcccacggggcacatggtgttcaggtcgctcacgcagcccgcgtagctgcattttccggatcccttgaatggggtgatggagatgggcaggttgtagccgtccaccaggctcacgtcgtagaagtcctgctcgttgcccagggtcaactccgccagggtcgccggtgggcttcccccgatgccgttgcagaagagggacccgccgcagtcaccggtggcgcagcgcccgcgcccgccgacgtcgaaggcgcagccgtggcggccccagaagcgcccggaccagagggcggcactgtgaagaggaagaagatggtggtgagaatgggtctaagagtcggcattgtggtgttcaacaatgctagctag

SEQ ID NO: 82731 - DNA, 513 bp, Glycine max
  Peptide Sequence Number=SeqID_199509
atgacagtgtcgtacaaagattggcatgagatgttgcctttttccctgcatggatatcaaacctcgctacgaacttctactggggcaacaccgtactccttggtttatgggatggaagtggtactcccatttgaggtagaggtcccttcccagaagatactagcggaatcgggcctagaagaatcagagtgggctcaaacccgctacgaccaactcaaccttattgaaggtaagcgtttgacggccatgagccatgggcgcctgtatcaacaaaggataaagaatgtgttcgacaagaaggtgcgcccgtgcaagttcaatgagggggaccttgtgctgaaaaagatatcccacactgttaaagataatcgagggaagtgggccccgaactacgaagggccttttgttgtgaaaagggctttttctggaggggctctggtgctcaccaacatggatggtgaggagctaccctcacccgtgaactccgatgttgtcaagcgatactacgcttaa

SEQ ID NO: 82732 - DNA, 903 bp, Glycine max
  Peptide Sequence Number=SeqID_199510
atgggaggagtagcagcaatcatatcaaggagtgcagcggcaccaattgagagagtgaagcttttattgcaaaaccaaggtgaaatgattaaaagaggacaactcaaaaaaccatacttgggtgtgtctgatggctttaagagggtcttcatggaagagggtttgattgccttttggagaggtcaccaggccaatcttattcgatatttccccacacaggctttcaattttgcattcaaaggttacttcaaaagcatttttgggtattccaaagagagagacgggtacattaagtggtttgctgggaatgtggcttcaggcagtgctgcaggagcgactacttcactacttctgtatcatttagattatgcacgtactagattgggcaccgatgcaatagagtgccgtgttaccggtcaacgccagtttaaaggactaattgatgtataccggaagaccttatcaagtgatggaattgctggcttgtacaggggatttgggatttcaatatggggaatcaccttgtatcgagggatgtactttgggatctatgacaccatgaagcctattgttttggttgggccttttgaggggaagtttctcgctagtttcttcttaggttggagcatcacaactttttcagcggtttgtgcatacccttttgacacattgcgccggcgaatgatgcttacctctggacatccaaacaagtactgtactgcaatacatgcatttcaagagattgttcgacaggagggtttccgagctctatttcgaggatttaccgcaaatatgcttctaggcatggcaggagctggagtgcttgctggatacgatcagctgaaccgtatctcatctagacacagtcactataatgagactaaccaaagagttctgaaatga

SEQ ID NO: 82733 - DNA, 489 bp, Glycine max
  Peptide Sequence Number=SeqID_199511
atgaccgcacgcagaaattggacggccctgattcgcgcgtgtatccatcccccccgaaactcgcacagagcaatagagagagaagaaaaaggaagaaaggtaatagagagagagagaaagagaagaggagagagaaacaaagaagagtgttcccacattacatggcctccttgcccttggggcaccaccaccatcaccaaccggcggcggcgactatacacccgtcgcaaccgccgcagtgtcagccgcaacccgaagttcctcgccggagctccgatatggagaccgataaggtacttccgttcattgcactcatctcgaaccctcggaatgattttattgtttcctcggagtggttttgagtggtttccgacttgctggagctccgatcgcagtcgattcgcctcagaagctccagcgtcgctggagtttcgaccgatctaccggttttccgtgctagccggtgaaaatatccggcgacgccgctga

SEQ ID NO: 82734 - DNA, 1338 bp, Glycine max
  Peptide Sequence Number=SeqID_199512
atgcgtgagattcttcacattcagggagggcaatgcgggaaccaaataggaacaaagttctgggaagtggtgtgtgatgagcatgggattgatcccacaggacaatacgtaggcaactccgaacttcagcttgaaagagtgaacgtttattacaatgagggcagcaatggacgttacgtgccacgggctgtgctgatggaccttgagcctggcaccatggacgctgcccgcactggcccttatggccagattttccggccggacaactttgttttcggtcagtcaggggctggaaacaactttgcaaagggccattacactgagggtgctgagcttattgactccgtccttgatgttgttaggaaggaggttgagaattgtgactgcttgcaaggatttcaagtttgccactccttgggagggggtacaggttctggaatgggaactttgctgatttcgaagatcagagaggaataccctgatcgaatgatgctcacattctctgtgtttccatctccaaaggtgtcagacacggttgttgagccttataatgctacactttctgttcaccagttggtggagaatgctgatgagtgtatggtccttgataatgaagcactctatgatatctgcttcaggaccctcaagctcgctacgccaagctttggagacttgaatcatttgatatcagcaacaatgagtggggttacttgttgcttaagattccccggtcagctcaactcagacctaaggaagctagcggtgaacttgatcccatttccaagactccacttcttcatggtgggttttgctcccctaacttctcgaggatcacagaactaccgtgcactttctgtcccagaactgactcaacagatgtgggatgccaagaacatgatgtgtgcggctgatccacgccacggtcgttacttgacagcctcagcagtgttcagaggcaagatgagcacaaaagaggtagatgaacagatgttaagtgtgcagaacaagaactcttcctactttgttgagtggattcctaacaatgtcaagtctagtgtctgtgacattcctcccagaggcctttccatggcttcaacttttgttggtaactcaacttctatacaggagatgttcaggagagtgagtgagcagttcacagccatgttcagaaggaaagccttcctgcactggtacacaggagaaggaatggatgagatggagtttactgaagcagagagtaacatgaatgatcttgtagctgagtatcaacaataccaggattccgcgactgatgaggatggtgattctgaagaagaaggtgagggtgcagagagctga

SEQ ID NO: 82735 - DNA, 1758 bp, Glycine max
  Peptide Sequence Number=SeqID_199513
atggttaatggtgtggctgtggctgtggcaccaaagttgttagtgatgtgcagaatcagaatctacaagtttcatggatttatcagaatccttgttccttctccttccaccagagccatgcattcccttaatcaaagcaaacccatgaagaaagccgagaaattgaaactgaaggatgagccgagagagtatatgaggaacgtaattgggaaaatttacaacatgctaaagtattcaagctgggaaagcgctgagcaagatctcaataatctgtctatgaagtgggactcttacacggtgaaccaggttctcaagtcccaccctccaatggagaaagcctggttgttcttcaactgggtctcttccctcagaggcttcaagcacgaccactatacttacactaccatgcttgatattttcggagaagctggcagagtctcttccatgaagcaccttttccagcagatgcaggagaaggggatcaagcttgattctgttacctacacttccatgatgcattggctttccagttccggtaacttcgatgaggctatgcaaatgtgggaccaaatgaaatccaagggctttcaccccaccgttgtctcttacaccgcttatatcaagattctctttcacaatcaaagagtcaaagaggccactcgtgcttacaaggagatgattagctcccgtgttgctccaaattgccacacttacaccgttctaatggactatcttattgggtctggacaatacaaagaggccctggagatttttgaaaagatgcaagaggctggggcgcaacctgataaagctgcatgcaatattttgattgagaggtgttctaaagttggtgggactgagttcatgacccatatccttcagtacatgaaagaaaaccgtctagttcttcgctaccctgtttttgttaaagcattggaagctttaaaaattgctggtgagagtgatacccttctaaggcaagtcaatccacaattttatatggattgtatcataagaaagaaagcaagtaatactatcacggttgctgcagattgtcctactaatatagataaagaacttctatttgttctcttgaaaaatagaaatgttgttgctattgaccatttacttacagggatgatggataagaaaatatctttagatcataaggttgtctcaaccattattgaggtaaattgtagtcattgccgacctgaaggtgctttgttggctttcaagtacagtgttacaatgggaataagtatcgagagaacaggatatctttccttaataggcttgttgatcagatcaaatatgttttcaaagctggcggaaattgttgagaaaatgactagagctgggcattctcttggaatctatctggcttcacttttgatctttaggcttggttgtgctaggaagcacactttggccatgaagattttcaacttattacctgataaccataagtgcagtgctacctatactgctttaattagtgtttacttctctgttagaagagttaacgaggcacttgagatatacaaaatcatgtgcagcaaaggattttgtcctgtgttaggtacttatgatgtactaatagctggtttggaaagaaatggtaaatacgctgaagcagaacattataggaaagcaaagaagaggaagagcttacgtgccaatagtggttctcaggaaagtgtttgcatagaggggaagatatgcaatcttctgttttctgttgatgtagtactttga

SEQ ID NO: 82736 - DNA, 1764 bp, Glycine max
  Peptide Sequence Number=SeqID_199514
atggcgaagaacctattggttttgttggggctgggtttagctggaatagttctcatcaccagaaagctcaataagtccgtcagagaggatttcggcgctttcattcataagcttcagctgcttcctcctccccagccttctcctcccaaggctcctcatcccctcacctcactcaccttcgcactttccgacctatttcacatccatggacacgtgccctcgttcgggcatcctgactgggctaggactcacgaaccctcttcttccactgctcccgctgtttccgctctcgtcgagggcggtgcaacctgcgttgcaactactgttctcgacgacttagctctaggtattggcggtgaaaataagcattttggaacgcctactaatcctgctgttcctgctcgagtaccgggtggctcctcaagtggtgctgctgtcgccgttgctgccaatttcgttgactttgcattgggtattgatacaactggcggggtgagagtacctgctggattttgtggcattctaggatttcgaccttcacatggtgctgtttcgcatatgggaatcatacctatttcaacaagtctggacactgttggttggtttgcaaaggatcccaatatattgcgtcgtgttggccatatacttttacaagcaccatttgtaatgcaacgcagtcctcggcaaatagttatagctgatgattgttttcagcatataaatgttcctcttgacaggagttctcaagtggtggtcaaagccactgagaagctttttggaaggcaagtattgaagcatataaatcttggggactatttaagttctagagttccaagcttgaaggggtgctctggacagaaaccaaacggcgaagtgaaagcttcctcattaaaattacttgcccacattatgcaattcctacaaaggcatgaattcagacttaagcatgatgattggatgaacacggtaaaacctgatcttcatcctggtgtttcagcacaattgcatgaaaaatttgaggtatctgatgcagagattgaaaactctaaatctgttagaagtgagatgcgtgctgctgtaaattcgcttttgaaggatgaaggaattttggttatccccacggtagctgatcctcctccaaaattaggtgggaaggagatcctatcagaggattatcagagccgtgcatttagtctgttaagtattgcaagcatatcaggttgttgtcaggtctcaataccattaggattttatgacaagtatcctgtttcagtgtccttgatagctaggcatggtggcgatcgatttttacttgacacattacagactgtgtatacaactctccaagaacaggctgatattgcttccaaaagcaaatcatctggaaatgttgttagtaaggagcaatctgctgaaattgccaaagagaagggaaaccaagcctataaagataagcagtggcagaaagccattggattttatacagaagctatcaaactctgtggtgataatgcaacatattacagtaacagggctcaagcgtatctagaacttgaaagttatcttcaagctgtggaagattgtacaaaagcaattagtcttgacaaaaagaatgtgaaggcctattttcgtagaggtacagctagacagatgctaggctactacaaggaagcaattgatgattttaaacatgcccttgtacttgagccaaccaacaaaagggcagcttcagctgctgaaaggttgaggaagctattccagtag

SEQ ID NO: 82737 - DNA, 392 bp, Glycine max
  Peptide Sequence Number=SeqID_199515
atgcaagtacgtaacattatacgaacatcgaatttgcttcggttctcctgccccttacggcaccagatcactgctccctttcatcacgaccctgattcgcgcgtgctctcaatctccctaaactcgcgtgaactcactctttctctcttcttgaacaaaaacagggcaagagagagagaagaaaaacgaagaaaggtaatagagagagaaagggaagaggagagagaaacgaagaagaagagtgtttctcacatcacatggcctccttgcccttggggcaccaccaccaccaccacaaaccggcggcggcggctatacatccgtcgcaaccgccgcagtctcagccgcaacccgaagttcctcgccggagctccgatatggagacagataag

SEQ ID NO: 82738 - DNA, 1365 bp, Glycine max
  Peptide Sequence Number=SeqID_199516
atgagtagtagaaagagaacggggatgcgggaaggttacgagtttatgccaatacgagatgttggtagatctgttggccagaaagccaagttgattggggttattcttgacttcggctttccaaagaaatccaagggcactgatttttgttgttgcctaagaataattgatgaaacacatcaccaaatctccatggctattaacatgtttgaggaaaatgtagaaagacttccccgtcttgctgctgtcggggatgtagttgtgctttgttgtgttgaggtaaaatcatttaaaggggaagtaaatgttactttcaacaagagattttcctcttttggtttatataaaggcaaagatggtgatgatttggatccttatcacgtttcttcttattttcaccacgtacgtgaagacgagagcttaatagttaagcttagaaaatggctgatgaattttcagcctcacgaagattcgagtaatttccccatgttaagagaaatcaaggaagaaacttctgttaatttggcatgcaagatccttcatttttgcgagactgctaaagatgagtggattatattttcttgggatggtactaacactccttcaaatgtcatatgttcaaagcttgaagaggaaattaactgtccacttcctttacaactagaacccttgcctttgtcaagagaggttctatgtactttgcctgttgctggatccatcttgaggataatgtttgataaagtcgttgtgaaaaatcatctgcaccttttaaatgttgataaatgggtcaaatttatgaatattcatcttaaggtggttgatggactatggcttggtgttttttcccctcaatcaagacttcgatatacaccaaatgaggacagtctgattgtagaacgttgtctgatgagcagttatttcctaagcctttatttattacagaagaagttaatcaagatcatgcgactcctgttacttttaatgactgtcctcactcattcaaaggtggtgaccgctaaattcaagtgtgttgttcgagtggtagcagcaatgccatacctagctaaaaatctgttgtctagtattgggaaatatagaatgcagctaacattagaggattcaacggctagagttcatgcttttgttactggcaaggatggggagaccctttttgatggttacccaagcattgatgagttgacaaggaagctaaatagattacttggagtaactgggataaaggatgctccaagagatccaccatgggttagtgtttgtctcaagtcatattatgtctccaaaactgatgtatggggcagtagaaacttcaaaatatttggcatcaaaatagtaggcgatacgtga

SEQ ID NO: 82739 - DNA, 1365 bp, Glycine max
  Peptide Sequence Number=SeqID_199517
atggatgagcgtcacattcagaaatcttactggcttcagcattccgccgatctctccgtcgaggcaatgatgctcgattccaaagccgctcatctcgacaaagaagagagacccgaggtgctttccctattacctccattcgaaggcaagtccgttattgagcttggtgctggtattggtcgatttactggtgaattggctctgaaagctggtcaattgcttgctgtggacttcattgacactgctatcaagaaggcctgctcaacttacgcttttgtttctcccttgatgcttcaggttgaaaaattagctgaaaggatggtcagatggttaaaagatggtggatatatattctttagagaatcttgtttccaccaatctggagattcaaagagaaaatacaaccctactcactacagggaacccagattttataccaaggtatttaaagagtgccatatgagtgataatactgggaattcctttgagctttctcttgtgggatgtaaatgcattggagcttatgttcgaaataagaagaatcaaaaccagatttgctggatatggcagaaagttaggtcacaagatgataggggtttccagcgcttcttggatagagttgaatacagccacaagagtattttacgatatgaacggatgtatggcccaggctttgtgagcactggtggacttgaaacgacaaaggagtttgtggcaaagctgggactaaagcctggtcagaaagttctggatgttggttgtggtgttgggggaggtgatttctacatggctgagaattttgatgttgaggttattggcattgacctctccataaacatgatttctcttgctattgaacgtgctattggactgaactacgctgttgaatttgattgtgcggattgctatagaaaaacatatcctgagaatacatttgatgtaatatacactcgggacaccatgctgcacgtcaaagataaaccaacattattcagatcattttacaagtggttgaagcctggaggaaaaattctaatcacagattactgcaaaagtgctggaagtccatctttagaatttgctgagtacataaaaaaaggaggatattatctccatgacattaaagcgtataggcagatgcttgaggatgcgggatttgatgatgtcattgccgaggatcgaactgatcagtttgtgaacacgctacagcaggagttaaatgcccttgagaacaagaaggacgattttattggtgacttcagcgaggaagactacaatgagattgtcgaaagatggaaggcaaagcagaccaggggtgcatctagagagcagatgtggggcttgttcattgccaagaaaaattga

SEQ ID NO: 82740 - DNA, 831 bp, Glycine max
  Peptide Sequence Number=SeqID_199518
atgcaagacattgacacttggtcatatttcaaaggagttgatctattgaaagaattgggctacgactttagtaactataggttgtggtggaagcatagagatgctaattttgaacaagggttaaaggagtttgctaatgacaatgatgcattgcagttatgcaattatgcactgattaatgaggatcatgaagttgctttagaaagagggagtgagaatgatggagagggtgaggattttgaaagtgatgaagaagcattttctgcaagtgaggattctaaagatggtgatgaagatatggatttggataatgagtctttacatcacctgagtagtgttgacaatactacaccttgggggagcattttgcatttgatatcccaaatatggatgatgttggagatgatattgatgttgactatatgtctgaggagttggacagtgggaatgaatcagatggggatgacaacatctggcttaaaaaagtttagagcacatgaaatgtgcaaggatttcgagtttaagattgtcatgcaattaagttcattgacccaattcaaggaagctatgatgaaacattcagtgttaaatagtaaagaagtcacattcattaagaatgataagaaaaaagctaggaatgctaagtccaaatgggtagcaatgcaaattcttgacaagctaaagtctaattctagtatgattgtgaatgatgttgttaattatactaggagtaggtttacagctagaattacatcatccacaacttacaaggctagaaaaattgcattagcaattgtggaaggggatgctgtaaaacaatatgcaatatga

SEQ ID NO: 82741 - DNA, 2547 bp, Glycine max
  Peptide Sequence Number=SeqID_199519
atggctacggttgatgttattaaatcctgcatcgattcaataagacagatatcagagcatattcaagatgctattgtttatttagatgctgggtctacagaaagtttccaatttattgcggcatatccaatacttcttgaacttggggcacgagctatttgcagtttggaaaacatgtgcccacttgatttggtggttgattggaactcaaattctgatcctgggaggaaacttgtggttatcacatcaagtctactaagtgatgcacaccggtatattttacgttgcctgagcgcacatcaagttgttcgtcattgcattatatttacatctatctcagagacagcacactcagcatttcctgattcacctctggggccagatgcatatcatgaatatgaatccttactggttcaagattatgaagaactagttaagaaatcatggacaaaacctggacaggcaaaacataactttgaagatggaggacgttcagagtttccttccagcggagaggatgttcttaatcttgaagctagttctagtggaagagatttttacgagcacaatcaattagactgcatagaagatgctgtgcagaaattggttgtttctgttcatcattttcccatgattttatgtcccatttcaccacgagtatttgtcctaccttcagaagggttggtggctgaagcatacttatcagctgagcatgaagattctattagtcctggtttgcctcccttaagtactggcttgctctctgatgctgatgatgtgcctcctggagctactcttacggcacactttctctaccatttggctgccaagatggacttgaaaatggaaattttctcccttggtgatatatcaaaaactgtgggaaaaatattgacagacatgtcaagtctttatgacgtaggtcgccgtaaacgatcagcagggctgttactcattgatcgtacacttgatcttctcactccttgctgtcatggggactcacttgttgaccgtatgttttcttctttgccccgtagaaatagaacattttcccatggttcaggaagccaactcaaacttagttcttcctacctgcaccgtgctcctttagatgttcagataccacttgcaaagatcctggatgaggaagattggcaaatagacaattttcgacttttagaaactgttgaagcttttttgtgtggttggaattctggtaattctgattctcagattgaaggcttgattaacctaagccagaaaattcatgacaagcctagtcagtctgatgtagagatacttactgggtcctttgtctcctcggaaaatttccgtggaatgccattattggaggctattctagatagaaaaacaaaagatggggccctactggtcaagaaatggctacaagaaactctgcgcagggaaaatgttactgtgaatgtgaagtctcgtcctggtcttgttacaaagccagagttgcaagctatgatcaaagctttgtccaggagccaatcgtctttgctaaggaacaaaggaattatccaattagcttcagccacattgtttgcccttgaggaatcaaattatgctaaatgggatgcatttagcagtgcagagaaaattctgggtgttagttctggagaaacaagtcaaagtcttgccattcaaattggtgatctcatcaataagactgcttttttgggatcacatgtaaatgaagggaaaagggagatctcaaaggggttactttctttgcaagatgctttgctgttgatgatcattggatatatattggctggtgagaattttccaacatctggttctgatgggccattttcttggcaagaggaacatttgttaaaggaagctgttgtagatgctcttcttgaaaatccatcagtagcaaatctcaagtttctacatggactaagggaagatcttgaaactaatgtaagcaaatcaaaatcagaggaaacagctgaagaaccttcaaaattagatattgatgattttgatgatgatcagtggggtaaatggggtgacgaagatggtgacaataaaaatgaaaaagtgtatggtgacgtgcaactgaagttggagttgcgtgatagggtggataactttttcaaatttcttcataagttatctgatctgaaaagaaagaatataccattgagggatggatcattgactacggaagctaattttgatgaggatagaaaaggattactttataagctactaacaagggtgttgggcaagtacgatgtgcctgggttagaatatcattcttccactgtggggcgcttgtttaaaagtgggtttggaagatttggccttggtcaggccaaaccaagtcttgccgatcaaaatgtcattttggtgtttgttattgggggcattaatggactcgaggtgcgtgaagctcataaggcattgggtgaaagtggaagacctgatatagagttgcttgttggtggaacaactctcctcacttccaatgacatgctcgacttactgttaggggactcgagttacatttaa

SEQ ID NO: 82742 - DNA, 111 bp, Glycine max
  Peptide Sequence Number=SeqID_199520
atgtcgtttcaaagaaggtggactaacgaggaccatggtgagattgatgtggttgagcaaatggttgctaaaccggttgtggagcataacaagaagatcaacaagttgtag

SEQ ID NO: 82743 - DNA, 404 bp, Glycine max
  Peptide Sequence Number=SeqID_199521
atggcttcccgtaagagaaaagccacaactgtagtgtctcaggccggttatgatagatcaagatttatatcacaggaggcctgggactgttactcagataatgtgcttgccaggaacgttctactagaaagaaatttcaagttgtatatcaatgagttcgatgatttcagaagagaattgattagaagaaactggcataaacagctaaccaggttgacagagggaagcattaatgtagcaattgtgaaggaattctatgcaaatctatatgtccctgaggacaagtttccaaagcaagttagggttcgagggaacctaataaaatttgatgttgattccctcaacacctttttggagactccagtggttgtggagcaaggggaaagcttaccttcttactccag

SEQ ID NO: 82744 - DNA, 1077 bp, Glycine max
  Peptide Sequence Number=SeqID_199522
atgggtctgaactacagaaatttgttcccaggaacaccatcaaactgtctacaagactgttcttatgatgataaatcatcatgttgtgatccttctaatttgctccctccaactcctcctatctactcagataatgatttgagccaaagtcccagcaaacacatcaaagctgaatacttgatcataagtttctccattgtagcaaccgctttcattgccctcttctgctacgccatctacgtcaagttcttctcccctcggaacacctcaattatcagaagaagaagaacaacaacaacaacaaccttgtcacagccacaaacagaacaatatttcttggacgaggaagaacatggtcctgtcgttgaccatcccatctggtacatccgcaccaccggtctccaacaagcagtcatcaccgccatcaccgtctgcaattacaaaaaagacgaaggcttgatcgaaggtacagaatgttcagtttgcctcagcgagtttcaagaggacgaaagtctcaggcttttaccaaagtgtaaccacgcttttcacttaccttgcattgacacgtggcttagatcgcacaccaattgccccatgtgtcgtgctcctattgtcactgacccaacaagggttccttcttccatggaccctactgcgtttgaaacaagttcttttgtggaggagatttttgaaaatagtgcggagaatactcaaaatagtagtgatgatttgttgaggggtgaggaagaggaaagagtgcaagaagatgaagcgtgtgaagagaacttggcttctgaacttgtggtgactgtgcagcagccgagaagatcggtgtctctggattcttcttctgctgctaagatcagtcttgctcttgctactgttgtgtcaggggaatctcacggggatcattcaaagagggttggtgggaatgggaatttggctactaaaggtggttctagttcttgttcttcgactagttcagtgaaaaggtcgctatcattcaatgccaaacacttgctatcatggtatagccgaagtcagagaaagccaaatgctcctttgagaagcttctga

SEQ ID NO: 82745 - DNA, 1431 bp, Glycine max
  Peptide Sequence Number=SeqID_199523
atgactgccaaagcacataatgaaatatgcagattaagccctcaaaagcttatcctgatcaaacacaatcgaggtaattttacaattgtcatcttaatcacttgtgtcacattcctcattgcattgcacacccagttcttccttcaaactccaccaccaccatcatcatgggaaacttcaatcttcaacaccactcacaacgagctcaattccacggtccataagcttcgttcctcggtcacgtttcttccactcaaggatctccgccatgcacgtgcaccccttgaaggccacacatggttcatgagttccatgtatgacacacacgaagatggtgaggtccaataccagcaattcccatcagaatcatcacatggtaagcttctatgtctcaaaggacgcgacacgcatgacgggtcatggaactcctatgctttggcatggcctgaggctttgccttataacaccaccttcatgagaggcttaacttttgtgtcatataaccattacaactatgagaatttgtggcatggtttatgtgccatggtcccatttgtggcttggcataagatgaataatagctcacaattgccctcaaggtgggttttgtatcattggggtgagctaaggttcaagatgggcctgtgggttgacaccttgatggaggccacctttaatgggccaccaattattgaaaagtttgatggagttaatgaagatgggccagtgtgctttgaggaggctgtggttatgaggcacaatgagggtggcatgtcaagagaaagaagaatggaagtgtatgatctaatgaggtgcaaggctaggatgttttgtaatgtgagcttaaaggggagtgatgtagaaatcaatgatagaggatcaccaatgatagggatgactttgtttttcaggacaggaccaagatcttttaagaatgacacaattgtggctgaaatctttcataaggagtgtgctaagattgaaggttgccggtttatggtagctcattccaataatctcaccttttgtgagcaggtgaaattgatgagtgtgacagatattttgatatctccacatggtgctcaattgaccaacatgtttctcatgcaaagaaacagcagtgtcatggaattctttcccaaagggtggctgaaacttgctggtgttggccaatatgtttaccattggatagctagctggtcaggaatgaaacaccaaggtagctggagggacccaagtggggatgaatgtccatattcagacgatgatcggagatgcatgtcgatatacaagaacggtagaattggacataatgaaaccctattttcagagtgggctagaaatgttttggctgaggtcaagacaagaaagattcaagaaacttcaataaagagaagagcttctagctcttttggtggtacttgtagctaa

SEQ ID NO: 82746 - DNA, 1248 bp, Glycine max
  Peptide Sequence Number=SeqID_199524
atggtgtgccaagcagcgagccaaacaagattccgggcattaaaacatgagtatggcattgatggtaaagcaacaattattgttagagtgatagcatgcttccaacccttgcatttttgtcagaaaagcagcaagtttccaaagatctcatacaagagcaccataacatctactagtcatttgttttgttggatggttaaggctgacgggtctttgcctcgcccacaccacgtggcttggcaatcaccttcttcaaattacttcagtatgctgcctaagcccagcttacttggtcttccaacatatctgaattcaggcacttccatcttgcctgctgtcagtacatttcatgggcttgcagctccttctatcccaagtctgaagaccaagctaacaaatgaagtgcagggattccttcagtatcactatgctgacacaagtttgaaagaaacacatgttggaggagctttacaaaatgcaaatccttcttctttgcagaagaggttgctgatcttcgaccgctctgataataagacaaggttattttatggtcctgtccctcttgtccagagtccaactgttactgctacaaagtttgctcaaagttacggtgtaaaaggggagggacaggccagtaatgtgggtcaaaagcatctagccagttacagtttactggaagagtctgttaaggatcatgcagttattgaagaaagtgaaaatcatgaagatacagaagaaataaatgcatttctttattctgatgatgaaagcagtgaagatgacgacgatgatacttgtgatgaggtaacaagtacagatcattctcctttggcaactaataagacttatgtgatacaagagcaatttaaagacactaaggaggaggttgctagctctgattggcctaacaaaaggctgaagttatttgatggtgactataatagatcatcgacacctgtggacaggtatagtttggtaagaccaaatgaaacctgtgattgtgtcagtgatgctgaatcgaagaattctagtggctgggcatattctgttgataaaactaaagtagataattcagtggctcaccatatcaaatttaaaaaggataagatccgtgaatcgttgaaagttctcgagaatttaattcctggtgcgaaaggaaaggagccactgttagtcattgatggcactattgagtacttgaaaattttgatgtcccaaactggtgctcttggggtgaaatatcactaa

SEQ ID NO: 82747 - DNA, 2019 bp, Glycine max
  Peptide Sequence Number=SeqID_199525
atgtgggaatcagagagtgagtctggtgcaggaagggaatatgggagtggacttctcacttcaaccaagcacagtctcaagactgagggatttcagcaaagaggcaactgttggtatgtttcaactgatattccaagtgatcttcttgttcaaattggagatgcaaacttccatttgcacaagtatccattgctatctcgaagtggaaagctgaacagaatcatatatgattcgcgcaaccctgacttgaataagatagttatggatgatctccctggagggcctgaggcttttgaacttgcatccaaattttgctatggaattgcaattgatttaacagcaggcaacatctctggccttagatgcgccgcagagtaccttgaaatgacagaggacctagaagagggcaatcttatattcaagacagaagcctttcttagctatgtggttttgtcctcatggagagactccatagtagtgttgaagagctgcgagaagctgtctccgtgggcggagaatcttcaaattgtgagaagatgcagtgagtccatagcatggaaagcatgtgccaatccaaagggaataaggtggtcatacactggaagggtaccaaaagttgcaagtccaaaatggaatgacatgaaggactcaagccctagtaggaaccagcaggttcctcctgattggtggtttgaggatgtttcaatccttaggattgatcactttgttagagtcatcactgctatcaaggtaaagggtatgaggtttgagatgattggtgctggaataatgcattatgcaattaagtggctacctggtttgatgaataaggacacatcaatcccaggagaagaaggaagcaatagtagtactagtaacagtatttctagtagtggtggtagttggaaaggtggacttcatatgattgtggctggacctagagatgacacttcaactcttcaagctaaagatcaaaggatgatcattgagagcctcatcagtataattcccccacagaaggatagtgtctcatgcagcttccttctcaggcttctgagaatggcaaacatgttgaaggttgcacctgcattgattaccgaactggagaaaagggttggaatgcagtttgagcaagctacactggctgatcttctgatcccatgttacaacaaaaatgagactacttatgatgtggatcttgttcagaggctgcttgagcattttcttgttcaagagcagaatgaaagttcaagcccaagcagaccaccctttcctgacaagcatgtgagcagtaacattaatgctaagacaagagtggcaagacttgtggacagttatcttactgaggtttccagagataggaacctttctctcacaaagtttcaggttctttcagaagctttgcctgagtcagctaggacttctgatgatggactctacagagcaattgattcctatcttaaggctcatccaacactaactgagcatgaaaggaaacggctctgccgggtaatggattgtcagaaactctccattgatgcttgtatgcatgctgctcaaaatgaaaggcttccattgagggtagtagtgcaagttctcttctctgaacaggtgaagataagcaatgcactagccaacaacggttctctgaaagaaggtgctgaatctcactaccagccaatgattccaaaccggaaaacgcttctcgaagggacgccacaatcattccaagaaggatggacagcagctaagaaagacatcaacacactcaagtttgagcttgagactgtgaaaaccaagtacttggagcttcaaaatgacatggaaaacctgcagaaacactttgataagttgctgaagcagaagcacagttcagcatggagcagtgggtggaagaaactaagcaaactcacaaaaatgactaatgtggaaaatcatgatatttcacctcagattccaacttcagaagaacagaacagaaagacaacaactagaaggtggagaaactcaatatcctga

SEQ ID NO: 82748 - DNA, 228 bp, Glycine max
  Peptide Sequence Number=SeqID_199526
atggctggacggaatgatcatgcgatagttgatgctcttcaagccttagctcaggctgtagggaatccaaacaggggagaagctggtggagctgttgagttaattaggcaagtttgtgaagtgctgatttttagcttctcgttaagccaatctgccggcttagcgatccatctgctaagtgcaccactcttgcagctgagcgcgaggaagaatctggaagaaggatga

SEQ ID NO: 82749 - DNA, 969 bp, Glycine max
  Peptide Sequence Number=SeqID_199527
atgggtaagctgcatttgcatggtggaaccggaagagttggttcgaattacgacactgttgttgtgattaagattcacaatatacgtgttttgcacattgattcccggtctttgttgctggctatggttcttgtcgctttacctttcttggggtttattctgaagggttcagttgtttctggatttgatgctactgctactgaatcaggttccatcatcagtgatgaggtgttgaatttgattctccgtgatttgggcgaggagggtcttctaagaaaggagcataaggttctcattatggactctccacctccacgtgttatggattttgaagtgtcttatgattttgtgttcacctgcagctttgatgctgctgcttttgctgatagtgttttgaaagttaatgggattgtggctttcccattgaggattgacccaacatctaatgctggtatgaaggctactgatgttgcattgaggaaaattgggttggttaatgacttggtggattcttcaccaaagagaaagctttgccaattggcaacacgggttaagagaaatgctttgaagggtcttgaggacgcgcttcttgagccaccgagggatgattttgccaagccaaacaagattaagtacctcctgagttgttgggtgattctcttgaaggttacaagagaggagtcttcattggtgtgggcttgcatgaggaaaatagagctgcggttgaatggtttgagcaggactaccccaaaaagggtgcaatgttttagattcatagtctccaggttgcatcagaaccacatggatgtttccgcatggttaacaaatcatgtgaaggaggaagagtttgttgtgatgaaggctgaagcagggaggagaaataagagtggcagaacatattgggagtgcttggctttgtatggaaggctgagggatgagggagttgcagtgcaccaatggtggaattga

SEQ ID NO: 82750 - DNA, 332 bp, Glycine max
  Peptide Sequence Number=SeqID_199528
gcttttcgacttacagacagcaaatctttatacggataaccactcgggtatttccgcccgtcagcgtgactcaaaagtcaatatgacagatcttgtgagcgcggaagatgacataaatctccacctatcaacgatcttgtctgccgcgattgaggaaggcttttcgacttacagacagcaaaaagtttatatgaataaccactcaggtatttccgctcgtcagcgtgactcaaaagtcagtatgacagatcttgtgagcgcggaagatgacgtcaatctccgcgtgccaacgggcttgtcgatcgcgattgacgaagggcgcagaagacgac

SEQ ID NO: 82751 - DNA, 3784 bp, Glycine max
  Peptide Sequence Number=SeqID_199529
atggggagcgttactgaagggaagttgaggttttgtattgatagagggggcacgtttactgatgtgtatgcagaaatccctggtcagactgatgggcaagttttgaagcttctgtcggttgaccctttgaactatgatgatgcaccggtggaagggatacggaggattcttgaagaattcactggtgagaaaattccacgcaactcaaagatacccactgagaagattgagtggataaggatgggtacaactgtggcaacgaatgcacttttagagcgcaagggagaaaggattgcagtgtgtgtgactcgaggctttcgtgatttactccagatagggaaccaggctcgccccagcatatttgaccttactgtgttgaagccatcaaatctctatgaagaagttgtggaggttgaagagagagttcaacttgttcagtctgaggaagaagaagaaaagcagggtggttcttcatctgtggttaagggaatttcaggggagcttgtcaggattgtgaagcctcttaatgaagaagcactgaagccagtactgaaaaacttattggacaaaggaattagttgtttggctgttgttttgatgcactcatacacttatccacaacatgaacaacaggtcaagaagttagctttgagtctgggattcagacatgtttccatatcatctgctttgagtcccatggtccgtgctgttcctcgtggtctaacagctggtgtagatgcttatctgaccccagttattaaagaatacctatcaggattcatctccaaatttgatgagggaattggaaagttgaatgttttgtttatgcaatcagatggaggacttgcacctgagagtaccttctcagggcacaaagcaattttatctggtcctgctggtggagttgttggttactcacaaactctttttgggcttgaaacagataagccactaattgggtttgatatggggggaacatctacagatgtgagtcggtatgcaggtagttatgagcaagtgctggaaacccagattgccggtgccataattcaagcacctcagcttgacataaacactgtagctgctggtggtggttcaaagttgaagttccaatttggtacttttcaagctggaccagaatcagttggagcacaccctggtcccgtatgttaccgaaaaggtggagagttggcaattactgatgctaacctagttctgggatatgttattcctgattatttcccttctatatttggtccaaatgaagatcagcctcttgatttcaagtcaactagaggagaatttgagaagcttgccaggcaaataaatactcaccgaaggaatcaggatccatcttcaaaagacatgacagtggaagagattgcacttggctttgtggatgttgctaatgagacaatgtgtcgtcctataagacagttgactgaaatgaagggccatgagacaaagaaccattcacttgcttgctttggtggtgctggacctcagcatgcttgtgctatagctaggtcgttaggtatgaaagaagtgctcattcacagattttgtgggatcttaagtgcatatggaatggggttggcaaatgttgtggaagaggcacaggaaccttattctgcagtgtatggagttgaatctattgttgaggtctcacaacgagaagctgttttacttagacaggtaaagcagaaattgcaaattcaaggatttaaggaggaaaatatttcaacagagacatatttaaacttgagatatgaaggtacagacactgccatcatggtcaaaagacaagtagctgaagatggaaatttatgtgactatgctactgagtttgtgagattgtttcaacaggaatacggctttaaactccagaataggaatattgttatctgtgatgttagagttcgtggtataggagtcaccaatatattgaggccacaggccatagaacctgcccctggcagtcctatagttgaaggctactataaggtttactttgggaatggttggcaggaaacacctctctataagcttgaaaagctgggctatggtcatatgatgtctgggccagcaatcatcatgaatggcaatagcactgtgattgtagaacccaactgtagagccattataaccaaatacggaaacatcaagattgaaatagagtcccctttaaccagtgttaaaatatcagataaagttgcagatgttgtacagctctccatcttcaatcacagatttatgggtatagctgagcagatgggaaggacactacaaagaacttccatttcaacaaatatcaaagaacggcttgatttttcctgtgctctatttgatcctagtgggggcctagttgcaaatgcacctcatgttcctgtccatctaggagctatgtctagtacagttcagtggcagctcaattactggggtgacaatttaaatgaaggagatgttttggttactaatcatccatctgctggaggtagccatcttcctgatataactgttattacacctgttttcttcaatgggaagttggttttttttgtggcaaatagagggcatcatgcagagatcgggggtactacccctggaagcatgccgcctttttcaaaatccatattggaggaaggagctgccattaaggcatttaagcttgttgaaaaaggtatctttcaagaagaggggatcattaaacttctgcagttcccaagctctgatggtcgaggaaataagatagcaggaactcgcaggattcaagataacttgtcagatctgcgagcgcaagtagcagcaaatcaaagaggaatttctctagttctagagctcattgagcagtatggtcttgaaacagttcaggcttacatgaattatgtacaggtgaatgcagaagcggcagtaagagagatgctgaagtccgttggtcatagaatttcatccaagtcaaatgaactcgtgactattgaagaagaggactacatggatgatggatccattattcatttgaaactgagcattgattctaataaaggagaagcagttttcgattttgctgggacaagttctgaagtttatggtaattggaatgcgcccaaagctgtaacagctgcagctgtcatatactgtgtccgctgtttagtgaacgttgatattcctctcaatcaaggctgtttggctccagtgaagattcttattccagaaggctcatttctctctccaagtgatactgctgctgtagtaggaggtaatgtccttacatctcagaggataactgatgttatattcactgcatttcaggcctgtgcttgttcccagggatgtatgaataattttacatttggggatgatacttttggttattatgaaaccattggaggtggaagtggggctggtcctacctgggatggaaccagtggggtacagtgccacatgacaaatacaagaatgactgatcctgagatatttgagcaaagatatccagtgattctgcacaagtttggacttagagaaaacagtggaggagatggatttcacaaaggtggtgatggtcttctccgagaaatagagtttaggcgcccagtaattgttagcattctttctgagaggcgtgtccatgcaccaagagggctcaagggaggaaaagatggtgctcgtggagctaactaccttgtaaagaaagataaacgaaagatttatctcggtggtaagaatacagtcgaagtgcttccaggggaaattcttcagattttgactcctggcggtggcggatggg

SEQ ID NO: 82752 - DNA, 312 bp, Glycine max
  Peptide Sequence Number=SeqID_199530
atgacaaaggagatgtgggatttcattcaaggccttgggaaagtgtttgaggaaaaagagttgaacataaagatactaaagtccctcaatagaacatggcaaccgaaggtcacgacaatctttgagtccaaagatcttacctccatcacatatgttgagctactaaaaaaattaagaaaatatgaaatggacatgattaggatggctgaagaggaggctaaggagaagaagagtagagacttagcactaaaaccctccataccatctagtgatgcgagtgaagaagaaaatgcagaaggtttcaagagctag

SEQ ID NO: 82753 - DNA, 2526 bp, Glycine max
  Peptide Sequence Number=SeqID_199531
atggagattgtgaccggagatcggtacctggagaagctggtgcagttcgtggagaaccaggcgggtcctctgatcgaaggagccttggtgttgaagctaaatccggcgggtctccactacgtgcaatcccggctggaggcgctgcacgagctcgaaagcctcctcgccggcgctccggtggactacctccgagcctacgtgtcggacctcggcgaccaccgcgccctggagcagctccggcggatcctgcgcctcctcacatcgctgaaaatcgtttcggttctgcctcatcccatcagggaccccacgcccttgtccttcttgccgtttgggcgcttgaaggttctggagctcaggggttgcgacttgtcaacttccgccgccaaaggcttgctcgagctcaggcacacactcgagaagatcatttgccacaactctaccgatgctctgcggcatgtgtttgctagcaggataacggaggtgaagaattctccgcagtggaaccgcttgtcgtttgtgtcatgtgcgtgtaatggcttggttctcatggacgagtctctgcagcttcttcctgcggttgaaacgcttgaccttagcaggaacaagtttgcaaaggtagataatctgcataagtgtaccaaattgaagcatttggaccttggtttcaatcacttgagaacatttgcacccttcacccagtatttagctccagttgatcctgtgatgagcaatctagtaacgattttagtggaaactagaatggtttcctgtcatattgttaaactagttttgaggaacaatgctctaactactttgcatgggattgagaatttgaagtcacttgaaggacttgatgtttcctacaatattatttccaatttttcagagctagagtttgttgcagggcttccatatcttcaaagcttgtggttggaaggaaatcctttgtgttgtgctcgatggtatagagcacaagtattcagcttctttgcctatccagaaaggttgaagttagacgagaaagaaattaacactagtgatttttggaagagacaaataattattgccagtatgcataagcgacctgccagttttgggatttatgtgcctgcaaaggatgaagctgtcattgaaggtggcaatatcagaaggagaaaggtctctcgtcttgtcagtataaaaaatgaagagaccactagcatatgttctgacgaggactttgtctcttgtgcaaatgatattcaaaatagagaggatcctgatttatctgacaatgaagctgaaatggtagatttgataaatagagttgagcatatgaagaaagagcgctctattcattggttgagggaatttaaagactggatggatattgcttctgacaaatcagtagaaactagaaaggaaggcagcacttccctgcatcatcagaaagaaaattacatcagaaagaagacaaatcaggagcagtctggtgacatctcaagatatgcttcagactcagttctagcctcgggagatgacagtagcatgaatattttagaatctgatagttcttttgtagatatgtcagctagttatcatagacaacagcactttgactatagaggtttgcttggtaatgctagtggggcttcacattttgactcaggaggagtggacatggagcgccttaaatcctcacttgagggaattagtagttctctctcacaaaatagaagttcccattctgacaccgttaccacccaaggaacacaaagaatgactgaaaatgtcaacttctcaccattgagtaccattcatgatatatctgggtctcagtcatcatctgcttgccccacgtctcctcctcattttcaagaagaccttcttcatcgccggcaacacttggtggaggaaattttgcagctgtcggcagattccttttcagtggtatcttttgatagtaacacaagctgtagtgatgttgattgcagtgaatttgagttgtcagtgcctaaagttgataatttcccatgcaaatattatatgaatggaagtgttgatggtcatttatctcaaaatcagctcaaggaaaagttttacaacccaagacaaggaattcttcatgcaagagaaaatggaaattctttatctagttctacctgtgacccaacttctaagcagcattcaattgattttgctgctggtgctgacaatgctgagagtgcattttgtgctaaccaggacactggtttgttggagaatagaaaaattagaaaaaaagccaagagaattatttcaatattagaagagaatttagatgttgatgcatctgatcatacacaagaacagacaagtcaaggacagatttctccaaatttaaaacaagtattggacattgatgattctactgaattttctgggcaccattactctacccaagagaatgatgatttgattgtgacatatttcaatacaagtattgctgattctgaagccagtgaggattactactcaactagtgttcagaacgttttaatgttttaa

SEQ ID NO: 82754 - DNA, 363 bp, Glycine max
  Peptide Sequence Number=SeqID_199532
atgaaacacctgatgcttattcttttttcaatgttacagaagacaccatttggatatacaaggaaagatgtcctattaattggacttggagttactttacttggcattggcttaaaaagtggactagagtttgttggagttgattcactacaagcaggaaatgtggttcagctagtgctggttttgggcctcacagttgggtggatctcaacatatatcttcagagtttcaaacaaggaaatgacatatgcacaacaactacgtgactatgaaagcaaagtgatggagaagcggttagaatccctaacagaagcagagctacaagcactgcttgaagaagttgaggaagagaagagtcgctag

SEQ ID NO: 82755 - DNA, 636 bp, Glycine max
  Peptide Sequence Number=SeqID_199533
ctattgaatccctctttaatataccatccaggaacacttttgagtgttttgagttgccacaagattgaagaagtttgtgaggtgctagtaggaatgggacttcaggcgcattgtggaaatttaaatggcagtttggagcaggtccaggttgagttgtttgacaatcaaatatgtggtggttcaaatgtgagcatatatcagtatgcaatggtgctcctcttttgtaaaaatggcagtgaggaatcatggctctcgagatcactctttgtgattggagggaatgtgcttttatgcattgaagatcttaagcagctgtactcattatcatcagatgcgtctgtctctccatatttcagaattgattcatgttgctccattgctgacattactgagatggttattgaggttggtggcagctgctgtgtgactttaggtctgacttgtccattggcagaactccatccatctacccaaatgaaccttcaaaccgtcaatcatgaaaatactgttccccggtctcgtaaattgaagcttcagtggttctctaaagattaccttgtgaagtttgtgtcattgttgaaggcaatccatgaaaaagaaacggggtcacctttggtagtaagatgtatatcgtaa

SEQ ID NO: 82756 - DNA, 534 bp, Glycine max
  Peptide Sequence Number=SeqID_199534
atggcgaggccagaaaggacaggtagaaataaaagtttagagactctaatagactcggacaaaccaggaatgggaagaaatgtgaaccaactgaagactcagaagtccattccaggctatggccttgaattcagtaacctctcgtatagtatcataaagaagcagaaaaacgatggagtttggatcaacaaagaaacatatcttcttcatgatatctctggccaggcaataaaaggtgaaattatggcaatcatgggacctagtggtgctggcaagtccacctttcttgatgcattggccgggcgaattgcaaaagggagtctagaaggatcagttagaattgatggaaaaccagttactacaagctacatgaaaatggtgtcatcatatgtgatgcaagatgaccagctcttccctatgttgacagtctttgaaacatttatgtttgcggctgaagttaggcttcctccttccatttccaggagtgaaaagaagaagagggtttatgagctccttgaccaattgggcttacag

SEQ ID NO: 82757 - DNA, 1350 bp, Glycine max
  Peptide Sequence Number=SeqID_199535
atggcaccaccgaaccccccacccacttcagaagcaagttcctccgccgtacagaaagtgaaaagcaatctcgtcttccgttcaacctgggccgaactcaacggcgccatgggtgacctaggtacatacatacccattgttctgtccctaaccctagccagtgacctcaacctcggcaccacattgatcttcaccggcatgtacaacatcatcaccggcgccatctacggcgtccccatgcccgtccagcccatgaagtccatcgcagctgtcgccctcgccgaccccaccttctccataccggagatcatggcctccggtatcctcaccggagcaaccatgttggtcctaggcgtcaccgggctcatgcagctagcttacaagctcattcccttgtgtgttgtgaggggaatccagctagcacagggtttgtcctttgcgttgaccgcggtcaaatatgtaagaaaagtacaagatttgcctcggtccaaatcaatggaccaaagacactcgcttgggttcgatgggttgattctcgccatcgcatgtgtttgttttattgtcattgtaaatggtgctggcgaggacccgaatcacgatcatgatcatgaccacgacgaagaaccatcccaccaaatccaagccagaataagtaataaagtgagaaaaataagaagggttatttttgcgcttccttcggctttcttggtgtttgtgttgggagtgttgttggctttcataagaaggcctagggtggtgcatgagattaaatttggaccctcttctatagaggtggtgaaaatgtctagacatgcatggaagcaaggtttcataaagggcacaatccctcaactcccattgtcaattttaaactctgtgatagcggtttgcaaactatcatcagacttgtttccaggtttgatgaaccttgtgggagggtggtttggggccatgccatgttgccatggagctggtgggcttgcggggcagtataaatttggagggaggagtggagggtgtgttgcacttcttggtgcggctaagttgattttagggtttgtgttgggaagttctttggctcattttttcaaccagtttcctgtggggatcttaggggtgttgctcttgtttgctggggttgaactagccatggcttctagggacatgaatactaaagaagattcttttgttatgcttctttgtactgctgtttcgttggtggggtccagtgctgctcttggattcttgtgtgggatgattgtttttgtgcttcttaagctaagggattggataaatggtaagccgattaatgctatttggaagcatgaaggccctgatgagcaagtttga

SEQ ID NO: 82758 - DNA, 638 bp, Glycine max
  Peptide Sequence Number=SeqID_199536
atgtcaggaccaagaagtgcagtttcaaaccaatattctgcggctcctgcagtggttggccagtctatggactactcagcaacttcatatgaaggatttgagattgaggaagtgcttgatgagctaaacttcggatccaagtatgcaaacccatggttgcgtgaggttgcagtgctctcatggcgaacagcactcaatgtaattcgcaccccagaactcttcctctcccgtgagattgtcttaactgttatggcacttatcctgtccaacatttttcgaaatctgagtcatcctttattcaaagacatcaataggctcctcaatttctacatctttgcagtgtgccttgttttcttttcttccaatgatgcagtcccttcttttatcatggagaggttcatcttcataagggagacttcacataatgcttaccgtgcttcttcatatgtcatttcttccctcattgtttacctcccattttttgctgttcaaggtttcacatttgctgtcataaccaaaaagatgctccacttgagaagcagtctcttgtatttctggctaatactttatgcctcgcttattactaccaatgcatatgtgatgcttgttagtgcacttgtgcctagttacatcacagg

SEQ ID NO: 82759 - DNA, 1167 bp, Glycine max
  Peptide Sequence Number=SeqID_199537
atggagggcattctgaaccttccagtgcaagaccctctttgtcccgagttttctgctgctcacataaattgggtcaaattggaaggtggtcgccaatgtggtgataatattgctctgattccttttgccagagttgatgattttgtcaaaggggaatcttccaaccccgaatgccctgcgagttttcgcttagaatcaagaaggaagagacctgtaggaagcattgccaaaccaagggttgatggctatcttgaatatacattatactggtgttcttatggtcccaaagactaccgagagagtgactcgggtgtaggggaggcgtcacatgatgagaggggacgagagctatgtatgcatgctccgcgaatttcggatgagttacgccagaaagtgatgtccatgctttatgttggaatatctttggacaagataatccagcaccatgcagaggatatgcagaagcaaggtggcccccaaaaccgtgatgattttctcactcgaaatgatgtgcgtaacatggaaaggactgttcgtaattcttcaaatgagctacacgaaaatgatgaatgcagtgtaaagatatgggttcagcagcatcagaagcatgttttctattttcaagataactcaagttcagaaccatttgtgttgggcatacaaacagattggcagttgcaacaaatgcttcgttttggaaataatagtttcatttcttttcattcaagttttggcttgaagaagcttaaggagaattatgccagtttctggccaagggttgactggttaatccacactttaactactgaatttcactcattatactggctagatcaatacagtttagagactgggtattttgagaatctacgggacaattctttctcctctaatgtttggtaccatgctcttcatattccagatgttgatgtgatactggatgagcaaaatctccatcttgccaaagttgcgagaccatcattgtctactcaaggttataaacaagctttgctcacccttctccataatcctcctgatgatcctttagttctggacctcacaattctacatgtgacccatttgcaacaagacattaaggccttggaagacttttccaacaatggattgctccagcctatagctcctgatttaagttctcaaacctga

SEQ ID NO: 82760 - DNA, 1269 bp, Glycine max
  Peptide Sequence Number=SeqID_199538
atgctgaggaagaggaacaggtcagtgcagaaggatcaacacctcatgtgtgaagtcaattcggagcactattctcaatctcatcatgctttggggcgaaacaacattaagggccactcaattttcaatgtcccttgtctttttgtgggtctaggtccaaaaggcttgttggattctgattcagttaggagccccacttctccactcgatgatgctagagttctttcaaatctaggcaagaaccctgttaggaagccaagatcttcacaccatgaaaggagctgggattgttgcaaagtaggtctaggcattgtggagtctttggaagactgttctagttctaggttttctgggaaaattctccagtcaccagagagcaagagagttagtctcagtccccaaatgatgatgatcaaagccccaaattgccaaatccacagggattcttctcttgagggatctaagtctttgcccaaagatttttgtaaggctcctccttattatgcccaccaaaatggatctgttgttatccacaagggtgaatgtgaatctgagtccactgttctttttgagattggggaaagtggccttgagcttgagccgtttgggagaaccaggtcttgttcattggactcatgcagtccactgaaagctctctctggtgtaaccactttttattctaattcagacactgataataattttgctgtgaaagatgtgagctcccctcctcgttttattggaggaagccagaactcaaataataacttcacacctacaaagctgaattcaaccacactttccattagcccttccaatgatatcatcaagtctctatcagctagtgagattgaactatctgaggactacacttgtgtgatttcccatggccccaatcccaaaacaactcacatttttggggattgcattttggagactcattctaatgcatttaaaacccatttcaagaatgaagagaaggagcatggagtgaagccattgggtagcaacaagttagggagtcctaagccatatccctctagtgacttcttaagtttctgccaccattgcaacaagaaacttgaagaggggaaagacatttatatttatgggggtgaaaaggcattttgcagtttaacttgccgtgccatggagatcatgattgatgaggaactagagaaatccaacaccaaccctccttgtgaaagctctccaaagccaaaacttggtgagctgctttttgaaacaggaattctcacagctacataa

SEQ ID NO: 82761 - DNA, 588 bp, Glycine max
  Peptide Sequence Number=SeqID_199539
atgaatttatgtatttccggttattattactcgcaccatatgctggaaccaggtaccgattttgatgacaataattcagatcctcctttatccgcacaagatgacattatagaatctgatatagagttggataatgctgatgttgttgagcccgataatgaccctcctcaaaagatgggaaatccttctgctgaagtaacggaagaacagaggtatcgtaaattgttccagattaatccagactcagccaaaggatacaaaatacgaggaatgtcgagggctatgttgggactaagggaagaagcagcaagtgaccttcacgtggcttcaaagttagatttcgatgaagagattagtatagcacttaaaaaggttgaacctaatgccaacaaaattgaggagcataggagaaaatgtgaacgcttaagaaaacgaaaggaacagaaaaggtctcctattaagaccgaaactcctatcaagaaggagagcaagaaactgaagcccagaaaggctttgcaagctgctatgaagcctggtattccaaaaatggcaaaatatcaagatcatacttggctgtatttgatatga

SEQ ID NO: 82762 - DNA, 174 bp, Glycine max
  Peptide Sequence Number=SeqID_199540
atgtatacagagctcattggaatattgatcgttgatgacagcagggaatggaaatactggagaagcttctctactgccaagtatatgctagtttattggctcaacgtggaaaaagacttggcgataaacgattttataggaaaaccaaattttagagggtttgaagataaatga

SEQ ID NO: 82763 - DNA, 1527 bp, Glycine max
  Peptide Sequence Number=SeqID_199541
atgcacgcgaaatcggcgcagtcgtcgttccgggatcggactcaggaattccacagcatcacagagaggttgaagaagtccggatcagggcccaatgggcccagcagcagcacttcttccaccagatcggaggaacagcgatccgcgatcgccaaccaatcggagttcaatagaagggcctccaaaatcggatacggaattcaccaaacgtctcagaaactcgccaaactcgccaagttggcgaagaggacgtcggtttttgatgaccctactatggaaatccaagagcttacgggggttattaagcaggatattactgctctgaactctgccgttgtggatcttcagtttctgtgtaactctaggaatgagagtgggaatgtttccgccgacaccactagccattcgagcactgtggtcgatgacttgaaaacacggttgatgagcaccaccaaagagtttaaggatgttctcaccatgagaactgagaacatgaaagtgcatgagaatagaagacagttgttttcatcttctgcatctaaggattctgcaaatccttttattcggcaacggccgttggctgcaagggcggctgctagtacttctaatgcccctgctcttccctgggctaatgggtcaccatcttcatctcaggcgtttcctaagaagcaagtggatggggagagtcaaccattgttgcaacaacagcagcagcagcaggaggtagttccattgcaagacagttacatgcaaagcagagctgaagctcttcagaatgttgagtccactattcacgagcttagcaacatttttaatcagcttgcaacacttgtttcccaacaaggagagattgccatcaggattgatgaaaacatggacgatacattggcaaacgtagagggagcacaaggggctttgctgaacattgcggagaggttgaagaaaacagggccagcgccgaatggacaaagcagcagttcatccagatcggaggaacagcgatccgcgattgcaaatcaatcggagttcaatagaagagcttccaagatcggcttcgggattcaccaaacctctcagaaactcgccaagctcgccaagttggctaagaggacttcggttttcgatgaccctaccatggaaattcaagagcttacgggggttattaagcaagacatcactgctctaaactctgcggttgtggatcttcagttactcagcaactctcggaacgagagtgggaacgcttctaccgacacgactagccattcgaccacggtggttgatgacctgaagacacggttgatgagcgccaccaaagagtttaaagatgttctcaccatgcgaactgagaacttgaaagtgcatgagaataggaggcagctgttttcggccactgcttctaaggactctgcgaatccttttgtccggcaacggccgttggctacgaggtcggctgctagtacttctaatgcccccgctgcaccttgggctactgggtcatcttcatctcagttgtttcctaagtaa

SEQ ID NO: 82764 - DNA, 2724 bp, Glycine max
  Peptide Sequence Number=SeqID_199542
atggacactttgttttttgggataaagcttcgtgcttctttgcaaggtaacaacactatcaaaagggttttccccagaagcaagaggtgcaacgtttctgcaaaacacgttcgttacccattgaggcatgcttttaggttttgtggccaaaatgtaaacttgttgaagaaacaccatgtttccgcaagttggtctaggttgaaatgtttcagggaaaaggaaccacccttttctctcagtgtgagttatttcaccccattgtggaaagagggggttcttttgatgagggcctctgtgttcactgctgttatctctggtttgtgtcttttggtttggtttggaaggaacaaagcctggggttttgttgaaacaaatatcttgccttctgtttgttcagtgatcagtgagtatgttcagcgcgatgtttgctttggcaaggttttgagaatctcacccttgagtgtaacattggagtcatgttcatttgggccgaatgaagaggagttttcttgtggtgaggctcccaccgtgaaggttcgttttcgccctcttgctagcctgtggagggggaaatttgtgtttgatgcagtattgtcacatccgtgtgtcttggtagtgcagaagaaagactttagttggttaggcatactgccatctcaagggggcattcagaggcgcttgtcaaccaaagaaggacttgatcatcgcactagagtgaggagggttgctcgagaggaggcagctgctaaatatgtgagagaaagggatgatgcagctagggaagctgcagagatgggttactttgtttctgagaagaattgtggtccatccaagggcgatgacgatttaaaggaaattgcaactcattcagtaggaggaacaaactccaagagttttttctgcatgaaggaggtggagcagcatggtcatcgttgcgtgggcacaggtgttgattatgatatgaaacatgctgatttggaggagtcatttagggtaaagtttcctgaaaaaggacttaagttttggaaaagagtcataaaagggcatagaaaacacaaatttaagccgaaggctaaaaggagtgacatcagtgcatctggtattgctctcagaaaaagaattcttgaacgcggtgcatttgcagcaaatgcatactttcgcagtcaatcacatgggaagtttgagcagcctttgtcttcttctggatgttttcatgctagagatcatgataggcaattggtaaaaagtgatgacaaaaatgatgtatctgttgccagtggtgatgataatagaaatggtgatcaccgaaatggaacacaattcagagatctgggagtctggtctccttcagctaatgaaaatattaatggtcattcaaatgatttaaatttttgcagtgatctgcattcacagacaagggagagtaaacatgaaaatttacaatctagtgaggatgttgcagaacatgccaatgctaatattagtacagagaaaaaggaggagttgggacttcatgttgcacacagtccaattgatgttagtgcaactaggggccaaagagatttggtttctgtgaagcctagttctctgttggcagcatattttcacgttccgtttgagaccttgattatgaaatttggcttaaactcgttttttagaaacattgaggggttgaaatctttcttcctttctggtcccattgaaaagttgaagtctgaaatggatggggtagatgttctgcagtctgaagacctaactaagattcttcctgttacattggattctgttcaatttagaggtgcaactgtgatgctacttacatatggtgacagggaagttagggtgctggagaatgtcaatggccatgtgaagtttcataaccactacgaccatataaatgtaaaactgagtggaaattgtaagacttggagatcagatgatatatgtgaaggtgatagctggttgtctgttgatgtttttgttgacactgttgagcagaaatggcatgcaaatttgaaaattgaccacttttttgtcccgctgtttgaaaggatcctagacattccaattacatggtctaaaggaagggccagcggtgaggttcacttgtgcatgtcaaagggtgaaacttttccaaatcatcatggacagcttaacgtaacagggttgaacttccaactatcagacgctccatcgtgtttttccaacatatcaggaagtttatgttttcgtggtcaaagtatatttttacacaatgcatgtggctggtttggcagcattcctctagaagcatcaggagattttggcattcatcccgaggaaggagaatttcatcttatgtgtcaggttcctagtgttgaagtgaatgctttgatgagaactttcaatatgagatctctctcgttcccattagcagggtcgataactgctctatttaactgtcaaggcccactggatactcctatatttgtgggaactggaatggtttctaggacattctcttctttgcatgttgatactcctacaactgtagcatctgaagcacttgctaaaagtaaggaggctggagcgttggcagcatttgatcgtgtaccattttcacatgtatctgctaatttcactttcaacactgatagctgtattgctgatttgtatgaaattagagcaagccttgtggacggtggtgaaattcgaggggctgggacagtatggatatgctcagag

SEQ ID NO: 82765 - DNA, 2490 bp, Glycine max
  Peptide Sequence Number=SeqID_199543
atgggtaggtggagaatgaaactcgatattcccagagctgaagttgctgagatgctccctcttgcaaggctactttctcgaagtatggatcctgctgttctttcaagatcaaagttaagaagggagcatcatgctccgtcaaatgatgttcttgatgatttgagccttcccggtttacttgaactcaaaggtcgctggcatggttctctcaatgccagcggtggagggaatggagacaccctggcagaatttgactttcatggggaggactgggagtggggagaatacaaaactcagcgtgtcttggcagttggtacttatagtaatgatgatggtttgaacctggagaagttttttatccagaaggaaaatgccacaattcatgctgatggaactttgttaggacctaaatccaaccttcattttgctgtcttaaactttcctgttagtctgataccaacagtagttcagatcattgactctacatcatccaatgttgctcattctctgcggcaattgttagcacccattagggggatcttgcatatggaaggagatcttagaggaagtttagcaaaaccagaatgtgatgctcaaattaggctacttgatggcgccattggtggaattgttcttgaacgagcagaagtcgttacctctctaacctcaaccagtcactttctattcaatgcaaaatttgaacctttgatccagaatggtcatgtactagttcaaggagctattcctgttactttttttcaaagtaacatgttacagcaagatgtggaattagataagagtaggactacttgggttcctgaatgggtgaaaaagaagagcatggggactaccgatgatgccagagacaaaaaagtttctagacgcagaaatgaagaaggttggaatactcaattagctgaaagccttaaaggtttaaattggcaaattttagatgttagagaagtcagggttgatgttgatataaaagatgggggaatgatgctggtaacagctttaactccttatgccaattggcttcatggcagtgctgatatcatgcttgaggccagaggtacagttgatcaaccagtgcttaatggatatgcatcattccgcagggcatctatatcttcaccggtgttccgaaattcactgaccaactttggtggaattgtgcacatgaaatcaaacaggttatccattccctcactggagagtaggataggcagaaaaggaaagcttcttgtaaaggggaatcttcccctcagaactaaggaaccagctctcaatgacaagatcgagtttaagtgtgaagttctagaagttaactcccaggtgcaaataactggttccatattgcaacctaacatttctggaaatattaaacttagtcagggagaagtatatttgccacatgataagggtggtgctgcttccaatggattcccatcttatccatctgcagttccccgtggtggcattgataaatcatatgcttcaagatatatttcacagtattttggctcagaatctgcttctctgatggccaaaaattcccaatcctctggctctgtcaatgagtcaattcaggtggaaaaggatatggaggaagtgcagataaaaccaaatataggaatccgccttagtgatctgaagcttgtgcttggaccagagttgaagatagtttatcctttcatccttaatttttctgttagtggagagcttgagttgaatggtcttgcccatcccaaatgcataaaacctaggggcacactggcatttgagaatggagaagttgatctagtcgcaacgcaggtgaggttaaaacgggagcatctcaatgttgcaaggtttgaacctgataatggactagatcctatgctagatttaaccttggttggatctgagaggcaatatagaattcatcatcgagctagcaattggcaggagtttgtagaacaggatacactgtcaccaattgagggtttaggatcaactggtccagtctggttagggttggaacaggtccttgagctgatgaagctcttaaaatccccagttgaagccaaacaagttgccagaagacttgatagtcagttagcagaatccattttggaaaacaatggtcatgttgcatttgaaaaggttgtaactgctactcttgaaaaactaatgccacgaatagaagggaagggagagtttggcctggctaagtggaagttggtttacgctccccagattcctagtttggtttgttctggtgctacagtagatcctttcacgttacttgctgctaatttatcatttggtacggacgttgaagtccagcttgggaaacatattcaggccagaatcgttaggcaaatgaaggagtcacagatggcaatggaatggaccttgacctatgaacttacaagtcgtttgcatctgtgtctaaagaatggctcatccaaatgcatactttttgagtattctgcatcccaggattaa

SEQ ID NO: 82766 - DNA, 708 bp, Glycine max
  Peptide Sequence Number=SeqID_199544
gctgagaatgatgagacagcaatagatgcaaacttctctggaagtttggcctttgaaaaaattatgcttcgctatattcccagttatcatcatttgatgccactcaaatttggagttttaagtgaaaacacaaaactttcagggtctcttttaagaccgaggtttgatataaaatggactgcatcgaaagcagaaggatcttttagtgatgctagaggagatatcataatctcagatgatttcgttactgttaattctgcttcagctgcatttgatttgtatatgaaagttcaaacatcttattctgataatttttctcttaaaagagaagagttttatgcaccaagagccattccatttaccgttagtggagttgagtttgatttgcacatgcgtggatttgaattctttagtttggtcactccttatacattggattttccaagacctttgattttgaaagcaaccggaaggatcaagtttcagggaaagattttaaaacctagtaccactgttattgaacaaaattttgacaagaacaagcagcatgtgcaaatgttggagaaaggaagtgcagatagtcttgttggtgaggtttcaatctctggtctcaaattgaatcaattgatgcttgcacctcaaatgtctgggtcgttgagtgtttctcccgagagtatcaaggtgatggataaacttttcccttcctaa

SEQ ID NO: 82767 - DNA, 417 bp, Glycine max
  Peptide Sequence Number=SeqID_199545
atgaaaggaaaaaggttttcattgaatccatatgttccactctctaaatggaatgcagaaaaagattccaagaatcatgatgatgaggcacatcctcaacctcagcaccttcttcaatcgaaggctaaaaacatgcctcagtctttgcagaatgtgtcagaatgggaagtgcaacaagctgacctggaacttggatatctaaagtcggcatttcttgattctgctaaacagtcccttagtgatgcatactcggcaaacaattctgatctggataattcaattgacttgctccaccactttgatgatgagacactgaatattgggaatgttccagaatctgtaccagcagctgattctgcttctcccaacccgaataatacagcatctaaagctggtgcttcgtcaaatcttgcataa

SEQ ID NO: 82768 - DNA, 645 bp, Glycine max
  Peptide Sequence Number=SeqID_199546
atggtttttccttcctcctccctctccctcttcttccccattcccactctgcttcctaataaccttatcttcagaaacaataccagggcaatccttaatcaacacaaatgcccattctccgaggaaagaccacgcttttcatgttgtgctctaaaacccacttcacaaaacaggatttttagaagggatttgatgctgttaggccttacttcgttatctccaacaatgccactttcagtgacacttgcggaagaagaaccaaaaatggcttcatttcttgacgaaataaatgcctattcttatatgtaccctgttgagttaccttccgataattttaccttcaaatggattgaatcccgaaagccagaacgatattcatcagctgcaccactttctcctgatgcacgcctgcgcattgtgtctgagcgtcttgactttattgataatgtcatcatttctgtcacgataggtccaccaaattcaagctatataaaatcaaaggataagagtaaatggactgcaaaagatgttgctgattcagttttagctgacagatcttccctgattatctctacctggaaagtggaaacaaggagtggtaatatggccacaaatgttggatggtggctaaacttcaagttataa

SEQ ID NO: 82769 - DNA, 540 bp, Glycine max
  Peptide Sequence Number=SeqID_199547
atggcgcgccctactcaccatgtcattgacattacggggagttccggaccgtccacttcgtcttcttccacaccccatgataggcttgccaatgatgtggattttggtgctttgaattctaggactagtagaaggcgaggggatactacgcgtagtagtaggcagcataggagtcctttgaattcgggtttgtggatatgtgttgagttagtgatcaccgtgagccagattgttgcgtcggttgttgttctatcgttgtcaaagcatgagcatccgcgtgcccctctgtttgcttggattgttgggtttgcgtctgggtgtgttgctaccctccctttgctgtattggcggtattatcataattgccttgttcgggagctagagtcatcatctcaggcctctctgaggagtaatgatccttcggggacacttctttccgattccacgacgaatggaggggaagatgttccggcatcttccagaagcaaccaagagtcgtggttgatgaatgcaagggatgaaagctctagtgctgaatga

SEQ ID NO: 82770 - DNA, 990 bp, Glycine max
  Peptide Sequence Number=SeqID_199548
atgggtttggattactataatgtgttgaatgttaacagaaatgctacagaggatgatctaaaaaaagcgtatagaaagttggccatgaaatggcaccctgacaagaaccccacaaacaaaaaagaagctgaagccaatttcaaagagatctctgaggcatacgaggcaagaaacgtactgagcgatccacagaagagggtggtttatgatcaggatggagaggaagggctgaaagataggccaccaccaggtaatgaatcagcatcaagtgggtttaatcccagaaatgcagaggatatttttgcagaattctttggaagtagcccttttggatttgggtcatctgggccaggaaggtccaagaggttcccatctgatggaggtggattcagtgcaactgacaataatttccgaacctatagtacaggacgggcgaatatgccaaagaagccactacctgtggagaccaaactagcttgtagtttggcggagttatactctggatctaccaggaaaatgaagatctcaaggagtgtcgtggatgttaacggacaggcaataccagagaccgagatactaaccattgaggtgaagccgggttggaagaaagggacaaagattacattcccagacaaagggaatcagcaaccaaatcaactggcagcagaccttgtgttcgtgattgatgagaagcctcatgatttgttcgatagagatggcaatgacctcattgtgagcaaaagggtgtcactggcagaggccattggaggaaccacaataaatctcaccacactcgatggacgcagtttgagtattcctgtgagtgacatagtgagccctggttatgagatgattgttgcaaatgaagggatgccaataacaaaggagcctggtcataggggtgatttgaggatcaaatttgatgtgaagtttccaacaaggttgacacatgagcaacgagcaggactcaaacgagcattgggaagttga

SEQ ID NO: 82771 - DNA, 744 bp, Glycine max
  Peptide Sequence Number=SeqID_199549
atggcacttgaagtgtcccctgatggtggaaggtggtgctttacgatggagacatgtccatgtttatatcaagaaatgtcatgtgccatattaaaacctggcctacaaactaatttttgctcttctgtgatcttatggctctcaaggattattccatctggggttgtgccaacaaagctcctcaattgggcgtttggagatttttttatactgacgttggtagccagacttgacttgccagagccattaatgggtaaagaatttccttcaagtgatgggtcaaagttgcgcgttgcttataagggccttccaggagcatatactgaggatgcagctttgaaagcatatccaaaatgtgagacagtgccatgtgaggactttgagacttcattcaaggctgttgaatcgtggttagtggataaagctgttctacccatcgaaagttctgttggtgggagcatccaccctaattatgatttacttcttggacacaagctacacattgttggggaggtgcagttgctaattaaccactgcctcttaggattacctggtgtgagaaaagaggatctcaaagctgtaataagccaccctcaggaattactcctatctaaatttctccatatgtctaaatttcttgcagtactgacactggctttctatgatgttgatgatctttctccaagtgaattttctttttgcaaatgccacaaggaggatattggtcttagaaaaagtttctaa

SEQ ID NO: 82772 - DNA, 483 bp, Glycine max
  Peptide Sequence Number=SeqID_199550
atgtttggcaatcagctgattaagaagttaaagaaacaattactcaccccacaacttggcgacaaccatcgtcgtagcgctgccagtgcgggcaacgagacacatcatgttgtcgagttgctcgggaaacaaatccccagagctgctcacaaattcgatgagcatgcaccttctttggttaagcaggttgcaacccaagtcacttgtttggttcagaaagtgacacacaaagctgagaaagtagtgagtgaggctcaatctggaggggcgcgagcagcagcaaattatgtagccactgagtccaagcaaattgtgctctctggttcggtgaaattgtggactggtctcaaccaatatccatcattccattcagtggcagagatggcagttcccctagctgccgaagagtttaacgaattgatgacatcaaaactaaagtggaggctgcttgtcccggagttgtttcttgtgcagatattctag

SEQ ID NO: 82773 - DNA, 279 bp, Glycine max
  Peptide Sequence Number=SeqID_199551
atggattgtcctgcattcctttccatggtaactaccagccaatgtcttaagaatgatggcaacctgtactctggccaatcggttactggggggaaaggaggatattgcacgccaggaatgttgcctatatcaggaaatgttggtgccaaaagttttctatttgcaccttggacctcaccaatgttgatggaaagtgacaaaacaatgaagaaagaaacaaagaagagaaaacggagagaggccattttttttagtgatgttgttggagctaagaaatag

SEQ ID NO: 82774 - DNA, 207 bp, Glycine max
  Peptide Sequence Number=SeqID_199552
atgggtctccactctccaggggagattcagggggtggtggtggttgaaggtggtggagagaggaaagggatggtaggaatggttggaattatggggtttgagggaatgttaggaatgttggggatcttaggaataggaatattggggaaggaaaaaggtggcagtggaagatttgggaaaacaggcaaaggagggacatttccctga

SEQ ID NO: 82775 - DNA, 510 bp, Glycine max
  Peptide Sequence Number=SeqID_199553
atgtctctgattccaagtttcttcggtggccgaaggagcagtgttttcgaccctttctccctcgatgtgtgggaccccttcaaggattttccatttcccagttctctttctgctgaaaattcagcgtttgtgagcacacgagtggattggaaggagacaccagaagcacacgtgttcaaggctgatattccagggctgaagaaggaggaagtgaagctggagattcaagatggcagagttcttcagataagcggagagaggaatgttgaaaaagaagacaagaatgatacgtggcatcgcgtggagcgaagcagtggcaagttggtgaggaggtttagattgccggagaatgctaaagtggaccaagtgaaggcttccatggaaaatggggttctcactgtaactgttcctaaggaagagattaagaagcctgatgttaaggccatagacatctctggttttatgttggctaagaggcctaatgtttgggccctagaaatctctggttaa

SEQ ID NO: 82776 - DNA, 384 bp, Glycine max
  Peptide Sequence Number=SeqID_199554
atgcagcatgtttttcaacatcccctaattgaaactgcaactggcacccctgaaaacatgaaaattagcaacgacagactctcctactttatcgacggtgtcctgttcgagttcaagtatagttacacggagacccctaagaagaaaaaggccacacgtgttgttttaaaggaagctgtggatttggaaaacatgccacttgaggaggaggtatttcagactctgaagagtgattcaaatggactcacaacaaaagtttctaagaagttgggcatctttggtcacaacaaattccaagagaagaaggaaaacaagtttttaatttttcgtgggtcacggaagctgcaaaaatcatggtcattgctttgcaaatgctggaggtaa

SEQ ID NO: 82777 - DNA, 1281 bp, Glycine max
  Peptide Sequence Number=SeqID_199555
atggacgtcgcagtcactgccgttcggtcaccgctgatcgtcctgggaagtccggtcaacgggtccgcctcagctcggttgggttccacttttgggttttccagaaagctatgcttgaattcagtatttatcccgaagcaagttcgtagaagagggtttgttgttagagctgcatcctcatctccggagtgggatgatgccaagatcgctcctcttcagctggagtccccaattgggcagtttctttctcagattttgaaagatcacccgcatcttgtgcctgctgccgtcgaccagcaactccaccagctccaaactgaccgcgatgctcatctacaaaaccaacaacagccttcttcacccactgatttagttttgtacaggagaattgctgaggttaaggctaatgaaaggaggaaagctctggaagagatcttgtatgcattggtggtgcagaagttcatggatgctaatatttctttgataccctctgtaaccccagatctgtctggtaaggttgatttgtggccaaatgaagatggtaaacttgagcagcttcactcagatgaagcatatgagatgattcaaaaccacttgagtctcattctcggtaacaaagctggagatttaacatcagtagctgaaatcagcaaattcagggtagggcaggtctatgcagcatcagtgatgtatggttattttcttaagcgagttgaccaaaggttccagttggagaagacaatgaaagttcttccaaatgcaacagaagaagagaatggtgttcatcgaaatacgatggacaatgcaagacccagtattgaacaggacacttctcaagtgatgtctcatcctgaagtatctgcctggcctggtggtgatgtcagtcccggtggatttggctatggtataaaggcaaccaggttgcgtaactatgtgatgtcctttgatggcgatacactacaaagatatgcagcaattagatccaaagaggctgtcagcatcatcgagaagcacacagaggcattgtttggaagacctgaaattgttgtaacacctgagggggcagtctctaaggatgaaaacatcaaaattagctttggtggtttaaagaagcttgttttagaggctgtgacttttggttcttttctctgggatgttgagagctacgtggactcaagagaccacaggtgggagccttgtgcattcagttgtccttttgatttctgtttgctcccatacatcacaagatacagttcatacttcatagtgtgttggtactga

SEQ ID NO: 82778 - DNA, 1413 bp, Glycine max
  Peptide Sequence Number=SeqID_199556
atgccatgccggggattgttctccttgtctggttctagtttcccagaagtgtcgatgtggctctacttcccgcactgtggagtgttgcaagacaaaaatggaaaatcagaaatttactttctaatccaaataatattcttaatgcggattgggatccacacttgtgtcaattaccatgtgaatccctgtgccacagtgcttccatgttcagttcctcagccttgttcgcatccggcctctcacagctgcctttttcgagattgccctccttgttcagtgcctgtagcaaaagaatgtattggtgggcatgtagttcttaggaacataccttgtggttcgaaggatattagatgcaataaactctgtgtgaagaccagacagtgcggtttacatgcatgtggcagaacatgtcacctcccaccttgtgataatctatctgttgtgacatgtggtgctcctaggagagactgccggcatacatgtatagctccttgtcacccttcaactccaagtccagatacaagatgcgaattccccgtcacaattacttgttcttgtggccgaataacagaaaatgttccttgtgatgctggtgctaattataatgctgatgtggtacatgaagcttccattattcaaaagttgcctgtgcttcttcaacctgtggctgcaaatggcaaaaaagctccccttagacaaagaaaactgatgtgtaatgatgactgtgctaagttagagcgtaaaagggttcttgcagatgcttatgagattaccgctccaaatctggattctctccattttggtgagaattcgattgcttctgaattgcttgctgacatgttgagaagtgattctaaatgggttttatctgttgaggagagatgcaagtttttagtacttggcaagagcagaggaaatgatgcacatggtccaaaagtccaagttttctgtcctatgttaaaggacaaaggagatgcagtaagggtgattgctgagagatggaagcttgtagtgaatgcagctggtcgggagccaaagcatttcatagttgttcatgttaccccaaaatcaagagctcctgctcgtgtgctaggggttaagggtactaccactgtaaatgtgccccttcctcttgcatttgatcctttggttgatatggatcctcgagttgttgtctcttttctagacttaccaagggatgcagatattagtgcattggtgttgagatttggtggtaagtgtgaacttgtttggttaaatgacaaaaatgcgttggccgtttttaatgaccctgcccgtgctgcaactgcaatgaggaggtttgatcacggcactgtttataagggagctgtgatggtggttgttccaccaaatgtcggggcatcagtagcatcttcagctaccaatgcctga

SEQ ID NO: 82779 - DNA, 1059 bp, Glycine max
  Peptide Sequence Number=SeqID_199557
atggttgaagctcatgaattttgcaaggttttacgacttgataagaaatcctttactgaaatactgaagatatactttttagatggtcgtattgtcttgaacaatctccttgaggtaaaagacttgagtctacaacgtaagcttttggagtcagatttcaacctgactattggtaacatggaaacagagctggcaataaggatgaattttgctgcccatgatggtcatcttgatcttgtgaaacgtttgattggatttggggcagatcccaataagactgattacgatggcagaacacccttgcatatctcagcatcaaaaggatatgtagatatttcttcctatcttgttgagcaaggtgtaaatatcaactgtgcagataaatttggcaccactcccttgcttgaagccatcaagaatggacacgaagaagtagcatctatacttgttaacgcaggagctatctttaccattgatgatgttggcaattttctctgcatgactgttgccaagaaggagttggaccttttaaaaagggttctgggttgtggagttaatccaaatgccaaaaattatgatcaacgtacacctcttcacatagctgcctctgaaggtttgtttacaatggcggaagtacttctagaagcaggagcgagtgttttatctaaggacagatggggaaatacacctcttcatgaagctcataccggtggggatagaaatatgatcaaaatgcttgaagtggcaaaagcttctcagttggttgagttgtccaataatattcatgaaactcaagcaacaccaacagatgaaattccgaaaaagagatgtatagtatttcctttccacccatgggatgatcagaaagcggatagaaaagagggagtggtcctaacggttccacaaagcattgaagagcttataaaggaggcgacaaaacatttggaaattccaaacgcttcctgtattttgtcagaacaatgtggcaaaattgtttatgtaggcacgattaacaatgatgagaagctatttctagtgagtgaagcacagaatgaatga

SEQ ID NO: 82780 - DNA, 759 bp, Glycine max
  Peptide Sequence Number=SeqID_199558
atgatctttaatgtggtgacatatctgcttgtccaaattgttcttattgatgtagttaacaatatgagacatttgatctctgaatctctcggtcttagatcccttgacaatcaaggcagtgatgttgccgagaaggtaagcgccgagaatcatgtcaaaggagacataaatcatgacaaatatcatttccctgacattgacggcatggatgtctccgtagccaagagtagccatggtaacaatagcgaagtagagggaggtgacgtaacgcttccaaagatcaatatgagtgaagtcagaataagtatagtcacccatcttcaagctaccgatccagcaagcggcagtgtgggtgcaataaagttcaacgacaaagagtttgaggatacgggagaacaagtaactgacacgggtgttcttctcgagggtgtcgaagaattgggtgactctgaaagcacggcagagccttatcaagagaagatagcggacgagctcgttgttggaggagagtttgtaaaagtagtcccaggggagacaggagagaaaatcggggaggaagcaagacttgaggtatctaagggcgatcttgtgggggtccaggaccaaggagagggagttggactggacctcgtgatagccaaccaagaaccggaggaggatgtcaaggaggaaaaacaattgccccgccatgtccagcaggaaaatcttctggggcaagcctcggaagaacccaaactccatgggagtcaagaaggatga

SEQ ID NO: 82781 - DNA, 480 bp, Glycine max
  Peptide Sequence Number=SeqID_199559
atggagagagaagtactggatcttgtgcattttcagttatctgttcccacaatcaaaacttttctaaggagattcatccaagcagcacaatcttcttacaaggctccttgcgttgaactggaattcctggcaaattatttagcagagcttgctcttgttgaatgcaactttttccagtttctaccttcccttgtagctgcatccgctgtgttccttgccaaatggaccctgaatgagtcagaacatccatggaatccaactctggagcactatacaaaatacaaagcttcagagctcaagactgttgttcttgcactgcaagatctgcaacttaataccaaaggaagctccctgaatgctgtccctgagaagtataagcaacagaagcaatgtgtcataactgcaagagacaattgcaaagctaagcttcccaaggatttaacttttgaatgggaaaattgtcataagtgttcaggatag

SEQ ID NO: 82782 - DNA, 1257 bp, Glycine max
  Peptide Sequence Number=SeqID_199560
atgacagacatctccaagtcccttctctttacctttaccatcatcatcagctttggcttgtgcattctttatgcatctgcagaactccagagatttgcacactcttccaaacatgatggtgctcttagcttcttggtgcttggtgactggggaagaagaggtgcttacaaccaatcactagttgctttccagatgggaaaggttggagagaagcttgatatcgactttgtagtttccactggagacaacttctatgacaatggactgactagtgaccatgacaacgcgtttcaagaatcattcactaaaatttacacagcaaaaagcttgcaaaatcagtggtacagcgtgttaggcaaccacgactataggggtgatgcagaggcccaattgagcccggtccttagagaaattgatagcagatggctttgcttaaggtcctttattgtagattcagagctggttgagattttctttgtagacaccactccttttgttgacgagtacttcactgaaccaccggaacacaagtatgattggcggggcattggcccacaaaaatcttatatttctaacttactcaaggacctagaattggcactgaggggatcaacagcaaaatggaggattgttgttggtcaccatgccattagaagtgttgggcatcatggtgatactcaagaactcataaatcggcttctccctatccttcaggcaaataacgttcacttttacatgaacgggcatgatcattgtcttgagcacattagtgacacggagagccccattcagttcctgactagcggggcagggtcaaaggcttggagaggagacattgaaggaatgaaccgaagaggcgtaaatttcttctatgatggacaaggcttcatgtcagtgaaattgactcagacggatgccaccattgagttctatgatgtttttggcaacgttttgcacagattgacttcttcaaaacagctacattcttccatatatccaacatttctgactgtcctgaatcctcatggttttgtgcataagaatgtgatgccgtggatatgtaaggatggccaaatggaagtatacatttctgataaccaatatccattgtcacttgatccagttgtgcaagcgcgctcagctcaagtgtcgcgttatgcgcacaagaaagttttgattgaccaatcaattggtgaaacatataaaaagaaaagggaaacatttgtttccttagcaacgaagaaaaccaagaagtag

SEQ ID NO: 82783 - DNA, 514 bp, Glycine max
  Peptide Sequence Number=SeqID_199561
atggataaagtaaatagagtttgtgccaaagatgaagagcgtccactccgaatcaccagagcaagagctagagccttgagagggattactccatactcaagaccctccttaaaaaatgagcagaaaaatgtgcttcgagcacatccgaaaagagcagcatcttctgaaaacaaaacttctgtggttgttcctgctgttgtccaacagaagggaagggcagtgctttcagatgtatcaaacatgtgtgcaaaaccacatgataagtgtactaagtcatcaaagtttcaggccaaaggagtttatacaaagaaaaccaccaagctagcagccttaggtgtttccactgaggtttcatcaacacaagagaatgttagagcaaagttggctgaagaattatccacaataaggatggtagaatcaaaggacaccataagagaaggtgttacagcagacactgcactttcaatgcaaaactctctgaaatctgatgagctccagagctctccaaacaaag

SEQ ID NO: 82784 - DNA, 981 bp, Glycine max
  Peptide Sequence Number=SeqID_199562
atgaagagaagttgggataaggacaagaaaggcaacggaggcttccacgttgattctgctccttctcttccccttccgcaaagggactaccatgcgcttcgccttcaagaccaggagatggaaccactttcactgactaccttctctttccaacctctcctggtcacaccctttttacccactcttggattcctcgctctcctgtcacttccatcaggtgacttgttcttcttattcatggacttaacgagcacagtggcagatatactcattttgcaaatcacctcaatgctaatggcttcagggtttacgggatggattggcttggttagccacggtggaagtgatgggttacatggttatgtccattctcttgatgatgctgtttctgatatgaaaatatttttggagaaggttctgaatgaaaatcctgggcttccatgtttctgctttggacactcaacaggagcggccattactcttaaggctctgcttgacccaaaggttgaatctcgcatagctggtgctgtattgacatcaccagcagttggtgtttccccttctcatccaattttgctggtacttgctcctatagcttcatttttgctgccaacgtatcaatgtagttctgcatataagaagggatcgccagtgtctagagacccagaggcgctaattgctaaatattctgatccattagtatatactggacctcttagagtacgtactggttatgagattctcaaaattacaagctacttgcagcaaaatctgagaaaattgagagttccattttttgttctccatggcactgctgattccgtaactgatcccgttgcttctcaaaaattatatgtagaagcctcctcaactgataaaactatgaaactatacgatgggttcttacatgacctgctctttgaacccgaacgagatgctatcacacaggatataattcaatggctgaacagtagagtatga

SEQ ID NO: 82785 - DNA, 1077 bp, Glycine max
  Peptide Sequence Number=SeqID_199563
atggcaggtttgggaatatggatgggtttcgttagcctgtgtcttctgtctgtatcagtatcaggtctgctccaacgcctagagcaccctgtcaaagctgatggctcacttagccttatggtcattggagactggggaaggaaaggaacatacaaccaatctcaagttgccactcagatgggaagggttgctgcaaagttaaatatcgactttgtgatatccactggagacaatttctacgatgatggattgactggtatagatgaccctgcatttgaaatttccttctcaaaaatctacactgccaagagcctccaaaagcaatggtatagtggtgagtccagacacaccaaccatggatgtaacaagcttacattgttgggcaaccatgactacaggggtgatgttgaagctcaattgaatccaatccttcagaaaattgatcctagatggatctgccaaagatcatttattgttgatactggtaaggtgacttctcggaatctcaatagaggttttatcctgaataaaattgctgagttcttcttcattgattcaacaccttttgtggacaagtattttcttaagccaaaggaccacaagtatgactggagaggagtgcttccaagggaaaaatatttatcaaagctcttgaaggatctggaaatagcattgaaggattctactgccaagtggaagattgttgtggggcatcatcctgtaagaagcataggacatcacggtgacaccaaagagctcataagacagctcctgccaattcttgaggaaaataatgtggatatgtacattaatgggcatgaccattgcttggaacacataagtagcagaagcagccaaatccaattcttaaccagtggtggaggttcaaaggcatggaaaggagacatggataaagataagaaagatgggatcaagttttactatgatggacaaggatttatgtccgtggagctggaagaaaccaatgccaaagttgtttatttcgatatttatgggaaagttttgcatgttgtgaatctgcccaaggggttaggtacttctgtctctgccatatag

SEQ ID NO: 82786 - DNA, 204 bp, Glycine max
  Peptide Sequence Number=SeqID_199564
atgctggttctggttctgcgggcgggccacatctgtcatggccctgattcagatgcaagagacgttaaggtggtcatcatgaatagagtttgtttgtgtctgaacgctttgagagccttgagagggacgactgagtctgctactgtcattaacccctcacccagtggcactgaaaaacatgctgctttttattcacatttataa

SEQ ID NO: 82787 - DNA, 222 bp, Glycine max
  Peptide Sequence Number=SeqID_199565
atggcatacaaaattgacccgtgggaaaaacctatgtatattacccatccatgggctgcaattatagaggctgggaaacaaatttctttgtggagtttgacaaagacaacaaacatgagcattataatggatcaggctgcacgtactttatatatgactagtccttctctgttctctcctccgtctgaaaaattgtgctactacgtatatcaactcggttaa

SEQ ID NO: 82788 - DNA, 402 bp, Glycine max
  Peptide Sequence Number=SeqID_199566
atggagcaaacgcctcttgtggcttcaatactcaatgcaactttgttggttgttgcaatattagctcttatccaaggagcacatggaattggaattggtgttaattatggcacagtagcaaacaaccttcctccaccagccatggttgcaaaattcctatcaaaatccaccacaataaaaaaagtgagactcttcgacgcgaaccctgaaattctacgcgcatttggcaacaccggcatagaggtaaccataaccgtccccaacgaccaaatccccgacatcacaaacttaacctacgcacaacaatgggtcaaaaccaacgtccaacccttcatccccgcgaccaaactaatccgaatcctcgtaggcaacgaagtgttgtccaccgccaacaaactcctc

SEQ ID NO: 82789 - DNA, 210 bp, Glycine max
  Peptide Sequence Number=SeqID_199567
atggatcagcttcctcctgagccttgtacaaaagagcacacccatatttgtagtatgtgtgcacacactcaggagcaagttcaccataatgcgccactctgttttgattcaaattatatttcagaacattgtgtatacagaaaaatgaaggttagaaatatcaaattagctaccatttccaagttcaccatgcacgcattcgatggatag

SEQ ID NO: 82790 - DNA, 726 bp, Glycine max
  Peptide Sequence Number=SeqID_199568
atggcagaaaaagaaatgactccatcctggatgaccataaccaagatggaatctggactacagtttcctccacaatttgccactgcatcacctacagccatactcagaccacacctcaggtccagtgaattcattccagccacaactgatttgcagccttcagtaaatattgctcgcgtaaggactatagcgcatgtggttcctgcaaaacaattaaagtgctccctctgtcacgtatttactccatcttcggttactttaggggcaccaaaactttgctccatcactacattaccctccataaagagaataaactcaacatcaaccaattttcgatcagaccacgattttgagggtttcgataggaggaatgggttcgattggtacagggagagtgatcggagtttgattcatcggtcggagagtttctgcggcggcggcgggtcgcaaagggatcaatttctgaaggggtttcagtcggagagggagcgatcgcggagggatgggagcgtgtcgtcgtggcggcgagggttgaaggatttggatgatagagagagggtagtgcgttcccctaagggtttgagggatgcgaggtctccttcgtggtcgaaggattctgtttctgagagcgagcaatcgaagaagagatcttcttcttctccgaggccctccaaagatggtaactccatcaagtctaagtccaagagttcaagagtgttgaggtga

SEQ ID NO: 82791 - DNA, 429 bp, Glycine max
  Peptide Sequence Number=SeqID_199569
atggcttactgtttccagaactcacatttggttaagatgacagtggaagaactgccaaagaagcttgttacaatgaaacagaaatcaatgcaagcatggccatgtcttggtgccaacttaagggtcaagatggataaatatcagtacacaatgtcaagcagcaggcatcggtggaagtacccctctaggtcatgtcttggtaccaacataagggtacccctcaaaggcaaggaaactttgcattttgaacagtccagtcagcctaccgctgtattagatttgagtcatcacatagaagccaatggaacaaacagcaccttgaatgctgcaatatttgtaggtctggattactccccatgtgtgctttggaacaagacacggaacaggacaacagcaccaatcatggggatcatggaacaagggcaataa

SEQ ID NO: 82792 - DNA, 1116 bp, Glycine max
  Peptide Sequence Number=SeqID_199570
atggagcaaagttttggtgcccctaaagtaaccgaagatggagtaaatactgcagagagcattgaattcaaggataaagttaagaaggttagtttcagacttgtagtgcatgttgctaatgctcctaatgatgttgcacaataccagattgcagggttctgtggaaccacatgcgctatagtccttacgcgagcaatatttactgaaggctgcaaatcagttgtggctggaatgaattcactggacctgaggtgtggtctgagtatggctgtaggtgatgcagtggcaaacttgaaaagcaaagcaaggatgattagcacctctgaagaaatagcacagggtgaaatgaagatgataatgctgatgagtatggctatatttctgaatttgaaaaaggggacaactcaagctttgggatctgcaatattggagcaggtttcatctgatccaaagatagaagaagaaatactggaagcagaagaaaaactgcagtttcccgacaacgagccagctcaggaggaagctgatccattggcagatgtgtccaagaaggaggatggatctcaacatggctccaacaaagatgcaccattgagatatgccattgtctatggatgctcagatgcaacaatagttctaggagtgcccacggatacactctatggatttgcttgtgatgcttggtgcgatgaaggtgaaggtgcgttgcggtggtcggtggcggcaaacgagatggatgaacatgagtggatgtatgaaataatgtctgaacgagcggatatggattatgaaaatgcagaagcatgtcgtgcgaatgaaccacatgttgattgttcggatgcgttcaatacttctcaggtgtttgagtcccgagaggatgttttgcggtgggctcgatccgtggctcatgaaaacggatttgtggtggtgattttaaggtcggacacaaacacaggtggtagaggaaggactacgtttgtgttaattggctgtgaaaggagtggcgtgtataggtgtaggaaaaaagaatttatcagaagagacactgggactaggaaatgtgggtgtcccttcaagcttcgttgcaagccagtggttggaggagaaggctggatg

SEQ ID NO: 82793 - DNA, 279 bp, Glycine max
  Peptide Sequence Number=SeqID_199571
atgggcatttatgcaaagagtgctctaaagggtttcattgagatggttcggaacagaaggggaggttcagttttaggtttagcattaggttcggagttgagggtggttcgtttagagagggagattggggagtttgtcaaaaagggtaggagtggggaagagaaatttggtgttagattgaagaaattggaacaacaatgtgagggttctggcatcccggagaaatttacttacaaagtcctgattgttcttgttctggtgactgcttgtgttggctag

SEQ ID NO: 82794 - DNA, 3102 bp, Glycine max
  Peptide Sequence Number=SeqID_199572
atggccaagagatcagattttgcccagaagctccttgatgatctgcggctaaggaaagaacgaatggcttcttctcagactcagaggtcaaaccaatcccaccatttgcctatagatgcatatgcttacaccaaacaaacatacagaggatccagacatacaaaagctactgaaattgtcagttccaaaactggggagatgctgaatagttctagcagaagctacagatcagtaaacaacggacaagtttccaatcagatggttacatatggaaaaggtcagagctcaaggcaaatgggtgatatgtcccttgccctggcttttgcatttgagaatggagggaaactaagaaggaatgattcaattatgggtttccttcaccaaattaaaaggggaacattggaattcagcatgtcagaaagacagttagcttcaactagcaactatcctatgcaaataagcgagatatccaaaggtgcacagaaactaaaccagatattgagagcctgttccaatggtcttaacatggactcatattcaatacaatttgcaaaggaactattacaaggagctattgatttggaggagtccctcaggatgctagtagacctgcaaaataattcacagtttatgattacatcgcagaagaaaaatcgaataacactatttgtggtggttaatgatgatgacaatgacacagggatggaaatgcaactggcacagccaactttctctttcaacaagcatactgctgagaacatccaacaatttggaaaggctattttcatgcagaggccaattactcttaccagctctaaggaaggtagaaactcaaataatgaaaacaaaaatgtgaagagacaagtttctcagaagcgatcaactaaaagtagctctgacattaagaatgtcaatgctatttcagaagggaaaaaccagacggcctccaacccagagaagggcaggattccaaatgtaatagccaaattaatggggctggacatccttcctgacaaagtggaaaaggaatcaaaacgggcaatgctccagaaaagagaaggaacatctcccaagcatgctgctaaaggaagcactaagaagactgaactgaagagcaaagaaacagataatttgatgcctatgaaaaaccaaaaagtgatagaagccttcaaagtgcctgcaactcagggtaaagagatgatattcggagcaaataaaaagttgcttgtcgagaagaccagctctgaggtggcggttcggaatggaataatagcactgaaaggatttgacaaacccagcataaaagcagacaagcctactaaaagttcccctcaaaagaaccttaccagagaaagtcaaaaggatgttcaggagataggaagaaaacagaatcacccaaataacaataacagggaacagaaaggcacaagaaaaggcagagccaacgatccaattcccaacaatcagccggaacaagtgtgtgaaagatcacaagttaattccttaactcaggaagacaaggaaatcgatggaaatactgttcagtgcgaaaaaagacacacaaacacgcacgtcatgaacaatgaaaagaagccttggaacaatgttggagttcaaaagtcatacgtactctccaaaaatgggcctcatgaagaaaagcatcgcagagaacagaaactccagctgaaggaagaacatatgttgatgatgagaccacaaggagggagtgaaatggcttccaagaattcaccaaaatcccctcatcaattgatcaatcctcagaagaagcagctatccatgaaccaggtcacactgtttaagaaaagctctggagaaaaaaatgttgcttctatgaaatcggaaggcttgttaactaatcaccatgatctagtcagagatgaagcatccaatgccacaaatgagaatgtaaaagaaagtatccataggaagtcaggccaaatttcctctccaagagatcaagaatttgaactagctaagcgaaatggcatcaaaactttgatggatgaaaaacacgtcaataaactggccagcaagaaaataaagaatactagaaaacaaaaagttggcatgcctggaaagattgatcaagtgttgactggaagaaatggagccaagctcatcactaaacaaggaaaacaacagattcccactcctgacaagttcgaagttttgaatgaagcagaacgtgaaagggttagcatgctcagagaaacagatgcgcacatcattaactccaatgaaccagtatctgtggctgtgactgaaccattggatatgaggcaccaaccttgtaaagaagctgaactgcctcctacattatccagttctgttggtggagaacttcaaagccaacaagaattggtagcaatagttcccaatgatttgtattgccaagatgtgcaatcattgcaagatgaagctgttcctgtggcagcagatgaaggatccgtaactggtgaagtcgcattacataaaacaaatggacttgatgaagagagattgtgtgttaacaactcaaacctgaatatttcggaaaaaagcatccaacagccactaacagaaagtgaaaactgcctcaagtggattctggtcatgagtcaactattcgtcaacactgcagaagcacttttcaaactcaacatcccgtttaacgttcttcaaggtggtggtcgggagaatcaagacgaaggtagcaaactcatattagattgtgggtatgaagtgatgaaaagaaaggggatacggcaggaactcaaagttcatagttattcaaggatatcaatgggaagcatgaacataatatccttagatgacttagttaggcagctgaatgaagacatggagaagcttaagttgtatggaaggaaaaaaagttgccaagccgatgatgttgaggactaccagtctaaaatgcttgaacatgatgtttatgatagagatccagacatgaactgcatgtgggatttaggttggaatgatgagacagttgcgtttatcgagaaatatgatgttataagggatacagaaaagcatatccttagtgttcttctggatgagatcaccgtagatttttgcatgtga

SEQ ID NO: 82795 - DNA, 2334 bp, Glycine max
  Peptide Sequence Number=SeqID_199573
atggcggactcagttgatgtgattttggactttcttaggaggaatcgtttcaccagagctgaggctgctttgctcactgagatcaataatcttcccgacttgaatgccaatcctcaaggtctagaactcattgtcaaggaaatagagtgtgggaatggtaatgcccatttgcaagcaacttctgctccctctattcttttctccaacacttccgaggaggattttttatactcgcggaacttcaacccctccactgttcctgttaagccctctgtatctcaaactaatgaagctgttgatgtaattgccgccaataccaattcaaagtcctggtctgtggaggaaaatgctgtatccatgtggcctgctagtagtagtaaaacctctgttgtgcaaagcaaacaacctatggaacttgatcgccaacttaaattcaatactccatctcttaaagtgaactttacagattatccctggtcaagaacggatgacaatatgaattcgtcttcagactccgccaaagattgttctgtcaagactatcttccccttctctaaaggggatatgtcttcaagctttggtgctgtcacttattctgacaaaaaagaggagaaaaaaaaggtagaaattagtgatactaggacatcatctattaaagagcaggtgggtgaactggggaggcctatttacttggtcaagacaccaggcagttctgaacagaagatcataggcagcttaagttttcctctcctccctgaaaatcagaaggaagagtttcctagccttcctccggttaaactcaagtcagatgacaagcccttggttgttaattgggaggagaagtttgagcgagatggaccaacctcaaaactccctggtgctgatagcactttgcttattggttcgtatctggatgtacctatcggacaggaaattaacccttcaggtatgaggagggctacagggggcagttggttatctgtaagtcaagggatagcagaggatacatctgatcttgtatcaggatttgctacagttggtgatgggttgagtgaatctattgattatccgaatgaatattgggactccgatgaatatgatgatgatgaggatgttgggtacatgagacaacctattgaggatgaggcctggtttttggcgcatgaaattgattaccctagtgacaatgaaaaggggactggacatggaagtgttccagatcctcaggaaagaggtccagccaaagatgaggatgatgatcaatcttttgctgaggaggattcttacttttccggggaacgatatcttcaggaaaataatgttgtacctgtcactactactgatgatcctattggtgtaacacttactgagtatggaaggactaatgataatgatttaatggctcaatatgatggacaattgatggatgaagaagaattgaacttgatgtgtgcagaaccggtctggcggggctttgtccctcagacaaatgaactcatcatgctaggagatgggagggttttgaatgataatctaagatcacggctagaggacatcaatatggatgatgatcaacatggttcagttaggtcaattggggtagggatcaacagtgatgctgcagatattggtagtgaagtgcgtgaaagtttggttggtggtagtagtgaaggagatttagaatatttccatgatcgtgatgcaggacttggtggctccagacactctcatcatgatttggataagaaatctactaacaaatcaaacaaaaataagaacaatgaaaagagtgagtcaaataaatatgtcataggatgtgacaaagatgcaccattgcagatgaaaactcatggtgatggaaacttttcatttcccctatctttgaaggatggtcagatgattcaggcttccaccaataagtccctgtggtcaaataacggcaacgcagatgatgctgatgactgtcttagtgcaattgtggaaactgatgacatgcttgctttgtggaggcgaaagagcagcgattcgtcacctgttaaaagttctagggatgagaataatgccaactttgtaagatccacaaactcttctccaacaacagtctcaaattatgggtattctgaaagagagcatgtgaaagtagaagaagatgaaaagactggaattgcaagggaagatgatctaggagcatcgctagaggatgaagaggtagctgctgtgcaagagcaagtaaggcagataaaggcacaggaggaggaatttgaaaccttcaatctaaagattgttcacagaaaaaacaggcatgtttttaatgtgtttgtgtgtgtatgctga

SEQ ID NO: 82796 - DNA, 510 bp, Glycine max
  Peptide Sequence Number=SeqID_199574
atgtcagatcattcctctagagttgcagtgatagtgtgggaattgatcaatgagtatcgcaacatgaaaagtagcatgctcggggcatggggcagtgggcttcctcgggttggtcttggatacggaggtggcggcgtccactgtttgggtaggaggaagagctcagacacgcctgacgcttggagttgggttggtggtgatttctctgttcgtgctgtatacgagttgcttctctctagatgtgagtccagtggtgacccctctgggcttggtcggcgtccaatgcgttctgctcttttacgtagagtagtagtattggatgacgtgggttgtgtcttttgtgagcatgactgggaggacgtggatcatttattccctggcatggtcttgtgtgcaggggaaaacgacttagcaaggtttgtcattttatctggcatgctacttgttggtgcctttggctccataggaatcgcatcatctttcaggaggaacaagcagatgtacagttag

SEQ ID NO: 82797 - DNA, 2142 bp, Glycine max
  Peptide Sequence Number=SeqID_199575
atggagtacggtgggtcgcagtccccaggggagcaagatggttcggattcccaagagaggaggaaacgctatcatcgtcatactgccaatcagattcagaggcttgagtcaatgttcaaagagtgcccccatccagatgagaaacaaaggttgcaattaagcagggagttaggcctggccccgaggcagattaagttctggttccaaaataggaggacccaaatgaaggcccaacacgaaagagctgacaattgtgctcttcgagctgacaatgacaagatacgttgcgagaacatagccatcagggaggccttgaagaacgttatctgcccttcttgtggtggcccacctctcaatgacgattcttattttaatgaccataagttgcgattagagaatgcccacctcaaagaagagcttgatagagtgtctagcattgctgccaagtacattggaagaccaatttcccaactcccgccggtccagcctattcatatatcgtctctggacttatcaatggcgagttttggaaaccaagggatggttggtccggctcctgctccttcccttaatcttgatcttcttcctgctgggacttcctcatccatgccaaatttgccttatcagcctccttgcctttcggacatggacaagtctctcatgtcagacattgcctccaatgccatggaagaatttctcaggctcgtgcagacaaatgaacccttgtggcttaaatcaaacgtcgaccgtagagatgttcttagttctgatgcctatgatagaatgttctccaagcccaatactcgctccaagaatcctaatgttcgaattgaagcatcccgagattctggagtcgtattactgaatagtttagctttggttgatatgtttatggacccaaacaaatggatccaactttttcccacaattgtctcagtggcaaggactattcaagtcatatcttctggggtcatgggcagttgcagtggttctttacaattgatgtatcaagagttgcaagtgctttctccacttgtttcaactcgggagttttacttcctgcgttactgtcagcaaattgagcagggcacatgggcagtaatggacgtttcttatgattttccccaagatagccactttgctcctcagtttcggtctcatcgttgtccttctggttgcttgatccaggacatgcctgatgggcattccaagattacttggattgaacacgtagagattgaagataaaactcttcctcatcggctttatagaaatcttatttatagtgggatggcatttggagctgaaagatggcttactaccctccagaggatgtgtgaaagatttacttatctgatggctacaagcaatcctacccgggataatcttggaggagtaatttcatctcctgagggcaagaggagcatgatgaaacttgctcaaaggatggtcaccgatttttgtgccagcattagcacatcaagtggccatcgatggaccacgctctctgggttgaatgaaatcgtagtaagagtcactgtccacaaaagctcagatcctggacaacctaatggtgtggtgctaagtgcagccactaccatttggctccccacccctccacacactgtctttaatttcttcaaggatgaaaacaaaagacctcagtgggatgttctttccaacggtaatgccgttcaagaggttgccaacatagcaaatggtttgcaccctggtaactgtatatcagttcttcgagctttcaacaacagtcagaacatgttaatactacaagaaagctgcatagattcctatggttcacttgtggtttattgcccagttgatctgccatccatcaacacagcagtaagtggtgaagacccttcatacattcccctactaccaaatggatttaccattttgcctgatggtcagcctgaccaggaaggagatggagcatcaactagctcaaacacaaacaggaatatagcaaggtctggtggttcactagttacaattgcattccaaattctagtgagcagcttgccatctgctaaggtcaatatggagtcggtgacaactgttaacaatcttattggctccactgtccagcaaataaagtcttccctaagttgtcctacctag

SEQ ID NO: 82798 - DNA, 201 bp, Glycine max
  Peptide Sequence Number=SeqID_199576
atgtgctcgctcaggacgccgcaagctcgcccagcgagtcgtttgtctcttcccgcgctcagtgcgcccagctcgctaagtcaaaattcacttactctcgcttattggcaaaaactcagggaggagtcgaaaaacagagaaaaaggagaagctagagcaatagaaatgaagccaccaagagagtctaggttagaggagtaa

SEQ ID NO: 82799 - DNA, 1665 bp, Glycine max
  Peptide Sequence Number=SeqID_199577
atgaggtggtgcagccaggtcttctctgtgtctgggtccggtgcacatgcacatgcactcgctctcgctcctatagttactgcttctttttccaacacaagtcttgtgttgcaattccaaaagcctctcttcaaattcagcaactcctcttctctcgctcttacccatcgtaagctgttaccctctgcactgccactaacgcagccctcaagttcaagggaggattttgatttcgtggtcgtcaatttctaccactttgtattcatccaagacccacaagctgaagtcgacaaacaccgttctttcttgcaattggagggtcttgacatcaatggaagattatatttgaatgaacaaggtattaatgcgcagtatagcgggccatcaaaagatgctatgacgtatgtcaactggttaagaaaggataacaggttttctgacatcttggttcagatatctccatcagaaaagggacatacctttccaacattgaagttgcgttataagccttcattagtacagtttgaaggtggtatgtcacatctttcattgcttgatccttcaatgcgggcaatacctttatcaccttcagaatggagagatagattggaatcaatcaataaaactgatcttacagcaaaagataactcaaacagaaattacattctattggatgtgagaaatgctcttactaataggttaccatggccaccgtcaattcaacactcagtagcagtacgcattgacggcgatatccatcgagttcacattgtggaagagaactggagtgcagagatgtcgtgcgttcgacatccctggagcagctgggggtcatccgaagaaatcatctctgacaatggtgacacgggcacccctcggtcgtggatgagcgacatctcgccgagaccagtcgctggcaaacatgatggtgactgcattatccggcagtccgtatcgttacccagtggttgcagtgttgacgatgacccaatgggtaaggactgcgttagcagggcacactgcccaagccatgtctcgcgcagaacaggaggtgcgaaggtgaaagaaactgagcctgtggaaggctacctgaaggttgcggagaagaggaaggagctaccagctcatcaatgggtagcatcggaaaattgccttgaagatgtcacggctgaccctacctacggtcagaaggtggacaacatttatggccacaacgggccacacaagcttgaagttaaacactcacgtgatctcaacgtgaagtgcattgggcccgaatcaaatgtgggccttactagccatacaacccctcaagaccatgattgcgaatatgataattataatgagcagcaagcggaggcagctagtgcactgcaggtttattcaaggaaaaggtggtgtaaaaaggaggcccatgatagtgggaaaactgccttatctgaagaaattacatcttcagacggccaacaacagctaacaccaccaaccagggacgaaggcaccgctaacctgttagaagaggccacagctcaatgggaactgacaaaggagttggggatgacttgcgggacagcccaaaaaacaatcattgaacaaatatcagcaatggagatcaaagacaaaaaggaagcagagtcattgggaaataggtctgatcaccaatga

SEQ ID NO: 82800 - DNA, 906 bp, Glycine max
  Peptide Sequence Number=SeqID_199578
atgagaagcaaagataatatatgccggggaacaaaaaggaaaagtgttgagaaaggaggaaggattgtatttattattgcaactggagtggccgtgtcgttggggttggggacactctctaactgttacccagtgccagtaaaggaattgcttcttttttctacaactagaacgcgcattcacaatcggagtaggaagaagctctttggtattggtcagaaaacgttttgcgttgaagctgcaaatgcaaattatgaatttgatccagatctgcgatctgtgattgaacttgccactgattctgagttgtacgagattgaagcaatccttttcgggccaagctactcgagtcctttgctcaaatccattccattggcattattcagaaacacaaatgaaaatggtggcctcgaccgttccatgattggagtcgaccttcgactacgtcagcaatttatagcagctctcgagtcccgatttttcttccttgctgctgatgcccgctctaccttaaggggttggaggccttcttatagaaatatcttgcttcaaataaggacaaaattaaatattccttgctcaacccaattggaacaagaatccggcaactaccctgccttgttcgacgttgtaagaacttcgtctcaaggtcaagccactctacaacatgaacttagtcaatggaaagtgcagtcaaaagttggggcccaagacattccatcaattgttttaaagggaggtggtgtatttactttgtccaagatatatcaattgttagcaaggaaattatctgggaaagctcttgtagaagctgccaattgccagggtggacagttagctatgattaatctagaatccacagcagccttgcttgcagcaaaacaggaatgtattttattggtataa

SEQ ID NO: 82801 - DNA, 1194 bp, Glycine max
  Peptide Sequence Number=SeqID_199579
atggacccaaaatctatcctaaggctcatgagaaccctagggccttttcttgcatctttggctcaatcttcttggagtcttttatccaatgcccttgggagaactggctttgaggaggacaagaatttccatgttgttttaaattctgtaatagctggaaggtatcatgttactgaatatttgggatctgctgcatttagcaaagctatacaagctcatgacctacatacaggcatggatgtttgtgttaaaattataaaaaacaacaaggacttttttgaccaaagtcttgacgagatcaagcttctcaagtatgtcaataagcatgatcctgcagacaagtatcacattcttcgattatatgattatttctattatcgaagtatgggagttttaccaccaaaaggaagaggtgatgggaatttggtagaaatttcttttaaactgtggtcatctaattttgctgtgtatctagaacatttgttaatagtatgtgaactacttaaagcaaacttgtatgagtttcataaatttaatagagaatcaggtggtgaagtgtactttacaatgccaagattgcagtcaattaccattcagtgtttggaagctcttcagtttttgcatagccttggactaatacactgcgacttgaaaccagagaatattttggttaaaagctatagtaggtgtgaggtgaaggtcattgatcttggaagtagttgttttgaaacagatcacctttgctcttatgttcagtcaaggtcctatcgtgctcctgaggttattttgggacttccatatgacaagaagattgatatctggtctcttggctgcatcttggcagaactttgtactggcaatgtcctcttccaaaatgattcacctgcaacattacttgctcgggtgattgggatcattgatccaattgatcaaagtatgcttgcaaaaggacgcgacacatataagtacttcaccaaaaatcacatgctttatgaaaggaatcaggaaaccaaccggttagaatacttggtaccaaaaaagacatccttgaggcatagattgccaatgggagaccaaggcttcattgactttgttgctcacttgctagaagtcaaccctaagaagcggccctctgcatctgaggccctgaagcatccatggttgtcatacccatatgaacccatatcatcttga

SEQ ID NO: 82802 - DNA, 123 bp, Glycine max
  Peptide Sequence Number=SeqID_199580
atgcctgatcttccattccaagttggggatttggctgagtcaagatgctttgaaaaggtggttatcgtggtgcatggtttagatgcaaggattagtcgttctctgaaagggtttggggtttga

SEQ ID NO: 82803 - DNA, 192 bp, Glycine max
  Peptide Sequence Number=SeqID_199581
atgaagttgagtagaaaagaagtaacagataggattgataagtggtttgctgcatgtgaagaggagaattggcttgacaaatataatcaagatgacaaccgttacagtgctgggcaatgcactcacattaatcttaaacgtgcagaacatgctagaataactataggcaaaattccaagtttgctttcatga

SEQ ID NO: 82804 - DNA, 754 bp, Glycine max
  Peptide Sequence Number=SeqID_199582
atgcagtcagatgtttggggtagtataagtgatcaagggatagtaaatcatatcacaggaggaaattttgcgcagagttccattaccattaatgggtggctccgtgatttcttatgggcacaggcatcccaggtaattcagtcttatggttcttcattatctgcatatggtctttttttcttgggtgcacattttgtatgggcttttagtttaatgtttctattcagcgggcgtggttattggcaagaacttattgaatccattgtttgggctcataataaattaaaagttgctcctgctactcagcctagagccttgagcattgtacaaggacgtgctgtaggagtaacacattaccttctaggtggaattgccacaacatgggcattcttcttagcaagaattattgcagatcctttacatgtaagacctatagctcatgcaatttgggatcctcattttggtcaaccggctgtagaagcttttactcgaggaggtgctctaggcccagttaatatagcctattctgggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaa

SEQ ID NO: 82805 - DNA, 276 bp, Glycine max
  Peptide Sequence Number=SeqID_199583
atgactcatcaggatttccaagtttatgccattattgtaaaccacagttacaatgctaaaatgaatgaatttgacatccttgtctctctcatcctttcacaaacacatctttgcttattcaacttccaccggaatgtgagtgtaagccattggtttgtttgctctaagcgacctgcgctcttgagtgttaacttccaagaccgtcaatcagagattgctcgtcctgcacgttggtgggggtgccgtaaaacaacgagtaaagttcaaaacaaataa

SEQ ID NO: 82806 - DNA, 554 bp, Glycine max
  Peptide Sequence Number=SeqID_199584
atggagcgcctccagtgcctgagcgtcatccgccgtttgagggttgagcgcctccgaccgctcggcggtcagaggcagcgccgcaagataatcctgggcgggttgagtaggcttattcattggcagacgcaccgtcaggcgccagcctttggtcactgggttatagcggacgttgttttctaccatttcaccgttgtcgccgatgctgatgtgagaggcgaccagagtattggcgtccagccctttcagcaccgggccgacgaagtcgaccaggaaggccacgctgccgtctggctcgcgaatcaggttggactgcttcacgtcaccggtcgaacgcatggtgcgggccacataggcgatgtcctgcgaatgcagtttgtcttcatcgcggtggaacgtatccggcgtccagaacgtgccgatgttgtcgttggtttcatccgccgtcgggatctccaccagctcaaccttgcctttgccccagtcgcccttcggttcaatccaggcgctcgggcgcagatcgtaacgatcgtccagatcttcatattcccgaa

SEQ ID NO: 82807 - DNA, 1557 bp, Glycine max
  Peptide Sequence Number=SeqID_199585
atggccaaggaagcttctctgtgcctcttgttcctcctctcctctctcactatctcctgttctggatctgtggagggtttttcctaccgtgagagaggacacacttcaacatctgctagaaccatatcattcctccagcaaagcaacgttcccccgtctcagattcgaattttcgtcacagatcataggattttgagcactctcagctactccaaagtgccaacagatgtttacttgaacaaaagtcaagttgaaaatttcattacttcaaaaccttctgaactaaaagctcatctacttaacattctccaaaattcaaacatcaagagcatcattgctagctgtggcagtgagggcttagcacaaaatgagatgcctttgttcttacatgctttgatatcaattagttcagttcttagagagcttcacttagggagggaggtaaaagtctcagtagcatttccactttcattcttagaaaagttgaatgcatcacatgaaaacaatattcgtaggattctttcagttataaaggaaatgaaatcctttgtcatggtagaagactacattgatggagaattcagcatcggggatcactttgttcatgctatcatcaaacgagccactcttgctgcttccattcttccttgcaaggatgttcccattgttctggcaataaaaagcacagttatcttcccttcaatggaattagctcaatttagtgagagagtgtccaaatatctagaatccaaaactcatattagaaaaagaatagcagcattatacatagaggtgcacagaacagaagattttgctagcaaaaagctcaaaaggagaagtctagatgacacaaccaacccaacaaacacagttttccccacaaatccagcatcatccacaccgatcatcacaccaccagatacaccaaccatcataacagttcctgctactaatcctgtcacaatttccccttccaatcctgctgcaatgcctgtgacagttccttccaccacaccagtgcctatacctcccacaaatccagccaattcaccagtacctgtgagcaatccagctacaacaactcctgtagcaacaccaccgccagtaaccatccctgtgacatcttatccacctccatcaggaaatgttcccgtcgtaaacccgcaaccgcaaccacctcctgcaaacactaatgctcctgccattcaggggcagagttggtgtgttgcaaagcaaggagcccctgaagcttctcttcaatcagctttggactatgcttgtggaatgggtggtgcagattgttctcaaattcagcagggtggaaattgttacagtccagttactttgcagagccatgcttctgttgccttcaacagctactaccagaagaatccagctccaacaagctgtgactttggagggactgccaccttagttaacacaaatccaagatctatttcaaagagcttgattacaacttatttcgacatatcttatggcataaacacttatgctaggatagttgctctcaaggataacttcttacaatttatatga

SEQ ID NO: 82808 - DNA, 371 bp, Glycine max
  Peptide Sequence Number=SeqID_199586
tgacacatgataccatcagaatagtgaacccaacaaaaggtctcaaactcacagaacgcgaggccgaagtggtatttacaacaggagggctatcagaagcaaaacctggcattatacctgacgctggattgcttgaatttaacactgaagggcctgttcctgaagatgaagatgttggtggtgctgttggaatagatggtgcaggtgttaatggacttggtggtggtagtgttgttggacttgattgcgtaggtggtgttgggggtgatgatgactttggcgttgttgttgttgttgatgatgatgatgggaagatgcacgaacccgtgcctattcacaattcagaacaaccagttaaaaatgggcactag

SEQ ID NO: 82809 - DNA, 282 bp, Glycine max
  Peptide Sequence Number=SeqID_199587
atggatccaagcaatggaaacttggatgtgttgattggagagagaggctttttcatttgtactagtggtggccaagatggttatggagtgggagttagagttacctcactatctaacgaactagagccatgggaggatgcttttgcttcttttgatcaacaactacttcttgctcttccttgggattatcagagggccctcatcccctgtttcactcaaatccctcaagttctaagccttggaggcctgcttagagatctgcctttgacttctcctgactag

SEQ ID NO: 82810 - DNA, 219 bp, Glycine max
  Peptide Sequence Number=SeqID_199588
atgagcaaaaagacagtgggtttgaaggtgaaagaagtgatggagaacatcattgctgatcctgagtgggggtggtggtgggagatttggggatggtggaatatcagagtgagtaggtggtggcaaaagtgtttgaggaatggttgtttatggtggagggtcaaggctaagtgtttgcttttgggtgggggttggaagaatggatggaacacttactag

SEQ ID NO: 82811 - DNA, 577 bp, Glycine max
  Peptide Sequence Number=SeqID_199589
atggttaacacaatcaagattgagaaattcatagggaagaatagcttcaggctttggtgcatcaagatgcaatccttgttgaaagaacggggcatctgggctcctccctccagtcaatcatcaaagattgataagtcaatgcttgagttacaagaggaaaaggaaggtattccaatgaaggaacatcttgatgagataaactatattctgatggagctacgggcattacttacaggaaaggactccattacacttgaagaagtcatagtagaagaaaagaaagacaaaggtaccaaaacgagcaaagattatcctaaggacatccacaatttctataaagaattgggctgcatctttgagcttcaatcaggtccttcaatggtgattttcaaccatggatatgcagcggaagataaaggagaaggggagcttcaccaccaagagagtgtcttggataagaagcttagagaggaagcttcaatggaggaaaagaatgagagagagagggggcatgaaattgaaggagacaaaagagggagagaagagacaaaagaggaagagaagtggaactttgaag

SEQ ID NO: 82812 - DNA, 834 bp, Glycine max
  Peptide Sequence Number=SeqID_199590
atgcagcagccggagaagcagattaacgcgccagccggaatgcctctcccggagcgccggagaaggcgacggagctctggtatatgtgccacttccggtgttagggttcagccacaagaagaacaacaacaagtggcaacgcgtgggactgttcttacagactctgaccagttctatttcaactggtatgctcacattgacgttcacgaagagatgatcaaggatcgtgtgcggactgatgcttataagaatgcaataatgcgtcataaggattttattagagacaaagttgtacttgatgttggatgcggcactggcatccttgctatattttgtgctcaggctggtgcaagacggacaatccgtgttgttgaagctaacaatcttttgaacattatcacggtattgcacggacgagttgagccagcttgtgaccctggggcaattaaggtgatgggacagcatctgccgttgccaaattgggctggttggtgctctatagcagcttcaagagcaataacatttatctgcattgggattccaagtccacttaggaaagctttggtagtttcgtttgtgcatagtgaaaatctgggtttgttgagatcctacatcgaatatagatatggtcaaaatagagcttataaagggcttggacaatcctcacctcatttgctagcttttggggatgttgaaatcggtgaaaaggttgatgttataatttcagaatggatgggctatatgcttctatgtgagagtatgcttggaagtgttattactgccagagatcgctggctcaaacctggaggtctagttcttccttcaaaggcaacg

SEQ ID NO: 82813 - DNA, 186 bp, Glycine max
  Peptide Sequence Number=SeqID_199591
atggtggccatggcaccgccatttaacagcaatgtttatcctctaaagccggctaagccaaagaagcagccaccaagaccttccctctccaccccttttggctttaatgaagatgatgagaatgacattgagagagaaattgctctccaggctagcaagaataaacgtctcaaggaagtatgttga

SEQ ID NO: 82814 - DNA, 1515 bp, Glycine max
  Peptide Sequence Number=SeqID_199592
atggaaggttggcaaagaggatccaagaagggtggttcattctatgaaagttggtacggctttgggaaaaacgctatgtgggctgtcatgactgtggttgtggtgatggagttcactgtaggggcaacattgtgcaaaggactaaatagaggattggggactctcttggcaggatcattggcatttcttattaagtattttgcagatgcccctggtcggatttttcaagcagtatacattggtgtttcagtttttatgataggagcattaactacttatgtgaggttcattccctctatcaagaagaattatgactatggtgttctgatctttcttctcacctttaatttgataactgtatcaagctaccgcgttaatgatgtctgggactttgcaaaagatcgcatatccaccattgccataggatgtggcctatgtcttctgatgagcatattggtgtttccaaactggtcaggggaagagctccacaacaacaccatatcaaggctcgaaggcttagccaactctatacaagtctgtatcacgggatatttttatgattctgcaaaacaagcaactgaaggtgattcatctgagaatccaatttacgaaggttacaaggctgttttagactccaaagtaaaagatgaaacactggcgtcacaagcaagctgggaaccaagattctcaagatattgtcacagaactccgtggcatcaatatacaagagtgggagctgctcttcgccaattcagttacactgttgtagcactacatggatgtctacagtctgaaattcagaacactgttcgaaacatcataacatttgagaaacctctaagaaattctgtgactttcatgatgcaagctggtagctgcatttctaaacttgctattacaccaaagtcaattagtaccctgtacaaagattcttgcatcagacttggagaggaagtgtcaaaagtattaagggaactggccaacagcataaggaacaaacgtcaattctcccctcaaacactctccaggaatctaaaggatgcattacaagaccttcacagtgccttgaaatcccaaccacaacttgtactaggctcgaggaatggtcgaactcaaacccctaaaaccgcagttcaagcagttccacatccacatcctgaccaaaagcttgaagaggacaccaaattctcattctcaagtgttaggaatggttcacgtggatccggatgtcaatccgtagagcactctcgtgaactgacaaggaaggttttaaggccacagatgagtatgagtgccatcattagccttgagttctcagaagcattaccctttgctgctttcacttctttgcttgtagagatggtggctaaactggattatgttatggatgaagttgatgagttgggcataatagcacattttgaagagttccaaggtgatgagattgtcgtgacttgtgaaaaaccaaacatcaataaacctcagaatgacttgccttcttatggagcagagtag

SEQ ID NO: 82815 - DNA, 1560 bp, Glycine max
  Peptide Sequence Number=SeqID_199593
atggctgaaaccaatactagtatcaaaagctctaggcaattgaggtgtgtttatagttttgctgataaggtgaaaagttttcctggtttggcaaggagggcaacatggaaggttggcaaagaggatccaagaagagtggtccatgctttgaaagttggcatggctttgacactagtttctttgctgtatctgatggagccattgttcaaagggatagggaaaaatgctatgtgggctgtcatgactgtggttgtggtgatggagttcactgtcggggcaacattatccaaaggactaaatagaggattagggactctgttagcaggatcattagcatttcttattgagtatgttgcagatgcccctggtcggatttttcgagcagttttcattggtgttgcagtttttatgttaggagcaatgactacttatgtgaggttcatcccctacatcaagaagaattatgattatggtgttctgatctttctcctgaccttcaatttgataactgtgtcaagctaccgcattgacaatgtctggaacattgcaaaagatcgcatgtccaccattgccataggttgtggcctatgtcttgtgatgagcatattagtatttccaaactggtcaggggaagacctccacaacaacacaataacaaagcttgaaggcttagccaattctatacaagtctgtgtcatggaatatttttatgactctgcaaaacaagcaactgaagatgattcatccgaggaccctatttacgaaggttacaaagctgttttagattccaaagcaaacgatgaaacattggcattacaagcaagctgggaaccaagatgctcaagatattgccacagaatcccatggcatcaatatgcaagagtgggagctgctcttcgccaattcagttacactgttgtagcactacatggatgtctacagtctgaaattcagacaccaaagtcaattcgtgcggtgtacaaagattcttgcatcagacttggagaggaagtgtcaaaagtattaagggaactggccaacagcataaggaacaaacgtcaattctcccctcaaacactctcaaacaacctcaatgaagcattacaagaccttgacaatgcattgaaatcccaaccacaacttgtactaggctcgaggaatggtcgaacccctaacaccccagttcaaaagcttgaagaggacacagcaagtgcaagaaccccattatcaagtgttaagaatgattatttttcgccacgtggatgtaaatccaaagaacactctcttgaacagccaaagaaggttttaaggccacaactgagtaagagtgccatcattagccttgaattctcagaggcattaccctttgctgctttcacttctttgcttttagagatggtggctaaactggatcgtgttatggatgaagttgaagagttgggtcgaatggcacactttagagagttcaaagatgatgatgatgatgagattgttgtgacttgcgagaaaccaaaaatgattatagctcagaatggcatgccttcttatggagcagagtag

SEQ ID NO: 82816 - DNA, 210 bp, Glycine max
  Peptide Sequence Number=SeqID_199594
atggtgcgtgacaggtttggagaagcaaccgcagtcaaagatgacgaatgcgcggtctcgacggtcctcttgtggtgtgtggcctccatgcgctctatgaacttggactcgttggagaagtcgagaaagcgtgtagagtttggatttcaagttgttgttgttgaggggttggggttgcctttctcagaggaggggtcaacttggatgaag

SEQ ID NO: 82817 - DNA, 1158 bp, Glycine max
  Peptide Sequence Number=SeqID_199595
atgttgttgctgagccattatttttggttggcaggagctacgactacttatgtgaggttcatcccccatatcaagaagaattatgactatggtgttatgatatttctcttgactttcaatttgataactgtatcaagttaccgtgttgataatgtgtgggaaattgctaaagatcgtatagccaccattgctataggtggtggcctatgtcttgtaatgagcctattggttttcccaaactggtcaggggaagacctccataattccaccatatcaaagcttgaaggcctagccaattctatagaagcttgtgtagtgagatattttcatgattctgaaaatcaagaaacccaagatgattcaactgaggatctgatttacaaaggttacaaggctgttttagattccagagctaaagatgaaacactggcattacaagcaagctgggagccaagatggtcaaggtattggcacagaatcccatggtggcaatatacaaaagtgggaactactcttcgccagtttagttacactgttgttgcactacatgggtgtctgttgtctgaaattcagacaccggggtcaattcgagccctatacaaagactcttgcatcaaacttgcagaagaagtgtctaaagcactaagggaactggccaacagcataaggaacaaacgtcaattctcccttcaattactctctgataatctcaatgaagctctacaaaacctccacaatgacttgaaatcccagccacaactttttctaggctcaaagaagtttggtggaaccacacatcctgaagaagacactagagtctcattctcaagtgttaggagtgattgttcttccatgtttgaatataaatccaaagagcattctggtgaaatgtcaatggagggacacaagaaggttttaaagccactgatgagtaagattgcgatgactagccttgagttctcagaagcactgccttttgctgctttcacttctatgcttgtggagatggtggcaaagctggatcatattatagatgcagttgaagaactggcaaaattgtcacgctttagagagttcagagatggtgatgagattgttgtgacttgtgagagaccaaaagtagctaacaatgacttgccttctcatgcattagattaa

SEQ ID NO: 82818 - DNA, 573 bp, Glycine max
  Peptide Sequence Number=SeqID_199596
atgactgagacaagtatgcgagctgggaatatcgatgtgtatggattcctcgagccacagtctatccagagatctggccaatcacaatttgaatcagaaaattacattaagaactggatgcaaaattcaaaacgagatgtgtacctaggagcctacttgaatggtgcacattggcaaatggtcgtcattttgcctaaggaaaatgttgtcatttggttttgttcgttgcataataagccagacaactacctcaaaggcataattaataggtcagtgttgttttttaatatatttgcattagcattagtcagtgctttgaaaggacttgacgatactcaacaaagtaaatccaagactcctgctaggtggattgttgttaaatgtaatagacaaaaaggaagcactgagtgtgggtattacgtcatgcactggatgtcaactataatcttagaaaatttcaagaataattgggaaatgtatttcattgatgctagaccattggaaccagagagattgaaggcgcttcgcatccagtgggcaaagtactatttgaaagttaaaaatgaaacttag

SEQ ID NO: 82819 - DNA, 228 bp, Glycine max
  Peptide Sequence Number=SeqID_199597
atgtcgaagctgagagaaatacaatttgcattggagaaagatgtatcgcacataggaccatggaatggaggcttcaatcccttctccttttctcaaacgtttgggaaccctaacagagcaaccaaaggaagagctctagagagcaccagaaacatcaaaattgataacaaagaactcttgagtgactacatcgagatatgggatgagttattcacaattggggattag

SEQ ID NO: 82820 - DNA, 278 bp, Glycine max
  Peptide Sequence Number=SeqID_199598
atggtgaaaagggaaaaatttgatcatatagaggaaaggctaagggtcattgaaggaggtgtaaattatgcctttgctgacattgcagagttgtgcctagttcctgacgaggtcattccttcaaagttcaaggtgccaaattttgataagtacaaggggactacttgccccaagaatcacatgaagattaactgcaggaaaatgggggcatacgcaaaaaatgaaaaattgttgatgcatttcttccaagaaagtcttaccggggcagccgtcacctg

SEQ ID NO: 82821 - DNA, 252 bp, Glycine max
  Peptide Sequence Number=SeqID_199599
atgcaaggcagtggcaacaatcaagaggattggatagagattaaggaaaacacgggtaactcacaagcctcactttgctactccttacaggctccaagactatgctttttgagttgggagatgaaagattggtgtacaatgtatccatatgtagcgatcactcccaactatcatcaacatgattttgtgaaaatgaggctaagtcatgaagtgctaaaagtgatagttgagcttagctcatcagtgggctaa

SEQ ID NO: 82822 - DNA, 672 bp, Glycine max
  Peptide Sequence Number=SeqID_199600
atgggagccaaattgcatctaggacaaaaactagcggggctagaccacgtctgggacaaaaaccaggacctgtttcccactttctccgttttaatgttatgccaacactgtaaattggaaaagggagccaaacaagattcaaactccaaagatcacaaatctaaaaagaggacaggatggcataagtcaaagaaaccagtgagtggaaggcatgattgctctgataagtttgccagacttaaaagggtcacagatggcggcgatccaggcaaaaaggtggttgttggcagggaaagagatacagacagagatgggaaggtcaactttaaagaatttttccatgggctatttgatttggtaaggaactatgatgaagaaagtcacaatgatacacataattctgataattcaatggatgctccagctagagtgttgtttgctcagcttgacaaggatggggacggatacctgtcagatgtcgaactacagcccataattggcaaactccatccatctgagcattattatgcaaaacaacaagcagattatatcatttcacagccgcaaaggtcattcaagagacctgtaacccagtatccaatcccgcactcaatccttgctcgcttctctgttcctctctcatccccttctattcctccttttcctttataa

SEQ ID NO: 82823 - DNA, 436 bp, Glycine max
  Peptide Sequence Number=SeqID_199601
atggctgaaaccaactattttgcaagtaacagatcaagcatgatcacaaggcattggatttggaagtatatgagtagtgttggtgagaaagtgaaaaggtattcaggtttggcatggagaacagcagtgaaagtaggcaaagaggatccaagaagggtgatccattctttgaaagtgggcctggctttgatactagtttctttgctgtatctaataaagcctttgttcaaagggattggacaaaatgccatgtcagctgttctcactgtggttgtggtgatggagtttactgttggagcaacattaggcaaaggactgaatagagggttggggactctgctggcaggatcattggcatttcttgttgagtatattgctgacatcgttggtcgggtttttcaagctgttttcattggtgctgcagtttttattttag

SEQ ID NO: 82824 - DNA, 672 bp, Glycine max
  Peptide Sequence Number=SeqID_199602
atggttctgaatacagtgttagtcactgcactatgccatggtaaaagaagacataaccagatgttggattcagcttgtggtggctggttggctgaagttattggggtggcctggaatcctggtcagtgtggtagctggttggcagaagtcccacatggaataaagaaagagttcggttctccaatggattgcatggaactgtggacacaggatttgttcccttacatctactacttccctggaatcttgttcttgaagatatataaactgatactagaaaaccttacaggtgagagatcaatgaaagttttcagccagaaagggcacatgttgaggatccattataaggttgccactccattgaagaagatcaagtttgtaaaccaaagtaaaaatgttcagaagccaacacaaaagtacattgagatagtcacagaaaaccttttgatttctggtttatggaagtggttcatatcagttgaattgaagcacttggttgctagtacaatgtggacaaaaggttttgagtacaagagttcatcattgaaggtatccgtccatggactagcctatgttagagctagctggtctatgaagggagattacggtggaagaaaagttcaaaggaaagataaactgaagggtactaaattgctagttgcccaactgtag

SEQ ID NO: 82825 - DNA, 738 bp, Glycine max
  Peptide Sequence Number=SeqID_199603
atgaagcttgggatttttgctgtcagcagggtgcagaaagctagaagacaacagacaaacaaaaataaggaaaatcgtcagcaaagagtgaaaggggtcatcaatagtcctactcagctctcgtgcaatctagtagcaataaagaacaaagaaagagatctaaaaagggacgtgcgtgcctgcattttgaacccaactgggaggatcgtactcggagaaggaaacgaagccatcgtggttcttatcgtgaagctccatctccctctgcgtgcgatgcaggacctcgcgctgggcctgctggaggttccactgaatcaactcgtgctccgtaacgaaccaatcggtggggtccacgtcgatcttcgggaacaagagtatgagccggttggtaacattaaacttgtcctcgtcattgaggtaatcctcggcgtccatgaagtcctcccactcgggctgggactcgtgggccggggccgggtccgactccagttcgggcagggcctggtggattatcttcttctcccactccttgtcttcgcggtgccgctcgagttcggcgacgagcgggtcgaaggcgacggcgtggtggcgcgagggggcgagggtgaagttggagcgcagcttgaggcggcggtggcggtggccggagtgcttatccggggaatgggagaggaatatgagaagcgccgctgcgacgagtatgtaaatgaaaatcgacgctttggccatcgctgctaa

SEQ ID NO: 82826 - DNA, 673 bp, Glycine max
  Peptide Sequence Number=SeqID_199604
atggccaaagcgtcgattttcatttacatactcgtcgcagcggcgcttctcatattcctctcccattccccggataagcactccggccaccgccaccgccgcctcaagctgcgctccaacttcaccctcgccccctcgcgccaccacgccgtcgccttcgacccgctcgtcgccgaactcgagcggcaccgcgaagacaaggagtgggagaagaagataatccaccaggccctgcccgaactggagtcggacccggccccggcccacgagtcccagcccgagtgggaggacttcatggacgccgaggattacctcaatgacgaggacaagtttaatgttaccaaccggctcatactcttgttcccgaagatcgacgtggaccccaccgattggttcgttacggagcacgagttgattcagtggaacctccagcaggcccagcgcgaggtcctgcatcgcacgcagagggagatggagcttcacgataagaaccacgatggcttcgtttccttctccgagtacgatcctcccaataatgaatctttcggttatgatatgggttggtggaaagaagagcattttaatgcatcggatgctgatggagatgctttctgcaccctgctgacagcaaaaatcccaagcttcatcaatggttgtgcaaggaggaagtcag

SEQ ID NO: 82827 - DNA, 603 bp, Glycine max
  Peptide Sequence Number=SeqID_199605
atgtctcattccaagaggattgggaagagtgatctcattgaaggtctctatgtcttagcttctccaagtgttttggattcagaagctaatacaaatatctgtaattctgtttccattcatgcatctatttttaagcattatccttcagttcctcactttaaagatgttcatccaacagttgatgattttgttatcagccttggaacaactgctcagtcagcagaggctcagtcaaatcctatccttcttcctaccacttcttctactgtagtttttgagtctatgccaccgcaacaacttcttagaagtccatcccctaagtggagacaggcgatgactgaagaaattaaggcattaaaagtaaataacacttggtctctggtccttttacctactaataagcactgtattgatagcagatgggtctacaagctcaaatataaacctgatggaacaatggataaatacaaagctcgattagtagctaaaggctacacacaacaagctggaatagattttttagacaccttttcacctgttgccaagcttacctcagtgagagtgcttctagcaaaagcaacaactaggaattggtgtttataa

SEQ ID NO: 82828 - DNA, 558 bp, Glycine max
  Peptide Sequence Number=SeqID_199606
atgcagacttcacttcttcatgagctagttgttggaactccagtcatctcagcaacatttgatcagcctcaaaagtcagttaacagatacttacccggtcctgccactcaatgtcaatattcaaccacaacatcaaagcaaatgaggctaaggacaaatatttcagaaactgttaaaagaaagctaagcttaggggctcgcattcttcgagtgggtggagtggaaaaagtgtttaagcagtttttcaatgttgaagaaggagagaggctgttgaaagtttcccaatcttatctgtccaccacatccggtcctctggcaggtttcctcttcatctccactgacaaggttgccttctgcagtgagagatcaatgaaagtctttactcggaaaggccatatgttgaggatccgttataaggttgtcattccactgaacaagatcaagtgtgtgaaccaaagtcaaaatgttcaaaagccaacacagaaaaaactttcaaatatcttgagcaggcactttctcaagcttagctgggtagaaaaatccacggttcaaacttaa

SEQ ID NO: 82829 - DNA, 843 bp, Glycine max
  Peptide Sequence Number=SeqID_199607
atggcaaaagccatagcaacaaacctgaagcttttgcaaacaacaaaaatcaaaacaacaacacttaagtacatccaccttgccctcactataaataaactaatcacccacaaaaaaggtgttggtggaagccagattcaaaaccttttgagtgttcctcagttgctcaaaaaaggttataaagtgttgtttgaagacaaaaattgcatgattaaagactcagaaagtagagaggtgttcaatattcaaatgaaaggcatgagttttgccttggatttcatgaacaaagagcaggctgcaatgcacaaagaggttagtagcacagtactttggcacaagagattggggcatttccatcacggtgctctaatgtttatgaaaaagaacaatcttgcaaaaaacttgcttgaattagaagaagaacttcctacgtgtgctatctgccaatatggaaagcaaacaatacttcattttccacaaactatgacttggagggctacagaaaggctgcaattgatacacacagatgttgaaggacccatgagaacaccatcactaaatgggattgctgacatcttttggaagtttaaagcttgggtggaaactacagaaaggaagaataggactattatggagatggctaggtgtttgcttcatgaaaaagaattgccaaagagattttgggcggaagccgcaaatattgcagttttcatgcttaacagactgccaacaaaagctttgcaaaagaagacaccatttgaagcatggtatggctataaacctgagttgctcaatctgaagatatttggttgtttgtgctttttcttacattcctcgggttaa

SEQ ID NO: 82830 - DNA, 498 bp, Glycine max
  Peptide Sequence Number=SeqID_199608
atgtatgttgtgagtttactatctaggtacatgcactgtgctagtgaaattcactttcaagctgcaaaaagaatccttagatatgttaaaggcacaattgattatggaataaggttcagtcaagttaaaagtttcaatcttcttggttattctgatagtgattgggcaggatgtgctgatgatatgagaaacacttcaggttattgttttactttaagttctggtatgttttcatggtgttctaaaaaacaagaagttatagttcaatcaacatcaaaagcagagtatatagttgttcttgctggggtaaaccaagctctttggattaaaaagctcatgatagacttgcacacaaaaccaacaaaaagcacacaaatatttgttgacaaccaagttgcaatttcaatggcaaatgatccagtgttccatggcagaacaaaacacttaaagatcaagtttttctttctaagagaagttcagaaggatggagaagtgtag

SEQ ID NO: 82831 - DNA, 396 bp, Glycine max
  Peptide Sequence Number=SeqID_199609
atggagcgtcgcacatcattaagacaatcatgtggaaggcctcccacaagcactaggaattatgtttttactgtcgatgtaaccgacggtatcatctccaaacctacagcattggtcagaccttatgcatatcatcaattgttgcctaccgaggctgtcgattttgttgatgcttcaagaccatgtatgaccatgcaacatagcagtggcgttggtgacatatggaccatctccatgcataatcaatatgtggatgaaccttggaatagattcttaacggacaatgatttgatgggtggagacgaggtcgtcttctattaccggcctaacgaacatgtgtgggagatcatctttaggaagaagcccatatgggatgaacatgaagacttcacttga

SEQ ID NO: 82832 - DNA, 954 bp, Glycine max
  Peptide Sequence Number=SeqID_199610
atgtcggaagcaccaccgcctccaactgccgatgcgtcaccgcctccgtactggtgctaccactgcgagaagcgcgtctccgtcgaaacgctcgcgaatctccccgacgtcgtctgcggcgagtgcaagaacggctttgtggaatccatgcccacgccgtcgcgctctcgctccccctccgcctcctccgacgacccctacttcggctcgcagttcctccaggtccttcgcctaatcgctcagtcggcgcgtgacgacgacgcgtcgcctccgccgccgccgagccgctctccggagaacgatttcctcaggatcgagctcggcggctgggacaacgacgaggagaacgaaaacgacgacgataacggcgacgaggagttcgaggaacacgaggaggcggaggatcgctccggcaacgaagatccgcacggaggagacgacgaggatctgagaagaaggaggcgcgagctacttcggcttcggattagggatttggcgactcgtacgaggagcatgcggaaccggatcttggattgggccgagattctgatgggcctcgaggacaattccatcgagttccgcctccagctgccagaatccgaccgctacgtcggaaatcccgaggattacgtcgacgcggcagagtacgaggcgctgctgcagacgctggcggagagcgacgggggaggcaggaggggagcgccgccggcgtcgaaggccgcgctggaagccttgccgacggtgaaaattgcgtcggaaagcgaagccgtggcgtgcgctatatgtaaagatttgctcggtgttggagacgcggcgaagaggttgccgtgcgggcatcggtttgagctaccaacggatgataaggaatacgaggaagagagagtggttatcgctgcttcttcgaattcgaacggagcttcgagttccggtggaggtggaagtgccattgtttga

SEQ ID NO: 82833 - DNA, 354 bp, Glycine max
  Peptide Sequence Number=SeqID_199611
atgaagcaacaaatttgtaaacaatactgcagaactgcaaaggtattggaaccgacaaacacacatgcaaggatacatttcaaggccggagaaactaaggtcaaaacgcaaagcactatcagcaggcaaaacaagatgcagaaaatcaagacggaagcaacaaataagcaacacatcatacatagagaaaacataattaagcaacagatgagacatagagtaatcatcgacccggtatggaggtcctcaaaaccttgtgaatgtgaccaacaagaacctgtaatgaggaagaagatgaaatggctgagacctgaagttggacacacgatgcacatggaaagggggaaatgttga

SEQ ID NO: 82834 - DNA, 492 bp, Glycine max
  Peptide Sequence Number=SeqID_199612
atggacatgcagttagcccgaaattctggggttagggtttcttcgaattcgatggagggcgacgccgtttcggggtcgagggtgtgcataaacgacgttttgacggacgactcgctgcgtttgattgtggggagggttgagagcagacggaaaccaagaagatcgccgcacgtgcgggtcgaagaatggttgatagggcttgttcgtcttctctcaagtggggatggaaccatattatccttggccaaatactgtgctaatttggagactttactcattagtggttgctggctagtctccgatgatgcggtaaagtcgctggctactgcttgtggtagcagccttaaagtcttagggttggattcgtatggaaacatttctgattctacagtgagttgtattttaaggcaatgcagaaaccttgaggcgctgaacattgctggctgtacaaagttgattgatgctggctgctcttcatcttataagcaatga

SEQ ID NO: 82835 - DNA, 465 bp, Glycine max
  Peptide Sequence Number=SeqID_199613
atggatgacaccattgctcatattcaagagttagaagatgctaaaaagattgagatgaaagttgctcaagcaaccatacatgaagtcgtggtggatgaagttatggaaaagtttgctcatcataaagaatcccaagcagatgtactgaaagctactttagatgattatcatctacctaaggagttcaacaacacccaattggttgtttcaattatacaaacaccttttgtggatgcaagaacaacaagtccaagctatgataaatacttcactaaaggaccaaatggaacaataaaggcaaacaatctccaaccaagtgattggacaacttcaactaatgaatcaagctttcatagtccaactccaaaacactttgggacctattctacatgctttgaaccatgttatgccattccttctacaataacctcaaccaccaccacaacaacaaccaccactacttga

SEQ ID NO: 82836 - DNA, 437 bp, Glycine max
  Peptide Sequence Number=SeqID_199614
atgggtgctgatcttaaagctgaattgtctgggaaaacttttgtttttggtcttaaggtttggcaaataattggaattgcggttggattgtttattgttgtcatcctctgtgtgctcccattttgccttacttcaaggaagaaaactagaagagccaggaacagaattcctgctagtcatattcctcctgtctcaaaggaaatcacggaagtgcgggttgagcaagtgcccgcaaatggatttgttcctcgtgaaggaatacttcttaccattcatgataagtccagtgacaaagaatcagacaaggttatgcttcatttaggtgttgggaagaagaagcatggggacagtggtagtcatcactcggattcatttcattacttggatggaggtgggtcacaatcaggggaagaaattagctctggcatggttggaat

SEQ ID NO: 82837 - DNA, 105 bp, Glycine max
  Peptide Sequence Number=SeqID_199615
atggaaactcctgctggcaatagtaaggctgaggctagcgtggaaggattatatttgggagtgggaactagtaatttacccgtgtgtttgtatgggttacgttaa

SEQ ID NO: 82838 - DNA, 212 bp, Glycine max
  Peptide Sequence Number=SeqID_199616
cctttgctgctgctcatggacgcactggtgttaatcagaacgtgtttgctacgcgaagaatgaagcatgcagggcgagggcgacgaacaatgttgtcggtgacgaattcagtggagagtgttagtttctgtatctgtattcactgcaaccacgaacatatccatggtggtggtggtggcggcggggtgaaagaagatgaaagcattaattaa

SEQ ID NO: 82839 - DNA, 1620 bp, Glycine max
  Peptide Sequence Number=SeqID_199617
atgaatttgcaagactacaacacagtcctaaacgagtgtgtgagcaaaagggccttcaaagaagggcagagagtgcatgcccacacgatcaaaactcactatcttccctgtgtgtacctctggacaaggttgatcgtgttctataccaagtgtgactctttgggagatgctcgccacgtgctcaatgaaatgccggagaggaatgtggtgtcgtggacggctatgatctcggcttattctcagagagggtatgcctctcaagcattgagtattcttgtgcagatactacgatcaggtacagaatctaatgagttcacttttgctaccatgccttacttcatgtataggttccttgggttttgtcttagggaggcaattcattctcttatcataaaattaaatttcaaagcacatgtttatgttggaagctcactccttgatatgtatgccaaagatggtaaaattcatgaagctagaggcatatttgaatgcttgcctgaaagagatgtagtttcttgtactgccataatctctggatatgctcaactggatctggatgaagaactggagctatttctccgtgttttaactgcactttctgggcttgctgctctagatcatggcaagcaagtgcacaaccatcttctctgctctgaagttccctcatttgtgatccttcaaaactctttgattgacatgtactcaaaatgtggaaacctcacttatgcaagaagaatatttgataccatgcgtgagagaactgttatctcttggaatgcgatgttagttgggtatagcaaacatggagagagaagagaagtgcttgagcttttcaatttaatgagagatgaaaacaaagtcaaacctgacagtgtcacagttttggctgtgttatctggttgcagtcatggaggacaagaagataagggaatggatattttttatgatatgaccagtgggaaaattagtgttcaaccagacaccaagcgctatgggtgtgttgttgatttgcttggtcgtgctggtcgagtagaagaagcttttgagttcatcaaaaagattccttttgaaccatcagctgctatatgtggttgccttttaggtgcttgtagtgttcattcaaatcttggcattggtgaatttgtgggtcataggcttctagaatttgagcctgaaaatgctggcaattatgttattctgtctaatttatatgcttcagcgggaagatgggaagatgtaacatcactaaggaacctgatgttgaagaaggctgtaacaaaagagcctggtagaagcttgattgaggttgatcaaaagagaagaagtatctgcaaagtgcaggaattattagtcaggtttaaagaagctggttattttcctgatttgagttgtgttttgcatgatgtggatgaggagcaaaaggagaagatacttctaagccacagtgaaaagttggctttgtcttttggactaattgctactcctgaaaatcttcatgctctaatccttgtcctctccaaaggcgaaagtgaccagtgcctgttcagactctcagccacagaaaatgagaaggtgactcctccaccaataaatgagcacgtggagcccaaccaagcgtga

SEQ ID NO: 82840 - DNA, 330 bp, Glycine max
  Peptide Sequence Number=SeqID_199618
atgttgagcccacctaaaccaaaatcttcctccttggatagtcctctatcaggaagtaacataaagcaaagttcaactcagaagaaatcaaaagagcatttttgtccattgtcactatcacaacagaaaaacaatagtgaaaaaactaaagtttgtggaccttttttcgctttcgtatcagagcatgccacatcagacttaatcctcgatggtgaaaaaagctacaccaagatatcagtgctaaaatcctcagtggttacttttctgaaggctataagaagaggatcaatgcaacgtttgaagcacgaaacaatattacaaagcatttga

SEQ ID NO: 82841 - DNA, 288 bp, Glycine max
  Peptide Sequence Number=SeqID_199619
atggacatactgggaccattgtcaaaggccttaagagtagtcaaatacttactagtcgtcatcgactacttcaccaagtggataaaagcaagaccactgcaggaaaatatggccaatgaggtggagaaattcacctggaaacacctcatctgcttgtacgaccttccatatgtcatcatcacatataaagacactcaattcatagctccaatttacgaagactacttgacaaggctaggcatcaagtacctagtcacctctgttgaacatcctcagaccaacgattag

SEQ ID NO: 82842 - DNA, 315 bp, Glycine max
  Peptide Sequence Number=SeqID_199620
atgcatgcatgtgacacgcaaaccgccagtggaactggcgagtttggtgttttcgaaggaaccgctagtgccaatggcgatatcggcatgcaaggggaaccgtcggtcaaactggcgagttccaagttgcagaagtcagactgcttttttcaggtggtaggctcgcttttcagtggtagggtcgctttatcagagatggcaggccaaagggaagttgcaactgccattggagagttaagggcaagttgcaactcccattggcgagttaggacagaagaaataaccatttctgatggcgatttaagtttccagtaa

SEQ ID NO: 82843 - DNA, 342 bp, Glycine max
  Peptide Sequence Number=SeqID_199621
atgtgcccagaaggacacgacaaaattgttaaaactggggaacacgaggctgacatgttccaggaggtccaaaccaaaaaccaagggctggccgacgaagcgacgggaggtggtccagcgaggttccgagggcgggaaggcggcacgtggccttcacgcgccagaaacgaggcgctgctgtggtggcgcgtggctgcgctgctggtcacgcgacttgcaggggtgggtcgtgctcctcgaggcgcacccaaccctggttttgccgaaaaatttgacggtggggacggcggcggcgaatggagacagtcagaacgggattgtacccgctctaatacatgttaa

SEQ ID NO: 82844 - DNA, 270 bp, Glycine max
  Peptide Sequence Number=SeqID_199622
atggatctagcaaaatctcaagtcacgaataatttgggtacccctaccacagttcgtggagaggctcatgaaggagcaccaccgcgaacaagtcttgccaaatctatcggcaccatcagactcatctaccagagactgatggagtcaatacggtgtggagggaacgaattccttcagtcgcttagtaggtctatagagtggagaatcaactccatcccttcatcgatggcatcatggagacacgcctaccacccgggtggaagatgctga

SEQ ID NO: 82845 - DNA, 168 bp, Glycine max
  Peptide Sequence Number=SeqID_199623
atgagaaaggaagagtggatttacccagtgttgttaaatggttgcaccgtggcagaatggcgtggcagattttttgccaaccgccataggcaatttgtgaaagggaggttgctgacttgtgtggaggtagaggctgctgctgctggagtgaatgaattgaggagttga

SEQ ID NO: 82846 - DNA, 351 bp, Glycine max
  Peptide Sequence Number=SeqID_199624
atgtctcagttaagccgtgccgtgtatttggagaattatgaagatgctgccaggcttaaggttgcatttgcagctacagctaacaacgacagtgttggaagagtgatgtcttatctcaatagagccataaaagaggagcggtatggtgatgcagctttcttaagagataaagctggcgctggacttgtgggttggtggtctggtatttcagaaggtgtaaatgatccacatggtctaattattcgcataactcctgagcatggaagatatgtggcgaggagttatagtccaaggactaaaggagatgctccacctcttttgcattgtactattgaggaatggcttgtctga

SEQ ID NO: 82847 - DNA, 816 bp, Glycine max
  Peptide Sequence Number=SeqID_199625
atggtctcacagacagttgaactcttaaagaatgagattcctctggagcaggaatcagtggttttagctgaagatgctgtaaatggtctcgttcttgtggacatcataaatggcttttgcacagttggtgctggaaatctggtatcaaaaacagatatgaggaggttgattcttcaaccaactaagttagacccgcttgatatagcctcttgtgtccgtgctccaagagaatccaatacgcagatttcgggaatgatcagtgaatcagcaaggctggctagagtgttctgtgagaagaatttgccggttatggctttcctggattctcaccatcctaacaagccagaggacccttatccccctcactgtattgttggctctgatgaatcaaatctggttccagcattaagatggctagagaatgaacctaatgtaacaatcaggcgaaaggattgttttgatggatatttgggctcaatacaagaagatggttcaaatgtttttgtagattgggtgaagaagaataagataacaactctgctggtagtaggtgtgtgcacagatatctgcgttctagattttgtatgctccacaatgtcagctaaaaaccgtggttttctggagcctctagaaaatgtggtggtgtattcccgtgcctgtgctacctttaatgtccctctggaggtagccagaaataccaaaggagctttggcacatcctcaggagtttatgcatcatgtaggcctatatatggccaaagaacgtggagccaagatagcaaatgaagtattgtttggtgcagcagggaaggtttaa

SEQ ID NO: 82848 - DNA, 1404 bp, Glycine max
  Peptide Sequence Number=SeqID_199626
atgaagggtgccaacctacacttgaaggctgtgtacttaaagcaaagaggggccttccatggacccccaacaacctcctctaaaacattggatgctgctgggagactgagttcagtggagtctactgaagacaaaagtgagctgtttgttgtgagtactgaagatccagaaaatggtaatgataggaatgatggctctgatcctgctgagggaatgcctggatttcagaatgtcttgaaagatatgattcctggggtaaaggtgaaggtattcaaggtgataactccagagaaagtagacaaggatctatctaatgtgattgagaagataattgaggacgaagacggagacgaagacgaagatgaagagatggaaaatgatgcagaaagtctagaactggaagagattaagtctgagactgaccaggagggagatgatgagattgaaataaatgctggtctgggaacttttgaacgtgaagaccagaatgagtttgctgtcaaaattgccattggtggtcttgttcagaaactttctggtaatctatcctctagagatttgcttcgagtccctgctatgctggagatgaaggggcgtggttcattttcctttactgttgaaaaagaagtcaatcagcaggttggtcttgacaaaggaaaatcttcatctgataaatcaactaagtttcaaggtcgacgcagagttgatcatgttatttttgaccttgcaaaattcattggcaggggaaagataccctcaaaggtgctgaaagaagtgggagaattgataaatctcactctaagtcaggctcagagccatcaccaattatctggctcaacaattttcaatcgcatcgaaataccagcttcgtttgatcctttaaatgtgcagtgtaaaccaagtaacatattttcattttcatcaggtctatacattggtgcacatgggctttactcctctgaagttattcatctaagacgtagatttggtcagtggcaagaggacaatggggctaaggagccttcaaatattgagttttatgagtatgtagaagctttgaagctaactggggatccttatgtaccagctggccagcttgaaacaacccttggacagaatatacaagatgaaaatggaactcctgtggcatttcgtgcaaaaattggaaagaggtatcaattgcctcataaagggataatacctgaagagtttggcgtgattgctcgctataaaggtgaagggaggctggctgagccagggtttcagaatgcccgatgggttgatggtgagcttgtgattcttgatgggaagcacctaaaagcagggccggttgttggatttgtgtattgggcccctgggtatcattttttggtcttcttcaatcggcttaggcttcaacagtag

SEQ ID NO: 82849 - DNA, 156 bp, Glycine max
  Peptide Sequence Number=SeqID_199627
atgatgcttcttcggagaattattgctgcatgtcctcaatcaaagaggatgttcagctcttctgttacccatggctatgaaagtgctattcaagaactcaacaaggtaaagtctttggtgtgttctgctagaggaaatggaatcggtattcggtga

SEQ ID NO: 82850 - DNA, 477 bp, Glycine max
  Peptide Sequence Number=SeqID_199628
atggataacagcaccctgaacaatcccggcgacaacgccgaagacccgccaccgccgccggctcccatgcaagtctttgattccttccaaccgttccattacgccaacggttccgatgaaggagaagaagctgttcctgctccagtcgccaatgcttcttctgctatgcgcgccagagctagcgaactcaccatttccttcgaaggcgaagtctatgttttcccagccgttacgcccgaaaaggtgcaggctgtattattactcttgggagcacaggagatgccaaatagtgcccccacctctgactttttgttgcagcaaaactatcaggacattcgggaaataaatgatccttcccgaagttcaaagctttcaagaagatttgcatcacttgttaggtttcgtgaaaaacgaaaggagagatgttttgagaagaaaattcggtactcttgccgtaaagaggttgctcagaggtag

SEQ ID NO: 82851 - DNA, 405 bp, Glycine max
  Peptide Sequence Number=SeqID_199629
atgcctcgccgtagctccggtggaagatctgcccgtcctgctcctcgggcagctcctcgtcctgctccagttcaccatgctcctcctccagcccctgctcagagtggtggtggatctatgcttggtggcattggttcaaccatagctcaaggtatggcttttggcaccggaagtgcagtggcacacagggctgtggatgcagtcatgggtcctcgtaccattcaacatgaaacagttgttacagaggctgctgctgctgcccctgcacccactgcaaatacttttggtggcgatgcatgcagcattcatacaaaggcattccaggatctaaggatatattttgtgcttggaaagatgtgggaggtaaaaattatcttctttggtagggtaactaatcaagactaa

SEQ ID NO: 82852 - DNA, 225 bp, Glycine max
  Peptide Sequence Number=SeqID_199630
atgcaaaagattacatccagttgtactctccatgcagaaacattggccactaggttaactctccatcataaccttccagtgcagaaaggctataaggtctcagtaactatccgcaatactcaacagagaggaatatgttccaaggattccacaaatgactccgaatgcagcaattgcaacactgagtgcaacctgatgttattaggaaaaagagaagttgagtaa

SEQ ID NO: 82853 - DNA, 594 bp, Glycine max
  Peptide Sequence Number=SeqID_199631
atgcatcgtaagaatggacagtttgcatcattgaaggaagactacaaatctcctgctgaaaattgggattcaagcaatggtactccttgcccagactctacatgccagcattgtggaattagtgagaagtctactccagctatgcgtcgaggaccagcaggtccaagatctctgtgcaatgcctgtgggctcatgtgggcaaataagggaactctgagagatctcagcaaagcaggaaggattgcttttgaacaaaatgaactggatacttcagctgatataaagccttcaacaacagaagccaaacattcttatgctaagcagggcaaggagggaagccctgaagaaactaagcctgtgcaaatggattccagacggtcacctgagaagacaaatgagcagtttattattggaactgctgaatcagttactaacaacttgtccgtccgattggagaatcatgctcttattctacatgagcaggatactcttgaggatcttgctgatgcttctgggaccgaatttgagattcctgcaggttttgatgatcaggttgacattgatgatgccaatatgaggacttattggctgtga

SEQ ID NO: 82854 - DNA, 657 bp, Glycine max
  Peptide Sequence Number=SeqID_199632
atgtacctcctagaactagaaggcaacgatagagggagtaggggttgtgttgtggctaggtgcttgatagctgtttgcaactctgaaggacatgtgaagatttatcgtccacctttttgtgattactgtgctgaatggattgaggggaggcaatatattctgatatgggcatggaaaaactatgtggtggacataactaaaaggttgtatgactattttcaatgtactgagtttcgaggtacgaggtttgcttcattggatgtatctgataaaaattcatcagatcaaacggattctatgtatgaagaaaatgggaaactgttaagtgctgatcaatatgcttctcgtagtgcaatgctgtgttcacttgttgtttcatggtctcccttgctgcgtttagcatctgaattgtatccagtttgtgattctgttagtctgcttgctgttggcgggaagtctggtaaaatttctttatggagatttcacccaccagaatgttataccattgaggacagagaagtcccaactactgtgaagtttgttggtcttcttcaggcgcacaattcatgggttacaactataagttggctgttgtttgcttttgattcttcgaatcctcaaattttattagcttctggaagctctgatgggaggtga

SEQ ID NO: 82855 - DNA, 2337 bp, Glycine max
  Peptide Sequence Number=SeqID_199633
atgtctcagacatccactgtcctgcctgccttccactccatcaaatcattgcctcctgagttcaaccccgttctcgtggaaaaacatggagatgttaaatttagacacaccaatccgattggatcaaatggccttgaaaatggtgcactggtagcggagatttctaaggaagttaactgccgtgctggtggcatggatctttttgacgaggactcgccgtatggtggaaaaggtagatcattaaaagaccggccgtctaatgcagatgaagactcagtatctgtttcattgcccctcccatcgattttgacatcctctagggaaagcaggtggaatgatgcaaatccttatggttcaaaaaagaagcttcagtcctggcttcagctaccgaatggggattgggagctggtaaagataataacaacttctggagctgaatctgtcatttcactgcctgatgggaaagtgaaagaggagagtttggtgccagctaatcctgatattcttgatggagtggatgacctcatgcaactaagttatttaaatgagccatcggttttattcaacctgcaatatagatacaatcataatatgatctatacaaaagctgggcctgttttggttgctgtaaatccatttaagaaagttcctctgtatggtaatgactacattgaagcctacaagtgtaaatcaattgaaagccctcatgtatatgcaattactgacacagccatccaagaaatgatacgggatgaagtgaatcaatctataattataagatgcttcaatctaagttcttatttcagctgcaacttgtgcaagtattgcttgaatgctggttttatgttttactctctcaagtttaaaggatggtctagtgtacaggctcccattggtgagagtggagcagggaagactgagacggcaaaaatagcaatgcagtacttggctacccttggtggtggaagtggaatagagaatgagatattaaagactaatccgatactagaagcctttggtaatggaaaaacattaagaaatgacaactcaagtcgttttggaaagctcattgagattcacttcagtgaaactggaaaaatatctggtgctaatattcaaacattagtccaatgcaacgaaggggaaaggtcatatcatatattttatcagctatgtgctggagcaccatcatcacttagggaaaagctaaatctaacaagtgctgaggactataaatatctgaggcagagcaattgttattcaattacgggagttgatgacgcagaagaatttcgcatagtcaaggaagctctggatgttgtccacattagcaaaggagaccaggagaatgtatttgcaatgcttgctgcagtattatggttaggaaacatatcatttactgtggtagataatgaaaatcatgttcaagctgttgaggatgaaggactgttcactgttgccaagttaattggctgtgaaattgaagacctgaagttgactttatcaactcgcaaaatgaaagttggtaatgatattattgtccagaagttgactctatctcaggctattgatgcaagagatgctttggcgaagtcaatatatgcttgtctgtttgattggttggttgaacaaataaaccaatcccttgcggttggcaaaagacgaactggcagatcaatcagcatcctagatatttatggctttgagtcattcaataggaacagttttgagcagttctgcataaattatgcaaatgagagattacaacaacacttcaatcgtcatttattcaagttagaacaggaggaatatatccaagatggaattgattgggctaaagttgaatttgaagacaatcaagattgccttaatctttttgaaaagaaaccactggggctactatccctgttagatgaagagtcaactttccctaatggcacagatttaacctttgctaacaagcttaagcagcatttgaattccaactcatgcttcaaaggagaacgagaaaaagcctttactgtgcgtcattatgcaggggaggtcacttacgatacatctggattcctggaaaagaacagggacctattgcacttggattccatccaacttctatcctcaagcaaatgtcatcttcctaagttatttgcatcccatatgcttactcaatctgagaagcctgtagtaggtcccttacacaagtcaggtggggcagattcccaaaagctaagcgttgccacaaaattcaagacttctattcaatatgtttataatgctattaatggtaaccatgcaaaatactgcatctacagcttgaaaaaggacagcctcatctaa

SEQ ID NO: 82856 - DNA, 423 bp, Glycine max
  Peptide Sequence Number=SeqID_199634
atggttgttggtactctctgtggctttgaccagtttatgaatttagttgttgacaaccctgtggaagtgaatggcaatgagaaaaatgacatagggatggtgctaacagctgtgtttatggcttttcttatagatgaggattctaatggggcaatagatcaagaggagttgaaaaagtgtatgttcaacggtgttctaatggctaacatgtatgtttatggcttttcaacggtgttcattcatctttgtcggttttcacacgtcgtgaccaagggagctcacaactttcaggctctagctgaagtatcatctcgagtagctcaaggcaaaaatagcaaaaacgagttaaatgaggttcagaatccacacaacattaaatacaatggaacaattgaagatttaaaatatacatggagaacttaa

SEQ ID NO: 82857 - DNA, 285 bp, Glycine max
  Peptide Sequence Number=SeqID_199635
atgtggaaccaggataaaaatgacctgaaagcagcaaaaagaagaagattagaaacaaagtgtggggtagaatctaaaacccaaaagacgaaatcaaagcaagatgtgaagttcgttgctgttgatcgactgaggtttgagaaccttttgaagcgcaacaggttcaagaaggagataaggaggaaggagaggataagaattcggagaagagataggggtagagatggaaaattaaatctaaaaactaatttgttaaccatgttattagttttagacaaaacttag

SEQ ID NO: 82858 - DNA, 171 bp, Glycine max
  Peptide Sequence Number=SeqID_199636
atggcgaatgtagaggaaagtagggcaacgaggcaaccaccatttgaagagaatgagtgggatacttaccgtaatcaacaaccattctcatatgaaacacgttcgatacttacctctggaccatacttcccatttccaactccagatcaaagagattttagattaccttaa

SEQ ID NO: 82859 - DNA, 950 bp, Glycine max
  Peptide Sequence Number=SeqID_199637
gtggttgggtagggtatttctcttatgatacaatgcgctatgtagaaaagaagaaacttccattttctaatgccccagtagatgacagaaaccttcctgatgttcatctgggcctttatgacagtgtgattgtgtttgatcatgttgaaaagaaagcatatgtgattcattgggttcgggtggatcgatattcttcagctgaggaggccttcgaagatggaaggaaccggctggaaactctagtatctcgggtgcatgatataattaccccaaggctgcctacaggttcgataaagttatacactcgtctctttggtcctaaactggagatgtcaaacatgacaaatgaggagtataagagggcagtattgaaggctaaagagcacatacgggctggtgatatttttcaaattgtactaagtcaacgttttgaacagagaacttttgcagacccatttgaaatctacagagcattgaggattgttaatcctagtccatatatgacttatttacaggccagaggaagtattttggttgcttcaagtccagaaattcttacacgggtgaagaagagaaagatcaccaatcggccccttgctggtactgttagaagaggaaaaacaccaaaagaagatatcatgttggagaaacaacttttgaatgatgaaaagcaatgtgcagagcacgtaatgctagttgatttggggagaaatgatgttggaaaggtctccaaaccgggttctgttcaagttgaaaagcttatgaatattgagcgctattcccatgttatgcacatcagctcaacaagtatcttaggttatctcttgggattagttcttctttccttggttttcatatttcctaattatatcacaacggatactagtctgccaaatctaaagggccacaaggcttgggttgaatttcttggaagttcaactttttcataa

SEQ ID NO: 82860 - DNA, 744 bp, Glycine max
  Peptide Sequence Number=SeqID_199638
atggtttaccctattgtgaagatttggttggctgacaatgacaaattgctgaaatcatcaaaagtggatcaaacttccttctcattattgaaggaggttataactgtcaatgctgtcccagtttctgtactttcagtaaccacgcatgttcaatacccttccaagatgcttttagccacgggcaaagtttctggttcatttgaaatatggctatgtgacatatcttctagggaatttgataagcttggctcatataatgcacatgatttagttgttacaggtttgacctgggcattcggtggaagatttttgtacagctgtagccagctacagagacatttgtcagatttctttacgagtgtcattatgcataacatgagctacacaaagctcttcaacatcatgttgggtgaacaagtgcaagcttgtcaaacactatttgtttctcctgaagggacaacaaacggcaaaggagttagagctttagtactaatttctagtctagtgatagtggcatactgtagtgtccccactagggacctgtataaagttgggtcttccaacataactggacccaaaacaggacagtttgttgttgcccaccgtaggggtaaagatgccttttgcctgtcatcttggcttccaccaggcagaagagggcagtctgttaataaaatttcagtgagaattgagaaaggcatggtactgaaactgcaagggaagcttagcatgagccaggagtag

SEQ ID NO: 82861 - DNA, 249 bp, Glycine max
  Peptide Sequence Number=SeqID_199639
atggagtcatcgtcatgctcagttttgtgtgatggtgatggtttgagggggaggaaaaatcgattgcgggcgggacaacggtggcgttggtggtgggtggcggtgctggtgttcttgccccatttcaagaggcagaggacaaagttgtgtagaggttgcgacttaaccggagcccatgcaaatggtcactttggaagagatgaccctgacttcacaggggaggtggtgaaacctctaaagtgggaatag

SEQ ID NO: 82862 - DNA, 357 bp, Glycine max
  Peptide Sequence Number=SeqID_199640
atgtctcctccacctctaggacctctcaatcactcacaaactcaactcacgctctcaggacggcttccttttccagctctggtctctgcagatcttcaacaacaaaatctctcaaactctctggaatttggacctctctctagaactgaagacatgcaagagctcctcaagaaaaatggccaaactcctactctaaatctgattttaggcttaaatagcggtgcgcttagcgggatgacccttcgcttagagaacatgcacaactcatccttcttccagattcttcctcgcgctcaaccgaggagggttgcgctcagcggatggctcgctaagccaaaagattggcttagcgagaag

SEQ ID NO: 82863 - DNA, 390 bp, Glycine max
  Peptide Sequence Number=SeqID_199641
atggttgattggctgaagacgatggttggaaacaggagatcagaagaagtggtggacccaaacattgaggtgaagccatctaccagagctttgaaacgggtgctcttaactgctttgagatgtgtagatccagattccgagaaaagacccaagatgggccaagttgtacgtatgcttgagtcagaggagtaccctttagcaagagaggatcgtaggcaccgaagaaatcgtggggttaactcagaaattgaatcacataaggataattctgacacagatggcagtgacattcagggctctagatcagaaagcggaaggatcagtggggtgtataaaattcttggatttgcctacccaagatgggcatggcagaggctcagcaggggataa

SEQ ID NO: 82864 - DNA, 861 bp, Glycine max
  Peptide Sequence Number=SeqID_199642
gttcattgtcttgatgttgagaaactgaatcgaatgtatgaaggaaggattctgagggcagctattgaatacttttggattggtggactacaagtggatgttcagctgaaatctcccttttcatgttacattgaaggaaattccagttatgtggagaaagaattaacttattggggaaccaatatcatatggtctttaaaccaatatcaatgtcatgataagcctctggttctctgggatataattgcagcattatcagcattcaaggataacaatttaaaatatgcagaacatttacttattgagtggatctcatcatcttttctacaattagatatggacctttctcctgaaaaagttttatcattcttctcttcaagcttgtcagacattccttctcgactactacacttgctcaatataatctgtagacgtgtaatgttggcagagctggatgctgatcaaataactggaatatacaaaaagtttcaaaagctggaagaggtaagtcctgccatggaaaaacaaattactaagtggacaaaacttcttctaaacagtgaaagagagctccgtgaaaggcttgtgggctttagtttttctgctttccaaactagcatgtccaatccagaaacaaatttcaaatctggttgttggtatcctgttggactagcacagatggaacaatggattgctttagatcaggaacatatacatgaccagttaaaagtcattgcatcagaagctaagcatgagaaaaggtttgccccactactcccctatggtattgtgtctgttgccataggtcagggtttagattggcaccagaaccactttttagaatgtcttcatttcatatag

SEQ ID NO: 82865 - DNA, 171 bp, Glycine max
  Peptide Sequence Number=SeqID_199643
atgttggagaaccctaatactttccaacttgggttgagaattcatgtctcttggatgctgttgggggcatgttttgagggattgaggttcatctgcgggggacttatgctctctgaccctatctcctccactttcacactccttgatggtctttgttgttttcagaaatga

SEQ ID NO: 82866 - DNA, 279 bp, Glycine max
  Peptide Sequence Number=SeqID_199644
atgggtgaattagcctctcattgtcatgagaagccttacacaagaagaaaacacaaggtggcagaagaaaaagatgattcacaagtgaattcttcaacaattgaatttctccaattcttttcctattgcaatggtgtttactcaccgatcgatcttgtattccctgggcaaggtcttcagatgatgtggcacttctcttccgctcttgaactaccatgtagacttgtctatgcacttggactcgttgggctagacctcacgaatgacagttgcatttag

SEQ ID NO: 82867 - DNA, 582 bp, Glycine max
  Peptide Sequence Number=SeqID_199645
atggtggatccatggttttcgttgccgcgcaccacgctgcttcctccatgccaagatttgaagatggagggtttttcctctacttcctccatgtcgagatctgaagatgaagggccttccttcgtgtggatactagatgggcgatggggagaaggggtggggtgggtgggaggatggcgcaacacaaaggggacgagcataatctataacccattgattcaaaaaaacgtgtcaaacttgagcgatgtcactaagaagaccaacggtcggcaaaagatcaagatgaagaagatcagcaacaagtgtaaccttcaggtgatgttcttaaagtgtcagactggagttttcaagaaaacgagtgagcttgcaaccctttgtggtgtcgaccttgctgtgattatgttctctcccaataaccaagtttactccttcagtagccctaatgtggatttcgtcatccacactatacaacccaaagcccacctcccttctttacccaagacctcaacaaggaccctagcatcgtggatgaggatgagctccacacacacctcaactgtttgtctgaccaaattgccgtag

SEQ ID NO: 82868 - DNA, 210 bp, Glycine max
  Peptide Sequence Number=SeqID_199646
atgaccccttgctcagcgactatgcatagctcatccttcttccagattcttcctcacgctcagccgataagtgttgcgctcagcagatggctcgctaagccaaaagattggcttagtgagaggccatctgcaccagtcatggagccagagcagcctatccaggatgtaccagcagctccagcactggatcttaatgaagatcagccatag

SEQ ID NO: 82869 - DNA, 165 bp, Glycine max
  Peptide Sequence Number=SeqID_199647
atgaagctcacacttccagcctccatagaagcttctcaagcaagctttcaccagtatatcacttgggaagataatgacatggattcatcaagtgattcagaaaatgaaattgcaaatctaagcctcatggccaaagactatgaaaccgaagaagagatgcattaa

SEQ ID NO: 82870 - DNA, 387 bp, Glycine max
  Peptide Sequence Number=SeqID_199648
atgacggaagggtgtggtgaagggttttgccttgcaaaccttcccggtgatgcttttagtctatgggggaacttctttgaggcaaagaaacaaatgatggctgatgccaagtttgcggggctgcttgtcggcggtgctgggttatggccccgtgctaagtttcggattggttggccccctcctcccccccgtgatcagttttgttgccaggattttgccaactttggcttgcgccccggacgaatcaaagcgacaagggctgaatctcagtggatcgtggcagcaaggccactctgccacttacaataccccgtcgcgtatttaagtcgtctgcaaaggattctacccgccgctcgatgggaaattgcgcttcaaggcgtctcgtag

SEQ ID NO: 82871 - DNA, 636 bp, Glycine max
  Peptide Sequence Number=SeqID_199649
atgaagttacatcacgttaagctttcccttagtgcgcggcgtagccatagtgctgggttgccatcgttcccccctgttgtgttggctatgagtgggtgtctcttcaaggtcttgggtctggttctccccttgatcacctttcaatgtgctctgcttgagcacttaaacgtatccctttctcaactccaccccaatagttgggccatgatgatgatgacaggcaaaaccggttgggtctccttgaacaggatattgaagaagctattcgagtttgactcaaatgtgtttcgctggttcaaggacctttttttcaaggtcctggctactaacgtcgaggctgatacgaggagccttgcatcccattctactgagggtcaacaaggccatcttggagcagcggtcgaccttgctggatacacggtgacgcgggccattttgtctcttccctcgcaggcgatcccctcgccaccttggatggtcggacccgctgctggggttggccctattgataaagttgctgaggtctcccccagcatgccttcctttgttttggctaagaggaagcacgatgatggtgctgaagtgtgttcacaaccggcaagtgtaccggatcgcacaagtagtataaaacggtaa

SEQ ID NO: 82872 - DNA, 354 bp, Glycine max
  Peptide Sequence Number=SeqID_199650
gctgcgcttgaaaaggaaaagaatgtgagtgaagttgaagatagtggaaagcaggaatctctggaggcattgacctcgcagataagtgacatggttgctattgcaaaaattatgaaagccactttggttttgcctacattggatcatgattccttttggacagattctagtgattttaagcaaatttttgactggaagaacttcattgaagttttaaaagatgatgttcaaatactggaatctctaccaccagaatttgcaacaattaagccagttttgaaggctccggcaggttattacgcaggggaggtgctgcaattattgaagaaacacaaagtgatcaaatttatctga

SEQ ID NO: 82873 - DNA, 258 bp, Glycine max
  Peptide Sequence Number=SeqID_199651
atggcaacattacaatcaacattagtgacactattgctcgagccagacccacatgcatggaagattaattctctacttgaatttggttgcaccttatattcaggagttataggatctgcagtattattatttatccaagcatggtgcatttcgctaagaggtcctctcttctgtgcaatgttcaatcctcttttcacagtcattgtgactatattggctgctttattacttcacgaggagatatactctggaaggtaa

SEQ ID NO: 82874 - DNA, 1531 bp, Glycine max
  Peptide Sequence Number=SeqID_199652
atgcattcgaattccttcaagctcatcttcctttgtacccttgttattttgttcaatttcccaactactaaagcacaggagtcccacgattatcttaaccaaatgtgcagtgaaagcgaaatccctgccaacagcacctatgaaaagaacctgaggactctcttctcttccttatcttcgaaggcaaccgccaaaacattcttctacgacacagtggtgggcagaaactcctttgacacggtgtatggtatgttcatgtgcaggggtgatgtaccctctcaactctgtgggcagtgtgtggtaaatgcaacccacacccgagattcagagccaggttgttccaggtccatatgggatgtgatttggtacgaggagtgcatggttcggtattccaacgtccctttctactccaaagtggccacacatcccttctgttacaagtggagcttggccaatatctcctccaacccagcaagtttcatgagtttgttgtacaacaccatgaaccaaactgcacatgaagcagccatttctggtaacatgtactccacaaagcaagcaaactattctaattctgagaccctatactgtctggctcagtgcacacaagacctctcaccccaaaactgcacagcctgtcttactcaagcaatagagtacctcccaaactgctgtgaaggaaagcaaggaggtagagttttgtttcccagttgtaacattaggtatgaattgtaccctttcttccgcaatgtcacggatgaggcactaccagaaggaattgttcctgagacaaaatattcacacacggattcagaatattcagaagatcctggctatatttctcacaactgctcaaccgaccaaatcattaacgatactgctttcgaatcaaacctcaagaccctcttctctgatttgacttccaacgccaccagtggcaacagaaacagcaaaagagcgggagcgggaacactgcaaggcttcttcacgtgtcgtgtcgacctttctcgtaccctttgtggagaatgcgtccaaaacgcaacggagaaaatattctccgcgtgtggtttggctgcggagggtgtgatttggtacaatcactgctggcttcgctattcaaatcgatcatttgccatggaaacaagtcccagctatgtggatctgaatgtcaccgacaccgataatcgggtgcaatattcctctcatgctttgacattgatatccaataaattagctgcaatggcggatggcacgggccaaactcttgacaaatatcaaagtggaacattgatattgaataataaacaaagggtgtatattcttgctcagtgtgcattggatctatctagtgaagattgcggtgcctgcctaagtgatatgattggatcagcaattccatggactcgtttgggaagcctaggtggcagagttctgtatcctacctgtattctccgctttgaactgttccagttttacgatctgattcccaccacagcaatcactcatccacttctactagcaccagcatcag

SEQ ID NO: 82875 - DNA, 132 bp, Glycine max
  Peptide Sequence Number=SeqID_199653
atgaagaagatgaaaaaatcactgatttccataaaggatgcactgttgagggcaaggccatcaatcgccattagttcccctgattccgaaacctcaaatgacataagagaaaatcctccaaactacatgtag

SEQ ID NO: 82876 - DNA, 267 bp, Glycine max
  Peptide Sequence Number=SeqID_199654
atggtcctaattgatcgtgctcgaaggaccgtgcgaggatctgcagatgatataggatggcttcaacgtgatcctggaatgcctccggttgaagatggaacagagaggttcctggaaattctggacaacatcaagtttttcttaccttgtcaggcatggtgttcacaagttaccaaattcggtggtttatttgttaattccaggttaatcatgactaactctacttccaatccctcacatgcagctggaaggacaaatgtttattag

SEQ ID NO: 82877 - DNA, 219 bp, Glycine max
  Peptide Sequence Number=SeqID_199655
ggattcaatgacacaaaaattgaattcaagctggcaaatgttcagaaaatatggcaaagattcttgtatcgtgattctgttttgcttgaagctgaaaggcagaaaactgctattggacatgttgatgattgggcagttgaattcttaaagctgacagaggatgatgcctttgccactttaatacaggtacttttattctttttggcaaactatttttga

SEQ ID NO: 82878 - DNA, 342 bp, Glycine max
  Peptide Sequence Number=SeqID_199656
atgatctactttttcattgcttaccttgtttatcgaaaccagaaaacgtttgatctggatggtgcttgtgtttttgatatggacatttcaaatcaaattttattaattgcacaaaagcgaaaggcaataggtggaatgcacttgttaactaaaatgagcttgatgtttccatttgagatgcaagacatcttactgccttccggcacaaatggtgttaaagacctacacatttctgcttctcatagtagtaccctggctctctttgcttctctaggaaagaaattatcagtgctcagcttggacagcggcaaccttgttgtcaattatgacctacaggtgtag

SEQ ID NO: 82879 - DNA, 372 bp, Glycine max
  Peptide Sequence Number=SeqID_199657
atgaacagattaaacaatgcaatttctgttggggatataaatggcaagataaaaagcatggaacacatgatcgagcatgaaactttgcctctaaataaagaaaagcaattgatacacgagatcaaacaattgaagcagaactatgaggagttgtcttctaatatgaaaaagcaggatcaatcacaacaatctgtagacaacaaggatgacaatattgaagagcactttaagcatttacagcttttgaagaaggaaatggaagtgctaagaaataatgttttgaagtcagatacagaaactaaagccgcaaagaagaaatataatgatgaatgtgataaactaaataagttccccttttactatacacactaa

SEQ ID NO: 82880 - DNA, 716 bp, Glycine max
  misc_feature (5)..(5): n is a, c, g, or t
  Peptide Sequence Number=SeqID_199658
ggggncggagcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcaggtgacatgcgagccttagaagacttgacatatgaaaggaggagagagtttttgaaagagcatcatctgccaaaagaagtcccaattgtttcctttcggaccgaagctggcatttcccctgctgttttagccacattatctcacgttgcacatgctgaactacccctggttgctccagccggtgagtctagaaaacttcctgtggtgatgccccttggtgctgctatggctgcttgtgcacagttgctgcaggtgaggtatggagagaaaagtgacgggcttgtcacatgccgagatgcagaagttcccggatccgttgtggtgcgacctaaacgaaaattggaccatgcatggatggtttattcatcactaaatgatgacctttctgaaggagatgcatttcaggtctgtgaggctctcttaactctacttgtggaaatcgggcagaaaaagatgcatgagcttgcaatgaaagatgaatga

SEQ ID NO: 82881 - DNA, 210 bp, Glycine max
  Peptide Sequence Number=SeqID_199659
atggcgtcccgaagaggtggagtctcactcccagacagacctagcaacaactcaagctccgtcctcgcgaagatctcgcgctcctccatcgtcacccgcggcaaggaagtcgccgatgacgctgcattcgtcgccaagaagctcctccgtagcactggcaaggccgcgtttttgctgttggaatacctgaagcggaaatttcgaacttga

SEQ ID NO: 82882 - DNA, 360 bp, Glycine max
  Peptide Sequence Number=SeqID_199660
atgggtcaaacagagcctgagcttcttctcaagcttgactgtggagtttggagatggttcccaaatgtggcatggtgcattctacacttcatcaggtacatatggttcacaatgacgtccttagttgagttcgaggaggcaccaaagtatatggagtatttcatatggtgggtacaacctacatggccctactaccattttgtcgagcatgtagagatcatagagattttgtcttctttggatgcactggagtatgtgctaagaccaccttatgccaaggatgactctcctcagtatgtgccaaggccaccctatgctagtgaggactccgagcatacagtacaacccatatcgctctaa

SEQ ID NO: 82883 - DNA, 1861 bp, Glycine max
  Peptide Sequence Number=SeqID_199661
atggcttccaattccttcatgctcgtcttcctttgcgtccttgttaccttgttcaactttgcaaccactactaaagcacagaacgtggaccaggtttattttgtttcccaaagttgcagtgcaaacaaaaccactgccaacagcgcctacgaaaagaaccttaagacccttctctcttccttatcttccaacgccactacaaccttattctacaacaacacagtcctcggcagcacaaacactacctctgacacagtgtacggtctattcatgtgcaggggtgatataccccttcgcctctgcaaagaatgcgtggcgaacgcaacccagaaactatcttcagatcaaagctgttctctttcgaaacaggctgtgatgtggtacgctgaatgcatagttcggtattccaacgtcggcttcttctccaccgtgtccacatctcccgaatattctttgtataacccgaacgacatcaccgacaactcaacaaacagtttcatgaacttcttgtccaacaccattaaccaaactgcagaagccgcagccaattctgctaaaaggttctcaacaaaggaagcaaacttgtctcagtctcagaccctttactgtctggctcagtgcacagaagacttgccaccccaaaactgcacaacctgtcttgcgcaagcaatacgtgagcttccaatatgttgttatgcaaaacaaggaggaagagtagggtttcccagttgcaacgtttggtatgaactgtaccctttctacggcctcatcacggatcagactccaagtccaaccagtactcctcttcctcctcctccatcatcatcatcatcagggaaaggtcaaccacggaatattattttgatccttacctccagcattactctaccagggatacttttcaccttttactattatttcatacgcagaaaagcaaaaaagaataacaaaactattcttaggaaaaattttgggcatgaaacttccaccatagagtcattgcaattcaacttagcaataattgaaacagcaacaaacaacttttcacacgagaacaagattggtaaaggtggatttggagaagtttataagggcattcttattgacggaagacctatagctataaagaggctctcaagaaattctaagcaaggtgtagaagagttcaaaaatgaagttctattaatagccaagctgcaacatagaaatctagtgacattcataggattttctcttgaccaacaagagaaaatactaatctatgaatacgtgccaaacaagagtctagacttcttcttatttgatactaaactggaaaatgttttgagctggtctaagcgttacaaaatcataagaggaattgctcaaggaattcaatatttacacgaacattctcgacttaaagttatacatcgtgatcttaaacccagtaatgtattgttagatgaaaatatgaatccaaaaatttcagattttggccttgctagaattgttgaaatagataaagagaaaggtagtacaaaaagaataattggaacatatggctatatgtctccagagtattgtatgtttggacatttttctgagaaatcagatgtttacagttttggagttatggttcttgagattattagtgggagaaaaaacatagattcatatgaatcacaccaagattactcggaggatagacctacaatgatgacaattgcttcatatcttagtagtcactcagttgaattgccttcccctcgagaaccaaaatttttcttgtaccatagaatagatccaattgctgcacatgcaagttccaggcaattggccaataattccctaccatcctctatcaatgaaatatctataa

SEQ ID NO: 82884 - DNA, 128 bp, Glycine max
  Peptide Sequence Number=SeqID_199662
atggcaaggctctcaccgactagttatgcctcacatctgtcaggattgccaagtcggcactatggaaacacgaccaaaaacttgatgtttttatccccaagaactcttaagtcgcgagtatacctcag

SEQ ID NO: 82885 - DNA, 1094 bp, Glycine max
  Peptide Sequence Number=SeqID_199663
atgccttggaaatccttcaagcttatctttctttgtatctttgtttgcttcttcttcaattttgcaactactactaaagcacaggacgccgaccctcttattattggccaaatttgcagcgcaaacagaaccactgccaacagcgcttatgaaaagaacctcaacaccctcctgtcttccttatcttccaacgccaacgcaaccttattctacaacaacacagtcctcggcagcacaaactcctccgacaccgtgtacggtctgttcatgtgcaggggtgatgtaccctctcagctctgcgcacgctgcgtggtaaacgcaaccgagagattatcttcagacccagagtgttccctgtccataaagggtgtgatttggtacgacgagtgcatggttcggtattccaacgtcactttcttctccaccgtggacacaagaccctcttactatatgtggaacctggcaaatatctcctccaacccagaaaacttcaataatttgttggccagcacctttaggaaaactgcagaagaagcagcaaattctggtaacaggtactccacaaagcaagcaaacttatcagaatttcagaccctttactgtctggctcagtgcacacaagatctttcaccccaacactgcagagactgtcttgattcagcagagtccaaaatccaaatatgctgcgatggaaagcaaggaggaagagttttctttccgagttgtaacattaggtatcaactgtaccctttctaccgcaacctcacgtatgaggcatcagaagcactggttcctgaaacgaaatatccagaaagagactcagaatattcagaagatcctggctatatttaccacaactgctcaacaaaccaaaacgtgaatgatactgctttccaatcagaccgcaagaccctcttctctgacttgtcttccaacgccaccagtggcgacagatactcggtaaaagccggaacactgcgaggccttttccggtgtcgcggcgacctttctcgttacctttgtggacaatgcgtccaaaacgcgacggagaaaatcctctccgagtgtggttgggctacggacgttacaatttg

SEQ ID NO: 82886 - DNA, 183 bp, Glycine max
  Peptide Sequence Number=SeqID_199664
gtaaatggtattgttgaccagttggtgaagtttgggaagattacaagacatattttagggattaagtttgctcctgatcagtttgtggaccagctgggagtcagtgcagtgtttgtcttaaatgttcctgctaatggtcttgctgggaaagcaataagttatttgttatattattttttataa

SEQ ID NO: 82887 - DNA, 414 bp, Glycine max
  Peptide Sequence Number=SeqID_199665
atgatgatgtctatgtggagtcaggctatcgtccagaaagacagacaacacttggcttcaagttttattattcgtgctattattcagtacatgagagtaacacgcacacaacagaaggcatcttcatgtttggagcaagaggatgaggtaagcgccttagttcgaggtcaaggatcctctttaaggaaactaactaatttgttaaggaaaagattcttctctgagttttattcatgcatgtatcaagctttatacaagtctcgttacgctaacgctttctacgtgcttaggtcgtgtgcaaatccttcgtggtctggcttctcgcggtactacgggatcatcttcttccagatggctgctggtgctatcattatcgccccctgggaaaatcacattgtcctcaaggtgatgtga

SEQ ID NO: 82888 - DNA, 270 bp, Glycine max
  Peptide Sequence Number=SeqID_199666
atggaaaggaacctggtgtttgctactcgttatgattttttgcactggactcgccctattgcatatgatattggttttgtggcagtgattatgaggtcagacaaagatactggaaatagagggcagacctcatatgttttaattggttgtgaaaggagtggacaatatagggcatataagaaagatttagtacgaacaattactggcagtagaaaatgtgggtgtccctttaagctgcgagcgaaaccagtgttgggaggtgaaggatag

SEQ ID NO: 82889 - DNA, 813 bp, Glycine max
  Peptide Sequence Number=SeqID_199667
atgagaaaacgtatcaatatggaaagtgatgctgacttcaattcctttgccacttcaactccttcaatcttctttgacaccaacacttctagcacatcctcctcctcctcctcctcctcctcatcatcatcaacatctccaacctcaaacaaagattcatgcaccaaagaacacaccaaaacccctcaaaatgactcaaccatttctcaaacctcattagaaaataaagaggactcaaaagagtgcaagaagaggcagagagacaatagcaaccagaatcaccaccctacttataggggtgtaaggatgaggaattggggcaaatgggtgtccgaaattcgcgagccaagaaagaaatcaagaatatggctcggaacataccctacagcagaaatggcagctagagcacatgatgtggctgccttagccatcaagggccattcagcatacctcaatttccctgaattggctcaagaacttccaaggcctgctagcacatctcctaaggacattcaagctgcagcatcaaaagcagcaaacactgcctttgaggtggttaagcattgtcaaataactgaagaacaagaacaagaacaaaaccaagcagaacaagaaacatcttcaactctctcaatggacaacactcaagagccttcaagttctcactctaccaatgatgatgacactttgtttgatcttccagatcttttccctgatggaaacaatggactttgctctttttcttcttggcatttgtgtgcagttgatagtggctttaggcttgaggaatcatttttttgggagaactattag

SEQ ID NO: 82890 - DNA, 651 bp, Glycine max
  Peptide Sequence Number=SeqID_199668
atggccatcgtactcacttgtacgaatttttttgtcaacagtgagactgttaaatttggccacgtcacattcttctggaatggaaaccgctctgggtattttaatgcagaattggaggaatatgtggaaattcctagtgattctgggattacattcaatgaacaaccattaatgaaagcattgcagattgctgaaaaggctagggatgctattcttagcgggaaatttgatcaggtacgcgtcaaccttccaaatggtgacatggtggggcatacaggtgacattgaagcaacagttgtggcatgcaaggcagctgatgctgctgtgaagatgattcttgatgcaatagagcaagtgggtggaatttatgttgtcacagctgaccacgggaatgctgaggatatggtcaagagggataaatctggaaaaccacttctaggcaaggatggaaaaatccagattcttacttcccatactcttgagcctgtgccaattgctattggaggtcctggattggcccctggtgtcagattccgcaacaatgttccaactggtggacttgccaacgttgctgcaactgtgatgaatcttcatggatttgaggctcccagcgactacgagacaactctgatagaagtagttgataactag

SEQ ID NO: 82891 - DNA, 282 bp, Glycine max
  Peptide Sequence Number=SeqID_199669
atgacggtgacagtgagttggagaagaaaccaccaacaagtgaagatgaatggagggttgaagaagatcgcagagcaagatgggatagcgaaaacaaaagcagtagatgaggaaacgaataaatgtaggggatgttgcttttcaattttaattgaagggaaaattcaacaactcacctatattgttgggtgcagaagaagaaacaacggtgtaggaagaaaatgccttaaactaattacacaaagcagagcccaaattcgcaacttaattattcaagtgtag

SEQ ID NO: 82892 - DNA, 153 bp, Glycine max
  Peptide Sequence Number=SeqID_199670
atggtactcgcggaagaaggttcttctgcaggaaggaaaagcactcccgcagaagaacctttcttccgcggatgccagcggaagatggaagatatggctcttctgcgggagcctccgcggaagaaccttcttccgcgagtacctgttttatag

SEQ ID NO: 82893 - DNA, 740 bp, Glycine max
  Peptide Sequence Number=SeqID_199671
atggttagaacacgaggtctacgtcgtgtggtaggcacaggtagaggcagagaccttagtcaggatgtggctgaggatgttcctcgacgtcgtaggcccactggctcagcacataggcaacgagttacccagagagtcgaggatttggctgaggatgtgcctcatgcgtctgatggtagcccagagaggacaggagccgccgatggtgctgaaacagatcgagtggctagtgatgggataactgctgatgatgagtggttccctggtgggccacgcgatccatctgttttgataggatttgctgatcatgtggcacacaacatatggagtggacaggagcgacctgatctcaagttggtctcccatggtaggaaagtagataaatttgggagaccgactgctgagatcaaaggtatgattgcggccaccggattggatccattgatcaggtgttctgtgatcaccactgatcctagactcatatccgcctttgttgagaggtggcatagggagacgagcagcttccacctcccagtaggggaggtgatgatcactctagacgatgtttcgtcactgctgcacattccgattactagcgcgctgcattcatttgagccgctggttacatctgacgcagtcgccctgttgacggagctacttgaggtcaccgcagacgaggctacagctgagacacgtcaggcaggtgggcctcatgttcggttgtcctggcttcgggacat

SEQ ID NO: 82894 - DNA, 441 bp, Glycine max
  Peptide Sequence Number=SeqID_199672
atgaacaaagctgttattagtctttatggccttttggggctttttgctggtgctattttaagctcatccatttgtgggactcccaagaattttaaagcagagaataattgcattccaaggggaaaaattgaaacatcactcaacaacagcacaataccaaaaaccatttacaatggcttcctcattcttgcaatcaagtttgtgcactacctaatctcgaggggatacaacaagtcatctgcaccttatacaacgatcgtgccattttgggtgaggcgtccattgaaaggaaggtcaactgcaacttgtttctattcgtggcttattcatggtcaactacaacttcaactacagcatggagaggcttcttcaaaatcatgccatttatcagggaacattcaagaagttgagtctaatcaatacaggataaagaaaatataa

SEQ ID NO: 82895 - DNA, 426 bp, Glycine max
  Peptide Sequence Number=SeqID_199673
atggcaagtggaagctacgcatggggagatgctgcactgtgttggatctacaagcactttccttctattgttttttctattgctgtcgaagattatcatgaaaggaaaccatgtgcgagtctttggaagtctgggaaggcatcactagtgtcgacgtatcacaagcgtttggatagattgacgtctgatgcttgttcaacagactacatggagtggttctacatgatatctcatcccttcatgagtctggcacagctaggggatcctcctagacacccgcccattgatgcacatgttgatgcttaccaagctatagaggaaaggttagaaaggttgctcaacctaaggatagtgactgaagggacaaaagcatacactatcaccgaagactacctaagaatcgcaagaggagttactgcgcaatga

SEQ ID NO: 82896 - DNA, 192 bp, Glycine max
  Peptide Sequence Number=SeqID_199674
atggggtccatctattgtcatacaccgaccggggagggttgtacgacagtttggtgttcaacagactacatggagtggttctacatgatatgtcatcccttcatgagtctggcacagctaggggatcctcctagacacccgcccgttgatgcacatgttgatgtagaccagcttcgacatgcagtggtataa

SEQ ID NO: 82897 - DNA, 1536 bp, Glycine max
  Peptide Sequence Number=SeqID_199675
atggcaggaggagcttatgtagattcgggaaatgcaaagcaatttgatgggaaggtcacggcattcgtattggttacatgctttgtggcagccatgggaggcttactcttcggttatgatcttggaataaccggaggagtgacttctatggaaccatttctcatcaaattctttcccggtgtttataaacaaatgcaagatgatgttggccatagaagccaatattgcaaatttgacaacgagctccttacactcttcacctcttccttgtatcttgctgcattagtagcttctttctttgcttccaccactacaaggatgatgggacgcaaggcctccatgttcttaggaggcttgtttttccttgtgggggcattattaaacggcttcgccgtcaacattgaaatgctgatcataggccgcctcttgcttggtttcggtgtcggatactgtaatcagtccgttccggtgtatttgtccgaaatggctcctgcaaagattagaggagcacttaacatgggcttccaaatgatgatcacaattggcatcttaattgcaaatcttatcaactatggaacttccaaactagaaaacggatggagaatttctttgggtgtcggagctgttcctgccgtcttgttatgttttggagctcttttcttaggagacacacctaattccctgattgaaagaggtcaaaaggaagaagccaggaaaatgttgcaaaaaatccgtggcattgataatgttgaagaggagctacaagagcttgttcttgcaagtgagtcagctaaagaggtggagcacccatggaagaacattacaacgccaaaatacaggcctcagctcactttttgcaccttgattccatttttccaacaactcactggcattaacgttgtcatgttctatgcccctgtccttttcaagactttgggctttggcaacgatgcttcccttatgtcttcagttatcaccggaggtgtaaatgtggttgccactcttgtttccatcttgactgtggacaaggttggaagaaaagttttattccttgaaggtggtgttcaaatgttgatttgccagattgctactggagtcatgattgctatgaagttcggggtgagtggcgaaggctcgttttcctccggagaagccaaccttattttgttctttatatgtgcatttgttgctgcatttgcatggtcttggggtccactagggtggttggtgcctagtgaaatatgccctcttgaggttcgttcagcaggtcaagccatcaatgttgccgtaaacatgctgttcacttttgcgattgctcaagttttcctagtcatgctttgccacttgaagtttggccttttcttcttctttgctgcatttgtactcatcatgaccatcttcattgccatgttgttgcctgagacaaagaacatccccattgaagaaatgcatacagtctggagatcacattggttttggtcaaagattgttccacatgctgatgatgatcgcaagcctgaggctgcccaaagttga

SEQ ID NO: 82898 - DNA, 615 bp, Glycine max
  Peptide Sequence Number=SeqID_199676
atggcggcagaaaagggtgtagagatggtggcattggagtgtttgggaaaagggttcaatttggccagcaatttttggttgaagttcgcaaagggaatttgtgaagagaggttggtggtgcttgatgaacagaacaagagggatattttgattcctggaactggaggagttaccattaaaggggtttctgagaatattcgttgtgataaaggggattacgacgtcgtttccctctgttgccacattgacgaccaccaccctgtccaagccaaaatcggggtgtgtcccatttgtgggaagaaggtgggattggatctcgttggacatattactatgcaacatgggaacttcttgagggtgcagcgtaaaaggagggtcaagaaagtaggctctggttcaacaatgtctatattgagaaaagagttacgagaaggagccttgcagtcccttcttggaggttcttcatacttagcttcctccaattctgagcctgatcctctgttatcatctttcatgtttaacccagctgtaactgatgattctgcgagtgcaaaacctccttctgttgaagatactctagtaaaagaaagcctatttagggttagggatttgtaa

SEQ ID NO: 82899 - DNA, 366 bp, Glycine max
  Peptide Sequence Number=SeqID_199677
atggatgcatatggaaaaagtggagacttcgacagtgctgttcattggtttaaggaaatggagtctaatggaattcctcctgatcagaaagctaaaaatgttcttctatctttagcaaaaacagatgaagaaagggaagaggctaatgagctcgtagtgcatttcagtgaaaatagcagtttacctaaagttaatggcattgttaaacttgttgacgaagatgaagaagaagataattatgaatattttgatgcccagctcgcaagggcttatgaacattctacagagcattatattatcaagcaattgaaagtatttaacttagacataatatactccaaatatgggagtcatattggaaagtaa

SEQ ID NO: 82900 - DNA, 2466 bp, Glycine max
  Peptide Sequence Number=SeqID_199678
atggcactgaggacaccacagaaactcaaactccgtcctcttcctcttttctctgtcttcagcaaactccctctttccacaacgccccataacaataataataatcactccgatgcttcggttgccgacatcctcgtctcggtcttcaccgaacaacccaacgccgacaccccggaactgaactgcttcgcccccattctcacccctccccttgtcgagtccgtcctcacgcgcctccgcacgtggaaactcgcccactccttcttccactgggcatccaaccaaggcttccgccacacctgctacacctacaactccatcgcctccatcctctcacgctcccaccagacctctcctctcaaaaccctcctcaaacaaatctcagactccgccccttgttccttcacccccggcgcattgggcttcctcattcgctgtttgggccacgcgggcctcgcgcgagaggcccaccacctgttcgatgaaatgcgactgaagggtctctgcgttcccaatgattactgctacaactgcttgttggaggctttgtccaagtccggcgaggttgatttgatagaggccaggttggaggagatgaaggggtttggttgggagtttgataagttcacgctcacccctttgttgcaggcttattgcaatgctcgcaggtttgatgaggctctgagggtttataatgtgatgagggaaaagggttgggttgatggacatgtttgctctatgttggcgttgtcgttttccaagtggggtgatgtggataaggcctttgagttggtggagaggatggagggacatgggatgaggctaaatgagaagactttttgtgttttgattcatgggtttgtcaaggagggtcgggttgatagggcccttcagttgtttgatataatgtgtcgggttggttttactcctcctgtttccttgtttgatgttctcattggcggattgtgcaggaatggtgacagtcatagagctctgagtttgctttcggagatgaaggagtttggggttacgccggatgttggaatctttactaagttgatatcggcttttccggacagaggtgtgattgccaagttgttggaagaggttccgggaggggaagaggagcgaactcttgttttgatttacaatgctgtcttgacttgttatgttaatgatgggttgatggatgaagcctgtcgctttcttcggatgatgattcagagcaaagccagtggtgatgtccagatggatggtttcttcaacaaggtcaagaaattggtttttccaaatggtgcttcatttagcattgtgattaatggcttgctaaaaaatgatcagttggaccttgccctgagtctcttcaatgatatgaaacaatttgttgatagaccaagcgttttgatttacaacaatctgattaatagtctatgtgattctaatagattggaggaaagccgtgagctcttgagagaaatgaaagaatcaggagttgaaccaactcatttcacttacaactcgatatacggatgcctgtgtaaaagaaaggatgttttaggggcaattgatatgttgaaggggatgcgtgcttgcgggcatgaaccatggataaaaaattccactcttcttgtgaaagaactatgcgatcatggaatggccatagaagcatgtaattttctcgacagcatggttcaacaaggtttccttcctgatatagtttcctattctgcagcaatagggggcttgatccagattcaagaactgaatcgagctttgcaattgttcagtgatttgtattctcgaggccattgtcctgatgtggttgcttctaacatattgatgagagggctctgcaaggcctacagagtcagagaagctgaaaaattgttggacgagattgttgtgaagggtttctttccctcagttgtgacttacaatctgcttatagatagttggtgcaagaatggttctgttgataaggctatggcacttctttccagaatgtctggagaagacagggagcccaatgttattacttactcgactttggtggatgggttctgcagagcagaaaggcctgatgatgcactcttggtttggaatgagatggaaagaaaaggttgttttccaaatcagattgcttttatggcacttatttatggtctttgcaaatgctgtaggcctactacagcactccattatttgcgtgagatggaacagaaagatatgaaaccggactcgttcatttatattgcattgataagttcttttctatctgatatggatttggcctccgcatttgagatttttaaggagatggtttattcaggatatttcccagaatcccatgataaaaattactccattgtaatggatgcaattgacaaattttccaaggatcacagaacatcctctggtatacaagttttgatggaagagggaaaacttcctacacattgtccgtga

SEQ ID NO: 82901 - DNA, 474 bp, Glycine max
  Peptide Sequence Number=SeqID_199679
atggggttggctgctcctcgctgcgacaacaatattgacaactatgccctaaaaagctctacatctttagcagaacaaagggtggtaaaaaagaatgagtcttgcaagctgccacttagaagccttactcttggcacaatggcaaggctgttgccttgggatgcttgggaggatgttgatccagatgaactttcatatgaggaattactggcattgggtgaagcagttggaactgagagcagaggtctttcaactgatactattgcctgtttgccttcagtcaactacaagactgggagtgatcaacatggaagcaatgattcgtgtgtcatttgccgggtggactatgaggatgatgagtccttgacagttctttcctgcaaacatctgtaccatcctgagtgcattaacaattggttgaaaataaacaaggaggaagctttagccttaaagaaatatttgatcacaagttaa

SEQ ID NO: 82902 - DNA, 774 bp, Glycine max
  Peptide Sequence Number=SeqID_199680
atgaggaagcccaatgcgccgggggtgaaggaacaaggggcggagtctgagatttgtttgaggagggttttgagaggagaggatggaggcgatggagttgtaggtgtagcaggtgtggcggaagccttggttggatgcccagtggaagaaggagtgggcgagtttccacgtgcggaggcgcgtgaggacggactcgacaaggggaggggtgagaatgggggcgaagcagttcagttccggggtgtcggcgttgggttgttcggtgaagaccgagacgaggatgtcggcaaccgaagcatcggagtgattattattattgttatggggcgttgtggaaagagggagtttgctgaagacagagaaaagaggaagaggacggagtttgagtttctgtggtgtcctcagtgccatcagtcacacttggacgacgacgacaacaactacaactgtttagacatgagcgaacgtggatattccctcatccttgtctataactacctaatggctaattggcttgaaaatattggttattccgagtgcccgcgtctgcatcaacctcgtcctctgtttctctcactcactcctgtggtgacatgcggtgcggctgtgacggagatcaacgagacccaattcaaagacacggttctgaaggctaaccgtccggttcttgttgagttcgtcgctacttggtgcggtccttgccgtctcatctccccctctatggaatccctcgctaagggctggcttaaggcccacgtaagggctttaggttaa

SEQ ID NO: 82903 - DNA, 981 bp, Glycine max
  Peptide Sequence Number=SeqID_199681
atgactatgaacgaatatctcatcttagaagttggtctggaagaacacatgaaacacaaactggaggttcacataatatgtctccttttcctcagtgctattcttggaataacaattcctcaatacttatttcttcttggacttgaatatacgtctgccacattctcatgtgcgttcctcaacatggtgcctgtatttacgttcattatggcagtgccatttggggtagagaaggtgaacatgcaaagcaagagtggtaaagccaaagtcatgggaactttggtgtgcattggtggagctttgttattggtcctttataaaggaatgccccttatcaacccacaatctcaacacatagcaaacaaaattacaagcacgcttccagctgccaagttagagaaatggattgtaggctccatacttctgactctaggttgcctcctgtggtcttcatggttcattatacaagcaaagattagcaaaaaatacccatgtcaatactctagtacagctattttgtcactttttgctgccattcaatcagcgacattaactttggtcttcaagagaaataatgcttcgtggattctcaaaggaaagcttgaaataatgagtgttgcatatgctggattgataggatcgggcttatgctatgtggcaatgtcatggtgtgttaaacaaaggggtccagtttttacagcagcttttaccccccttatgcagatatttgtggccacgcttgatttctctgtactaaaggaggaaatttacctgggaaggttggtttctttaatcactttcatgattccaccctttctacattccaccgcacctaatgtatctctatctgcaataagcagtttggcaggatctgccttggttattgctggcgtgtatattcttctatggggaaaaagcaaagaggaagggcaacatgttctgaaggatacacaaacaaatcaagatgtagaatgtcaatag

SEQ ID NO: 82904 - DNA, 618 bp, Glycine max
  Peptide Sequence Number=SeqID_199682
atggagaacgacactgccgccgccgttaacaataacaccaccgccaccgccaccgctaaagcaggttctggaggagtgaaatcgaacaaccataacctagaagaggagcattccaatttgaatggcgaggagcacatggcagaacaagtggaggcagaagaagaggaagatcgagaagccgatgatggtgaaggagaacaaactggatctcgtcaaccttccagaacccctttcactaatctcagccaggtcgatgctgacctcgctctcgctcgaacccttcaggaacagctgcccaaggacatgcagataccaggcgttgatatccctgacccacgttgttggcctttcacaaacagctgtgaaagggcatatatgatgctgagaatgaataatgaaggaagtgattatggaagttgggaaggcggaagctatttgcatgatgaaggagatgattttgatgatctacatgatggcactgatgtggatgaggatgaagatgatgatgatgatgaagatgatgatgatgaggaggatgaggatgaagatgcatttgatgtccatgctcatgctagtgctggagaacatgataatcccactattgaatttgacccagat

SEQ ID NO: 82905 - DNA, 1647 bp, Glycine max
  Peptide Sequence Number=SeqID_199683
atgcttggtgtctcattggcgtgtaaaattactaacataagccataatctactcagcctccttgataaatgtaaatcaattcttgaactgaagcaactgcatgctgttgtgatctcctgtggcttatctcaagatgacccatttatatccaaaattctttgtttttctgctctgtccaattcaggcgacattaactattcctacagggtattctcccagctttccagtccaacaatttttagctggaatacaatcataagaggatactcaaacagcaaaaatccaatccaatccctatccatttttctaaagatgctgcgacttggggttgcaccagattatcttacatacccatttcttgtgaaggcatcagcgcgccttttaaaccaggaaactggtgtatctgtgcatgcccacattataaaaactgggcatgaatctgataggtttatccagaattctttgattcacatgtatgctgcttgcgggaatagtatgtgggctcaaaaggtatttgatagtatacagcaaaaaaatgtggtttcatggaattccatgttggatggttatgctaagtgtggagaaatggttatggctcaaaaagcttttgagtccatgtcagaaaaggatgttcggtcgtggagctctttgattgatggttatgttaaggctggggaatacagtgaagctatggccatctttgaaaagatgcagtctgctgggcctaaagccaatgaagtaaccatggtgagtgtctcatgtgcctgtgcacacatgggtgctttagaaaaggggagaatgatatacaagtacatagttgacaatggactgccactgacattggtcttgcagacttctcttgtggacatgtatgccaaatgtggggcaatagaggaggctttgcttatattccgccgtgtctctaagagtcaaactgacgtgttgatttggaatgcagtgattggaggtcttgcaacacatggattggttgaagaatcccttaaattgtttaaggaaatgcaaatagttggtatctgtcctgatgaggtcacatacttgtgcttgttggctgcctgtgcccatggagggttagttaaagaagcatggttcttctttgagagtcttagtaaatgtggcatgacacctacaagtgagcactatgcttgcatggtagatgtgctggcacgtgcaggtcagttaaccactgcataccaatttatttgtcaaatgcccacagaaccaacagcttccatgttaggtgcccttcttagtgggtgtattaaccatagaaatttagctcttgcagaaatagttggcaggaagcttattgagctagaaccaaatcatgatggtagatatattggcttatcaaatatgtatgcggttgacaaacgctgggatgatgcgagaagcatgagagaagctatggagagaagaggggttaaaaaatcacctgggtttagttttgttgaaatatctggagtccttcatagatttattgctcatgataaaacacatcctgattcagaggaaacttattttatgctaaattttgttgtctatcaaatgaaacttagctgtcacgaagacaatcaggaaagatcgctgaatgatacatcaatggaagatgacttgcttctcttttga

SEQ ID NO: 82906 - DNA, 234 bp, Glycine max
  Peptide Sequence Number=SeqID_199684
atggttactcttaaagataatgataatgaaatgtcaaggaggctgaagaaggtacttgagaaattcagaagtactgactgtgcatattaccaattgtgccaccttgtgaggcaaggcgaacaccccaaagaaggattctttcttctttcaaacttgtttgaggaccagatgggtgctaatattgggtatgctgattggatgctacagatttcccgacaagtgcagcaagcataa

SEQ ID NO: 82907 - DNA, 393 bp, Glycine max
  Peptide Sequence Number=SeqID_199685
atggtgcggcctcctatgcttccagtatatttcttcctcattgatgtttccataactgcagttagaagtgtaatggttgagcctgcaagcactgagaacaacaactactgtatacctgcaaatcagtccttgcttccaaatgccgccattacagacccacatgcacaacagaagaaggaaagaagaggtggaattagaccattgggagaaagcacacatctggatgacatatttgttcccctgccagattatctccttgtgaacttatcagaatcaagaagtgtggtggaaacctttcttgatagtctgccatccatgttccaggacaaagtgaatctggaatctgctttcggtcctgctctcaaggctgcctttatgattatggtatgctag

SEQ ID NO: 82908 - DNA, 2598 bp, Glycine max
  Peptide Sequence Number=SeqID_199686
atgtgtcctgaggcctttgctggtatgccttatggttataaatctgatatgtggtcacttggttgctgcatgtttgaaattgttgcacatcaaccggcgtttcgtgctccagacagggctggacttatcaataaaataaatagatcctccatttctccactgccaattgtttactcttccacactgaaacaacttatcaagagcatgctgaggaaaaacccagaacatagaccgacggcatctgaattattaaagaatcctcatttacaaccatatgttctacgctgtcgtaatgcatcatctatttttctaccagtacatcttataaatagtaactcaaaggataaaacaaaaaacaaatctagcggtagcaaagaccattgggacaaggaggcagaattggcgggattagtaaatcgtttggatcaactttatccattagagggaaatggagatgtacagatacgaaactggcataatgatggcaagctagcagtgtcaaccattacagaagacaaccttgagactaaaatggttgatttgaccagctatactgcagagttttctactagtattagtggctcaaaagatggatcaacaacatctgaatcaactgtttatagtgtgtgcaaggaaggagactttaaaaatagacttacaagggactcggctgactgtgagatcacttcaaagagtacaatggattctgtgcatgaagatcaaggacttgatggtcataagtcatacgcaattgacataaatatggtgattaataaagttgaagatactttatccaatgaagatttcaatacagatgaagcacttagtgaaggtgccaaacctgaggactccagtaaatcaataatgtccagtgaagacagcaacggtaatgataaagatgagttcattgatgagatcacttcaaagggtactctagattctgtgcatgaaaaacaaggatttacagctgaacattttcagaactcagatgtcattgacacaagtgcagtgtctacaaaagttgaagataattttttcaatgaagatagaacagaagcagagagggaaaatgccaaacctgaggactccagaaagtcaatagtgtccagtgaaaacagcggtggtaatgataatgatgggtccattaatgagatcacttctaagagtatgctagattctgtgcatgaagaacaaggatttacagctgaacattttccgaagtcagatgtgattgacacaaatgcagtggctactaaagttgaggataatttttccaatgaaggttttgaccaaactgaaacagagagggaaaatgccaaaccagatgactcccgaaaatcagtagtgtctagtgaaaacagtgatggtaatgataacgatgggtccattgatgagaagacatcaaagagtacgcttgattctgtgcatgaagaacaaggatttaccgctgaacattttctgaactcagatgtgattgacacaaatgcagtggcttcaaaagtccaagataatttttccaatgaaggttttgaccaaactgaaacagagagggaaaatgccaaacctgatgactccagagaatcaatagtgtccagtgaaaacagtgacgggaatgataaggatgggtccgttgatgagaccacattaaagagtacactcgattctgtgcatgaagagcaaggttttatagctgaacatgttcaaatgttagatgttgaaatagatgcagcggcttcaaaagttgaagacaaattttctaatgacggatttgataaagctgaagcacagagggaagatgccaaacttgagagctctagtaaatcaataatttcctgtaaaaacagcaatggtaatgatgaagatggatctggttatgagatcacatctaacagtatgctagattctgtaggtgaagaaaaaagactttctgctgaatactttcagaagtctgatgcaattgacataaatgcagagactacagaagttgaagataaactttccaaagaaggctttgatagagctgtaacacaagagaaagatgataaacctgaggactccaataactcattgtctagtgaagacagcaacagcaacgataaagatgggtccattgatgaggaaaggtcatcaccaattgcacatgctgttaaggttgagcatgacactgacactggaaacaggttgaaggaaaataaaaaccctgaagcatttacggaaggctcacacatggacagcttggcttgtgagagtaatgaaacgcgtccgggtaaggatgaaggacaagcagatacacgcacaatcagttgttcaatgcataaagaagttgataatgctgtcatggctgataagacaccaaatggcgttccatcaaggacacacatatcaagaggtggtgataatacttgccatcaaagagctgatgctctggaatctctgctcgagttatgcgcacagttacttcagcaaggacagcttgaagagcttgctgctgtgctaagaccatttggagaagatgctgtatctgtatcatccagagaaacagcaatatggcttacaaaaagcctcatggcctcacaaaaacttcatcctgagacatag

SEQ ID NO: 82909 - DNA, 1023 bp, Glycine max
  Peptide Sequence Number=SeqID_199687
atgtttttcctgtatggatatggaggtattgggaagacctttatgtggaagacattagcctctgcattacattcaaaaggtgatattgttttaactattgcctcaagtggtatagcctcattgttattacccaatgggagaaatgcacatttgaaatttgctattcctatgcctacattagacaactccacatgtaatatccaccaaggctattttaggaaaattattcccgtcatacctagaggaagtagatcaaacatagtgcatgccactataaatgctttgtatctatgggactattgcacagttttaaagctgacgaaaaaattgtgtttgcaccccaactcaacaatgagaaatgcacaagaaataaaaacattttctcagtggttgatagatgttggtgatgggaaactaggcaaagcgattgtcaaccatacatacccagatatccaacagatgtataaggatgaggactttctcaagtctagagctatactagcttcaacaaatgagatcatagaccaaattaatgagtatgtattaaacatcatcctaggtgaagagagagaatatttcatctgtgattcaattgacatgacagatgttgtaaatttggatcaagcagaaggcctatgccacgggataaggctaattgtctctagaatgaccaatcatgttattgaagcacaaataatttatggaggaaatataggaagtttggtttatattccacgaatgtcattatcaccatctcaatctccttggcttttcaatatgactagaagacaattcccatttatagtgtcatatgccatgacaatcaataaatctcaaggacaatctcttgaatctattggattatatcttcctcaaccagttttcagtcatggtcagctttatgtcgcattcttaagagttcaaagcaagaatggattgaaaatccttattcgtgataaaaaaggaaaaccacaaaatataacaaccaacgtggtttacaaggaagtacttcaaaatctgtag

SEQ ID NO: 82910 - DNA, 399 bp, Glycine max
  Peptide Sequence Number=SeqID_199688
attcttccatctagaattggaaaaagtggggtcttatttctaattggtttgtttgctgcagtggccactccaaagcagattagagaactgatgcaggtggtaggcctcacaaatgatgaagtgaaaagccatttgcaaaagtacaggcttcattttaaaagacctcaaggttcttcaattggccatgctaacagtggcttatgcaagatggcacaagataaatgtggagacgataaatctggctctccacaaggtccactcttcctaggagggtctggaaaaggtctttcaagctctggacgcaatagcatggacacagaaggagatgaggaatcagattgccgcaattggaaaggtgggattcatcaccaattgcaaccagaaagtgacgttttgtga

SEQ ID NO: 82911 - DNA, 276 bp, Glycine max
  Peptide Sequence Number=SeqID_199689
atggtgtatgattttacactatttgatgatgttcttgctggtagtgtcaatcctaactacttaatagatgttatccgggagttagttgatgtattccaatggagcttagatggaaaacccaaaaaggtggtgttcaccatgaaggataagtgtggcaccattgtcagttgtactctatgggaggattttgcattcctgctgaaagattatttggacaaacatgaaaatgaatcagttatacttctgcttcatttggcaaaaattaaggaagcataa

SEQ ID NO: 82912 - DNA, 156 bp, Glycine max
  Peptide Sequence Number=SeqID_199690
atggagactacatgcaaggaatcactggccagagcacaggatgagtctaccaagatatctgaaactatcacaaatgctaaatctaaagtgagacacttcgataattgctctctggtggatggcttcttccatggtaatgattttaggatagtttaa

SEQ ID NO: 82913 - DNA, 3990 bp, Glycine max
  Peptide Sequence Number=SeqID_199691
atggaattggcgttggcattggagtgggacgatcaagtgcgggaaggcgttctaaagaagctaaagctctggcaacaacgcaacaacaaacccccaacggcatgggtcacagagctagtggagcatttcaacacactgggcattgccctaccctgccccgagttaggggaacttctagtgtcccaaatatgcttcgacaacaaccaccctttgatctggaagttcatccaccacgctctctcctcgcgcctcctcttccctctccaaatactctctcttctctcctccaacgtccttcgccaccgccactcccaccctcacgccttcgccctcttcctccctctcctcgcgcaacacgccttctccttcctccctaccctctccaacaacctcaagatggtgaattctgtggatgctgtgatgcgattttcggagacttataagatacgcgatctggagctggggcacgtgtttgtgctgttcttttacgatattgttgtggcgttgattgattgcgtgttgattgattgggggtttcaggtgacgtttagtgagaaatcgcgtttggttactggaggaggtggtggtgatgatgaggaggattatatggaaattgatcggaatatgacgacgatgacacagagttttgagaaaagtgaacagataaggaagcggaattcattcaccgccttagaggtattggaaagactaaccgaaagcagaaaggctactattttgctccagtctgttctcttgaacatgcctgaaaaattcaattgcctccagcagaggctccaatttcttgaatcccttgagttggcctcatcagagttaaaatcagtaaaccaagtcctaacaaaagtgtctgcaagcattcgtggagtttctcgttttgattactgcctaaggaagcatcagctggttgggatgcttaaggcatcattgagatgcaactatagattttgtcagtctccttgttgggttccttttgatatttatatggagaatgctatggattctagacaaattcctaccaaatcagctattgatgtgcttacagaagcaatcaagacacttcaaatactaaaccaggctagctggcaagaaacttttctagcactttggctttcagcccttcggcttgtgcagcgagttgagactggccctattccccatcttgtggcccgtctatgtgtacttttatgcattgtccccttggcaattgcaaatgttctaagggatgactctgaacataattcgtcatctgttcaggtgtctatggaatcagaatacaggcatgaaatgaaaagtggtagttctatgaaacttggactgatttcatctgttcaggtccttggacacttttctggcctcctatgccctcctacattagttattgatgcagccaaccaggcagctagaaaagcagcaagcttcatttataatactatgaatggaaagggtgaatctggcactggaattcatgctaataccaatacaaaagcaggcgggaacttgaggcatctcatagtggaagcttgcatagctaggaatttaatggatacatcagtgtacttctggcctggttatgtctctacatctgttttgtctttgtcagattcgtcaccactagaaaaatctccatggtcaatatttatggaaggaacgccattaaacaatacccttataaattctcttacagtgacccctgcctcaagcctggtggagatagagaagttatactatattgcattaaatggatcagatgtggaaaggccagcagctgcaaagattctatgtggtgcatccctcagccatggatggtatattcaggaacatgtggtccaccatgtggtcaagcttcttgcttctccggtacctcctagtcattctggatctcagagccctttggttaataatatgcccatgctgtgtgctgtcctccgtggcacttcctctatcgatactattcatatactttctttatatggtgtagtccccgcagttgctgcttctttattaccactttgtgagacatttggctcaattaaaccgacttcaaatagcactggcgatgagtcctcctcaacatcgacatcaacatcaacatacatgaccttttctttagcctttcttttccttattcgtttatggaaattctgtagaccccctcttgacctgtgcatcacagaattaggagttgcagttggaggtttggagtatattttgtcattgcacaataatcgtgccatgttttcccaagataaactgaaaagcaatccaagtctctctgattctgcatctgttaaacctgtatatattgattcatttccaaaattacgggccttgtattgtcaatacaaatcttgtgttgcttctgccctttctggcatttctactggaaattccattcatcaaactgctaatatgattttaagcatgatttaccagaagataaccaaaggtggaatttcatcaagtaattcttcatcaccgactactgctagcagtaacgcgtgtagttctctcatgaattctggtgaagataattttcaaagacccttgcttcctgcatgggaagtactggaagctcttccttttgtccttgaatcaattttaactgcttgtgttcacgggaggatttcatcacgagaattgaccacaggtctgagagaccttgttgattttcttccagcatcgcttgctgccattattgattacttttcttcagaagttactcgtggtgtatggaaactagttccaatgaatggaacagattggcctagtccagcagcacttattcaatcaattgaatcagaaataaaagctatattaactcatgttggcgttgaggttccaaaccgttcttctggtggttcaccggtaatgcttcctctaccaatggcagctctggtcagtttatccattacttttaaacttgacaagagccaggagtacatgcatgctattaccggagcagctttggaaaattgtgcatcaggttgcccttggcctagtatgcctgtaattggctctctgtgggcccaaaaggttcgtcgctggcacaacttcattgttgtatcaggttcccgttctgtgtttagacacagcaatgagtgtgtagctcagctgttgagaagttgtttcacctcattccttggaacattgtgtgtttcaacctcaaaactgactgctgagtgtaatgtgaatggcctgttgggtagcaccattactgcccctggtccctatccttttgtcgctcctggattcctttttcttcgatcttgtcgaaatatacacaatgtgcagtatgtaaacgatataattgtgggtcttgtgacagagtactctaatgaattagccggtagacggacgggtgccagctctcgccacataaaatccaatgaagtatcactatccctttccgctcaaagtgcaaaagaggtggctacacttggtgcaagtcttctatgtgcagcaggtgggatactactggtccaggaattgtataaggaaactattcctacctggctgctgtcgtcaagggatgtgaagcaaaacaatgatagtgttgggtcatatatacttgagggttatgctatggcatatctgttgatattgtctgggtcaatcatatggggtgtcgggaccaagttaccatcagggacattcaatagaaggaaacgtaccattgaggtccatttggacttcttggcagaagtcatggagaaaaaaatctcactcagttgcaatccaattacatggaaaacctatgtctgctgtttggtgggattgatggttagtcttgcaccagcatgggttcaagaagtgaaggtggatactttgaggaaattggcgcgcggattaagcagatggaatgaacatgaactggcactctctctgctacatagagggggcacagcagctatgggagctcttgctgaacttgtcaatgtgattgagtctgaacatatgctgccgtgctcataa

SEQ ID NO: 82914 - DNA, 1476 bp, Glycine max
  Peptide Sequence Number=SeqID_199692
atggaaggaaggaggcgtggaggttatagtggtcgacgcatagttgcaagcagaagagggagtggcaaaagcaatgccaacaacaacaacaacaacaacaacaaaaacaacaacaacatcaatgtcatcaagaagcttcagagccgcgaaatttggtcgaagcctcatcgagcttttgcttctgtcactgcttctcacagattccgctctatgtgcttgacgcaccaatacgacactcatgatccctccaagactccctcttccctttggcccttcttgatgaagagaactaaggttgtcgaaattgtggctgcaaaaaacgtggtctttgctctttaccattctgaaaccatgaaattgggttttgtgtgtgaattccaagcagaaactgatgagaggatttgctttttgaatgtttgccctgatgaaatcattcggagcctcttctacaataagaacaacgactcgctcattacagtatctgtttatgcttctgagaacttcagctctttgaaatgcagatacctacgaagggggaagccggatgctgggtttcctcttttccaatctgaatctttgaaatggcctggatttgttgagtttgatgatgtcaatggaaaggtcctaacttattctgcacaagattggtaccttcctcattttcttgtctttctgttccacttctactgttatgtctttgatcttaagaactacaccatgctatactcgattttagataggaatgttcaagaaatcaagatcagccctggcatcatgttattaatttacaatagaaccagcggtcatattcccctaaagattatatccattgaagatggcacagttctcaaagtgttcaaccatctacttcatcggaataagaaggtggacttcatagagcaatttaatgaaaagcttctagtcaagcaagaaaatgagaaccttcagattcttgatgttcacaattctgagctgatggaggtaagcaggacggagttcatgactccatcagcatttatctttctatacgataatcaattgttccttactttcagaaatcgaacagtttctgtttggaacttccacggggagcttgttacttcatttgaggatcaccagttgtggcacccagactgcaacacgaacaacatatacataacaagtgatcaggatctcattatgtcttactgcaaggcagattctgatgatcaatggattgaaggcactgctggatccattaatgtcagcaatatcttgaccgggaaatgtgtggcgaaaataattgcaacaagtagcagtgccaaggcagacgagtgcagcagtagtggttgcagctgcaagcaaagtgattcatgcctaatgaggaattcagttgcggaggctttggaggacatcactgccctcttttatgaggaagacagaaatgagatctatacggggaacaggcatggtcttgttcatgtatggtcaaactaa

SEQ ID NO: 82915 - DNA, 1176 bp, Glycine max
  Peptide Sequence Number=SeqID_199693
atgtacaagtcaaagtggctgagccaaagagtggagatggacgttgaaggtcagtggcagatttcacagagagagatatgctggtcaatgatgttcatagcttcatggagcatcattgtattattatatgtgaaactgtggtatagatctcaaaggatcagatcagtgcttcagaaacaaggcatcaatggaccaaaaccttctttcccctttggcaacctttctgagatgcaacagctcaaccaaggtgctcctgtttctcttgaagccttagacaaatgggctttttccctctacccctttttccatacatggaggcaacgctatggtccagtgttcatgtactccactggaaccaaacaacatctatatgtggaaatacccgaattaatgaaatggataggtctgaacacatccttggacctgggccggccatcgcatctaacaaaaacattgaagcccttgctgggtgatggcatcatcatgtctaatggactacattgggccttccaaaggaatttgcttgttcctgagtttttccagagcaaaattaagaattgggtggatataatgggagaatcaaccatggcaattatcaaaaaatgggagagccatataacagaaagtgaaggggggattacagagctggtgattgatggagatatgaagactcttacagcggatgtcatttccaaagtttgttttggcacctcttatgctctaggaaatttaatttttgcaaaactggcctccatgcaagctatactagcaaagtctagtgttctatttggatttctaaacctaaggtttcttcccaccaaggaaaacaaagagctgtggaagttgcagaaagaggtggaaacgatgatactaaaagtgatcaaagaccgtgaaggagaaaaccaaaagagtggcacacatgagaatgaaaaggatctattacaaataatactagaaggtgctgccaatgccaccactggtactagtggaaagggctatgagagtagtgctcttgcaattatttggacactgctgctacttgccttacaccctgagtggcaacaacgaattagatcagagattatggagacctatgataacacggtgcctcattcctttcttgacatggacaaacttcgaaacttgaaagcagttagtacaacactccttttctga

SEQ ID NO: 82916 - DNA, 708 bp, Glycine max
  Peptide Sequence Number=SeqID_199694
atgtattatgtgtatgaggctgagctctggcgcaacagtaaatttgtgccttgtgactggttggtcatgggttcaaatttaaaaacagtctctttgcatagatccacactaggcacaatgaagaagggatctggctgcaaaggaagcattgtgtgcctgatggtaacattatgtgtagtgattgcacttgtattgctaggagtgatcttagcaatgacagtgttcaaacctaggcaccctattaccaatgtggattccgtaaggcttcaaaacatgagcttggacatggacatatttagcatgagtgtaaatgtgaacttgacattggaagtggatgtttctgttaacaaccctaataagcttggattcaattactacaatagctatgctcaactcaattatagaggacagttgattggggaagcccctatacccaatggacacatattagctgaggagattaagggactcaactcgacactaactgttatggctgaccgtttggtctcaaattctgaggtgaccaaggatgttgcattgggtttattgcccctcaacagcttggtgagaatttttggccaagtcaacgttttagggtttatcaaattctatgtggcttccacctcatcttgtgatttcaccctcaatctttccaatagaacaatagtggacaataagtgccaagagaagacaaagatttcgggttga

SEQ ID NO: 82917 - DNA, 1224 bp, Glycine max
  Peptide Sequence Number=SeqID_199695
atggaagctgagggtcaatggcagatttcagagagagagatatgctggtcagtggtgttcattgcaacatgcagcatcataatattattatatgtgaagctgtggtatagacctcaaaggatcagatcagtgcttcagaaacaaggcatcaatggaccaaaaccttctttcccctttggcaacatttctgagatgcaacagctacccaatcaattagctcctgtttctcttgaagccttagacgaatgggcttattccatcttcccatatttccatacatggaggcaactatatggtccaatgttcatgtactccactggaaccaatgagcatctatatgtggagacacccgaattagtaaaatggataggcatgcacaagtccttgcacctaggccggccatcgtatctaaccaaaacattgaagcctttgctggggaatggcatcattaggtctaatggactgcactgggcattccaaaggaatctacttgctcctgagttttttcatagcaaaattaagaattgggtggatataatggaagaatcaaccatggcaattaacaaaaaatgggagaaccatataacagaaagtgaaggggggattgcagagttggtaattgatggagatatgaaggctcttactgcagatgtcatttcaaaggcttgttttggtagcacttatgctcaaggcaatttaatttttgcaaaattggcctctatgcaaacagcactagcaaagcctaatcatatatttggatttctaaacctaagatttcttcccaccaaggaaaacaaagagatatggaagttgcagaaagaggtggaagctatgatactaaaaatgatcaaagagcgtgaagcagaaaaccaaaagagtagcacacatgggaatcaaactcaaaaagatctattacaaataattctagaaggtgctaccagtgccaccagtactgagagtagtggaaagggtatttttgggcctgggtataacatataccagtcgattgtagacatctgcaaaaacatgtactttgcaggctctgagagcactgctcttgcaattacttggacactgtttctatttgcattgcatcctgagtggcaacaacttgttagatctgagattatggagacctacggtaacatgttgcctcattcctttcgtgacatggacagacttcgaaacttgaaagcagttagtacaacaacaccccttttctga

SEQ ID NO: 82918 - DNA, 381 bp, Glycine max
  Peptide Sequence Number=SeqID_199696
atggtaattcaagagagtctacgtctttatggccctgcagttacaaccgcgaggggagtgttggctgagatgaagttaggggaacatgttctgccaaaaggcatcaacatgtggttgtacataccagcattgcaccgtgaccctgataactggggaccagatgctagggagttcaagccagaaaggtttgctggtggtgtttctgcggcctgccaaaactttgctctgctagaaatcaaggaagcactgtgtcttcttctctccaacttctcctttgctgtttcaccaaactatcaccattgccctcagtatagaatgttgttgacgccaaaatatggtatgaggcttcttgttagcaaagttcacaaaaccaggacataa

SEQ ID NO: 82919 - DNA, 261 bp, Glycine max
  Peptide Sequence Number=SeqID_199697
atggttcaggtcgtggcttcacgatccattcaaagcacccctttgtgccctatttctggatttgcacatgacaaaacccaaaacttgttaaagccttcatcttttgcttccaaggtgttccctttggtagagaacaataacaaacactccaaactcaacctcagaagccttcagatcagtgcaaggaaatcttccccttctgaagtcatccccatgtcacccgaagatgatccaaaagttcgtgctttttgcattttttga

SEQ ID NO: 82920 - DNA, 1275 bp, Glycine max
  Peptide Sequence Number=SeqID_199698
atggcttacaggagaaggcaaggtatatccaggtcttccaccttcaaggaagaatttcatgatccatcattggaagatgtacatgttaaggattctaatcatgacaatgcttctccttcaatcttctcatcttcttcttcaacaccagcttcatctcttgctgctcaagccatcaaagccactgcttctcgccatcagccttctctttccttcgcttttgcccccgccgagtctgaccatcaaagatccaagagctttgaggcttacggaaatggcaactccaagtctggtttctggggtgtgattgcccagaaagccaaatcaatattggatgatgataagccaaccccacaacatgacaccatgccccaaacccatacactcaaatcacactcatttaatacctgttcaggtccttctgcagctcagaactccccttcacaattcaagccagtatatgaatccctcgactcgagtagaaaaatggacaatcctaaatttcggaagggcttggataaaatcaccacgtccctcaatcaactaggtgacacttttgagaaggcttttgaggaaggccgaacaattatggagagtaagaaagcagacctgagaactcaaatcaggagaaaaggaaataactctggggacacaaacctgacttcagatatgagaaatccattgcaagaagccacccagacacagaatcagtctagccatgaaacaaaactcaaggcatcacgcgacgtggcaatggcaacagctgccaaagcaaaattacttcttcgcgagctaaaatccgttaaagcagatttggcttttgctaaagcaaggtgtactcaacttgaagaagagaataaagtactccgggaccgagagggcagtgataagggacagaaccgtgaagatgatgatctgataaggcatcaattggagacacttctagctgagaaggctcgtctggcgagtgagaatgagacatattcaagagaaaaccgtttcttgagggaaattgtggagtaccatcagctaactatgcaggatgtggtgtatatagatgagggcatgggagaagtcagcgaagtttaccctgtagatgacagtgggatcacacggttgttatctgtttctccacactcatctgatgaggatgttctggtctcaccaagtccgcctatgctatcaaaagaaatatttactgtgccggaagaagatagtaagagtatatcagaagatgatgctccttctgctgtctcagtttctccacatacaaaatga

SEQ ID NO: 82921 - DNA, 1680 bp, Glycine max
  Peptide Sequence Number=SeqID_199699
atggctgcgaattttgggaatatcttgtttacgtcgtctcagtctagctcacaggttcatggggccactgattctgtccaggttgcagtgtgttctctttgtcaaaaggccctatcacctgataatgagatggcaagcgatcttgctagcagtggtgtgtgcggtgattgtaaatttttgttacttgaagactttgggaatcatacacttacccaaagctcacgatggaggcttagaggaagattcaggcacaacagttctgaatccgttgagaataatttctcacagcagatcccccatgtggttaatactgtgaggcaacatcagtcagctgcttctggggaggatgatcaacttgtagatggtgatacccctgcttggtcgttgcaatatgctagtgcacatactacccctagtgggtctagaaggtggaggcaggttctctctgacactgacagtgatggttttgataattggaattctctttatggcgaaaatgaatcaagtgcaagttttagacagtacaggcttccccatggcgagactgattctttctcccacagtgcttatggaggtgactcagatatctctatggatactcatagttttgtaggcactagagtcttaaattttccagatgagggagatgagtttgacagtgacactgacatagatccaatgcatgctggtctcagccaatggatttctactgatgaagacaatgaagaggaggaagaggaagaagaagaagaggaggaggaggaggatagggaatgggaattagctgaggctgaggaagctgaagccacatcccaccttcaaatttttttcacctctagtccaagtgagagcagggatcacattaattctactgaatctgggggaatgtttagccagataatccgggagacctggcatgcttttgaggatgttgatttacctcatggagcaaactttggggattatcttgatgctagaggttttgaagatctgcttgagcatcttgctgagaatgacagctcaagacgaggagcacctcctgctgctgtgtcttttgtgaataatctgccacgtgtagtcattggcaaggaaaatgagaagcacggggaactagtttgtgccatttgcaaggatgtcttgacacccggcactgaagtcaatcaacttccatgctctcacctttatcacaacaattgtattttgccgtggttgagtgcacgaaattcatgccctctttgtcggtatgaacttccaactgatgataaggattatgaagagggaaagcagaacattgatagtagaaatgtgatccatgagaggcagagaatagatgtaacagatgatagttcttctgatgtttctgatggagatgaggtgaatgaagaaactggtagtagtcaaggtggaatacagcagagacttctgagctcaggttctaccatgaattcttctgcaacaagaagtggtagaggaagatggttttttcttgctgcagctccaattgttagtctagtgggcattgttcttgtcttgtggttaggtaataacaactctcagattgaaggaagtagacatctgggcggtcactacttatccgggcaaaatcagcacaccattcatgcttattcctctccaaaccagagggagggtagaagcagagggtggtggtgcccattctaa

SEQ ID NO: 82922 - DNA, 300 bp, Glycine max
  Peptide Sequence Number=SeqID_199700
atgataatcacgcgcttctttgggtccttctgccgctgcgcggtggacacctttggcgccaccgtggcggacacgaagaacacgcgcttcgcagaggtgagggtccaagggagaaccgtggagggtgatgatcacgggaggacaggaggcgcagtagagagagaatattctcgcgccggcattgttcgtcggagtctcgatggcgccgccacctacactggaggttctcgcggtggtttgggggttggagatggggaggacaggaggcgcggtagagagagaatggaagggattttgtaa

SEQ ID NO: 82923 - DNA, 768 bp, Glycine max
  Peptide Sequence Number=SeqID_199701
atgacagaaaagatgatgatcacatttgataaatattgggttgtgattcatgatataatgggagttgttactgttttggatccaaggtcgaatggtctcaagtatccaacacttcaagctattgcaaaggatatcttagctattcatgtatcaacagtagcttctgaatatgcttttagtaccagtggccagattttaagtcttcatcatagtcaacttcattggactactttagaggcattgatctgcactagatgttggttattgagtactgaaactgatggtgataatgcaagtgatatgatgggaagtgaccttattacccacttggaggaacgaatactacatgaaatttatgtagaagcaaagcttcatgatgaatcaagattgattcaaagatgttttgatgataacaaaggtgatgacaaaaagctcaaaggtcaatcaaagaatgagttcaagatgttcaagatagaatcaagaacacttcaagattcaagaggaaagttgatttcaagaatcaataatcaagattcaaggatcaagcttccaagaatcaagatcaagattcaagaatcaagagaagacttaatcaagataagtataaaaagagggtacatctacttgggtttgactgagaacaagagagggtacatctcttgtggatcagttctagtggagggtacatccagcatgttcaaagagaacaggggaggatacatcccttgtggatctttgcttggaattgtacatccttgtgtggagtag

SEQ ID NO: 82924 - DNA, 228 bp, Glycine max
  Peptide Sequence Number=SeqID_199702
atgaaagaggggctagggtttggggttatggacggtgaagacgaagaattaggggaaaagcttgagagagagagagagagagaaacaaagatgggatgggtacaagacaaacgacaaaccatacaagaaaaagagagaagcaaccatttcggatgctatacttgctcaatgctttatcctcccccaattaacatttgccatttcatttcatacgaaaatattcaataa

SEQ ID NO: 82925 - DNA, 126 bp, Glycine max
  Peptide Sequence Number=SeqID_199703
atggggctcgcgttagtgttcgggaatgacatggagggctactatgagaagcttctcggcggtgagagcgacatcaccgctcctgcggcagttttgaggccattgactaatgactaccttcagtag

SEQ ID NO: 82926 - DNA, 138 bp, Glycine max
  Peptide Sequence Number=SeqID_199704
atgagacagacttgcttctggcacattaatgatgcagctgcggttcaagggcacagttctgacaacaaggagacaccaacaaaacaaggatatatctgcaaatatcagggcccagagattagagttgagagagtttga

SEQ ID NO: 82927 - DNA, 105 bp, Glycine max
  Peptide Sequence Number=SeqID_199705
atgaccccacttcattttgcagatatgctaatttctcctaaccagacctcaagatttgagggccctgaacaagcggattcgtggggcataggtagtgcttcttga

SEQ ID NO: 82928 - DNA, 975 bp, Glycine max
  Peptide Sequence Number=SeqID_199706
atggagcttcttcttccaagtctagtaatggtgtttgctcttgttttgtgctttgaatcacttcctagtgttagggttcagtcttctactacttctcccgggtcatcttcaaaaagggaagaagcaaaggctcttgatgcacttctccaacaatatgcttacagggctttggtgaatccaaaaacaggtatcatctacaatgcaactcatcttccttccaatttgactgagattgaggttgcggcattgagattaaggagtggaagtttaaggagaaaagggttccaggcatacaatgaatttgaaattcccaagggactcattgggagtccttatgtggagaggcttgttttggtgtaccaaaatctgggtaattggtccagcaggtactactaccctttgcctaattatacttatttggctccagtgttgggactactggcttatgatggttcaaatttgtcagtaacaagtttatcagaactagacatagacgcatctgagggccctatattggtcaagttcagggatgtgaaacaagcccctcatggtgctgttgcaaaatgtgtttggtttgatttgcaaggttcttccaatttcagcaatgtgacaggtggcaacacatgttctactactcaacagggtcatttctctatagtggttaaatccactgctcctctagcaccttctccaactcctgcaggtgctgctcctaaaggggaaggtgagaaggggaataataagaaagtgtggatcattgtagggtctgttgtggggggactagcattgcttgtgttgttgtcacttctagttttgtggatgagcaaatacaaacagaagaagagaatgcaacagatggaaagggctgcagaggtgggagagcctcttcaaatggcttcaattggggatacaaaagcacctgctgcaacagtaacaagaacacaaccaacccttgaacacgaatatgcaccctga

SEQ ID NO: 82929 - DNA, 255 bp, Glycine max
  Peptide Sequence Number=SeqID_199707
atgggtggaaatttgaagtttgtcatctcagatacaagagaagttaaggacagttttcgcattacaaatttcagaactgcgagagtaacaataaggttgcagcgcaccaagagtgacaacgacagtgatgttgcagtgccacgagaggttgcaatgttgacggtgacggagttagagtgccgtgagaggttgcaaataagagtgcgaaagcgtttgagtgagaatgatgagagtgagaggtttcaaagttactaa

SEQ ID NO: 82930 - DNA, 549 bp, Glycine max
  Peptide Sequence Number=SeqID_199708
atgtcaggcttgtataatcccaacttctctcctgctagagcagcttctcctcagattaggagcaatccagaagtggacagtcagtacctatcagagttgctggcagaacatcagaagcttggacccttcatgcaagtgcttcccatatgcagccgcctcctaaatcaaggtctagctcttcctgtttgtggatctatcacttcttgtttttgcactcttgttgtttatggaggcatgtttggtgtgtgttctcaaagaaaggaattgaatgtgcctgatttgaagtgtttggcatggcttttcatgtttggagaagagcttgaaatattaagggtttctggaatgttgtccaatcaaggttttggtgacttcgatagactgcgacatagaagccctagtcctatggcttcttcaaaccttatgtccaatgtcagtgggactgggttgggtggatggaatagtctccagcaagagtaccataagatgaggaggtttacggccacagcacttgcaagatcttctcttttgttcttcaaagcagtttcttga

SEQ ID NO: 82931 - DNA, 282 bp, Glycine max
  Peptide Sequence Number=SeqID_199709
atggctcaagaagcccagaagttcctcagctggatgaaaaataaacatggtggaaaactagacaacagactcccattggtgaagagcataaatgttagtggtcacaagtatgggcttgtttatgctggcattggttgggttatttggaggaccaaggatgacttaccagaagaccttgtcttccatattaattaccttggagctgaccaacccaccttcacccttaatttctctaaaggtgatttgattcattacaaagtatgtacatttcttgatccttga

SEQ ID NO: 82932 - DNA, 171 bp, Glycine max
  Peptide Sequence Number=SeqID_199710
atggctcgtttatcatcagccacttctctaattcttgcccttgttatattcacttcagagatatccaaggggaaggggaacgagaacgcgacgtgttgggaggatatgctattcgtaattggaggtggttgtcctgatttaaatgaatgcccagaaacgtgtcgtccttaa

SEQ ID NO: 82933 - DNA, 705 bp, Glycine max
  Peptide Sequence Number=SeqID_199711
atggaagtgagtttggatttgagtttggcctttgtccctagaagaaccgtttgtgagattcttggcgatattgctaagagcaaagatgggtctcggagaatggccacaattgaggacttagtgaaaaggttggaagatgagaagaagaagattgaagcattcaaacctattagtaaattgaaagaagagataaaggggggtgtgagaatgaaagatgaagccgtggttgaagagttgatgaaacttatgaaaaccaattctgaagcaaatgggtctttgatgattgtggggaacgaaagcagtgacacgaagaattggatgaactctgttcagctatggaacgttgaaaccaaacagaggaatgaagagggtgatctatttgtgcccagcaatccaattgaacaaaaaaacgacaccaacaagagtgtctcaaagacagtgatgaaggacaacaagaaaatgtcacaggttcctagtcttgggttgatgagtcctgcagtgttggaattgaatcatagaaaaacagaaagtggttatggacatggttcgtccatgattattacaagctcggttgaaattaagggtcatcatcaatcacaacaacctcagcagaatccgaggaaacaaaggcgatgctggtcaccagatcttcatcggcgatttgttgatgcgcttcaacaattaggggcccacaagctagattag

SEQ ID NO: 82934 - DNA, 292 bp, Glycine max
  Peptide Sequence Number=SeqID_199712
atgaatgttgagatgcagagatccatttctaaccataagatgcaaaatattggagatgctatcccaaatagttgcaaagatttggctaagcaagttctaaccatgttagaactagtcaacaacataatcaaacatcaaactttgatgctcattcatccagtcttaagattgggattcagatgtatttacgataatgaagacagtgcaaaaagtgaattgccttgtttggatggggactggtgtatgttaggttacgtacttgaggacgagactattggagatggcatgcgag

SEQ ID NO: 82935 - DNA, 363 bp, Glycine max
  Peptide Sequence Number=SeqID_199713
atgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgaaattaatggtttggatagaagtatggtgttcgacaaaatttatcatttaagggttacatcttctaatagtgttagtgggggtacggtatttgtgaaaggtaattttgatctttcacaaacacattaa

SEQ ID NO: 82936 - DNA, 207 bp, Glycine max
  Peptide Sequence Number=SeqID_199714
atggcaccttatggtagattcattgctaacattttgatagctgtgatgtttgtttgcttgttttttgtgaccaacattgtggcacaggattcagagattgctcctacaggtcaattggaggctggaactgggtttgatttgcctgtttctaaggagctacagttacaagtatgtaatttctactcagctattattggtgtgagctga

SEQ ID NO: 82937 - DNA, 219 bp, Glycine max
  Peptide Sequence Number=SeqID_199715
atgagagtcgggagacaaccattaccatgcttccccttgcaatgggtcatagtaaatctcacttttcctgcaagtcctggagcatttggtaggattgtaaaactgcttaatgtaggcattgtttctcaaatcaagaagatggtcaacgatccttgcattgatgtgaagcttcgtgcaagacaagcacttgggcagattattacttctggtgatagttaa

SEQ ID NO: 82938 - DNA, 273 bp, Glycine max
  Peptide Sequence Number=SeqID_199716
atggtggttcgtcgacaagtgctggttggtgtggttgttaacgacggaggtaagcaaggactaaaagaaaatgaagaggaacttggtgtgaatgaagaaaatgaagaggaatttggcgtgcatcaacatgttaattgttctgataccttaaatacttctcaggctcgatctgttgcttctgatattggttttgtagcagtgattatgaggtcagaccatagttgtcaagaccggcctagcggagcggagcggctgaccccaaaattgggatag

SEQ ID NO: 82939 - DNA, 790 bp, Glycine max
  Peptide Sequence Number=SeqID_199717
gtactggaccaaaggagggtctctccgcaatgtgcctgtcggaggtggctgcaagaagaacagaagaggtaacaagaccttgttgagacaatccattgatggtttcactttcaaaaactcgtcgccaccttgtggctatgccacagatcacaataataaccctttagggcattcttatgatcctagaataagggcttcttcagcttctagctcctcctcagtagtgactgatggacctaacattgatcttgctctagtttttgcaaatttccttaaccaaaagcccaatagttctgaaggtggggttgagagtagtactaatccagatcaagagcaaacagtttttgatccttctctagaaaacaattcaaggctatcaaacacagatgttgttggtccaagtactttgcctgaagaacttggtctcactgggtgtttgaatcttcctgaacaacaaccacacacacattctagtgaggctaataataacaataaccaaatgtgctatggtgagttcaacactatgcagacacttcaaaaagatggaattgagcaatacagtagtcatggtggtgctatgaattttgagctgccaccattgccgggtgaaggggaagcctcacatgatcatcacatgatgtggtcgaattctgagatgatgataaatcatcatgcatttcaagtcacacaacctccactacttggacttgaagttcatgatgcagacttattaataggtaattggagcccctttgattcgccaaaggatacttctttttccaggccttga

SEQ ID NO: 82940 - DNA, 255 bp, Glycine max
  Peptide Sequence Number=SeqID_199718
atgttacttcgaagaaactacgaagggaggatcataggctccattctctacaaaatccttgagttgagttttgaagatttcactccgattaaagtgttcctcccctgcggtggtcctatggcaagtggcggtggctcgtggcggtcactgatggttgtgggtggtgaaggaggaggtttatggtttttggtgagggtttgggagaaagagaggggtgaaaaacgtgtgcttttcacgctgctgtcgtatttataa

SEQ ID NO: 82941 - DNA, 177 bp, Glycine max
  Peptide Sequence Number=SeqID_199719
atggatacccgtcttcgtgtgattagtgatcctatgaatggagttcaacagatcgtagcaccgatattatatggcctcctcagagcattctggaacagtcctgctggtcccaaaacaactcacttttggggacctattgccaactggggattcgtggcagctatgtattgggaataa

SEQ ID NO: 82942 - DNA, 195 bp, Glycine max
  Peptide Sequence Number=SeqID_199720
atgactttcaagaagtcatttcgattcgaaaatgcctggctcttagaggacaagttagagaatgttgtgaatgaagagtggaatgtggaggagaggaggaagaagtttcgacttgaggttgatggcttaaaaagggaattggagaggtgcaagaattttgatgatgttgacttggtgacaagagttaattcataa

SEQ ID NO: 82943 - DNA, 273 bp, Glycine max
  Peptide Sequence Number=SeqID_199721
atggagctccagatgcacgcatacatgcaacatttggctgatcagcaggcagcaaaccattggggccaaatgcagttgaatgacagcttctatcagtatacactgcaccagaatcgccaggatcctaacccttacccgtggcctactcccgagcagttcagagaggaggcaggttctacagatgctcaaggaactgcccaaggtgatgaaggtggagctgaggatgatggtgacatggcagaattgcttgatttcttcataagaggaggctga

SEQ ID NO: 82944 - DNA, 432 bp, Glycine max
  Peptide Sequence Number=SeqID_199722
atgatgctaatagagggaacaaagatcaaggtgaaagtagaaaataaggatggttgggagaataatattgacatcgatactctagcttcaatgaggtcctttaatggtgattttccaccatggagatgcagcggaagacaatggagaagaggtgagaggaggcgccatccactagggaataagccatggaagaaggagcttcaccaccaagatgagccttggataagaagcttggaaggatgcttcaatggaggaaaagaaagagggagagaaagagagaggggggagcacgaaattgaaggaataaaagagggagataagtggaactttgaagtatgtctcacaagactctcattcatcaaagttacaacaagtactgttacacatgcttctatttatagactaggtagcttccttgagaagctttcttaa

SEQ ID NO: 82945 - DNA, 180 bp, Glycine max
  Peptide Sequence Number=SeqID_199723
atgatggccccgaagaaactccctgctaaaagatttaggaagaccattacaggagaaggatcaagttcagctccacctgtagaaatcgagtttgatgggcaccattttcaaagtgaggaacaccagcgccgttttgaaatgattaaagattggtattttctcaaggaaaggcgggtctag

SEQ ID NO: 82946 - DNA, 405 bp, Glycine max
  Peptide Sequence Number=SeqID_199724
atgaaaaccaattcagtccaattccatgaaccaattattaatcccaagaatttccccaatatcattttctacatcaaggttgctccatctttagttgttggttgcaccatggtcctcaagcctaccgagcaaacacctatctctactttctttaatgctcatcttgctaaattggttggaatcctagatgaagtgatcaatgtagtgcctggatttggcccaactgttggtgctacattaagcttacacatggatgttgataaggttagctttacttgttcaacacaaatagaacgtgagataatgcaggttgcagctaagagtaacttgaaacaagcttcacttgaattaggaggcaagtcacccttcataatttttttaaaggttcacaaatgcattggatga

SEQ ID NO: 82947 - DNA, 252 bp, Glycine max
  Peptide Sequence Number=SeqID_199725
atggggttgtatattcaagatgattattctacccgcttggtggccttgggaaaagtatatgagggggtgtccataatacacaacgtgccttatgcatatgacgtggttaatgtgagtgttggaaagtttatgagggtaatgctcaagtcccttttcccgtgtcagaggattcacagattcatccaaagaaataagttgaacatgttcataggtcgaatatcgttggtggagttgatcccttgggtgacttga

SEQ ID NO: 82948 - DNA, 273 bp, Glycine max
  Peptide Sequence Number=SeqID_199726
atggtttcatgtatcgattccttgagccttagtaaggcaaaggatagacacgatgaatgtcaacattacattaaaacatgggtgaaagaatcacaaagagaggtctaccgaggagcttacttgaatcacctattattgtcgaattcaggggccattggcagcttgtcattgtgtgtcctaggaacgatctcgttgtctggttctgttccttattgttttggtgatggaacaccgttagacatcgagaccattaaaacaatttacaagaaataa

SEQ ID NO: 82949 - DNA, 351 bp, Glycine max
  Peptide Sequence Number=SeqID_199727
atgagtagtggtgacttgcttggtaatcaggctggaggtttggacaaccgtacactagacagcctatacaatgatgcactcaggagaaacaaccaaaatgccagctatgatccatgggagccagcactagggggaaacatgatgcaaccaacaatgcataatccattttttgcttcaaatacaattgctgctccaccttctgttcagatggcttccaggaaaaagccatttggggtaggaaaaggtcacccaggcgagttggagcttgcccaggcgagctggttacttagccctgaaggtaacagctcacccaggcgagctggagctcgcccaggtgagctagttacttag

SEQ ID NO: 82950 - DNA, 399 bp, Glycine max
  misc_feature (391)..(391): n is a, c, g, or t
  Peptide Sequence Number=SeqID_199728
atgctgaagttgcagctgagatgcattaaatttatccatgcttcacagaattacaatgctcttggttatgatgacaaaatctcagatggtttctatgatctgtatgggatcttgaccgaggcaacctctgcaagaatgccttctcttgtagatctgcaaggaacaccgacctcagatgatgtcacatgggaagcagtcttggtcaatagggctgctgattcaaatttgttgaaacttgaacaagaagccatggagatggccgtcaattcaagaaaagattttgaagtacttttagatagtgatttggtacacaagcttgcaatagtagtggctgaatatatgggtggatcagttgaagatcacgaaagtatgttaagagcatggaggagtnttattaca

SEQ ID NO: 82951 - DNA, 438 bp, Glycine max
  Peptide Sequence Number=SeqID_199729
atggcctttggaataagagcacaaaaatggaagagacaagagagttgtgaagacaacaataaagaaagggcagaggctaagacaacagagactaggagcaagtgggagaaggtaggggccacaaagcatgacccacttgagaagagagagggtcacaagtactactacttcacattcccagagaaaaaattaaaaggtggtgggagttggaagacaaccaacttgatttctctttcttcttcctcctcctccctcctcaatccttatctcaatttccaaatagaagtggtgctggtgcttgtggtgaactgctcagaaatggcatatagaatgaacaagttggaaaaaaataatatggttgctttgagtctccaacttttgctatttcaagcaaacccaatatttgtccttagtgatatgcaaagcaaagggctttga

SEQ ID NO: 82952 - DNA, 111 bp, Glycine max
  Peptide Sequence Number=SeqID_199730
atgccaccatggaaggcgcatgtggcgttaggattgtaccatcggggaaatggaggcattcttggtcggaggggcattgggcaagggggaaacccaatattggccaagtaa

SEQ ID NO: 82953 - DNA, 227 bp, Glycine max
  Peptide Sequence Number=SeqID_199731
gaggcacttatttacgtgatctgcatggggttgctagcaaaccgccattgtcaatggcgagtttgttgtgcaacgcccacgtggcatggaaatcgctaccacgagtgacgagttgcttgcaggtggaagtcgccaccatgactggcgagtctggtcctggttttggaaaccgtcagtcaaactggcgggttggctttagagggttgcaggcaagggttcaggcgtag

SEQ ID NO: 82954 - DNA, 558 bp, Glycine max
  Peptide Sequence Number=SeqID_199732
atggtggaaaagaaaaaatttgatcatatagaagaaaggctaggggacattgaaggaggggacattgaaggaggcgaagattatgcttttgctgacatggcagagttgtgcctagtgcccaacatcgtcatacctccgaagttcaaggtgccagattttgacaagtacaaggggactacttgccccaagaatcacctgaagatgtactgtaggaaaatgggggcatacgcgaaggatgaaaaattcttgatgcatttttttcaagagagtctggctggggcggctatcatttggtacaccaatctggaatcttctcggatggtgggatacatgccttcgagttttgcacatctagtgtttgcaggcgagaggatcaaggtaggcctaagaatgggcaaatttgattatgttgctttgacgagttttggcaataggaggcctggggcaggtggagcaaagaaaaatgagggagacgctcatgccatgactgcaatacccacatggccaagctccccgcaaacccctcacaaccctatgtatcagtatcccccacactaa

SEQ ID NO: 82955 - DNA, 339 bp, Glycine max
  Peptide Sequence Number=SeqID_199733
atggggaagtggggagaagatagtacacatcattttgttattagagctcctaatccagtaggtcctgaatggcacaaacaagatggaagtaagattggaagagaaggaaaagagaatagtaagtgtcctcttggaaagagtctaagccagaggtatcccaaagtccaaatgattttccctaccctctcccatcctccacttcccgatatattctctccactcccactaattgcctattcatttgccataacgcacttagaacacagcagcaccagaagtactacttgtgatttacatagatgcaacgcatctaataaccacccaccagtacaggattag

SEQ ID NO: 82956 - DNA, 732 bp, Glycine max
  Peptide Sequence Number=SeqID_199734
atgatgcacgtgcttttagtggaaaattgtgttgaattcgggtctttgcagacaattcgagcgtggcacattatcggacgtcttggtggatgcaatgccatgaatatgcaactgtcacagtctccaatggatgcacgaccaagttatgattatattcagggagcaaatgtggaaccaactacattttacaacattggggatctcgaggtgcaagacaacttggctcgaatatgggtggatattggaactgttgaaccattgcttctgaatgttttgataaatgcactgacacagataagctccgattttgttgggatcaagcaagtcatgtttggtggatcagaatttgagaattggaatgagaatttgaaatcagaggatgcagtttaccaagagtccttccttcaaggccaacaacttatagccatgttaagtgttaactgcaacttcaccgagaggtggtgggaagctcacaagcatactctgggaagcatggagtaccaagtatgtcactttaatgctacagaacatgaagtgatcattttcattgagacaaggaatgtggaggggacgttggctacctatttaatacgcatttataaatcaccatggcaagccaaaacttcctctagaccatgggaacatgaatttttgtcaccgcgaaagccaaacactatgatcacgggtggtgactatttagaaacaaaagtgataattatggtattggaataa

SEQ ID NO: 82957 - DNA, 417 bp, Glycine max
  Peptide Sequence Number=SeqID_199735
atggttccgcggctagccctgagctatgccagaacaaggacattctcatgtagtgctagaaatcgactgaaggatttgaatggtagggacttcagtatagacattgttaacgaaaatctggagcttgaggatgatggtggcgatgatgggttttcggctcgaggattgtatgcaagaagtgaggcaaatgacactgatgaagaagaagcacaaaaagatggtgatggtggatattcaggtagcccagggaaggattatgatagagatccagaacttggtaacattctggggagttttctagagaatccccaagaggcacaatccaaattggaagacagactaagaaagaagaggagcaaaatactgcacacaaagactggatcaggaaaaccaatgaaagtgtcatttaacaagtaa

SEQ ID NO: 82958 - DNA, 828 bp, Glycine max
  Peptide Sequence Number=SeqID_199736
atggacatagcacattgctatttaaagggtaatgctgattctgtggatgttgatgtggacacaggtcaccttgacatggtttttagtgaggaaactgctgggatttttgacataaaatggagtccagctggagggcatgcaagtccttttctagctcaagcagatgctgatggatacttgaggattaaaatactggggggttgctgtaatggagtggaaggggctaatctaaaggagatcacaaatggaaaaatcagtaactctatgtgcctgtacctggattggaatccttcagctacatccatcacagtagggctttctgacggctctgtgtcgattgtttctcttcttgaatccaagctagaaatacaagatgagtggaaggcacatgattttgaactttggacaacctcctttgacatccaccaaccaaatttggtatacaccggctctgatgattgtaaattcagttgctgggatttgcgagataaacctcccaatgtggtatttcagagctctaaagtccacaaaatgggtgtttgttgcattgagaagagtccacatgacccaaataccttgttaactggcagctatgatgaatacctaaggcaccaccccttcattccaggtttggttttggctgcttgtatgcacaatggttttgctattgtcgccattaaaggcaacaatgctgaagtgtcggaaacttacaagaagcatgattctcttgcctatggagcagactggcagaaacgagaagcaaatcacataggtgggaataccaaacctctagtggctacttgctcattctatgacaaacttgttcgg

SEQ ID NO: 82959 - DNA, 198 bp, Glycine max
  Peptide Sequence Number=SeqID_199737
atggagtttcaggctttggattgggaaatggcagaaaagctacaggaggaaatgaaagggagtggtttgcgtgtcaagggcatgacaaggggtttgattagagctatcaaggagacagagaaagaggttgttggggccactgcaacaatgctctcagcctcgacaacctctttctttaaaaatgaaaaaaaggtttga

SEQ ID NO: 82960 - DNA, 303 bp, Glycine max
  Peptide Sequence Number=SeqID_199738
atggaaaacacacttgagtcttctggcagtccacgacatagaaagatatcagccagatgggattcggttgaagcatgccgacctatagttgatgaagcacctgagtttgaagacacacttagttacatagctaaggttcgctctcaagttgaaccttatggcatatgtaggattgtccctccagcttgttggaaacgaaaaccatggggagatgagccttacctcgacatcgacggtggagcacaacccaatgaacgtcctcaatgtcgtcaaagtaaagctccaaagcacaatgcagattga

SEQ ID NO: 82961 - DNA, 1055 bp, Glycine max
  Peptide Sequence Number=SeqID_199739
tcactatgacactgacactactgcctcctccaaaatcaccattcttgaagacccttttgttcctgtgcagcactagtctcctcctccctgatgctgatgcggttcagccaatcatcccaaacccctcctcatcttcaacaacaggaacaatccctgctttcccagaacaagctgaagctgcaggctgccctctcaacctctcagatgaccactatgaagccataaagagtgcatgtggctccaacaaacctgatgatgatgacctccaccgtagcagatgctgtcctgtgctcgcagcgtggctctattctgcatactcagccactgctcttagtgcctcacagggccataccacatcctatgacatgcccttgttgcctgatgactcagaaacatgtgtgagtgacttggggaaggccttgaaagttagaggaatccagctttttcagcccaatgagacttgtgatgtggtctattgctactgtggcattaggcttcaccctttgacatgtcctgagtcattctcagttactccaagtggaagtcttgttgtcaatcaaagtgtcaaaagattggcgagggattgctcgagtagcagcaccaatgtcaacaagtttcccggcctgggtggatgctccaagtgcttgcatagtctctattcgcttagaaagaagtcttcaaattcaagcaagtcagaagaagataggaccagcaagatccataacaaagactgtgaactcatgggcttaacatggcttctggctaagaatagaacagcttacattcacacagtttcgggggttcttcgagctttgatgttgagcagggaaggctctgacccacaatcatgcactctaaacagtgatggaatgcctcttgccgttgattcctctgaaatttctccctcaggaactcgtcctggaaatcctgtcatggcttccagtgatcgttctgatgcgaagtcttggaattcgttattcttggatccttcttttgtgaagctgttcttgagtcgcatcagaaccatgttccatacactgctgctccatagttga

SEQ ID NO: 82962 - DNA, 474 bp, Glycine max
  Peptide Sequence Number=SeqID_199740
atggtgaagttaatatatgagagtcacaatcatgcattgactaagtcattagttggacattcatatgctagtcgactgactaaggatgagaagattattattggtgatatgacaaagccaatggtcaaaccaaaaaatattcttctaacattgaaaaagtataatgccaatagttatacaacaatcaagcaagtatacaatgcaagtaatacacatcgttcttccataagaggtaataatactgaaatgcaacaactaatgaagcttcttggacgagatcagtatattcattggcatagattgaaggatgaaggtgttacatgcttagcgcgagttacaggcttagctcatgatcaccgactcactcgctcagtgcagcagtcgcgcttagcgcgagttctcatgaaagtagagagcatcccacatagagctaagactagggttcatgcaggaatatgggaaatcaacccttag

SEQ ID NO: 82963 - DNA, 270 bp, Glycine max
  Peptide Sequence Number=SeqID_199741
atgtctaaaaatcgagttggggttatggcgtgtggccaatctagagttgaagtcgcaagcaaagatgacaaccactttggtctccacgatcctcttgtggcatatggtctcaacatacaccatggactcaagctcgtgggagatggtgagatagtcaaacctcacaatgacacaagcggccacgacaagctcgccatggaggtaaaaagggcctgcgcaattgaagagggaaggaagaaactagtgaaggggaggaagcaagaaggttag

SEQ ID NO: 82964 - DNA, 2115 bp, Glycine max
  Peptide Sequence Number=SeqID_199742
atgtctgtagtgttttatgcactctaccaagaacattacatgtatactacacgccagcttgataacaacgatttcagtgggagtgaaattccttctacctatgcaaacctaaccaggctagtgaaattaagtctacgaaactgtagtctgcaaggagctattcctgatttcagttcaatatccaagcttacctatttgtcacttgcaaacaatttactgtctgggtctatccctggtagcatatggcagaacatgtccttcagtgcgaaagataaacttacaattgatctccagaacaactcattttcagatgttttgggaaacctgacccccccggaaaatgttaccttgaggctttctggtaatcctatctgcaagaattctaacatacaaagtattggtcaatattgtggacctgaagcagataataaggcagcccaagattcaacaaactcaactttctgtccagttcaatcttgtccagtggatgacttttatgaatatgccccctcttctccagttccctgcttttgtgcagcacctctgagaattggatacaggctgaaaagtccaagtttttcttactttgctccctatagaagtagttttgaagactatataactaggtccttagacttagatctctatcaactatcaatagattcagttgcttgggaagagggacctcgtcttagaatgtatttgaaactcttcccttcctataatgattccggttctagtatgttcaatgaaagtgaggtccatcgcattaaaggcatatattcatcatggcactttcctcgcactgatttttttggaccatatgaactgctgaacttcactcttcttggaccttatgcaaatttaaatgttgattcaaagaagaaaaagaataatgtgggcataaaaatttctgctgtgatagcagctgttgcttgtgctttagcaatatctgcaataatcattctcctgatttctaaaagaaatatgaaataccagaagaagatttccaggaaacgaatgtctactaatgtatctatcaaaatagatggcatgaaagcatttacttacaaagaactggctattgctaccaacaaatttaatatctcaactaaagttggccaaggaggttatgggaatgtctataaaggcattttatctgatgaaacttttgtggctgttaagagagcagaagaaggttccttacaaggacaaaaggagtttctgactgaaattgagcttttgtcaaggttacaccatcgaaatcttgtctcgctgattggatactgtaatgaaaaagaggaacagatgctggtttatgaattcatgcccaatggaacccttagggactggatatctggtaaaagtagaaaaaccaagggaagcctaaattttagtatgaggttgagaattgcaatgggagcagccaaaggcatactgtatctgcatacagaggctaaccctcctatattccacagagatattaaagccagtaacattcttctggactccaagtttacagctaaagtggccgattttggattgtcacggcttgtaccagacttatatgaagaaggaactggtcctaaatatgtgtcaacagttgtgaaaggaactccaggttatctagacccagaatatttgttgactcataagctgactgacaaatgtgatgtctatagcctgggaattgtgtatctggagcttttgacaggcatgcaaccaatatcacatgggaaaaacattgtccgcgaggttaatacggctcgtcaatctggtacaatatattccataatagacagcagaatggggttatatccatctgattgtttggacaagtttttaactctggccctcagatgttgccaagacaatccagaggagagaccatcaatgctagatgtggtgagagaactggaagatatcattacaatgttgcctgaacctgaaactcttttctcagatgttagcttactcaattctggtaacatagcacccccatcatctgcaacaacatcaacatcaaatgtgacaagggaggagcaacacatgtcctcatatgtttcaggaagtgatcttgtcagtgatgtcattcccaccgttgttcctcgctga

SEQ ID NO: 82965 - DNA, 849 bp, Glycine max
  Peptide Sequence Number=SeqID_199743
atgtcagctaccttagcttctctggccaaggaagaggaagtgccaagtaaagccattgatacactcagagcagttgaagaccaacatgggggtgtaattgtgaacattgaggagcctatggattcctcagtttttgcttctttgctagaagattcaatattacaatggagggaaaagggaaagaagggagtgtggatcaagctgtccagagaacattcaaatcttgtggattctgcagttaaggctggattcagattccaccatgctgaaccagattacttgatgcttgtgaattggattcccaatactcctgatacccttcctgcaaatgcttcacaccgcgttgctgttggtgcttttgtcatgaatgccaacagggaggtgcttgtggttcaggaaagcaatggcaggtttagtggccaaggaatctggaagttgcctactggaggcgttgatgaaggtgaagatatttgtactgctgcagttagagaagtcaaagaagagactgggatagatacacagtttgtggaggtcatagcatttaaggaaaggcataaatctttcttccggaaatcagagttgttctttgtttgcatgttgcaacctcattcctttaaaattcagagacaagtttcagaaattgaggcagctcagtggatggcaattgaggactacatggcccagccttttgtccgagaaaatgagctatttgactttcttaccaaaatagggttatcaaaatttgatggcaaatacaatggcttttctaccgtactgtctagcacttcctctcgcaaaaaatcttacttttacttcaacaacaaggacgctggtcacatgttagcttga

SEQ ID NO: 82966 - DNA, 177 bp, Glycine max
  Peptide Sequence Number=SeqID_199744
atgaagtatctaacgaaggatgatccaaggagaagccttgagcatggaaacaatcacacaacactctctgccctttgtgcctcaaaaatcgcaatttcagaacccattatgtgtcagaggttcctttttatagtaattgaaattttcacacgactcgctaaagcgagtagctcctga

SEQ ID NO: 82967 - DNA, 237 bp, Glycine max
  Peptide Sequence Number=SeqID_199745
atgacacctgctcacacaagaattataattttcacaataacatccatcagtacacagttcgcctcagtcatgctctgcatcatccgtatgagctgctcaggcttagaagaaagagggagtggagactggctggtagcaagaagagggacgatggctagaggggggattgccgaaggagggaccgttggtggagggacctgtggagcgtctggagcggctcgaaccctgggaaaatga

SEQ ID NO: 82968 - DNA, 447 bp, Glycine max
  Peptide Sequence Number=SeqID_199746
atgaggctcaatgcctatgaatcctccaagaattataagcagaagatgaagatttatcatgataggaagctgctaaagaaaacctttcagcttggacaacaactcaagtccaagtggtctagccctttcataatcgaagaggtgaagccttacaaagcagtggagctactaaatcctgcctcaaatgaccttgagcggagctggatcatcaacaatcaaagatttcaaacatccattcgcctagagaagcatatcgacatcgctctggtgaagaagttctatgctaatatctatgatccagaggacggcatgccaaagcagtgtctgacctcgtcgtcattccataaggggagaagtaccctacttactcccagtacctccacacctgccctgagaactaggccatcatggccaagatctgcacaccgggcggatagttcattctga

SEQ ID NO: 82969 - DNA, 243 bp, Glycine max
  Peptide Sequence Number=SeqID_199747
atggaaattgaagatgatgatgatgatggtatgcgtatctcggtccccagccatactttgtcgttcttcccttctcttcaattctggataattgctaaagaggtctggcaggaggtatcattgaagcataaggtggactgtctagctctatcagtggatgacatgagagccttcatcttcgctgctcttcaacaactctcgcatcctaagattgaagtgtttgttttggagaaggtgcaatga

SEQ ID NO: 82970 - DNA, 252 bp, Glycine max
  Peptide Sequence Number=SeqID_199748
atggctcttacacgtgaacattattatatctatatgatgaaggtgggtgcaggatggtttgacgtgtggattgcaaacaccagaggaaccagatatagtggcagacacatcttgttggacccctctagccaggcctttctaaaggcttgcaaagccacatgccagagcaactcacatatctcgcctcatcataccagcaaaacggacattcttgttgaagcctactaccttcagtggtccatgcaagtctaa

SEQ ID NO: 82971 - DNA, 729 bp, Glycine max
  Peptide Sequence Number=SeqID_199749
atggtgttggattacgggtattttggtgatgttgtctctttggatactacttattgtaccaatcaagcaaataggccacttgctttgttttcaggttttaaccattataggagtttagtaatctttggtacaactttattatatgatgaaatggatgaatctttcaaatggctatttaagacattcttggaagcacatagtcataaaaagcctcagaccattttcactggtcaagaccaagcaatggctaaggcacttgttgaagtaatgcctaagacacatcatggtttatgtacatggcacttgatgcaaaacggaattaaacacctcaagccagatgttgatataaagaaattcttttgtcactttgaacgatttgttgaggaaaagtgttacaatgagctagtttgggaagagaggttgaagatgatcctagactttctagcacagggagaatattgtcagctggtagaggaaagtacaaatgtcatgtgcaagaaaataaaagagcttcgcttacaagcacatagcatttacaagaacaaggatgatgccgttgcattggcgatcaatgatgatacacaacctaaggggttcaagaaacgacctagcataaagaggcacaaccaaaaaaatttcaaaagttggtctgtgttacaattaaagaagaagaaaaaagctctaactagggtcaatcacaaagtcaaacatctaagggacaccccttga

SEQ ID NO: 82972 - DNA, 654 bp, Glycine max
  Peptide Sequence Number=SeqID_199750
atgggttcgaatccggaaacaacctctttgcatatgcaaaggttgatgaagaataactcaatgcaagtcattgatccaccctccacagatgaagaaaatgtagagcctttgtctcaagattttgtccttgtggaaaagacagaacccgatggtacaattgagcaaataatattctcttcaggtggagatgttgatgtttatgatcttcaagctctttgtgacaaggtagggtggccgcgtagaccgttgtcaaaattagctgccgctttgaaaaatagttatatagtagcctcactacattctataagaaagtcacatgggtcagaggggaatgaacagaagagattaattggcatggcccgtgctacgtctgaccatgccttcaatgccacaatttgggatgtcctagttgatccaggctaccagggtgacataaaggaacttaaatttaggctatatttgaatggatggagtggagtgggccaaggtcttggtaaagctcttatagagaaactgattcgaactcttctgcaaagggacattggcaatataactctgtttgcagatagtcaagttgtggaattttatcgcaatttaggctttgaagctgacccagagggcataaaaggcatgttttggtacccgaaccactaa

SEQ ID NO: 82973 - DNA, 372 bp, Glycine max
  Peptide Sequence Number=SeqID_199751
aaaagcagaaggcggaaaactgctgcatggctaagggagtgtgtattacagcttggtccaactttcattaaacttggacagttatcatcaacaaggtcggatctatttccccgtgaatttgtagaggagcttgcaaaattgcaggacagggtccccgcattttctccaaagaaagcaagaggctttattgagagtgaattaggagctcccattaatatattgtttaaagagtttgaagatcggcccattgctgctgctagtcttggtcagagaatactctctgtagggaacttttgtctcttggacagtaattgtattgctgtatttgtgtcatacgagactgatagggacttgggtattatgggttcctaa

SEQ ID NO: 82974 - DNA, 264 bp, Glycine max
  Peptide Sequence Number=SeqID_199752
atggctgcatccggggatcccctattggttggtcgcgtgataggaaaagagattgttccatacctgggaccaaggccacctattggaatacatcgttacatatttctattgtttcaacagaaagtgcctttgggtcttgtggagcagccaccaactcgcgcaagtttcaatactcgctattttgtccgacaattggacttgggccttccagtggccaccgtctacttcaactctcagaaagagcccgctgccaagaggcgttga

SEQ ID NO: 82975 - DNA, 570 bp, Glycine max
  Peptide Sequence Number=SeqID_199753
atgcatgtggatggctcctccaaccaacaagggagtggagctggggttattctagaaggtcccaatggcgtaaccatggcacaatcattacactttggcttcaatgccacatgcaatcaagctgagtataaggctcctcgcaggactaagactcaccaaagaggttggcacccaaagagtttggtgccgaagggaaattttgaggaagtacaggtcattcatataagccgagaagtcaatgacaaggccgacaagttggctcgactggaaacttcccctaagcttgggcaactgaaaacattcatcctcctttcagttcccgaacccagtgttttaggaaaagaagtcctgcaggtgaaggaaggaccttcgggatggaaaaaagagatacttgagtacttgaaacacgagacactctcagcagacaaggggaaagctagaaagttaaaagcgcaagctgccaagtataccttagtggccggtgaactatataggagagggttctcctttgtcgcaacctacccttcaaagggaggaaggcgcgcggagtcgccaccaacgtttatttga

SEQ ID NO: 82976 - DNA, 633 bp, Glycine max
  Peptide Sequence Number=SeqID_199754
atgcaccatttgataacaacgttaaggttgggaccttttgtcaacaacctatgcataaaactagcatctgacctcaacaagctacggaggagaacagctaagtacgtgaagatggaagaactggccgagtcagtcagaacggaagaggagtcgaagccacttgagggagagaaaggaaagagccctcgaccaaccaaggcgagtcataaacaccattgtcgaaggtttcgttgggggagaagccatcgcctctggcgaaaaaggcacctttacatgatagtacatgctcacatgttgtacaatatactcctcggtcgtctctcactcaaatcctcgggtgcaattgtttcaacccctcacctcgcgatgaagttcccatcggaagatgagaccatcataattgtgcacgctgaccagaggatgacaagagagtgctacatggccagccttaggttacgacctcattttgcagtagacatgcccaggatcgatcaaagctttaaagatgcaaagcctattgcccagagaaaaagaaagataggtgaagagagatctcaatcaggcatgctcgaaggatacatacccattcctgaacatcgatcgcctggtcaatggagcagtcggacattgtaa

SEQ ID NO: 82977 - DNA, 2256 bp, Glycine max
  Peptide Sequence Number=SeqID_199755
atggcaaaggacaagcctgtttctgtcaaagatgccgtcttcaaattgcaaatgtcactccttgaaggcattcaaaatgaagaccagctgtttgctgccgggtctttgatgtcaaggagtgactacgaagacattgtaaccgaacgatccatcacaaacatgtgtggttatccactctgcagcaatgctttgccatccgatcgcccgcggaagggtagatataggatttcactgaaggagcacaaggtctatgacctacaagagacttacatgttttgttcttcaaattgtcttgttagcagcaaaacttttgctgggagcttgcaagctgagagatgctctggtttagacctggagaaactaaacaatgttcttagcttgtttgagaatttgaatctggaaccggtggagactttgcaaaagaatggagatttaggtttgtctgatttgaaaatccaggagaaaacagaaagaagcagtggggaggtgtctttggagcagtgggctggaccttcaaatgcaattgagggatatgtaccaaaaccaagaaaccgtgattctaagggtttgcggaaaaatgttaaaaaagggtccaaaactggtcatggcaagtcaattagtgacataaatttaattaacagtgagatgggctttgtgagtactataattatgcaagatgagtatagtgtttcaaaagtaccgccaggtcaaatggatgcaactgctaatcatcaaattaaaccaacagctacagtcaagcagccagaaaaggttgatgctgaagtggtcaggaaagatgatgatagcattcaagatttgtcttcatcttttaagagcagtttaattttaagcacctcagaaaaagaggaggaagtaactaaatcatgtgaagctgtgctcaaattctcccccggttgtgctattcaaaagaaagatgttcattcaatctccatatcagaaagacaatgtgatgtggaacagaatgattctgctaggaaatctgtacaagtcaaagggaaaacgagtagagttattgctaatgatgatgcttccacttccaatttagatcctgccaatgttgaagagaaattccaagtggaaaaagcaggtggatcattaaagactaaacccagatcttcccttaaatctgctggtgaaaagaaatttagtcgcactgttacttgggcggatgagaaaatcaacagcactgggagtaaagatctttgtgagtttaaagaatttggagatattaaaaaagaatctgactcagtaggaaataatatagatgttgccaatgatgaagatatattacgtcgtgcgtcagcagaagcttgtgctattgcattgagctcagcatcagaagcagttgcctctggagactcggatgtcagtgatgctgtttctgaagctggaatcactatattgccacctccacatgatgctgctgaggaaggtactgtggaggatgctgatatactacaaaatgattcagttactctgaaatggccaagaaagactggaatttctgaagctgatttctttgaatctgatgactcatggtttgatgctccaccagagggtttcagtttgactttgtcaccttttgcaactatgtggaataccctcttttcatggacaacatcatcttctttggcatatatatatgggagggatgaaagttttcatgaagaatatctatcagttaatggcagagaatatccttgcaaagttgtcttggcagatggtcgctcatctgaaataaaacaaactttagccagttgtcttgctcgagctttacctgcgcttgttgctgtgctccggctgccaataccagtatctatcatggagcaagggatgtatagttgtcccaaactaagagtcattacagatttattatacttcagcaggcatggtctgaaatcagtgaaagtaggggagtcttggcacaggggtttcaagcaatggcatcagcttcttgcagagacaatgctggcatgcttgctggagacaatgtcatttgtggacgcacttccagctttcagaacaaaacaatggcaagtggttgctcttttgttcattgatgcattgtccgtatgtagattacctgctcttatctcatacatgacggataggagggcttcatttcatagggttttgagtggttctcaaatacgtatggaagagtatgaggttttgaaggatcttgtagtaccactgggccgagcacctcatatctcttcccaaagtggggcatga

SEQ ID NO: 82978 - DNA, 1672 bp, Glycine max
  Peptide Sequence Number=SeqID_199756
tgggtggcctccgccgacgcctccggcaccgtcaggatctggggcacgcgaaacgacttcgttttgaagaaggagttcagagtcctctccgctcgcatcgacgaccttcagtggtctcccgatggtctcagaatcgttgcctgcggcgaaggcaaagggaagtccttcgtccgcgcttttatgtgggattcggggactaatgttggtgaattcgatggtcactctcgccgggttttgagttgcgcctataaacccacgaggccttttcgcgttgtcacttgtggagaggattttctggttaacttttatgagggacctccctttagatttaagctatctcacagggatcattcaaattttgtgaattgtgtaagatattctccagatggcagtaaatttataagtgtaagttctgacaagaagggtgtcatattcgatggaaagagtgcagaaaagattggtgagctgtcttctgaaggtgggcatactggtagtatttatgctgttagctggagtcctgatggaaagcaggtgctgactgtatctgccgacaagtctgcaaaagtatgggacattactgagggcaataacggaaaggtgaagaaaacattgacttgtgctggctctggtggagttgaagacatgctagtggggtgcctatggttgaatgattatcttgtcactgtttctcttggtgggacaatatctatatttttagcaactgatcttgataaagccccgacaacattttctggacatatgaaaaatgtttcctccttaactattcttagaagtaaccctagggtgctattgtctagcagttatgatggcttaatagttaagtggattcaagggattggatatagtggaaaactacacaggaaggaaaattctcaaatcaaatgcttagcagctgtagaagaagagattgttacatctggatttgataataaggtggaacaggacttggatcaattgttggatttggacccaagcacaaacaagcctaagatctggaaagtttattccaggaggcagcaaaagggaatagggaggagaattagttatgctaactttgcaaattggttaggaccaaggctagcaaattccaaggcttctgcggtaaatgaatactatggagaaatggatcagtgtggagatactgaagccattgatataggaagtcaaccaaaggacttgagtgttgcacttctttctcctgaacttgctctagtttcaattgattcaggagttgtcatgttgcgtggtaccaaaattgtgtcaaccataaatcttgggtttattgtgacagcatctgctgtctcacctgatggaagtgaagccattatcggtggacaggatggtaaattgcacatatattctgtttctggtgatactcttgtagaagaggtagtccttgagaaacatagggtagtgtgggaccgtgcctcccgagaggtgaagctgaagaacatgttgtaccatactgctaggataaactgcctagcgtggtcccctgatagccataggattgctacaggatcactcgacacatgtgtcatcatatatgaagttgatcagcctgcatctagtagaattaccataaagggtgctcatttaggtggggtttatgggttagcatttactgatgaatatagtttggttagctcag

SEQ ID NO: 82979 - DNA, 495 bp, Glycine max
  Peptide Sequence Number=SeqID_199757
atgctctctgatctgcctgaaacggcgtcgttgaaggccgtcgatggctgtgttgcgatgtcgcccgataagtctccctctgtgcccgttgaaggtgaggccttggtgtcccctcagtgtcaaggtgagaccgcggagaaatcgaagggggtgctgatggcggcggcgacgacgacgggtggtcgatcgaagaaacaacgcccttcgaaattgagccccaaggttgcgtggggaaagcttctctctcagtgttctcagggggaggaggaggagggggagaggaggaggcgtcgtccatgggggaatgagaatgagagcgagaaagagggttcggtggtggaagtggtgtttggtaacatagtgggtggggtggtggtgtgcggctggctggttttgagatgtggacaggataggacgagggagggcaccaccaatttggtgggggaagtggctaacgtgcgccgcgttcacacctggacgctgctcattggctga

SEQ ID NO: 82980 - DNA, 477 bp, Glycine max
  Peptide Sequence Number=SeqID_199758
atgcatttcagggaacctatgaaggaactgttgggaaaagaaggggaaagaaggctatcaaacttaggaatggagcagatgctagtatccatgggtcatcaatcaagtggtgcagttgacttgtggaactatccaacatggttagggaacctcattgcccatgatattaatggagaagatatacctgatcctgttgacatggctaccatggaagaaaatgttgcaccagtttatagagatagggaaaggggagttgcaaggtataatgaattcagaagaaacttactaatgatccctattagcaagtgggaggatttaacagatgatgaagaggtcattgaagctcttagagatgtatatgaagatgatgctgaaaagctggacttgatagtgggtctccatgcagagaagaggataagaggctttgctatcagtgagactgctttctttatattcttaatcatggcttggagttaa

SEQ ID NO: 82981 - DNA, 657 bp, Glycine max
  Peptide Sequence Number=SeqID_199759
gtgatacattttgtggacaagcttgagttgtggcaaaggctgccagtgttgttggggttagcatacttgggaattagaaggcacttgcattatcgttacaatttgttgcatgctggaggagtcaatggccacaagtatgatacacaagagtatgcctatacgacaccggatgggaagcaattcaacatgatagcttgctcatggatgcagctcatgattcatgattggattgaccatttagaggatactgaacaggtggaaattagagctcctgatggttattcaagtggatgtcctttaaaatctttcatgtatttcaagactaagaagttcaaaacagacgcttcatgtatgaagtttggcttccaaaacatcaggactccttggtgggatggaagtgtcatatatgggaataacgagaagggcatgaaaagagcgaggacgttcaaagatggaaagctgaagatctcagaagatgggcttcttgagcatgatgagaaaggtattcctatatctggtgatgttagaaattgctgggctggcttttcccttttgcaggccttgtttgtcaaagagcacaatgccctatgtgatatgctaaaagtgcactatcctgattttgatgatgagcagctctatagaatgcaagattggtga

SEQ ID NO: 82982 - DNA, 297 bp, Glycine max
  Peptide Sequence Number=SeqID_199760
atgagcgcatttcctcttgcgctaagcgtgacaattctcactcagcgcaattccctatcggtctctgacccaggtgtctttgacattaataaagatgtgtatgatgatgagcttgtgctgattgatgacatcccagaagatgttgcccctacacctgagaggctggcgaccccatgtcgaagggagggaaccgttagtgagtcttcaagttcaaccttagtcgaggagggtgctcgggagggaactattaatgagtctttgagttcaaccttagtcgaggagggtgctagggaatga

SEQ ID NO: 82983 - DNA, 213 bp, Glycine max
  Peptide Sequence Number=SeqID_199761
atggcggaaaatcttcacgaatttgctcatggaaacatctcggaagcgttatggaagcacctcggcttggattttcttcatggaaacacggaaaaagggaggtgcttgccgcccagaggcttcttgaggaagatttctgagcacaccccaatcactaagttcacccccattttcgtactttatggaagtcttacgggagcgtttcaaacataa

SEQ ID NO: 82984 - DNA, 204 bp, Glycine max
  Peptide Sequence Number=SeqID_199762
atggataagattctgctccgtccaccttcttcttcttcatcttcccgtcccatgcctattgtatcctgcacctctaaggttgctcaccaaaacgtaaatgcacacccttctttcacagcgtcagagctccaagatggaaagatcttggcccttgattccaccgcttctaataagacaccaaggacataccattaccattactga

SEQ ID NO: 82985 - DNA, 414 bp, Glycine max
  Peptide Sequence Number=SeqID_199763
atggtttcagtcaaaggttcgttgttgggggagttggttggaaatggtttcgaggtttgtgggtacaatggtgaagtttttgaagtgtcgtctgactcttactcctcgaggtcatatttttctagttcaattaaccttttggcaacaaagggatctagtgaccttctggaatttttgagccagttgccggaaaatatgggtgagaacgttgcaactctgatggtggaccctgctgctaagacggggacttccatgggagatgcacctcggcctaagaagtaccttgtgctgaaggagaagcgcttgccttcccctatcacgcttcccagatatacatgggttgatggagaggtaggaatcatgacgcaagctggtgctaacatgaatgccttctggttggaggtcttcctctga

SEQ ID NO: 82986 - DNA, 246 bp, Glycine max
  Peptide Sequence Number=SeqID_199764
atgcatctgagctcaacctcacaccatgatattcaatttaaatctaagtatgcaaaaaataagttttttagaaccactaagagggaaaaacctagaaacccaaaatgtgaaaaaatgcaaaaggatttgcattggtgtgtggtgaaaaattgggaattgaaagatagtgaaagagatcgcggtaaaggtggaaacttactccgaattgctccacgccatgcatctgagctcaacctcacaccatga

SEQ ID NO: 82987 - DNA, 195 bp, Glycine max
  Peptide Sequence Number=SeqID_199765
atgaagcctttacagggaaccactcaaacgttgacacgtgtcattgacatgtggcagtcacatatggcattgacatgtggtagtcaacgtttgaggccttctcggcaatcgtcatttgaatttagtcctaaaaaatcaagcaggcttgaatttgatttgaacagtaccggtgatgatggtcacacccaacattga

SEQ ID NO: 82988 - DNA, 1278 bp, Glycine max
  Peptide Sequence Number=SeqID_199766
atggaaggcaagactgaaagtcatatgacatcagcagcagcctttgtggaagggggggttcaagaagcttgtgatgatgcttgcagcatatgccttgaggatttttgcaaaagtgatcctgccactgtgtcagagaagctcccagtgtcctatgtgttggcaacctatcagcttgagggatgctaccagttgtatgcatttcatcacagtcaagagctgcttgaggcagtagagctggagaggagcttgagagatactccatcaagaaatgctgcgatttttcatcatccaacacttggtgattttgaattgcagcatttacccatgggtgtgaatgaggccgatattgaagagcgaataattcaacatttaactgctgcagccgcaatgaggagatctcatcacctcagccggagggaaggccatcgaactaggccatctgctcatggccgtccacacttcttagtatactcaactcagcctagtgcaccaccatcagctgcaggagggggaagtgaaccagctgcaattcctgtaggaagtccatctaccccacttacatttgatggaaatgagcaatcatcactacagcagatcccccatgttcaaactcagagttcttctttaacttctgcctctactgtctcaacaacaaatcttcaaggagttcactctgatgatagaagttttgcctctcattcttttcctgcaagccaagacagagcacagccatcagaacaatcattctctgattctctgcgctccagatttaatgcagtatccatgagatacaaagattcaatttcgaagggcacaaggggatggaaggagaggctcttctctcccaattcttctatgtcagaacttggttcagaagttaggagagaattgaatgctaaaattgctagcgtgtcccgattgatggagcgccttgaaacaagagaaaataatagtgctgcaggaacttctttatcaaatcatttggtgaaccgttccattgcagagacaagcaaccaaagcaatgtggaagctcgcatctttgctcaacgtatcatgtttgaagcgtttggcggcggaggaacgatgttctatggaacaacgacacagcagtctcaggctttgaagtggttcgtagaggtgataacttactatcaggattgggctagagcaaaggcagtgcagcataatgcaactcgcctgggtggtgataacgagaataatagatggaaaccgcctccacaaggaacttggaaatgcaactttgatgctagcttttag

SEQ ID NO: 82989 - DNA, 426 bp, Glycine max
  Peptide Sequence Number=SeqID_199767
atggaaccagatgcccaacatgcaccacccataattcctatgttgcagagcttattcagggggcagctggtgattgtatacaaccaacaacagttagctcacaataggccaatagtatccatggaaaaatttctggacaaggtggccaggcctgaagcccagcttcctttgggaagagcccccgaggttgttcctcccagtcctataccaacaaggacaaagcctgcactagctgagtcacaacctccagtagtagagccacctgcttctctggaggttgagatactatctccttcaccaactccacgggcaccacctttgatactcattcctgatgactcagatgctgaagctgctgctcctcctgactcgccagcctactacctagaggatggttcggacttttctgactggatggactattga

SEQ ID NO: 82990 - DNA, 333 bp, Glycine max
  Peptide Sequence Number=SeqID_199768
atgtcagtgatgggtttggaagggtggtggtgttggaggagaagaaggaggtggggggtgaagttgaagcaggtggagctgttcctggatggagtcgagtctaatgatgaggtcatggtgagcatcggtgaggatggactggttttggtaagacgaaggaaaacttcttctaaacaattggtggtcttggaacgggtgtggcacttatccatgaggcatggcgtcctgaaggtacgctggcctttgggcattcctcttaggtcgagactggtgcatcccatcaatttctatagttcccttttaatcatgttgaacaattccgtgaaatattga

SEQ ID NO: 82991 - DNA, 315 bp, Glycine max
  Peptide Sequence Number=SeqID_199769
atggctgagttgtatgagacccacgttcatcatctctattacttgtttctcaatctctgccttttgaaagtgatggtgagtatatatttgaagaaggttggtgatagtagggagagggtgttgcaggaaggtggtcaagcattgaagcagaagggaagatgcattcgtcgaagttgttggagcatctacttgaagagtgatggagtggccactatacctaaatttcatggtcaaggtgtcataattggtgatgatgggtccaagctatttgagccattgaatgcagagaacgatgtcgacaccactaatgggtaa

SEQ ID NO: 82992 - DNA, 471 bp, Glycine max
  Peptide Sequence Number=SeqID_199770
atgtctctttttgcatactgcattggtgatggcatgaagttcccggacatgcgtggaggcgcgttgaagacaagggcaaaaaacgggggtcttcgtcataagttgcttgagtttgtcaaaggccaattgggcgtcttagtgccattggaagttgtctttccacaacagggtcgtcaaagaataggccaatctacgattgcttggattttgattgggtctggtgcgaccccttgtgatgacacattgtggtcgaggccaaagaagagaaagtgcaaaaagctcctgataaactcgcttagcgaggcagattggctaagcgagtctcatccgcttagcgaggcagctagctcgcttagcggatgggaaaccctagaagaggataagttagagatctgcgcactcagcatccagccagcccgcccaatgaggacgttgtctcttttcgcgcttagcgcgcccgagctcgcttag

SEQ ID NO: 82993 - DNA, 1245 bp, Glycine max
  Peptide Sequence Number=SeqID_199771
atgctcgtttgcctagcaacaactcgaatttttgggacacattgtatatgccattggagtagctctagacccttcaaagatacaggcgatggtggcttggcccgtccctaccacaactcagtccttacggggatttttgggtttgatcggattttattgcaagttattcaaggatatgcttccatagtagcgccattgacgtccctgcttcagaaggataatttccattggggagttgaggctcaaactgcttttgataacctcaaacaagctatgacacaagccccagtactagccttgtcggacttctctacacccttcatgctagaaacaaatgctttatgtctagccatgggtgttgttcttatgcaatatggccacccactagcctttttcaacaaagctttctgcccttgcttacaacgttcttctacattcattctcacaatacctaatttcaccttccatgatgcattgcacagacatttcctcaccaatgattcattccaggaaaaggttcaacaggtcaccttggaaccgaattcacatcccgatttcaagattcacaatgggtcattattcttccaaaacaagatatggcttaacacagagaacctatttctttcatcgttgatggaggagtttcattcaacccctcttggtggccacctaggtttcgccaaaacccttcatcgtcttcaagcaaacatctattggcccaacatgcgcaaggacatgaggcaatttgttcgcaaatgttctacttgccaacaagttaagtatgaacccaagcggcctgcaggtttactcccaccactaccaatactatcctctccttggaaggagctatcactagacttcatcattggtcttcctccttcgcagggctacactaccattcttgtagtagttgaccgtttcacgaagggagctcactttggggccctagcttcacactacacaactcataaagtagcttttcttttccaagatatggtcggcattactaccttcgaagacacttataggaagccccatccttctatttccacttatttgctaagctcatctaatgtggaagtagtcgatcaccttctctctataagacaggatctttgggcttctttgaccactcgtcttcaaaaaatgcaactcgccatgaagactcaggcaaacagtaaacaacgtgatgtatcatacaaggttggtgactgggtatatctcaaactacacccataccactag

SEQ ID NO: 82994 - DNA, 573 bp, Glycine max
  Peptide Sequence Number=SeqID_199772
atggaacaacgcggtctccctgccatccctactagttctggtacaaaggaatgggttgatgattatcgatggccatcggaggaagggaaacctgaccaacaggagtgggtccttagtgaggcttcaccaatgaaacatggaatatcgagtggattcaagaagaggataaagaagtttgtttctatggacgaagatgaaaaaacaccctatcatggactgagaactaaacatcacgacaatgaatgtcagtgtattatttcatggcgtacccaagaaaataactgggaatggaagggagacgcttgccatatgtcacctcgaaaggtgaaaaccggtgctagaatgaaccgaagtgttgtaggatcattcggcgagtgccagaaatttgaaccattgcgctggtttatcgtggacaaatgcttaaaggtattgttcgagtatgtgattgagaacctctgtttagtcgtctgtctaagggctatggggaaaatcgtgcaacttgcagaaaatgtcaaggaaaagcaacctatgttgtataatgtggaggaagggcaccgaagtgaacccctttag

SEQ ID NO: 82995 - DNA, 898 bp, Glycine max
  Peptide Sequence Number=SeqID_199773
atgataatctacacaacaacaccagctgccatccttctttttgaacaaaagcaccggcgaagagaatgggctctgactggaccggatgaggccagcatcgagcatagaagccatatgtctttccaatttggttttctggcagtaagggtatcagtatggcttcacgttgacaaagttagaatggggaaggagatggataaggtggtggggacaatgcaggaaatggtgagtggtgtagttcgttgttacagggcccagggggaccttaggacatgtggtgccatagtccaaaaggttaccgtttccgaccattacttgcaatgccggtgtggaggaggtggggaagttaagaaatttagcaacccgcgcttgaatgaaattataggtgctaccactatcgttaaggatcatgacgcgatgatgagagatctggccatagatatgaaaggtttcgagcaccagtatcccaaacagaacactaagactaatttgggggtggtcattaagaattttttcgagagagggcaccactgtggacctttgtctcttcggacaaccatctcctccaatgagaggcgtttcacgggtatcctaggattggaagtcgtaggaggtcccgatggttggttcgtcaaaggagggcagagtgagacccataattcggttcacgagtcgctcaaactcattgaggggtcattacagaatgaaggggcgaatctgaattccagagcttggagcatagcctgccatgatgtgaggaaaccgttcctcgacatccattggtaccaacagaagggtggtgtggttctgtgccaggattatttggccatgcatgaaatggatggtggtggtttgacgggtattgtggtctggcatggcaggtcggaccaaatgatag

SEQ ID NO: 82996 - DNA, 696 bp, Glycine max
  Peptide Sequence Number=SeqID_199774
atgggaagacgtgagggaggcgtagacgacgagcacatacttgagaggcaactggacagcattgttatcggaggaatgaagctatatgtcattatcccacgatatgggagacagaggggaggaaaacaacatgagcaagtgcacaggaatgagaacgaagcatctcgtcctatccaaaaaggtgcaagaacaaaccacgcatctttcgcggaggtggttgcgaggaaagaaaataagaatgcatcacacagccgcgaaggtgggctatcatcaatatacctcgagccctctttggacatgctgaaatggcttagtgaagcttgggtagggagattgacgaacccgacgatgtttgacaaggtggaagatgaactgaggtgggattttggagtggatatctcaaccaaatacctgggggatgacatggtcctgctacttgaagtggatgccgagtctgcgtccgggctacaggctgacctgagtccagtgttggggaatcccaatcctagcctgggacgagatgtccatcaagaagatagtggggggtgtatgaagtgcacatactggaggaacgcggatacaccactgacaagtgccagtgtagaagaagcagcgttacggcgtcgtcagaataaattgactccgacggaagcttcatggggtctccggctacggagaaatcacatgagccggtga

SEQ ID NO: 82997 - DNA, 306 bp, Glycine max
  Peptide Sequence Number=SeqID_199775
atgccacctcagctgtctcgccattggcactggcgagacagtgtccacgtcagcccgtgtctcattgctacaactggcggcacccatgtggcacctgtctcgccatttgtcctggcggcatcatccacttgtctccaccccactcataccgccatgcatgctggcgggataggctggggttacgtaaaaaaagtgactcggcttggaaatagttttgaaatagacctattttgggaattagtttctaaaactaaccccattaggtcaaaatgccccaagtttccaatcaactatttgtatctctaa

SEQ ID NO: 82998 - DNA, 234 bp, Glycine max
  Peptide Sequence Number=SeqID_199776
atgggctcaaaatctaccctaaggctcatgagaaccctagggcctttccttgaatctctagcccaatctacttggagtcttctagccaatgcccttgcggggtccaaagtcaagcttctactagaagagatgaccaagaggatcaaggatgaactactcatcaaagtcaaggaaggagaaaatcacaaggagctaaattggagcgtgttgaagattgctgaacagctcgcttag

SEQ ID NO: 82999 - DNA, 1079 bp, Glycine max
  Peptide Sequence Number=SeqID_199777
cccctaatgtatctattaagatagacagtgtgaaagaatttactttcagagaattggcccttgctactaacaattttagcagctcaactaaagttggtcaaggaggttatgggaatgtctacaaaggcattttatctggtgaaacacttgtggccattaaacgagcagcagaaggttctttacaaggcaaaaaagagtttttgactgagattgaacttttatcaaggttacaccatcgaaatcttgtctcgctgattgggtactgcaatgaagaacaggagcagatgctggtctatgaattcatgcccaatggcaccctaagggactggatttctggtaaaagtgaaaaggccaaggaaagacaaaattttggtatggggttgaaaattgcaatgggtgcagccaaagggatactatatcttcatacagatgctgaccctcctatattccaccgagatattaaagccggcaacatacttctggattccaaatttacagctaaagtggctgattttggactgtcacggcttgcatcattcgaagaaggaagtaacaatactaaatacatgtcaacagttgtgaggggaacaccaggttaccttgacccagaatatgtgttgactcaaaagtttactgacaaaagtgatgtctatagcttaggaattgtgtttctggagcttttgacgggcatgcaaccaatatcacgtgggaaacacattatttacgaggttaatcaggcttgtcgatctggcaagatatattccattatagggagcagaatgggtttatgtccatctgattgcttggacaagtttttatctctggccctcagttgttgccaagaaaatccagaggagaggccatcaatgctagatgttgtgagggaactagaaaatattgttgcaatgttatcagaaagtgaagctagtttaccagatgttaccttagataattcaggtgaaatggcaccctcatcatctttaggatctaactcagcaagggaggaccaacacacgtacgcgtatgtgtcaggaagtaatcttgtcagtggtgtcattcccaccattgttcctcgctga

SEQ ID NO: 83000 - DNA, 402 bp, Glycine max
  Peptide Sequence Number=SeqID_199778
atgcagggtcatgagggaaaattctctgtttatgtacattcatcaaaggaaaaaccaatacatgtcagccccttctttgttggccgagacattcacagtgaaccggtaggctggggaaaaatttctatggttgaggcagaaaggagacttttggcacatgcacttttagaccctgataaccaacattttgtcttattgtctgaaagttgtatacctgtgcgccgctttgaatttgtgtacaactacttattattaacaaatgtcagctttattgacaggtatatagaacatatgctgcctgaagtagaaaagaaggatttccgaaagggttcacagattgtagaaacaatgggaacatcattggtttcagttataaagtattttttcctctttataatatga

SEQ ID NO: 83001 - DNA, 1170 bp, Glycine max
  Peptide Sequence Number=SeqID_199779
atgtttcagtacttctttcgttcatcctttccatttgcttgctttccaggatatactgtgatgccgactctaagaattcatggatatgccttgcttgtttcatcttgtttcatcatcctcatagcagcctcacaaacagatccttcagaagtaaatgcactgatagacatcaagaaaagtttgattgatcccatgggcaatatgaggaactggaattcgggagatccgtgtatggcaaactgggcaggggtttggtgctctgatagggaggaggctaatggttacttccatgtccaaaagctgtctttcatgcggaataatttgacaggcacaattccaaaggaaattggaaatattacatcattggaactcttgcttctaagcgggaataagttatctggtactttaccagatgagcttggcaaccttacgaatttagatagattccaagttgatgaaaaccaattgtcaggtcctattccagagtcatttgtcaaaatggtcaaagttaaacatctccacatgaataacaactcgttcaacaatcaacttccatccaagctttcaaagctgcccaatcttgtgcatttgcttgtggacaacaataacttatctggttaccttccaccagaattctctatgttagaacggttaagaatactgcattctatcctttgttctcaaggactccctacactttatgctgattttagctcttcagggcaacctttagatgtttcttctagtcttcagttacatgtataccatactattcagcacattttgcaagtatgttgtcaacttgataacaataatttcagtgggagtgggattccttctacctatgcaaacttttccagtttagtaaaactaagtctgagaaactgcagtctgcaaggaactattcctgatttcagttcaatagccaacctcacctatctagaccttagctggaatcagtttactggacatataccatcagaacttgcagacaatatgacaactattgatctatccaataataatcatctcgatggatcaattcctcgaagcttcatataccctcatcttcaaaaattgtcacttgagaacaatttactgtctggatccatccctgctagcatatgggagaacgtggccttaaatactaaagataaacttacaatgtaa

SEQ ID NO: 83002 - DNA, 645 bp, Glycine max
  Peptide Sequence Number=SeqID_199780
atgaagaaggaacgtgcatggccgcaattcataaggaatcttttgatcatggttggatcaagaagccggccacagttgaggaggcctacttggattattgttctgctttccatagtgtgtgtgtttctgattgctgcctatgtttaccccccgcctagcccttcttcgtgctccgtcttttcctcccatggttgcggtagtagtgcttttgaactgcctccagctgctcatacccgcgaattgactgatgcggaggttcagtctcgggttgtcattaatgagatcctgaactattatcctgtgcaaaccaagaaacctaaagttgcttttttgtttttgactccgggctcgttgcctttcgagaagctctggcacatgttctttcagagtcagagcgatccttctattttctcaagtcttgtgcttggcctccttccagatgattacactttctcctcccttctcaaggcctgtgcaagggagagtggcctcaagccaaccaatgccaccatgcttgttgcacttctgtcgtgtgctttgctagggtcattggacttagggatgtggatccatgagcatgtcaggaagaatgggtatgatcagtatgttaaggaaaatactgcacgtatagatatgcatgcttaa

SEQ ID NO: 83003 - DNA, 237 bp, Glycine max
  Peptide Sequence Number=SeqID_199781
atgaagatttcgacatctaaggcatattcttcatcatctaatccagaaacactgatcgaagatgctaaagctgatacaccgtctacaattgtccgtccaatgggacaaaagacggccaaaaggaagagcaaggggaaaggagtaggaacatctaccaatactgaggcaacaacagtcaacaaagaaggcctagaagagtcattaatcgcaatcgtgaagatgaacatctacgattga

SEQ ID NO: 83004 - DNA, 1908 bp, Glycine max
  Peptide Sequence Number=SeqID_199782
atgaaggaaccatgtgatagtcattggaatgttgtgatacttatccttcgatacctcaaaaatgcaccgggtcgcggattaatatatggagataaaggcaatgccaaaattgtttgctactctgatgctgatcgggcaagatcaccatcagataggaggtccacttctggatattgtgttcccattggagggaacttgacttggaggagcaaaaagccgaatacagttgctagatccagtgctgaagttgagtaccgtgctatggcagcaactgcatctgagattacatggcttaggcaacttctccaacaactaaaatttggagacactcaggatactagactgctatgcgacaatcaaactgctctccacatttcatcaaatctggtcttccatgagcggactaaacacatagaaattgactgtcactttgtgagagagaaggtgctcttaggagaaatcatcactgactttgtcagctcaggcgaccaacttgtagacatgcttactgaatccctcaaagctcctacaatttctacatcacctatgaaagctccccagagacgagcacctacagctacattgtcgagtacttcagacaggggaaggcgttcaaacttgcttcttattcttggaattgtcactggcatactcttcatttccattgtatgtgtacttatactttgcttatgcacaatgaggccaaaaacaaaaacacctcccacagaaactggcctgctactaaggtttgctctcctttctacagaaaagccaaggattgaaagtgcagtttctgctgttgggtctcttccccacccaaccagtacccgctttattgcttatgaagaacttaaagaagcaacaaataattttgaaccagcaagtgtacttggagaaggaggttttggtagagtttataaaggtgtcttaaatgatggaactgctgttgcaattaagagacttactagtggagggcaacaaggtgataaagaatttttagttgaggttgagatgcttagccggttgcatcatcgtaaccttgtaaaactagtgggatactatagcaaccgtgactcatcacaaaatctactttgctacgagcttgtcccaaatggaagcttggaggcctggcttcatggtccgctgggaataaattgccctttggattgggacactagaatgaagatcgcccttgatgctgcaagaggacttgcatacatgcatgaagattcacagccctgtgtaatacacagagatttcaaggcatctaacatattgcttgaaaacaactttcatgctaaagttgcagattttggtctagctaaacaggcacctgaaggcagagctaattatctatctactagagtcatgggcacatttgggtatgtagcgcctgaatatgctatgactggacacctgctagttaaaagcgatgtttatagctacggcgttgtcttgctggaactgttgatcggaaggaaaccagtggatatgtcacagccatctggacaagaaaaccttgttacttgggcaaggccaattcttagagataaggacagcttggaagaacttgctgatccaaggcttgggggaaggtacccaaaggaagattttgtacgtgtttgcactattgctgcagcctgtgttgctcctgaagcaagccaacgacctgcaatgggtgaagtggtacaatcacttaaaatggtgcagcgggtcacagaatctcatgatcctgtgttagcgtcatccaatacacggcccaacctgagacagtcctctaccacttacgattctgatgggacatcttcaatgttttcttcaggtccttactctggtctaagtacctttgactatcacaacatttcgagaacggctgttttctctgaagatcttcatgaaggacgatga

SEQ ID NO: 83005 - DNA, 653 bp, Glycine max
  Peptide Sequence Number=SeqID_199783
gtgcgttgaaatggttgcttgtgttgctatcttgcatggtgtggtttgtggttgattatggtgcgtgtggcagagcactgcagctggaagcaccttctttgtctccagctgcagcacctgttgttgctgttgatgatctgccactgccgacgaatgctcatgggttaaagcatttgcctgcaccgattccgtcacgcgccaatttcaccaaagggagaggagaattacagcccccggtttccgggtttaagaatattgcccctatgcatcccattgctgatgctattccttctgctctcgctcagccaccattgtccccttatgtttccgattgttgcaaacaagacatggtgtggaaacgtggcagtgaggtttgccactgtgcttatcccataaagctagacctacttcttttgaatgtctctgaaaaccccgaccagaatgcttttctcaatgggatcagtttctcggccgaggaagcagctaaaataaactcattgcttttactgcataaggttcaactagaccgcagatttgtgggcgactacaaagtaatcaatataacctggtttaaacctccacctcattctccaggaagagagcgatatgctgatgctaaagggactaatctattgattgctcattccttctga

SEQ ID NO: 83006 - DNA, 138 bp, Glycine max
  Peptide Sequence Number=SeqID_199784
atgggattaaggttgcaaagtaagggtaaggggtcaatgttggagcctagaaggcagaagaaagggaagggagagaggttcaaaagaaaaagtggtctaaggacatctgacatggatccatgtcacggaactcaataa

SEQ ID NO: 83007 - DNA, 255 bp, Glycine max
  Peptide Sequence Number=SeqID_199785
atggaaaattcaggtgcaggcgacgatggtggacagatgtttggagcagaagatgatgttggaggatcagtaggtggcactactggtagtgcctgtgttcgtcaatggtatgtgagtagtggaggtggacttggagcaggagcaatgagtggtgttggaacaacaggagagaaatggcggctcggtggtggcacagcagagctcgcagtggtcgcggttactgttcatgagacaaaaaaggggggctgcggctga

SEQ ID NO: 83008 - DNA, 534 bp, Glycine max
  Peptide Sequence Number=SeqID_199786
atgacaaataacaacaacaacgatcagttcattgttgagggagcatgtctcataagaccactaggcttcacaagagaggactatccatgctggaaggacaaaatggagatgtacatcaagtccactctgtacatactttggttgattattacaaatggagatatatccattcctagaccaaaagcagaatggacaaacacaaatcttgctataattaagcttaacaaaaaacctcattatactctgacatgtgctctatccagaaatgagtacaacaagatttgtggactaaagatagccaaagagattagaaaagttgtcgctctgacgagacactatgagagcttctccatgagagacaaagaatctatggatgacatgtttggaagacttcaagtacttctaaagaaacttgaagctctaggacacaccttcatcaaagctcagataaatctaaagatccatgacaattttcccaaggtatgggaaccgaaaacaatggtcatccaagaagctcaaaatttgaaaacctag

SEQ ID NO: 83009 - DNA, 201 bp, Glycine max
  Peptide Sequence Number=SeqID_199787
atgatttggctggagagagtagtaaatttggctggaaaccaacacttgaaacatgtgattctgatgctcaatgcttggtggattgtggaccatctgactgacttgattcctcagaggacaaattcttacataatcaacactagacctttacttctgagtgtcggtcatcagcctacatcaatgactgacttgcttcactag

SEQ ID NO: 83010 - DNA, 1092 bp, Glycine max
  Peptide Sequence Number=SeqID_199788
atggtgaaactagcttctaaggagcctctttgtggcaaagttcctttggtgcatatctatgattctatcctaaaggttaaagatgtctggaatgggatggattgggatcttcacaagctttattctactcttcctcaatctgctgctgctgatgttgtcagtgttaaacccatgctggtggtaagccttccggatttgtggatctgggagccttgtgtttcatgcactttttcagttagtgcaatctataaatggcttcaagggagctgttttatagtggggctagctggaattggatttggaagcttaaactccctgcgaacatccaattctttgtgtggcagctttgccacaaagcaataccaacctgatctttgcttatggcccgtggtattattcttgatgacacttgcccggtttatcagaatcaccaggaaactattgagcagtatttactccgatgtgattatgctcatgatgtttggagggcttgtggttgatcgtcctcgtggggatgactggattgcttggatcaagcaagcttctcatagatttgggaacatggtccctattgtcttgtgcactaaatggtgcaacagaaatggtcccttttctcggcccatcacttttggttcatggctgtggggagatgttgagatgattgtcttaaatgtggatgagagtgttaccattgatgtcagaaaagctgggtatggaggcctttgcacgaaccatagtggtgactttttggttggtataccggataagtatttggacaagacaagaaggcggacacctaatgtgacataccctatgaagttgggtaccctttcggccatatgccttcttattctatataacatgtctcagtcttttgcatatacaagtggaacaattgggttttatggttatgctggggatactattatcatgcactctgagatcatggcagtcttttctgactctaagcatgttgatgacttgattagagatgggtgccctcagcaacatctttatgctaatgagcttcacactatccatagggattggaatttggattattcagttcgaccgcaacctcagggaggataa

SEQ ID NO: 83011 - DNA, 303 bp, Glycine max
  Peptide Sequence Number=SeqID_199789
atgcatctctctctttctcacactgacccaactccaccacaagttagagaagccgcaaatctagccaaagaagtttgtagatctaccattcaaagttgcagatttgtcgtcccctcccacctccatggtcatcgtcattggagttcagcgctaacttttggaacatcgcgccagagtgttactcacattttctttggatccaatttcgttaccgttaccaaatgcaaagaggttgaacgggaattcttcaaggttgaaacccttgtagctgttatgtattggtggcctttatgttttatgtga

SEQ ID NO: 83012 - DNA, 699 bp, Glycine max
  Peptide Sequence Number=SeqID_199790
atggcgcacacatcccttttcactccctcttcctctcttaggttcaaccctcttcttcttacctccaccccctcttcttcttcttcttctcgctccaacaacctttctttccccgctctctccaggaacctaaggaaatcggtagaagatagaaagattaacaaaaaatctgctgtgaaagcagtgtatggtgatgaattttggacacctgagaggagttcacgtccgggtatttggtctataaggagtgatttgcaagtcccatcttccccttatttccctacctatgcacaagggcaagggccaccccccatggttgccgagcgtttccagagtgttataagtcagctttttcaatatagaataattcggtgtggtggagcagttgatgacgatatggcaaacatcatagttgctcagctcctgtaccttgatgctgttgatcctaacaaggatattgtcatgtatgtaaattctccaggagggtcagttacagctggaatggcaatatttgatacaatgaggcatatccgacctgatgtgtctactgtttgtgttggattagcggctagaccttttaatctgcagtatgggagcttttctgctgagtgcagggacaaaaggaaagagatacagcttgccaaattcaaggataatgattcatcaaccgcttggtggtgctcaaggagggcaaactga

SEQ ID NO: 83013 - DNA, 1777 bp, Glycine max
  Peptide Sequence Number=SeqID_199791
gatatttgctgatgttgctggtgacattacaattgtcgttgatggcgagtcttttcttctgcataagtttcccttggtgactctaagtgggaagatccggaagatggtggctgaagccaagggttccaatgtttcaagcttggagctcatcaactttccagggggtcaccagacatttgaacttgccatgaagttctgttatggaatgaattttgagattacaacatttgatgttgcgcggcttcgatgtgcagcagagtacctagaaatgacagaagaatacagggagcaaaacctcatctcaagaacagatatttatctgaatgagattgtatttcaaagtcttcagaagtcagtggaagtgctatccacctgtgagatgttacctccagatacagtggatgaaattgaaatatcaaacggatgcgtggaagccattgcaatgaatgcttgcaaggagcaactagtttctggtttatctaaattagactgtgatggtaaatctgaagagctaaaggaggattgtgttgcatggtgggttgaagatctctcggttttgcgaatagattacttccaaagagttatttgtgccatgggaagaatgggggtgagatcggacagcattattgcatcactgatgcattatgctcaatcatcattaaagggcattggaaagtgtcaattttggaatccatcaaggacaaactcaagtccaactagtgtagaaaaggaccagaggataattgtggaaactctagtaagtctcatgccaacagacaaaagctcttccattccattgacatttttgtttggcatgttaaagatggctatcatgttgggtgccactatcccctgtaggcttgagcttgaaaggaggatcgcgttacggttggaaatggtctcactagatgatctgcttataccatctctacagagtggggactccttatttgatgttgatacagttcacaggctactggtgaatttcttgcaacgggttgaagaggaagaaaccgaagattatgggtatgaatctgatgggttttgttcttctggccatggttctctgctaaaagtgggacagcttattgatgcttatttagcagaaattgctcctgatccctacttaagtctacagaaattcattgctttgattgagatacttcctgattatgctcgtggaagaaatatctatgattccaaaattctaatggttgggcacttcctagttaaacctcatattctcaatcatgcacatccagcactaacagaacaagaatgcaagaagctatgcaagttgatagactgccagaagctgtctgaagaagcatgcaaccatgcagcccagaatgacagacttccactgcaaatggtggtgcaagtcttgtacttcgagcagctgcgtttgaagaacgcgttgtcgggcagttccggagacgggctgctgtcgcagagaataagcagtggtgttccaagtgcagccatgtcccctagggacaactatgcttctctgcgaagagagaaccgggaactgaagctggagatttcaagaatgagggtgaggctgagtgagttggagaaggagcagatgttcatgaaacaaggcatcattgacaaggcaggaaatggaagaacattcttaacctcactttctaagggaatagggagaattgcaatttttagcagtcaaggcgggggaaagcgccagaaatcaggtaggaagtctcggggttcggaggggaaaactggtaggagtaggagatattctgtttcatag

SEQ ID NO: 83014 - DNA, 219 bp, Glycine max
  Peptide Sequence Number=SeqID_199792
atggtcttcttcataggcactccattgtacaggcacaggttgttaggaggtagctctcttactcgtgttgctcaagtcttggttgctacatttagaaagagaaaggcctcttttggtagcaatgagttcataggcttgtatgaggttcctgttaggcagtctgttatcaagggaagtcaaaagattgctcacacgaatgatttctggggagaaacataa

SEQ ID NO: 83015 - DNA, 564 bp, Glycine max
  Peptide Sequence Number=SeqID_199793
atgggcactgcactgcacctctgcgttagtttcaatcctgctcaaggtttttactcacccacacgcttttctctctgcaacgcattctcttcacattctttaaaacttacgcccaaaatttttcagagagcacttcctatacgtatattatcagtggggaagaagcgatcacgtggactgcaactcatggttgatgagtatgtggataagctcaggtactattgcagtgttgaggatgttcaaatacggccaaatcctcaaaatgcacgtgaccaaagggctcaggttgatgccgaagatgaggcagtgatgaaccttataaggtctgatgattgggttgtgatgttggatgaacgtgggcaagacattggatctgagcaaatggcagagttggtgggtgatgcaggaaatactggtgcttcacgattatccttttgtattggtgggccatatggacatggaagaaaaatgagggaacgggctaacttatcaatcaagttatcctcgctggtcttaaatcatcaaatagcattacttgtgctcgtggaacagctttacaggtag

SEQ ID NO: 83016 - DNA, 249 bp, Glycine max
  Peptide Sequence Number=SeqID_199794
atggaagcaacaagatcgacattcatcaggaccgggaaacggagcgtaacggtaacagagttgggcgttggagggttgagtttgaacggagaagagggaaggaagagagacgcagccatggcgattccacttagccgtaacgcgacagtgacgcaaaataaagctgaagcctcacacgtgccacgtgtgatgaaaatcgagttggggtcttacatgagtagaattattgggttttgtgatgccacgtag

SEQ ID NO: 83017 - DNA, 168 bp, Glycine max
  Peptide Sequence Number=SeqID_199795
atggaaacgacgttgaacgacgagaaggcccatgcggtcgcgcggatgttgttgaagtacttggacatgatggatgcgaaggagaacgagaagccaaagagtgatgaggaggaggacgaagaggatggtggcatgaaggcgtttgagtgtggcaatggtggttgctag

SEQ ID NO: 83018 - DNA, 285 bp, Glycine max
  Peptide Sequence Number=SeqID_199796
atggagggtttagtctctcattgttatgagaggcttttaaaattgcaagtggttgatgggaagagaagaagaccaataggaatgatgatggggaaggaatgctcccaaagtctcacgctaagcgcgattgttgcgcttagcatcttaagttctcagctttttggccttctccctgttcgtcgaaagagttcctttgaggagatattctgcaattttgattttccaactttcgagctcttctatttctatctgcaagcactccttggtcgacacactgggacatga

SEQ ID NO: 83019 - DNA, 251 bp, Glycine max
  Peptide Sequence Number=SeqID_199797
atggaggaaggaggtgcaacatgggcgggggcagcggtgtatgacagcaacgatgcgacggcggagaaagggactatcgcttctggacatcagtggcggcctccgatggatctcatgacggtgcttgacattggcaatagcatgagcaacgcggaacttcacatgctaaagcgcgcaatgcggttggttatatcttctctcggcgcggctaactggcttgctgtcgtggctttcatgattgattccaaacg

SEQ ID NO: 83020 - DNA, 843 bp, Glycine max
  Peptide Sequence Number=SeqID_199798
atgtcaaaaatgggtaattggaagaaaaaatgcagagagttgttgaggccaagagaggtcttgtacctcctcaccatcacaatcctcagcctcctcctccctttgtctttcttactcttagccactctctccggtgcccaatactaccttcaagccctcacttattattcctcacaaccctttccctatcttttccaccttgccctcaatatcaacccatgtattctttattttctcgtgtccattgtgagcgtggggaccctgatccaggggctgatgggtaaaatcacactcttgagcgagttaccctccaagtcctcgcgtatctccacagcgtggattttgctatgcgcctttcaagtttgcgttggtttgggcattgagggaagcattgcggccgggctttacgacgatgatgacgtgtcaagttttggggccgagagaagcctgttgagcaggatgatatttctgttgggcctgcacgagacgacccacgtttggtgtaggatggtggtgaggcccgtggtggatgacacggtgttcggtggtgcccgaagggagaggtgggtcgagagagtgggccaggctgcgggcctgggcacgctgtggtggtggaggctgagggaggaggtggagactttggtggttgtggcccaagtgaagagtgagcaactaatggatgtgggccttggtgactttgttggatggtggttgtattacctcattgtcactattgggatggtcaggatcgtgaagggtctcatgtggattttcatgatttctctatgtagaacaaggccaacaatagaggttgaatcgagtcagaacgatgacaaggtgtaa

SEQ ID NO: 83021 - DNA, 661 bp, Glycine max
  Peptide Sequence Number=SeqID_199799
atgaaaaagaaattactgttttttatggtattgcctatggcaatatcagcacaagtagggattaatacaacccaacccacaaaaactcttgatgtaaatggagagctaagggttcgaactttaaatcagggaactgaaacggatgttattctctcggcagatgcagccgggaatgtaagaaaaatttcgagaaatgaattgaacggtggtggatcatcaggtttcaattccacgattctgggatatgatccccagcctgtctccaaaagacaaattccgccaggaccagttccgggagggggaacagctacagaactcggatgtaaaaaatgggctgttaataaccatacctattgtgcgtaccagatttctcaacctattacctggttcaatgcgtttaactttggaaagcaaatgggaggctatcttgtaacaatgcccagtgatacagaaagagcatgggtaaatacaaatattgtagcatccggaactggatataatctggccaacaatatttggataggattcaataagatcagaagaccggggaaccccgaccagctacaatggatcaccggggaagagttcagaatcaattggtcgacgaatccggcaacaactgaaaactggttcgcatccggagagcctaataacgccggag

SEQ ID NO: 83022 - DNA, 1893 bp, Glycine max
  Peptide Sequence Number=SeqID_199800
atggagaagaagaaggaagaaggagggaaagtggggctgagaaagaagccatgtggaatgatgagtggtaggaatgtgagagagtctctattgggatccctcaaccatcaccgtagagggcatagttttaatggggtggccaacaacaaccaccaccacgatgacaacctcgatcttttctccgacaaccgtcgctccctcgctcttgctgcttcttctgatgactcttcagatgtttcggtgaaactggggaggctctcagttggaacagcgaaaccggttagaagtgggattgatgatctgttatcatctacagaaggagggaagcatgattatgactggcttctcactcccccggggacccctgtttttccatcagaaggagaatcccaaacaaccttagctcctccaaggagaagtttgactagatcaacatctacctctaaggcctcaagggaggattaccctcctccctaccagcaaggtgccagggtctttgcttttttggggggtttcggagtgaagaaggataagcttgcagtctcacaatcagagaacaatcccccctctagaccagcaagaagcagttcagtaactcgctcttccatttccacttcacactcacagtacagctcctattcttcaaacagacactcatcttcaatcctcaacacaagttcagcctcagtttcatcttacattagaccatcttcccccgtaactcactcttcatctgcagcaaggccttccactccctcgtctcgccccacagcatcgcggtcctcaacaccctccaaaccgcgttcagtttccaccaactctactgctgaaaagaatagaccatcatcacaaggctcaagaccttccactcctagttctaggcctcacattcctgcgaacttgcattctccatctgcttcatcaactcgatcactgtctcggccttctactcccacacgtaggagctcaatgccatctttatctccatcaccttcccctacgacaggttctttaacttcagcaggccgtgtttcatcgaatggacgcagttcagcacctgcatcaaggccaagctcaccaagcccgcgagttaggcctccacctcagccaattgttccacctgatttcccacttgaaacaccaccaaacctgagaacaacattgcctgataggccggtttctgcaggccgatcacgtcctggtggtgtcactatgaaggcaaatgtttctgaaactcaagcctccccagttactatgccaaggaggcattcatctcctattgttagtagggggagagtgacagaacctgcagcaaaaacccgtggctattccaatggccatcatgctgatgcttctgagcctagaaaagtctcacatgctcctgaggtggctgcaaggaaatctattaggtcctcaactactgctcctgacaacactggatttgggaggactatctcaaagaaatccttggatatggctattaagcacatggatataaggaacagctcaggaaatattcgttcactatcaagcaccacactctttcctcaaagtattagaacttccacttccaaatctcatcgagtctcgagtgctccagcatctgttgacatgaatggaagcatgataagcagtaaaaatggagccaattttgatgtgggaaatggtattgataggaatatgatgatgaaaggaagagatgcagatgaaagacaatattctgcaaaactgagcgaagtggacatctatgagagttctcgttatgatgcactattgtttaaagaagatttgaagaacacaaactggctgcatggtgctgatgataagtgtgatcaaggccccatatttgataatggatttgagcaccttcctgaaccttttggcctcttataa

SEQ ID NO: 83023 - DNA, 1824 bp, Glycine max
  Peptide Sequence Number=SeqID_199801
atgatgctacagtcctactttaccacaataccaattttcctactcctgcttgtgtttactcgaactaaagctgatctacagtcagaaaagcaagccctccttgattttgctgctgcacttcatcatggtccaaaggtcaattggaactctagtacctcaatctgcacttcatgggtgggagttacatgcagtcatgatggctctcatgtgctttctgtgaggcttccaggtgtcggattgcgtggttttctcccaccaagaacacttggtaagcttaatggcctcattagtctcagtcttaggtccaacagcttgagggggaaccttccaactgacctactttcccttccttccctgcgctttgtatatctccaacacaacaacttctcaggtgttattcctgattctctgccaccacggcttatctttcttgatttgtcccataactcttttacaggacaaattccagcctcaatccaaaacttgacacatctgataggatttaacctccaaaacaactctctcacaggacctattcctgatgttaaccttcctagccttaaggatttggatttgagcttcaactacttgaatggatctattccttcaggtctccataagtttcctgcctcctcatttagagggaatttgatgttatgtggagcacctttgaaacaatgttcttcagtttcccctaataccacattgtctccaccaacagtctctcaaagaccaagtgatctatcaaacaggaaaatgagcaagggagcaaaaatagcaatagttttggggggtgtcacattgctgtttcttccaggtctcttagtagtgttcttctgtttcaagaaaaaagttggtgaacaaaatgtagcacctaaagagaaaggtcagaagcttaaggaggactttgggagtggtgtgcaagagcccgagagaaacaagcttgtattctttgaaggttgttcttataattttgatctggaggacttgttaagagcttcagctgaagtccttgggaagggaagtgctggaacaacatacaaagccatcttggaggatggaacaacagtagttgtgaagaggttaagagaagtggcaatgggaaaaaaagaatttgaacagcaaatggagattgtccaaagacttgatcatcacccaaatgtgattccccttcgtgcttactactattccaaagatgaaaaactaatggtttatgactactcaacagccggcagtttttccaagttattgcatggaacaacggaaactggacgagctcctctagattggcatacaagattgaagatcatagttggagctgctaggggccttgctcatatccactcagccaatggaaagaaacttgtccatggcaatataaaatcatctaatgtgattctctcaatagatcttcaaggctgcatatcagattttggcctaactcccctaacaaatttctgtggttcctccagaagtccaggctatggatcacctgaagttatcgaatcacgaaaatcaactcaaaaatctgatgtgtacagctttggtgttctcctccttgagatgctgactggcaaaacaccagttcagtattcagggcatgatgaagtggttgatcttccaaagtgggtccaatctgttgttagagaggaatggactgctgaagtgtttgatcttgagctaatgaggtatccgaacattgaagatgaacttgtgcagatgctgcaactggcaatggcatgcgtggcagtgatgccggacgtgagaccttcaatggaggaagttgtcaggacaattgaagaacttagagcatccatttattaa

SEQ ID NO: 83024 - DNA, 330 bp, Glycine max
  Peptide Sequence Number=SeqID_199802
atgacctccagcagcctaaggaggaagctgaaaaatatttttaaagatttcacaatcagctttggcaaaacaagcaacaagcaacaagaggcaaagcgggggagggagctcacaagaattttcagcacccaacaacatcaaaacaaggcgctaaataaccccaacacagggtgtttcgccagtgggaatgacaacacctacatgcaacctgtttcgctgaccaggctggcgatacatacttgcacctgccacttgaaaagcgcgcctaccccctgccacctgaggcctagcctagtgcccctgttaaggctcagtgaatacttgcaatga

SEQ ID NO: 83025 - DNA, 931 bp, Glycine max
  Peptide Sequence Number=SeqID_199803
cctcctcctcctactctctgccatacccatcggaatcatcgtcactctagagcgagccaaacccgccacccacgtctaccactaccacagtaacggctggttccgagaatgcgccaagtgggattctcataaccgccgcttcattgtttccttcttcgaaggtggtcttggtcaggttttgctgccggagaaggattatgagtcatcgccgccgttggaggaagtcacggtggtcaaagagacccacttggccggaaatgcctccttgggcatcgccattgacgcacctagaaatcgagtcctcgtcgttaacgctgacgtgatcggtaatcgatacggcgcgcttgcagcatatgatctctccacctggaatcgcctctttttaacccaacttagcgctcccagtgatgagaaatcattcgcagatgatgttgcagttgatgcagaaggcaatgcctatgttacagatgcaaaaggcaataaaatctggaaagttggggtggaagggaagcttatatcaatcattagaaacccactgtttacttcaaaagagtggtataagaacttggttgggctaaatggaatagtttatcacccagatgggttcctgattgtgattcacactttcagcggcaatttgtttaagattgatttaacaaaaggagaggaagtgaagataataaagttaaaggaagggaccctttcttttggagatggtttagaactgttgtctcccactaagcttgtagttgctggaaatccttctggaagattagtggagagcactgatgggtggaacacagcttctgttgtgggaacattctcagggcctaagcatcgcttggccacagcagcaactgtgaaggacgggaagaaatctaaacattggggaactgggaatgtggggatcatacatttacaggacgtttag

SEQ ID NO: 83026 - DNA, 2538 bp, Glycine max
  Peptide Sequence Number=SeqID_199804
atggtgtccaaacctaccgactcggcttccaaacctcgaaaacaacttggagagccagcaaatgatggtattggaagcttgtccctcgagttaaatcagttaaaaaagcaaatccaggcggagagaattgtgtgcattaaagaaaaaattcggagcaatgagaagaagctacagtgtcatatgtcaggagtcctgtcagaaacatcaacaaggggttcttcacagacagaggaaaataggaaaaatccaattctttcttcaagaattgaccatcctttatgtaaattcagtggtttctctccagtctggggagacaaggaccacaacaatcaagatgtattatctgctacaagtatcaaaatgccttatattgaaacactaccaccatatacctcttggatatttctggacagaaatcagaggatggcggaagatcagtcagtggttggaagaagacgcatatactatgatcaacatggaagtgaagcactgatatgtagcgacagtgaggaggagttaacagaacctgaggaagaaaaacatgaattttctgaggctgaagatcgtgtcatatggatggcatttgaggaatatgggttaaacaaggaggtaccaaatattgttagtgaatttgttgggggcaccagtttagaaattcaggagaggtacaaaactatcaaggaaaagaacattggaaggttggaccagccttctcaaaactcaggagaatatgaatctactattggcatatgtctagagaaaagcctgagtgctgcattagattcttttgataatcttttttgtcgccgttgcctgatttttgactgtcgtctgcatggctgttctcaacctttaatatatcatagtgaaaagcagacagtttggtctgatcctgaaggagacaggaaaccttgcagtgatcagtgttaccttcagttaaaggtagtaaaaaatgtgacagaagattcaacttctgggtctgatcagaataagagaactacaattacagaagaggcagatgtgatattggctccctccattatagaggaacctagtaatcagagtataataccttttcaaacagaagttgattgtcatggatctctcaatttaaatgttcctatctcagtgagtgtggaaaaacggaaagtcctaaatcagtcagacatgtcaccccgtgactcaacactccatcccaatgattgtcagaattcttataaaaagctgaaggcaatctctgatgctgtagttactgtaaatagtgattctagcaagaaaataagtttgggtgcatgtggtgaaagtatacatacaattactagtgcaattttggacaaatctgttaaagataactcaattaaattaatagattcttctagcacttgccctagtgatgagcaggacaaaagtattggtgatggaccaaaagatcctacaaatgagacagaatttaagatgtccaattcaatggaggggatagttgatgggatgctaagtctctcagattggaaacctctggagaaagaactatacttaaagggagtagaactgtttggcagaaacagttgcctcatagcaaggaacttacttcctggtctgaagacttgtatggaaatagctagttacatgcattctggaggagtgtcaatgccccacggatctattgttgctcctagttcaatcatggaagaaaagggaaaatttgatgctgactgcacagaccaggagatgccatctaggtcacggttgctgaggaaaaggggcaaaacaaggaagtttaaatattcttggaaatctgctggccacccatcaatatggaaaagaattgctgatgggaaaaaccaatcttgcaagcagtatacaccatgtggatgtcagtcaatgtgtggaaaggaatttgttcaaaaagctgcaaaaatcggttcagaggatgccattgtgccaagagtcagtgtagaagtcgacaatgcccatgttttgctgcaggacgggaatgtgatccagatgtctgtcggaattgctgggcttttgaatgaacatgtctcgaatctattgcttcacctgatcaagaaagtcattgattcacaaaaccacagtaatattttgtaccccaataatccagtatttcagtgttgtggggatggttcgttaggggagccacctcggcgtggagaagggcaatgtggaaatatgaggcttctattgagacaacaacaaaggattctcttggcaaagtctgatgttgcaggatggggagccttcttgaagtacgttcttgatgcttatcgcaaaggagacaagttgaaatttgcaaaccactcatcaaaccccaattgctatgcaaaggtgatgctggttgctggagatcaccgagtaggcatatttgccaaggaacacatcgatgctagtgaggagctcttctatgattatcgttatggtcccgatcaagcaccaccatgggcacgtaaacctgagggttctaagagagacgaatcaacagctcctcaaggcagggctaagaaacaccagtctcattga

SEQ ID NO: 83027 - DNA, 2595 bp, Glycine max
  Peptide Sequence Number=SeqID_199805
atgttgtccatcttctgcaacatttttaggcatattgataggacccagccagctgcaggaatgccacatgagcagttgattcatcatgagtcaaatgggcccaaggagctattagatgagttgaatggagctaagttttattccaaactggatttaaagtctggttaccaccaagttagagtaaaggaatctgatgtccataagacagcatttaggacgcatgagggacattatgagtttcttgtgatgccctttggactcatgaatgccccttcaactttccaaagtctgatgaaccatgtgttgagtctactgtcctcccacagtctagtcgccaatagaaagaagtgtcactttgctcaaagggcagtagagtatttggggcatttaataacagaagagggagttgctgtagaccctagtaaagtggccagtgtgattaagtggccacagcctaagaatgtcaagggggttagaggattcttgggcctcacaggatactatagaagattcataaaagattatgggaaagttgcgagaccgctaactgagcttaccaagaaggacaattttaaatggggagaggaagctcaacaatcttttgaagctttgaaggaaaaactcactacagcacctgttcttgctctgcctgatttttctaaaaattttgtgattgaatgtgatgcgtcgggaggaggtgccctgggaacacggaatttggttaaatctacttatgaaaaggagttgatggcggttgtgctagccatacaacactggagaccctatcttttggggaggaagtttgtagtatccactgaccaaaagagtctgaaacaactgttgcaacagagggtggttaatgctgatcagcaaaactgggcttccaagttgttggggtatgattttgagattgtgtataaacaagggagattgaacaggggggcagacgcgctgtccagaattaacaaggggctggagttaaacactattaattcttatgtgaaatggatgcaagaagaacaagtgcgggcagaaaataagcaagatgagaagttacagagaataacgaaggaagtgcaggaagatcccactctgtggcctggatatgagtatagacagggtgtattactatatgaaggcaggttggtaatttcaaacaagtctgaattaattcctacactgttagaagaatttcattcttccccacatggaggacactctgggttttacaaaacctacagaaggcttgccgcgaatgtatactgggtgggcatgaaaaggaccattcaagagtttgtgaagggctgtgacacctgtcagaggcagaaatatatggcatcatccccagggggtctactccagcctttaccaattcctgcacaagtatgggaggatatctctatagacttcattacaggcttgcccaaatcaaaggggtatgaagctatcctggtagtggtagacaggttatctaaatattcccattttataccacttaggcatccttatactgcaaggagcgttgctgatgtgttttgtaaagagataattaggcttcatggagtaccactgtctatagtgagtgatcgagaccccatatttatgagtagtttttggaaggaattgttcaaaatgcaggggacaaagctcaaaatgagtactgcatatcaccctgaatctgatgggcagacagaggtagtaaataggtgcctagaaacctatttaaggtgtttcatttcagaccagcctaagacttggatgtcatgggtacattgggctgagtattggtttaacaccacattccacgccgccacagagaagacacctttcgagatagtatatgggaggcccccaccggtgttgaccagatggctgcagggtgaaactagagtggaagctgtgcagagggatttgctggacagggacgaggctctgagacagttgaagagtcaactgttaagagcgcaagacagaatgaggaatcaagctgataaaaggcgtgtggataggagttttgtgtgtggagaatgggtgtttgtcaagcttagagcacatagacaaaagtctgtggtgtccagaattaatgccaagttagctgctagatattatggcccataccctattatagagaagataggagcagttgcatacaggctaaaattaccagaggggtccagagtgcaccctgttttccatgtgtctttgttgaagaaggctgttgggagatatgaggagaaagaagaactaccggacctgttggaagaacacattgagatgtatgaaccggaggcagtgttggcagccaggaaagtgaaacagcaaggggaagaagtcaaacaggttctaattcattggaagggcaaaactgtggaggaagcaacatgggaagatgagattatgatcagaagccaatttccaaagtttggccttgaggacaaggccacaacagaagaagggggtattgataggacccagccagctgcaggaatgccacatgagcagttgattcatcatgagtcaaatgggcccaaggtttggaaggatgtagtgggaggggaaaaagggggcagctgggaaattggaggaatattctag

SEQ ID NO: 83028 - DNA, 503 bp, Glycine max
  Peptide Sequence Number=SeqID_199806
ataggttagacagtgatgatgaaaacaagaatagagaaacaaatttaacaggatgcaaaactaatgagaactatggaagaattagaaattggcaattattttataataaagctagggataatgattctgatcataatgtggattttgctgctgggaatgtgaaacttattaccaccaaagaagcgtgggaccaatatttggaagaagcaaggagggatggcaaaattgtgattgcaaatttcagtgcagcatggtgtggtccttgtaagatgattgcaccatattactgtgagttatctgagaaatacacttctatgatgttcttggtagttgatgtggatgaactaactgactttagcacttcatgggacatcaaagccacaccaactttcttctttcttaaagatggacaacaacttgacaaacttgtaggagccaacaagccagaactgcagaagaagattgttgccattaatgattcgcttcccgaatataagcagtga

SEQ ID NO: 83029 - DNA, 600 bp, Glycine max
  Peptide Sequence Number=SeqID_199807
atggcccaggttcacgttccgcctcataatgcgattctcgttcgcaacggtggtggtactgttagaaatcagttcgtgacgacgtcgctatacgttggagatctcgacccgaacgtcacggacgcccaactgtatgatttgttcaaccaattggggcaagtcgtatccgttaggatttgtagggacttgacaggaggagatccggtgatgtacgagaggaagaggaagcgtatggagtcgaaccgcgagtccgcccggcgatcgcggatgaagaagcagaagcagctcgaagacctaaccgacgaagtgagccgattggaaggcgagaacgcgcgtttggcgccgagcataaaagtgaaggaggaagcgtacgttgagatggaggccgccaacgacatcctcagagcacagaccatggaactcgccgaccggttaaggtttctgaactccattattgagatcgccgatgaggtcggcggcgaatccttcgagattccgcagattccggaccctctcttcatgccctggcagatcccccaccctatgatggcaacgccgcctgacatgttcttccatggaaatgaaggcctgtttgcttga

SEQ ID NO: 83030 - DNA, 5296 bp, Glycine max
  Peptide Sequence Number=SeqID_199808
atggattcgaggaagggcaaagcttctgtttctgcatcttcactgagtgctgcacctttgagtgtttcaaataaggtggatcagatggtgtcgccccctagggatgtgagagctgttgagactgatgaggaacttttagagcatcagcttctacctagaagatatcatgcttggttttcaagaagtggtgaacccagtggggatgatgcggatgaagatgatgatggcatctctttacctttagattacagcaatctagtgggcaggtatcctcacataactaaggatcatttggtgaagcttctgaagcaattgatgctgagtacggtcaatcctttgcatggaaaacttgaaggaagtagtcctaatgcagctgatgttcctactttacttggatatggttcattttcgcttcttaatgttgatagaaaaacagctgacaaactggtgaagccccctccactttacatgcgttggccacatatgaaggctaatcaggttcaggggctaagtttaagggagattggaggtggttttactaagcaccatcgttctccatccattcgcagtgcatgttatgcaatcgccaaaccatctactatggtgcaaaagatgcaaaatattaaaaagctaagggggcaccgtgtggctgtctattgtgccatatttgatggatccgggagatatgttattagtggttcagatgatcgtcttgtcaagatttggtctatggaaactgcattttgcttagctagttgccgtggacatgaaggtgatattactgatttggctgtaagctcaaacaatgctttggtggcatctgcttcaaatgattttgtcattcgagtttggcgcttaccagatgggatgccgatatcagttttgcggggacatactggagcaggcaatgctccaccagctagtttgccatcctcaagtaatgttcaacaaagctatcaagtactttgttgtgcatataatgcaaatggaactgtttttgttactggtagctctgatacttatgccagggtgtggagtgctttgaagcccaacactgatgacgcagaacaaccaatacacgagatggatttattatctggccacgagaatgatgttaattatgtgcagtttagcggttgctctgtggcttcaaaaattttgacatctgacccctggaaagaagaaaatactttgaagttccgaaatttctggtattgtcatgataacatagttacctgctctcgtgatggtagtgcaattatatgggttcccagatcacgtaaatctcatggaaaagtaggacgctggactcgtgcatatcatttaaaagtgccaccaccgcctctgcctccccaacctccacgaggtggtccaaggcagagatttctacctacacctcgtggtgtcaatatgattatatggagcctggacaatcgctttgtgcttgcagctattatgggtaatctacttgctaaccctttgttgtatgaaaatagggggagaggaaataattcttatgttttggatgttcaccctttcaaccctcgaatagctatgagtgctgggtatgacggacgaaccattgtgtgggatatatgggagggcatacctattcggacatatgaaattggacgttttaagttggttgatgggaagttttctccgaacatgcgcaacctgcagttgcttgcttatcacctaagagatccagttccatgtgcttggtccttcctagcatgtagaattgggttaaataaccttctgaattctgagcgagcagccacattctgtctcttagaccatcaagagactagattagacccaagaaaaatagaggcactagaagtagatctcctatcatcaaagtcccaggtcccaagaaacagtaccttaaagatacctaagtatccttttcactaccgtccagtgctgttccagaggttgagacatgagttgacatttttgttgacagagaaactgatctcaggcctagtaatggattggctattgacagagaaactactgataaggccttttggtatggcacccacaacaaacttgtataggctagcatcaaggagtgttggattttgcaggatggacggaacatcaattgtgctttcagatgatgttggccaaatatattttctgaacacaggtcaaggcgagtcccagaaagatgcaaaatatgatcagttttttcttggtgattatcgaccccttattcaggatactcagggatatgttcttgatcaggttgtgagtagtcattgtgcccctgagactcaacttccaccacaccgaagaaacattcaggaacctctatgtgattctagtatgctgccatatccagaaccttatcagagtcaatttcagcaacgtcgacttggtgctcttggcattgaatggcgtccttcattgataaaatatgctgttggtccagattttactgttggtcaggactacccagtggtacctttggtagatttggaagtaatggttgagccacaaccagagttcttagatgccatgttctgggagccagaatatgacattattgtaagcgatgatgctgactctgaatacaatgcaaatgaggatagttctagtgcagccgggcaagggagtgttatctcttctagtgatctagaatatagtgatgactctagtaatagggacggccttcgaagatcaagaaggaaaaaacataatgttggagtaatgacttcctctggaaggcgtgtaaggaaaaggaatttggatgagtgtaatggtaatacttctggaagtaacagactccgcaagaaatccaagggcagctcaaaagcctcaaaaaggaaatcttccatagctaagacattgagaccccagcgaattgctgcacataatgctcgtagtatgttctctcaaattgatgaaacatctactgatggggaagataatgattctgatgaagaagcatcagacagtttccaagatcctgatgatcttagtgaatctgagagggaaatggataataaacatcttgaaattaaaaagccccttttagaaaagtttgcaactgtgtccaagcctcctgcattctctgagtccctggtaaatgttgaaactagaccgagactggttgttaagttttcacttcgtgattctaagaagaatgtgcccactgaggacacaagactagcttgtgagactcaggataatatggtatcccagtcttctagacctcaacctgaagaaagtgatcaaaaaacttttccagacacaaaatcgttggaccctgcattatcttctatggttgcaactaatgctgaacttccccaaagcctcaacggaaatgaaaatgatgataaagaacaaactgaaaatgctacaaataatctgtatgcattcagatatgttgaggcaaacacagatcagtgcagaaagatgaagacacacacacatgaactttcaagatcaggggatgctttgctgactgatgctgaaattgatgaccttcttgaacacaatgctaatgggtatgtaaagcctgagatgaatctcagaaaaaggagatcagaacatgtgattggcaagttagagactgtcgggagtatggttaatacagagctgactgattttgaagatgcacctaaattttcatcgcttgaaccttcattgtttggcaatcctcagccaaatgctgatggctccttgacatctggttatgataagttcaatgaaggtgataaaggccagtctggatctgacaaatgtgcagaggacacactagaaaacaatgaagttgttcactcaagccattgccatgacctcaaaatgaaagcacctgtgaaatcaaccaagttagttattaaaaagaaacaaatttcagcagacactgaaggtccttgcaaactgaaaattgttagttctaaggcagattcaagctgtgctagaggtattgggatatctgaaaattcctcctctatggggcctaatctagtcacagaagtaccagaaggtgaagatgacagaaaatttagttctccacagctactgcattcatattctgacaagagaagttatgatcacttccataaaagggacaagtcatataaagggaaagtcaatcaagatggttttgaatcttttgattgtgatatgggagaacatacttctgttttcagcaaccaacatggtttaggaattggtttgtctgatgttacaagtgatcctatgcgtcaaacacggtttataaggatgaagacaacttctgaggagccaagcacttcaaacagaagaattaaaattcgacagggtcaaagttccaggggaaaatctgatcgggaagactcttctaccagaatgtcagatcaacttcatcgaagaataaggacagccagacacaggaatggtgaatatattgccaatgattctggtactttaactcgaagggtgtcaaatcaccatgtcaaaaaattgtcatggctgatgttgtcagagcctgaagagggttaccgatatattcctcaacttggtgatgaagttgtgtacttaagacagggccatcaagagtacataaagtcatattcattatctgaatcaggtccatggagatcatttacagggctaggtgcttctgaaatttgcaaggttgaagaacttgagtatgcagagctaccaggctctggggatagctgttgtaaacttaaacttagatttctagatccttcttcgtgtgtgcatggcaaatcgtttaaattaactctacctgaattgattaacttcactgattttgttattgagaaaacatggtatgatactgccatgaagagaaattggtcttcaagagataaatgcatggtctggtggagaaatgaagatgggaaaggtggaagttggtgggatggtcgaattattcaagtgcaggccaaatctgatgacttcccagagagtccttgggaaaggtatcgggtccagtacaagactgatcccaccgagaatcatctgcatagtccgtgggaactatatgattctgagatgctatgggagcatccccacattgatcatgagatcagagataagctgctttcctatttcaccaaattagaccgcagggagaggtttgatatccaagcactgaaccaagtagctgagaaattagagtttgcaaacaggtttcctgccccattctatcctgaactaattcaatcaaggttgaagaatgactactatcggagtgtggaaggagaatatcagaatggtttagaaggaaacttgaaaggatatagaaagctcaaattggattttatag

SEQ ID NO: 83031 - DNA, 600 bp, Glycine max
  Peptide Sequence Number=SeqID_199809
atgtctgttagagatgtggtcacgtggaactccatggttggaggttacgtcaaaaactcgcgtttcttcgatgcgttgagtattttccggcggatgctgagtgacaaggttgagcctgatgggttcacctttgctttggtggttactgcatgtgcgcgccttggggctcggcaatgccaaatgggtgcatggtttgatggattgatgtttcaagacaggtttagtgggttggcaattcatgggcttgcaatgaatgcgaatgtggtgttttcgaggatgcagatggagagtgttttgccagattctattacttttattgggattttaactgcttgtagtcactgtggattcgttgaagaaggtcacaagtattttggtatgatgcagaaccgtttcatgattcagccacagcttaagcattatggaaccgtggttgatctcttgggacgagcagggctcatggaagatgttatctggagagcacttttgagtgcttgtagaatccacagaaagaaagaacttggtgaagttgccattgcaaacatatcccgcttagagagtggagacttgtgttgttgtcaaatatgtattgctctttaa

SEQ ID NO: 83032 - DNA, 255 bp, Glycine max
  Peptide Sequence Number=SeqID_199810
atggcatatgaattgcatctgagactatttggagactctcaaatttatgattttgacaggagagttggagcaggatctgaagatccactggctgcatgttccataattaagaagcaagtaaaaagaaatctaaatgcagtttcaaagctcagaaaggcagcacttgatcatttacggtatgtgaaaagaacaaccatgtatcctctagagcatagtcctggacatgggtcgctttgcactgtgccaactgattaa

SEQ ID NO: 83033 - DNA, 1377 bp, Glycine max
  Peptide Sequence Number=SeqID_199811
atggaacctcaaagtctgtgttcctcattggaaatattgacacaacatatcaacacaatcatagaccttatttcctcgccttatcattgttttacagtggttttggttgcattcctagcaacccttttctttgcatgcagaagaaaagcaccaatttacttgatagacttcacctgctactgtccaccgagttcctataggctaccacttgccatgtttgaagagaatcaactttatgacaacatggatcctgacgctgttgctttccaatgcaagatcatggccaaatcaggattcagtgagcaaacatccatttctccatctcttgctcagatacccaaaataaaagctctctcctttgcccttgatgaggctgagacaatcatgtgttcagtaatcaaagacctgtttgagaaacacaacatcaacccaaaagccattgacataatcatcactaatagtagtgtcttctgccccacaccatctcttagcgccgtggtggttaacaagttcagaatgaggagcaacataatgagcttcaacctatcaggtatgggatgcagtgctggaatcatatcaatgagtctagctaaggacttgttgagagttcataggaactctttggctttaatagtaagcacagagactctaagtctgaattggtacactggtaaagtcccttctatgcttctttctaattgcctattcagaatgggtggagcagctatattgatgtctagtagggtccaagataagcacaaggcaaagtataaacttcagcatattgttagaacaatcactgcacaggatgatcaatctcatggctgtgtctaccaacaagtggatcctgagaacaaagaaggtatatcaatatcaaagaacatagtaaatgtgtctggagatgcactgaagaaaaacatagcttcactaggaccattggttctgcctttgagggagcaattcttgtacttattttcgattatttgtcgcaaagtttggagttcaaggagaataagcatctatactccaaatttcaaccatgcttttgagcatttctgcatacattcagggggaagagccatcatagaagctgttgaaagaaacttgaggctaaggaaacaggacgtggagccgtcaaccatgactctttacaggtttggaaacatttcgtcttcttcgatttggtatgagctgagctacatagaagcaaaagggaggatgaaaagtggggatagggtgtggcaaattgcttttggaagtggattcaagtgtaacagtgcagtgtggaagtgtgtttgtgacgtgaagccagacactgccactgcatggagggatacaattcactcgtaccctttggatattgtgagaaaaaactga

SEQ ID NO: 83034 - DNA, 1265 bp, Glycine max
  Peptide Sequence Number=SeqID_199812
atgaggattctgcaacttggtttgtttcttgctttagcatctggatttgcagccatttccatttacatcaccggcctctctgatccttttgtatttttgttcttctgtcttgaatctaacaataatgtaaccaccacacgcgcagatcccagttatcacctcacggatgaagacacccaagcattgctttccctgcacgacactttccagaagtgtgtgagtgcaaatggacttggcctaaaagcaaccaggggcacagattattgccaaaccacaataaatttccccagtgacaccatccccaaatggaaagatcccaaaaccggtgaacttgaagctctgtcttttgattttaatctatgtgaagctgtggctacatgggaacaagtgcgaaacagtaccactatacttaccaaggaattcattgattctttaccaaatggatgggaggaatatgcatggcgtaggatcaataaaggaatacagctcaaccgctgtgagaacaagaccttgtgcatggagaaactttcactggttctccctgaaacaccaccatacttcccaagacagtttggacgctgtgctgttattggtaactcgggagatctcttgaaaacaaaatttggaaatgagatagatggttatgaagttgtcattagagaaaatggtgctccaacacagaactacactgattacgtgggtaggaaaagcacatttcgccttctaaaccgaggatccgccaaagcactggataaagttgtagagttagatggtattgccacttgttatcttgtgagttcaacttgctgtaatgtgaattactataaccttactataattgctgtttctgcagaacaaagaaaagaagtcttgataataaaaacaacaattcatgacatcatgaacaaaatgattcgggaggttcctataaaaaatcctgtgtacctcatgctaggtgcatcctttggctcagcagcaaaaggaactggacttaaagctcttgaatttgctctctctatgtgtgattcagtggatatgtatggtttcactgtagatcctggttataaagaatggacaagatatttctctgaatcccgtcaaggccataccccgttgcatggtagagcttattaccaaatgatggagtgcttggggcttatcaaaattcattctcccatgcgagctgatctaaatcgtgttgtaaaatgggttccaagccgccatattataagatctgctagaattgcatcagagaaattactgag

SEQ ID NO: 83035 - DNA, 351 bp, Glycine max
  Peptide Sequence Number=SeqID_199813
atgcatgagcagtcgacttctagagttaaaaatcatatccgacttaacttgagccaacttgatcacaacttctggctagaagagaacacaacaacaaaacaaggccaagaggtgtctgactgtgttgatcacccggaaaggagaggcttatgctcctccatgtaccagagcatggcaaaagggcaaccagacaagggaggttcatggctgagattttctgctgagacttctattggtgaccaacaaagaaggttagtgtgtcaattggtgaccaacaaagaaggtgaagagccaaagacagaaaccactagcagaggaaaaacacagtggaaaagtgaagaaagtcactaa

SEQ ID NO: 83036 - DNA, 261 bp, Glycine max
  Peptide Sequence Number=SeqID_199814
atgatagtgggcacgagcagtggtggtgaccgtgatcgtagcaacgaggacaacaataatgacagagacattggaagctataatgttgatggtagtgctacaaagatagtgataatgatggtgattatggttgtgcacgacgatgacaataacgacaacaatagccataacgataatagcagcaatactattcgtgtgacaacaacaacgttgtggtgtggtgtttgcggtgatcgccaaccgccagagaaagaacaatag

SEQ ID NO: 83037 - DNA, 528 bp, Glycine max
  Peptide Sequence Number=SeqID_199815
atgttgctgcttgaaagattaattgggagtgtgaggttgtatgctagtgaagtggtcatcacatttagctttaaagactggagttcatttgataatctagatgtattcagcaataaggaacagaacaagaaatctccagacacagttttacaaccaaagagaggacgaccatatcttctagcaattaagcagtcaatgcgtagctgcatttgcatacaccagaagaaagcacatacaaaacccaaccaatctgattatttacaagtatctagagtatctatgatgagtatttcagacttagttgggagctacagattacaaaactatcaattcttcaaaagcaacacaagtgaatcagaagcaacaaactcaacattttcaatctgtgcatgcaacaattcaagacagaggcccaagatccccgaaactgtgtatgtgggagagccctcttccttctgtgattcttatcaatatcccccaacggaagaggaggtggaatatgatagtatgaggttgccagagatttag

SEQ ID NO: 83038 - DNA, 1954 bp, Glycine max
  Peptide Sequence Number=SeqID_199816
atggaccgccacattcaacttcttccccactccacgtcggtcaacgttcatccatatcgctacccacactttcagaagtgtgaaattgaacttcaggttgaatcaatgcttcaaaagggtctcattcaacccagtacgagccccttctcctctctgatgctactggttcgcaagcaagatgggacatggcagttctgcgtggattatcgcgcactcaatgtgattaccatcaaggactgcttaccaattccaactatagatgagttacttgatgaactggggggtgcgacatgcttttccaagctagatttgctacagggatatcaccagataaggatgaatgccaaggacactcccaaaactgctttccacacccaccatggtcattacgagttcagagttgagtatctggggcacctggtattgcgcaaaggtgtggaacctctggcattaaaaatcgaggcaattatccattggcctacacctcgcacaaccagagctgtaagaagcttcttgggactcgccggtttttatcaccggttcatccggggatatgcttcaatcgcagcctccttggtccacgtcactaccatggagcaatttgtttggacactgcaggctcaggaggcctttgatcaattgaaacgggctctggtcgcagcccctattctggctctgccggattttaaccttccattcaccatcgagacagatgcctctggtatcggcatgggggcggtattatctcataaaggtcatcccctcgcattctttagcaagtcgttcagccccaaattgcttcgcgagtcggcatatgttcgcgagttattcgccatcacgacagcaatgaaaaagtggagacaatatttgttggcacatgtactagcaagtttgatggggtacgattaccaaatccaataccgctctggtacccacaaccaagcggtcgatgcccttttgagatgctttgataaggaactttttacactcatgaatctctctgttccttgcccacttttcttcgaagaattaaaagctcaaatggagcatcactcgaaatatcaaaaactccgacaggacatctcgacggcccctgataaataccctaatttcatcatagttcatgacttgatcctcaggaaagggcgaatttggctgccgcaaggacttcccctgattcgcacactgttagtcgagttcctctccaccccaaccgacggccacatgggagtagccaaaactttggctaggatatcagaaaatttttgttggacagggcttcgcgacgatgttgtgaaatttgtggctcagtgcatcaattgccaatatgccaaatacgaaacaaagcgcactgccgagttactgtgcccacttccggttccacatcgtccttgggagaacctatctatggactttatcaccggactaccaccttatcacgacaacacagtgatcttagtggtggtcgatcatttttccaaagggattcatctcgacatgtttccggcggcacacactgcacatgcagtagcttcattatttatggaaattgttgggaaaattcattgcctccctcaaagcctggtctcagaccgtgaccccttgtttgtcagcaagttttggcaagagctctttcgtcggagtgggactcaattgcgcatgagctccacctaccaccctcaaagtgatgggcaaacggaagtcctgaacaggtggtctcacaacacctcatggaacgcaggaagagggatgactccatatgaaatcacatttggccgcaagccattcaatttttcggaatatctcgcaggatcatccaaactcaatgtcgttgatgaaatgctgacagacagggagggaatatttcaaacaattaggaaaaagcttctcaaagctcaggagaaaatgaagaccatcgcagatgctaaaagaagagaagtagagtaccacccag

SEQ ID NO: 83039 - DNA, 3904 bp, Glycine max
  Peptide Sequence Number=SeqID_199817
atggaacatgagtcaaaacaattcatggatattgctgaatatgaaggtcacaagaaagccctcaaacaactgaagtcagttcagtatcaaggcaaagaggaccaaacaatgtcaagcatcaaatgcttcaaagatatgatgatagaagcacactctaaaacaccagtatcagtggatgcatgctataaggattttagagacagaaaggacctggaaaatgtggatgacagaaaattttatatacaaaccacaataaccaaagcagatgatctaccaccagaaatctacaactggaagctacaacaacactctggtttgcctcaagctcatcaacatccaatgcaagaacagttggacaaaagaaacataattaagcttgattctagcagattcaacaggtccatagaagattttaccttatctatctcaaaatacagagataaaacaggaaatactctcttaaattgtcatgtagaggatgaattaaacgaggatgcatcacagccaaaaaaattgtttgatcatgtaacgtttacatcagcttgcaagcataggccaagccagaaaaatcatgaagaaagttccgagatacaaagatcatatagcctaggaaagtttgatgaagtttgttcaaactccagaagatattccctgcgcgacttgtctgaactgactgaaaggagaatttcagaactacattattcagaggtattaggaaaatgtgatgaagaatatactgtagacattgcatcaatttatgagagcttgattagttcatcaggcgctacttatgcttccttaaaggatgtgattttggatgagctgctaatagctatctctacatccaaagaagaaagaaaaataagggcatcagtatctattctgacaacaataatttcaaggaacaagtcaattatagaagatgtcaagaagaaaggtttaaggttgtgtgatctggcaagtgctctaaaacaaaatgtccatgaggcagtaattctaatctatttaataaatccttcacctatcgatataaaaacattggaacttcttccaatattagtggagattgtatgcacttcaaatagttacaagaataagcaagagtcacttcttttgacacctcatgcagcatcattgatgatcatcgaagaactagtaacttcatttgactatgccacaaataacatgcatttggccaccatcagttctccacatgttctcagcggatttcttgaagttgccaggaatgataatctagaagaatttttctctttaaccaccattcttataaaatgcatgcagtatgatgcacaatgcagaaaatcatcagctattagtctgctgcagcgtatacagcaagaaagcagcatcaatattatgcagatactaatgcattgtgcacatcagttacaacctgatcaccagcttttagcagcaaatattttgcttcagttagacatactgaactcccctgacaaaggcgtgttcagagaagaagcagtgcagatccttctcagggcaatgacatctgaagaaagttcagagcagatattagctgcatccattctatcaaatcttgctggtacatatgcttggacaggagaaccatacacagctgcatggttgctgagaaagacaggcttgacctctccctatcaccagaatatgataagaaacttcaactggttggatcagagtttacaggatacgagcacagatttgtggtgtggaaaaattgccaaatgtatcataagccttggggattctgtcttccatactttagagagggtgctaagaagcaagataaagagggtttctagagactgccttatagccatttcatggcttggttgtcaaatatcaaaaatcccagacagcataagttattctgcatctgaggttatactaagtggaattgagcagtttctgcatcctgggatagagttggaggaaaggcttctagcatgtatgtgcatgtttaattatgcctctgggaaaggtattgtcctcaacatagtttatgtctgggatattagggggcactcagccagtcttgtatgggacattaaagagcacaagaagtctgtgacatgtttttcactttatgagccatcagacagtcttttaagtggatccactgataaaaccataaggagaaagctggaatgtgttgaagttatagcattgaaggaaccaattcatcatttgcgtgcacacggtgaaacaattttttcaattagtgaaagcctgggattaaagctagttaatgaatcaagagtgaccaaagatattttgaaaggtaagcatgtgaaatgcatgacagtggctcaaggaaagttatattttggatgcacagattcaagcatacaggagtattcctcaacacacaaccgtgaactagaaatcaaaccccctacaaggagttggaggaagcaaagtaagcccatcaatgcagttgtagcatatagagactggctctatagtgcaaataagcatgttgaaggcacaacattcaaggaatggaaaagaactaagagaccaaaagtttcaattcttacggacaaaggagataatgtggtggacatggaagtggtagaagacttcttgtacctaatctccagctcttcaccgaacaacattcaggcaccgaaaaagttggggagaatatcagctggaagcaagataacaagcatcctcgcagccaatgacataattttttgtggtactgagacgggactaatcaagctagcgggtgaaggtttctccgccgcgccttatcacgccgtccgaaagcgtcgttgctgcgaaaccctagacagaagcgacgccgtagatggaggtggagcccgtggagccacagtcgctaaagaagctaagcttcaagtctctgaagcgcgctctcgatctcttctctcccattcacggacacctcgctcctcccgatgccgaaaggtgagcgtggagtatggcggaatcaaaagcactgctaatcaacctcctcatcaagttagttctgccacacaggatccagggccctctaacactcttgctcttccaggtccaggagattccaaggattctcagaaaggaggaccccaaaatgccttggttgttggtccaactatgccatccacaacaccgaatgatactggctttcagagcaaaagtacagcggttgtttcagcctctggttcatctgaaagttgttcctctgggcagatatgggacttggcaagtggagtattgaagctcacattaacaggccacattgaacaagttagaggtcttgctgttagcaacagacatacttacatgttctctgctggtgatgataaacaagttaaatgttgggaccttgaacagaataaggttattagatcttatcatggtcatctgagtggtgtttattgcttggctcttcatcccacaattgacgttttactaaccggaggacgtgattctgtctgccgggtttgggatatacgaagtaaaatgcagattcatgctctttcaggacatgataacactgtctgctctgtgtttacgcggccgacggatccccaagttgttacgggttctcatgacactaccatcaagatgtgggaccttagatatggtaaaacaatgtcaactcttacaaaccataaaaaatctgttcgagcaatggcccagcatcccaaagagcaagcttttgcatctgcttcagctgacaatattaaaaagttcaaccttccaaaaggagaatttttgcacaacatgctctctcaacagaaaactatcatcaatgcaatggctgtcaatgaggagggtgtgatggttactggaggtgacaatggcagcatgtggttctgggattggaagagtggtcataatttccagcaatcccaaacaattgtacagcctg

SEQ ID NO: 83040 - DNA, 663 bp, Glycine max
  Peptide Sequence Number=SeqID_199818
atggtgaaattggttgagactcggaaacctaattgggaaaaacgaagagaagagttaataatgttagtattgttgaatttttgggatggaagggaattagggatttggagggagaaagaaggcaaggatttgatggtgagtttgagaatggagaatggagaatggggtcccttttgtctaccaactttcactttcagactagcactagccctcgaagttagctctcttcttttcttctatcattttggtgctctcgttgagctcaccctcccaacctcttccatggcatcttctgagaaactcgacgaggccttactcaagctcaccaataaccaggtgtcgctaggggagtctatgcagtccttgaccctgaagattgatgatctgcttcatcgcatgaccctcatcatctctcccattccttcaccatctccgatggtcccgccatcctcatccacacctgcaacccaacatcgcatgaaattagaagtaccccgctttgatggtaccgaactgcttggttggatctccaagatcaaccaatattttgattaccatggaacaccagaacacgatagactcactgttgcttcattctatatggaggggcgagctttggcatggttccagtggatgtctgggaacgaccaattcacgtcctag

SEQ ID NO: 83041 - DNA, 669 bp, Glycine max
  Peptide Sequence Number=SeqID_199819
atgaaaaaacgtaaagagaaagaaaaagccatagtgataaggttcattcaagacaccttggaagatgagaaaaccaggaatggtctaaaattgagatgcacttccaacttgaggattcaaaagcaggaattctttgaattctctgagcaatcagtgctgtccaatctctattggggtattgacagcattgaggctgcaattcaagctcaacagccagaagaaagatccttcaggctaaggaactcagaacaaatgcttcaggtgccagcaatgcttgatgaggaagaggtcacagccacaattccaaaccgttacttggtgtgctgctcctacttttacctctcagtggttaggaagctccagggagatgagtggcaggcagcactgcattttctccaagcagttttggtctcaccaaagcttgtttggacagaatttgcatcacaactttgtgaaagtcttttcccacaatcaggcatcaccatgatgcagagaaacagtagcagtagaagtctggaatctgtgtcttctgaggatgagatggatgaagcaattaaggaggtggcaaggaagtacaaggagtggcttgtgtattaccaggtcatgctttatggagagactccatggtggcgcagttattgcagcaaacaatcaccacggtctgtgtaa

SEQ ID NO: 83042 - DNA, 459 bp, Glycine max
  Peptide Sequence Number=SeqID_199820
atgggtgttgccgccgtccaccaacatgatcacctggtggccggcgatcaggcccaacaagcacaacgtttctggagcgaggtgactcgccaaagaattgaaactaatttgggtcgggcccgagtcactggtgtcaggttgtggttcacttggtcctataagaggcagagggtgctcttctttgtctgtgaccaacagaaaaaccctagaggtacaacggtggcctctatgaggctatttcgtccggggagaggcgcttcaacggaggcgatggaggacgtcccggcaaaggaagtaaaaggggcagagaagctgtgtgcagttgtggctgaagcactgttggttgtggctgaggtaacgattggtgtggcggaacacggggcagagacaacgggcctaatctccggagtggggccggaacatcaagcaatttctcctcctggaggcaagcaagtctag

SEQ ID NO: 83043 - DNA, 1416 bp, Glycine max
  Peptide Sequence Number=SeqID_199821
atgagaattgggagagaagaagtggtggaagaagtgaagaggctgctatggttagcagtgcctctcttctcagttggaattttacaatacattcttcaagccatctctgtcatgtttattggccatcttggtaccctccctctttccggcgcttccatggcctcttccttcgcatcggccaccggcttcaacttattgttggggctagctactgcactggacacattttgtggtcaatcaaatggagcaggacaataccatatgcttggaatacacatgcagagatccatgcttgttgttttaatgatgagtgtgttcctttcgatcatctggtacaacacagaaccaattctcaaggctatgcaccaagacaaagccatatccaaggaagccggctcatacacccagtacatgatcccgagtttatttgcatacggtcttcttcagtgcattctcaagttcttgcaaacccaaaagattgtgttcccaatggtgctaacttctggaattgcagctgtgcttcatgtccttttgtgttggcttttggttttcaagtcagggcttggaatcaaaggagcagccttggccaattccatatcgtattggataaatgtaatcttgatttctctgtatgtgaggttctcttctgcatgcaaacactcttggacaggtttttccaagatggccctgcacaaccttcttgatttccttaaactcgctgctccttcagctgttatgcactgcttgaaagtgtggacatttgaactgatggtcctcatgtctggtcttcttcctaacccaaaattagaaacttcagtgctttcaatatgccttaatacatttggtctagcttggatgatccctttcggattcagtgctgctgtaagtgtacgggtctccaatgaactggggagtggaaatccacaagccgcaagtctagcagttcgggtggtgttatcaatggccttaattgaaggggtcattttagtttcagccatgattctactgcggaatgtctggggacatgtttacagtaatgacaaagaagtgatcagatatgtttcattcatgatgccagttttggccctttctagctttctagatgggatccaaggcattcttgcaggatgtgggtggcagaagattggtgcctatgtgaatcttggctcattttatcttgtgggcgttccttgtgctgtagtattagcgtttattgtacacatgaaagccaaggggctttggatggggatcatttttgcatttattgtgcaagtgtcactttacataatcattacttttcgaactaattgggaggaacaagcaaggaaagctcaaaggagagttgaactcataaccatcccgccaactactagagacagcgtattaccgcatcaaaaacaggaactagttccctaa

SEQ ID NO: 83044 - DNA, 696 bp, Glycine max
  Peptide Sequence Number=SeqID_199822
atgaggagaactatacacaatttgagaaagcttgtaagaaaaacaaccaccagaattctgagaatcggaggaatacacaacattagtgtcaaaggacagattcaaactatcatcttcaggagaacgagaggaactcgcttgagtaaggttcacagtaggcgcaaaggtattactcaaagaatcaagtttattgtacttcctaagtggcagttcttgtgcaagaataaagccttcaacttcttcttcaccggtgatatatggaagtcgactttgaataagagcaataacagaatcgaaatccctaggaagacctttaagaatggaatccatgtgctcgcgataggtagcaacatctcttacagatccaagcgccttaatgcgaggaaggaacttcgaaacgagatgattatcaagagtagtagtatgacaaagttcccatcggagctaacacgccttcattctagtttgatgatgaaaataagcgtgaatcttcgagctcgaaagtgtggattgaagccaaacaagcagaaattcagggaatttctctgtgccagtgtttttcttcggaaatatcttgagtcattggaactgagtgcactgaaatcgcaccagagtttgtcggaatcgcaccaccgaagttgttcgggatcgcgccacctctggttaaatgatagaagaagaaaagaagagagctag

SEQ ID NO: 83045 - DNA, 1806 bp, Glycine max
  Peptide Sequence Number=SeqID_199823
atgcattcaacagaggttgatgctcatttaaaagcactaaaaacattatgcaaacggaaagcttcaaatctcaaagaggcagaagcattagtcttgaaatggttccaccaagttctctccagggcttctggaataatagaaaaattcatttcagagaattcagaacaaaatgcagaaggcagcttcttcactccacctagaagtgggactaggaaaggcaggaaatcagtagcaaagtccaaggcattgtctaaagcaattacagcgatttatacagttgggtctttagttattgtttgcccatctgctgatatgagcaatgtagttcctctattgcatacaatcatcacttctgggagttctggtcctatattaaataaactacccggcccttcaacttctttacaacaggaagctccttctttttacattcaagggtggcttgccatgggcaagctttgccttgctgatgggaagctagctaagaattatattcctctgtttgtacaggagcttgaaaagagtggatctgcagctcttcgcaacaatattgtggtcataatggcagacttttgtgtccggttcactgctcttgttgattgttacataacaaggatcacaaggtgtctcttagatccttgtgaacttgtgagaaggcaaacattcatattgctttccagattgctgcagagggactatgtgaaatggagaggagtgctatttcttcggttccttttgtcacttgttgacgaatcagaaaagataaggcagttagcggattttctctttggaaatattttgaaagtcaagtctcctcttttagcatacaatagttttgttgaggctgtttttgttctgaacgactgtcatgtccataatgggcatcgtgagtctcaaggatcacgaaaggaaagccaaatcttttccatcagaggtactgatgaagagtcaaggtctaaaagaatgcacatttatgtttctttactaaaacaaatggctcctgagcatcttctagcaacctttgccaagttatgtgcagaaattctagccgcagcttctgatggtatgctcaatatagaagatgcaactggacagtctgttctacaggatgcttttcaaattctcggctgtaaagagatacgcatttcatccactcgtgcatcatctgagtcagcagatgtagaggaggaagggggagaaaatggatctgcagctagaagaaaggctataactcaggcagtcaagaaaggccttatccaaaatacagtccccatcttcatagagttgaaacgtctgttggaaaccaagaatagtcccctcataggttctcttatggagtgcctccgcattattctaaaggactacaagaatgagattgatgacatattggtagctgataagcagctgcagaaagagcttatttatgatattcaaaaatatgaagcagcaaaagctaaagcaacagttgctgaggctgtgggcaccaagccaaaatcaggttcaaatcaattagctgatgtttctaagaatctgaccaagacacaagaacaaacagttggacaaagcagtaacgagcttccaagtgattcaagagttgcttcagcaatagcagacactgcagctgcagcaacagcccgttctgtgctcagggaaataaacaaggggacgggtacaccaccacttagttctttgagtgttcctaaagtcaagtcttgtactggtatgtgtaattccaaagataagtgcatggatgtcatacaatctttaaggaaaagacagtcttttgattctgatgaagaaaactaa

SEQ ID NO: 83046 - DNA, 954 bp, Glycine max
  Peptide Sequence Number=SeqID_199824
atgccgcagggcaatgccgccgccgcagcagcgctgctggaccacggcggcgatgccggcgacgccgtaatggcgcggtggttgcagtccgctggcctgcagcatctagcctctcccctcgcttccaccgccatcgatcatcgcctcctccctaaccttctcatgcagggttatggagcacagtctactgaggagaagcagaggcttttaaagttaatgagaaacctcaattttaatggggaatctggttcggagccatatacacccaccactcaatctttaggtgtggctgggtcggatgggttttattctcctgagttcaggggggagtttggagctgggcttttggatcttcatgctatggatgatacagagcttttgtctgagcatgtagtttcagaaccttttgagccatcacccttcatgcctggagatactagagtatttgaagacgatttcgatccaattaacagcaagctggaaagcggggaagcagatactgatgcatcaatttccttacctatgaatagcacaagggaaaataatgttgctaagattaaagttgtggtacgcaaaaggcctttaaacaagaaggagcttgctaagaaggaggatgatgttgtaaccgtaactggcaatgcatatttgacagtccatgaaccgaaactaaaggttgatttgacagcttatgtggagaagcatgagttttgttttgatgctgtgcttgatgagcatgtgaccaatgatgaagtataccgaagcacagttgaaccaattattcctacaatatttgagcgaaccaaagctacctgtttcgcttatggtcagacagcatttatttttggttctcagtgtgagaacctagtgaacaaggaaggaatgcatttaagtctttttttttttggaggggagggtgtgatgttcatagctggcatgtctgatatagtcctataa

SEQ ID NO: 83047 - DNA, 1389 bp, Glycine max
  Peptide Sequence Number=SeqID_199825
atgatttacgacacggtactagccaaaagctttagtcgttatgatcagaaaaggttgggatatggagcatttgtgagctgcttgttcataattttgagtctttgcactgtgtttaagccttacttgggtcctgtgcatgttttgagcctgaaactcttcatcgatgttgacactaaaatgctgatcaccagcagctctttacaaatagccaaagtgaaaggaaaagaaacaaagaaagaggagctactatgtacttcagaagaaagaacagaattttgccaagcaaggggagacatcagagtccatggaaaatcctccaccgtatccattgtttcatctaagacaactatgttggaaaaaaccatgtcacggagtttaaagccttatgcacggaggggcgatatagatgcaatgaatcgtgtaagagaatggtcagtgaaggcagtaaatgctagccagaaagctccccaatgcacccaaagtcacaacattacggctgtattattttctactggagggtattctggtaaccacttccatgaattcactgacattgttattccactgtttttgactgctagacaattcaatggagaagtacaatttatcataactgataaacgtccttggtggatttcaaagcacaaaccacttcttaagaagctatccaactatgagactatggacattgatggagatgatcaagttcattgcttcccaagtgtgactgtgggtctcaaacggtatcagaaagagctaagcattgaccctcaaaagtattcctattctatgaaagacttcagggatcttttgagaagttcctatgcattgaagagagttgaagcaatgaaaatcagagatggtctacgtgggaagcctaggctcatgattctttcaagaaaaagatcaagatccttcactaatacagatgaaatagcaaaaatggctgcgagtttgggctttgatgtcattgttaaggaagcagggtggagcatgtggggctttgcaaatgttgtgaattcttgtgatgtgttattgggagttcatggtgctggtctcactaacatacttttccttccggaaaatgcagttttcatccaagttgtgccttacggagggtttacattggattggcttgctacaaatgactttggaaagccctctaaggatatgaacttaaagtacttggaatacaaaataggcttgaaagaaagcactcttatacaacaatacccgctagatcacatttttataaaggatcccccattggttgagaaaattggatgggaagaatttaagtctgtgtatttggacaaacaaaatgtaaagcttgatgttgataggtttaggcctacattgcagaaagcctttgagctattgcatcaataa

SEQ ID NO: 83048 - DNA, 774 bp, Glycine max
  Peptide Sequence Number=SeqID_199826
atggcatgcttcagtgccatccatatcctggtgacttttcagacaaatccagacctttccactgctcctactttatgggactgcgacgtaagcaaggatttcctgtcaataatggtggacagtttgatactaaccgttgaagaatttaagcattctgtcaacatatacactctatggaaacctggaatggacatcaatgtttcccacgtgaaacgtcgtaatatacctacctttgtaacttgggagattaagccaagttcagagttaagggtttctgaccatagtcaagcagaaaagtctcaagaaggtaaaatggttgtatttggagcaaatggtgataggaagagaaaacaagcagaggatagtgtgaattgtactgactcggaaatcaatagtactagtgagaaacctgatttgaaatcttcagtggagtttgctggggatagagagaccaatggatcagtgacaagcaacttacaagttacttccacgggtgcatctagttctaaagaagctaaaaagctagccattgagaagattatgtgtggtccatatgatgcacaacgagtcttttcagaagaacctgatgagcttgaagatgatcttgagttcagaaatcaagtcaaagattttggtgggaaaatgaaaaacagcaacttggactcttcatactcagagattgcagttgccacggaaccaattattcctaagaaggaaaccacttctgcaactcgtttatactcaaatgggggctcagaagagcttgaggtttaa

SEQ ID NO: 83049 - DNA, 3534 bp, Glycine max
  Peptide Sequence Number=SeqID_199827
atgactatggcatattccggcatatttcagggcttcatcagattcaaagccatgtcgcgccttcgttccactcctctcagaccttctcttccctccattcctcttcaccgcaccgccattcgcctccgccatcactcatgctccttcgcgcttcaagtcgtcaagaacacgcgccagaggaccctcaagttgccgttttggcaccaacgcagctccacctacggtcgtttcgcctaccaggatgtctccagtgacgaatccgatgttgaattcgcctcttctccctctcacaaccaacaactgggtgattcaactcacgagaacattgacgagtggagatggaagctcaccatgcttatgcgcaacaaagacgaccaagaagtggtgtccagggagaagaaggaccgtcgcgatttcgagcaactttccactgtagcttccaggatgggtttgtatagccggcagtatgcaagagttgttgtgtttagcaaggcgcctttgccaaattaccgccctgatttggatgataagcgtccgcaaagagaggtagtcttaccacttggtgttcataaagaagtagacgctcatctccttgcccatctttcacaaaaggctagaaacaagtggggttctttgagtgattccttgcataaatcaagggattctagaagcatcccagccaatgaaggaatgtatgaacaaccagagcccatgacccataatagtgtggtcaaggagaaaatccttgatcgaaaaagtttgcaactgcttcatcggcaacatgattggcaggagtctcctgaagggcaaaagatgcttgaatttcgtagaagtcttcctgctttcaaagagaaggatgcatttctgagagttatttcacagaatcaggtcgttgttgtctcaggtgaaactggttgtggtaagaccacacaacttcctcaatacatattagaatctgagactgaagcggcacgtggagctgtatgtaacatcatttgtactcagcctagaagaatatctgctatgtctgtttctgaaagagttgcagcagaacgtggggagaaattgggagaatctgttggatacaaagttcgtctggagggtatgaaagggagagatactcgtcttcttttttgcaccacgggtgtattattgcggagactgcttgtggataggaatttaaaaggtgtaactcatgttattgttgatgaaattcatgaacgtggaatgaacgaagattttcttctcattgtcctgaaggaacttctccctcatcgccctgatttgaggttgattttgatgagtgctaccttaaatgctgagcttttttcttcatactttaatggtgctccaactatgcatattcctggttttacatttccagttcgagcacattttcttgaggatattctggaaaggactggatatcggttgacaccttctaatcaaattgatgactatggtcaagagaaaacatggaaaatgcaaaagcaagctcaagctttcagaaaaagaaagagccagattgcttctgctgttgaggatgctttagaagttgcagaatttaaggggtatagcctacgcactcgagattcgttgtcctgctggtgccctgactcaattggttttaaccttattgaacatgtgctttgccacattgttaagaatgaaaggccaggtgctgttttggtttttatgactggttgggatgatataaactctttgaaggatcaacttcaagttcatcctttgttgggtgatcatagccaagtattgattcttgcatgccatggctccatggccagctctgagcagaggttgatatttgaaaatcctgaaggaggggtgaggaaaattgttctagcaactaacatggctgagactagtattaccatcaatgatgttgtctttgtggttgacattggaaaagcaaaagaaacatcatatgacgccttaaataacactccttgtttgcttccatcttggatctcaaaagctgctgcccggcagagaagaggaagggctggtcgtgttcagcctggtgaatgctaccatctttatcccagatgtgtttatgatgcttttgctgattatcaattgccagagcttttgagaacacctttgcagtccttatgtctgcaaatcaaaactctacaacttggaagcatctctgagtttttatctagagctctacagccaccagagcctctatcggttcaaaatgctattgattatttgaagattattggggccttagacgagaatgaaaatttaacagttttagggcacaaattggcaatgcttcctgtggagcccaaacttggcaagatgctcattttgggagcaatcttcaagtgtttggatcccataatgacagttgttgctggtcttagtgtaagagatccatttgtgatgccgtctgacaagaaggatcttgcagagtctgccaaagcccaattagctgctcgtggctatagtgatcatctggcactcatccgggcttacgagggttggagagatgctgaagctcagcaagctggttacgagtactgctggcggaattttctttcttctcaaacacttagggccattgactctcttcgaaagcaattcttttatttgctcaaagatattggtctggtcaataacaattctgaaacctacaatacatggagtcatgaagagcatctactccgagcagtcatttgtgcgggtttgtttcctggaatatcctctgttgtgaacaaagataagtcaatagcgctgaaaacaatggaggatggtcaggttcttttgtattctagctctgtaaatggttgtgtctcccgaattccattcccatggttagtgtttaatgaaaaggtgaaagtgaattcagtatttcttagggattcaactggaatatcagattcagtgcttctcttatttggtgggaatgtatccagaggtggactagatggtcacctgaaaatgttgggagggtatttggagtttttcatgaaaccagaattagccaagacttacttgagcttaaagatggaactggaagaactgatacagaaaaaacttttggatcccatgttggaaacacaatcgcatagtgagctgctttctgctgttagattgttggtatcagaggatcattgtgatgggagatttgtctttggtcgccaggtcctaccacaatcaaagaaggaaacaaactccaaaactggtggtggagctgagggtaaaaattataaaaatcatcttcaagcattccttaacagggctggacatgattcaccaacttacaaaacaaaggagctgaaaaacaaccaattccgtactactgtcgtatttaatgggttgaattttgttggtcagccatgcagcagcaaaaaattagcagaaaaatctgctgctgctgaggctctattatggataaaaggggatggccattcatctgatgatattgaccatgcatcagtgcttttgaaaaagagcaacaagaaaagtaggaaaaattcgtttagtggtgctaaatggagttga

SEQ ID NO: 83050 - DNA, 1443 bp, Glycine max
  Peptide Sequence Number=SeqID_199828
atggaggaaacggtgtctcgcataatctccgagctagaggatctccgtggaaacccgcaaccaccgccaccactctccgaacaaaccctaatggatcttcaatttctcctcaaacactctctcacagagactctctacgatgagcttccatcgaagaatctctctccgtcttctctcattcctcccattgcttcagcaatggactcttcaccaccgcaccactctcttctcgcttccgacgtcttcctctcgctcctcctcgctccaaacgcacccgtttttacactctttacacccatttcgtttctttctttcctccgctccctccgccgctcctgcaaggcccactcccaccccggcccggcccaagacaactccatgaaccggaaacggaagcggccgggccgcggccgggcgagtaatccccaaaacgacgacgattcgccggacaccggttcccaacacgacccccgggtgctcctccgcgtgctggagaagctagtcaaagtaatgggattgatccacttgaaccgcttcccggagactctcaagtccctgattcaaaccgtggctgaaatccccgtgacctcgctcgatacgtgcgggaacgcggcggtgtatagcagattgcttagcctgtgttcgcacgtgctgaaggaagttctcaaatctgagcacggagaaccttccaacactgctgccgaggtgttgaaatcgctgtgttcgcttgttctcatggcgaagtcgctggcgaggacatttgctattggatttgtcaccggtcttagtaaccaatgcgatggtgtgaagaaggcgctggttaattttccgaggtatttggccaagaaggcgccggagaaggccgagcctagagcattggcggtggactccatcatggaggttgttaaagttatggaatttgatgatcaaattgcgtttgtgaagtatgttgtgcagatggcacaggggaagtcgaatcttcggcttttggcggttgatctcattttgaatctggtgacgtcattgagggatccgttgggcgtggagagtgaagggagtgaggcgtggggagtgtggtgcttggaggcacttgtgaaacggtgttctgatgtgagtggcgcaattcgggcgcgggctttgtcgaatttagcgcagctggtggggtttttgtctcgtggtgagaggactagtgcggttctgaaggagtttacggggtttgggagggttggtgatgggaatgttggaggtggaatgaatgatatgctgaggaggaggtgtatggatgataaggcagctgtgaggaaagctgcattgcttttggttactaacttgacttctcttcttggaggtgcaattgatgaagtggtgctcaagacaatgggaatggcttgttctgatccacttatcagtatgcggaaagctgcaattacagctctatcagag

SEQ ID NO: 83051 - DNA, 522 bp, Glycine max
  Peptide Sequence Number=SeqID_199829
atgcaacctttaccactcagagctgcagaagaccttgttcgacagttgcatcagccagtttaccgggatcagagatttaaattgtggcttagctactttgagatatatggtggaaaactttatgatcttcttagtgacagaaagtgggtattcaatcttttatatgactacgttgggaaactttgcatgagggaagatggacggcagcaagtttgtattgtaggactgcaagaatttgaagtttgtgatgtactaattgtcaaagaattcattgaaaagggaagtgctgcaagaagtacaggatccactggtgctaatgaggagtcctccaggtcacatgctatcttgcaactggctgtaaagaagcacagtgaagttaaagcgagcaagcgaaacaatgatgggaatgaggcaagaagtgggaaggttgtgggaaaaatttcttttattgatcttgctggaagtgaacgaggtgctgacactactgataacgatcgtcagacacggtacttttacatctaa

SEQ ID NO: 83052 - DNA, 675 bp, Glycine max
  Peptide Sequence Number=SeqID_199830
atggaccatatgacagcaaaccgtagaagctgccataaattcttaagtttccttcctcttaccaaacccctatgctgcaaaacatcgatggaagatcagattggaaacgtagccaatagaaagaagaccaaacaagagaaaaacaaaatcagatttgataatcacaggatgaattacatcagtgtcatcaatagcattaaggagaatgtttacttatcgggctctttgacttccgctagcatgactaattccatgcagtattttctaattctgaagcaattcggtattgaagctcatccaaggaaagctccaatcatcaagcaggcattcaatcagctcctgcttgctgtcatcatcgccatagagatggctatggagaaaaattggagtgtcctttggttagaaacaaactcttctcttcttgtcaatgcgttcaagaatccttctagcgggccttggtctttgttcaactgctggaagaattgtatatctttaaccaatagttttagttttagaattttgcatatttatcgtgaggcaaatgcttgtgcagattctctggcctcttttggtgcacataatctaggatttatttggtgggactccccaccctcattcatatccatggagctccttaggtacagacaggacctcccttcttataaatttgcttag

SEQ ID NO: 83053 - DNA, 210 bp, Glycine max
  Peptide Sequence Number=SeqID_199831
atggcaaaatgtttgatgggagaaggaatgcaagtgaaagacagtgaatgttgcatgaaatcagagcctcaaaaggctaaatatctcgaccaaatattcaatagcagtgagagttcataccacagtcaacaaggatattcaatcaaagacaagccctgtgtcacattcatatggaccgtaccagtagcagtaaatactacaattttttag

SEQ ID NO: 83054 - DNA, 786 bp, Glycine max
  Peptide Sequence Number=SeqID_199832
atgagaaacagggtaaaagttacagcagtttacccagtgtgttgccatggatttcaggaagaggaagtgccgcaagagccttttgttgctcttacaagtgaggaggaagatgaggttgaacgtgccttttctgccaaccggtggaggatcctggttacccacaagaattctaacattgagatcacgggagagaagtttcagtgccttagaccggctggatggttaaatgatgaggttataaatttgtacctggaattgcttaaggagagggagcaaagagaaccactgaaatttctgaaatgtcattttttcaatacctttttctacaaaaagttaataagtggtccgaaaggttatgatttcaaatctgtcagaagatggacaagccaacggaatttgggatacagtctacttgaatgtgataaaatatttgtacctatccatcaagagatacattggtgcttggcagttatcaataagaaagataagaaattccagtatcttgactcaatgaaaggagaggatagttttgtgctagaaaagctggctaaatattttgcggatgaagtaaatgacaagactggaaaacatattgatgtaaatacctggaaaaaagaatttgtgaaagaccttcctcagcagaaaaatgggtatgattgtggggtgtttatgataaaatatgcagacttttatagcaggggtctggagttgtgttttaaccaggaaaacatgtcttacttccggtgtaggacagctaaggagatcttgagattgaaagctgaatga

SEQ ID NO: 83055 - DNA, 294 bp, Glycine max
  Peptide Sequence Number=SeqID_199833
atggaaatggggtgggggtggggagttatgatcagctcagcttggacccagattttccaaaatcagcaaaatccaaaaagggaaaaaaatgatgaactagagggaagtgaaggaagagaaagaatgggatttgatttaccttatgccatgggaagaggagctgaaaagcgactcggtgagtcaaagcggaacgatcccgagtttttagggttgcattgtatttgccaggtgcttcgagctggaaacaccagagggcagagagaagaaggaggatggaagttgaaaatggagtga

SEQ ID NO: 83056 - DNA, 540 bp, Glycine max
  Peptide Sequence Number=SeqID_199834
atggtttcaagggcagatatgaatgaagtttatgcagagtatgcaagacctggtggttggaatgatcctgatatgcttgaggtgggaaatggagggatgacaaaaaatgaatatattgttcacttcagtttatgggccctttccaaggctcctcttcttcttggctgtgatgttaggaatatgactaaagagaccatggagatagtagcaaacaaggaagttatttcagttaaccaagatccacttggtgtacaaggtaaaaaggttaggatggaaggtgatcaagaggtaaccctctttggacagatttgggcaggtcctctttcagggtacagggtagctgttgtcttgcttaatcgtggcccttcgaaaatctcaattacagccaactgggatgacattgatattccaccaaaaagtgctgttgaagcaagagacctttgggagcacaagacattgatgagacccttcgtggataaattgactgccacagtagatccacatgggtgtaaaatgtacgtgctgaagccagtggcttga

SEQ ID NO: 83057 - DNA, 813 bp, Glycine max
  Peptide Sequence Number=SeqID_199835
atggagctctccgtggttgcaagagacatggaagaagttgtattgctggttgatgatttgagatcactttctgggatttctcgctgtagaatatgtcatgaagaagaatttgagagctccaaaaccttggaagctccttgtgcttgttctgggacagttaagtttgctcacagagattgcattcagacatggtgcgatgagaaaggaaatacaacttgtgaaatatgtctccagcaatatgaacctggatatacagcagccccaaagaaatcgcaaataactgatgcagcaatgaccattagggatagcctgcaaatttcaaggaatgaacaagaaccgttaaacacaagaatagtgggtatcgttgaaggaaacaattactctgaatgcacgtatgctgcagataggaccgcggcttgttgtcgatccctggctttagcttttacactcatcttgcttgtaagacatctttttgcactccttacagatggaatggaagattatccatttacaattcttacggtctttttactaagggccagtggaattattatacccatgtacataattattaaggcgatcggagctattcatgacaatattaagcgtcaccatcatgaggttttaaaattttccatgcattatttttttgtactggctgattcatcgattatgggtgacatgcaaccacaactaaaaaatgattgttcctctatttatcaggattctgacgatgactcatcgatatctgatggagatgatgaagaaaatgagacaccaaatgatgaaattttaagacattcacaatcatag

SEQ ID NO: 83058 - DNA, 831 bp, Glycine max
  misc_feature (49)..(49): n is a, c, g, or t
  Peptide Sequence Number=SeqID_199836
atggggttatgtgttggcgcggaacgcggcccgccggaaaaccggcagnccgctgatatctgctgctcagggcaggttcttcacatcctcgatgtgcagcggcatcatgttcttgttcatgttgtacatgacccagagcgagccggagagcgtgatcaggagcaccacgacggtgaagatcagcgccatgaaggtccagccgccttcggacttggtgtccatgtgcaggaagtagatcatgtgcacgaagatctggatgacgccgaggcccatgatggcgatgacgagcagcgtcttgttttcaaggacgtcgcccatgaccagccagaaggggatcgccgtcagaatgaccgaaaggatgaagccgatcatgtagcttttgaacgtgccgtggctcgcgccatcatggtgatgatggtcgtcgccatgcgcgtcgtgatgtgcgtaaacgaaggagaagacgccgatccagatgacgtcgaggaagtgccagaacatcgacaggcacatcaggcgacgcttgttcgccgcgatcaggccgtgcttggcgatctgcaccatcagcgtgacgagccagatgatgccgaaggtgacgtgcaaaccgtgcgtgccgacgagcgcgaagaacgacgacaggaaagccgaacggtgcggaccggctccttcttcgatcaggtgatggaactcgtaaagttcgacggcaaggaaggcgaggccgaagagaccggtgattccgagccagaccagggtcgtctttaccttctgcttttccatttccagcatggcgaagccataggtgatggaggagaaaagcaggaagccgggtgttga

SEQ ID NO: 83059 - DNA, 273 bp, Glycine max
  Peptide Sequence Number=SeqID_199837
atggaggcggaaattcatggtgaagatggttccaaattcgtactgggaagcaatgagaaactagtgtttggacaaggttgtggattcggcaactacaactgcagagtgtctcattgccatatgcccttcgaactcggccatttaaactcagaggatgctaatgttgtttcatttgaagtcctgaaggagaaccccttttgggtgtacgacagagaaacgcttcggctcttcaaaaagttcgacaaaggtcacttgcaattcagacacatttga

SEQ ID NO: 83060 - DNA, 216 bp, Glycine max
  Peptide Sequence Number=SeqID_199838
atgaagttctgcacctttttgtctaagcaaacgagctcggttcgaactccacggctccgtcttcggtattcgactaagaaaccgtgtcggcggcgggtttctcagatgaaggggttgaagaaggctagagctcattggaaaactgataatggatttcaagaagggtcaacctctgaagaatttcgtccagtttggtggacatggtgttttaagtaa

SEQ ID NO: 83061 - DNA, 1080 bp, Glycine max
  Peptide Sequence Number=SeqID_199839
atgtcagacggaacattgcaggtactggacggaacgcacctgagaggcgtcgatctgtccttaggcgacgacggtccattcaccggagctaacatactcgacattgcccattcccgagcctcttcttccctcttcggtctctcattacccgattatctcaaagcctctgctctcacgcgcctccgcactccagacgccgatgctttccgctccgccgagtacaccgccgacaaggcctccgagattctccgagactacatctccgccatcgccaatgaactcaaaggtttattttattctccttcttctgatcatcacgcaactcactacagtattaggacacatgcgttctctaatctcgatttctcgatccgtgactctgatgataatcctcttgttgtatcagtcttggatggaagtactctccggttgttattagaggatgaggatgactttgccatgttagctgaaaatctattcactgacttagatgtcgaagacaaggggaaaatcagcaagagtgaaattcggaatgctcttgtccagatgggagttgagatgggcgttcctcctttctcagaatttcctcagctaaatgacttgttgaaaaaacatggggcggatggagaagaaaaattgggtcaggcacagtttgcacagcttctgcagtctgtactgcaagatctagaagaggaactttctaaacaaaatgttgtttccattcagaatattcgaatcattaatggctgtaagctaagacagctattggccaatgaacaggaattaaacaccattgtggagaaggcattgctggaaaaaccggaagcaaaggatggactagtagggaacacagaaataataaggagcttccttgagagaaacgcaaaggaattgggtttaccgccagctcaagctgacaatgcagttgttcttctttatgacgctgtctttgctgaaataacaaaagaaaaagatggtgctgaattagataaagaagagctggcaaaacttgtgaagaatatcctcgagaaattcgcagagcagctagaagttaatcctgtgtatcaggacttagcttga

SEQ ID NO: 83062 - DNA, 1386 bp, Glycine max
  Peptide Sequence Number=SeqID_199840
atggagagatttggagtacgcattatttctttgattcttcttttgatgcttactaaaaatttaagttccaatgcacttggtgacagtatgaaggatgaggaaggactcaaagaagaccaaaatgaaatggaaaattctctctctaattatgatgaaatgaggggcatgaaagatgatgattggcagatggtgcaaaagaagggaaaccattttgtggtgaatgacaagcctttctatgtcaatggattcaacacatattggcttatggtatttgctgcagatgagtccaccagaggaaaggtcactgaggtgttcaaacaagcatcctcagttggtatgacagtttgtaggacttgggcattcaatgatgggcagtggagggccctacagaaatccccatcagtttatgatgaagaagttttcaagaaatacaaaatcaggcttatcttatcattggccaacaactgggaggcatatggaggcaaagcacaatatgtgaaatggggcaatgctgctggccttaacttgacctctgatgatgacttcttctcacatccaactcttagaagctactacaaggcccatgttaaggcaagttcctttaaattaatgcaacagactgtgctcaatagagttaacacattcacaaacatcacttataaggaagatccaacaattttcgcttgggagttgatgaatgagcctcgttgcacctcagatcccacgggtgacaagttacaggattggatacaagaaatggcattccatgtgaagaaaattgatccaaagcacctagtggaggttggagtagaaggattttatggcccatcaacacctcagagaactcagttcaatcccaacacatatgctacacaggttggaactgattttatcagaaaccacctggttcttggagtggacttcgcttctgttcacatatatgctgactcttggatttcacaacaaattgctgatacacatatcccatttataaaatcatggatggaagcccacatagaggatgctgaaaagtatcttggaatgccagttgtttttgctgagtttggtgtatcttccaaagaccctggctacaattcatcatatagagacacagttataagcactgtgtacagtaccatcctaaactccacaaagaaaggggggagtggggctggaagccttttgtggcaattttttcctgatggaaccgataacatggatgatgggtatgcaattgttctctcaaaatccccttccacctcaggcattatacaacttcaatccactaggcttgcactgtttaattccttgtgcaacactaaatgcaattggggttgtaagaagaagaaattgttggaggaaatactctatcgtgacgaactgtga

SEQ ID NO: 83063 - DNA, 463 bp, Glycine max
  Peptide Sequence Number=SeqID_199841
gactacagaggcccgtaaccagagctggaaaccccaggaccctgttggacttctccgggtccactgggtgtctttgtgggcccgtaaccagagctggaaaccccagggccctgttggacttcttcggggccctgttggacttcttcgggtccactgggcatcttgtggggggagattggcattgtggtcgctgggcaaaatgttgttaaatagcaatgtcatccacgtaagagtggtcatgttggtgcgcatgatccacactcatctttttgcagcggcactggtgaaatcttgccccggcatgcatagtagatgtgtgatagcctccctctctggatgtgctcgcacagttggtcgccctccaatatcagggggtggcccaggaactgataaaaggaaactactggccctcgtaaccgggagtgcaagtctcggtgaagcatctaagggcaaaggaccttaa

SEQ ID NO: 83064 - DNA, 381 bp, Glycine max
  Peptide Sequence Number=SeqID_199842
atggcaataccaaccttaaggtctccagctgctttgaagaatttcaatttggagataagaacatgtggatatgatttgaacaaatggagggcatctactcgcatgaggtctgacttccaaattcttgatagtgactctagtagagggtgggacttagcaacaaagcttatctccaagagaggttcccaaagaagaggacgcttatctgctgctgctgccttgaggcacccttatttccttctgggtggggatcaggcagccgcagttctttctaagttaagcttaagcacaaaagaacctccagaaagatctgaaaggaaacttggtttcagtactatgatacagaaggcaaaagctacacttgctgtcttgccagtctaa

SEQ ID NO: 83065 - DNA, 538 bp, Glycine max
  Peptide Sequence Number=SeqID_199843
gagttgtgcaagggtgggcagcgatcttgatgggtgtgatgtcaggaagcattccctggtacacaatgatgatcctccatgacaagctcccattcctaaagcaaatcgacgaccccatggcggtgttccacacccatgccgtcgccggcgctctcggcggcgtcctcacggggctcttggcggtgcctaaactgtgccgtctcttctacatggtccccgattgggaaaaatacattggactcgcctatggcctccagaacggtgcaactcatgcgggtctaaggcaaatggccatccaagttggggccatagttttcgttattatcttcaactttgttacgaccagcttgatttgcttgctcgtggggtccatagtaccactcaggattgacaccgatgctttgcaaatgggtgacaaggcaatgcatggagaagaggctttcgctttctatggaggagaccctacagcaaagtttgagaacctcaagcacaataaagtttatgatactcaagacttttcgtttgttagagacacaag

SEQ ID NO: 83066 - DNA, 210 bp, Glycine max
  Peptide Sequence Number=SeqID_199844
atgaaatttgcacactttcacggttgggatttgcaagataatgttcgtggagggagaaaaaggaatcgcatgaagacagtacaagtggaggtttcaatccctttccgtctctctgacgtttgggaactctatcagagcagtcggaggaaaaattggaggaatctcaggaaaccgctagagatgccgttgtcgttgttggaagacacgtga

SEQ ID NO: 83067 - DNA, 1158 bp, Glycine max
  Peptide Sequence Number=SeqID_199845
atggcttctctgctctctacaactgcaaccacacttcaacataatcacacaatctgcttctcccctgtcaaacccaccaccccaaataccattcccttctcaacaaaccgttgtttcaagaacaactctgcaaagtgcaatgctttttttgataaattccccaaagacttgttggagaccacttttcatttggaccagttccctgtcttccaatcagtgatagtgaagtttcagaatgtaactgaagacttatcagacgtgcagaggtgggggcttgggatcctagcagggctgacatgggcttatttcaccgcgaggcccggtgttctcgtcggcgccattgatgcattcctcttggctcctatccaactggttttggacagtttatctggaaggaggaatctgaagaggactgattttcttgttggagataagcttggagaagggtcatttggtgttgtttattcgggtgttttggtcccaaggaatgtggatgtgcaagagtggatgcagaaaagtggaagggacaaggtggctaagttggatgccaaatctaaggataaagtcgttcttaaaaaggtaaaggttggaattgaaggagcagaggaatttggtgattttgaagagtggttcaattatagactctctagagcagctcctgaaacatgtgctaagtttcttggtagttttgtagctgataaaaccaattcacagttcacaaaaggtggaaaatggcttgtttggaagtttgagggaggccgatctcttgctgattacatggctgatcaaagcttcccttcaaacttagagtctatcatgtttggacgtgtcttgcaaggcgtcgactcttctaaacgaaatgcattgatcatcaagcaaataatgcgccagataattacatctcttaagaaaattcacgacataggcattgtacacagggatgttaagcctgccaacttggtggttaccaaacgggggcagattaaactcattgattttggtgctgcgacagaccttcgaattggaaagaattatgttcctaatcgtacccctttggatcgtgactactgtccccctgagctatacgtgttaccagaagaaacactaagtctcccaccagagcctattgcagctttcctttcacccatcttgtggcag

SEQ ID NO: 83068 - DNA, 606 bp, Glycine max
  Peptide Sequence Number=SeqID_199846
atgcgccctgccactctgcctgaaaggaagccagccaggtgttcactctttttcctcccgttttgccagaaccgtgtcagcgcagtggcgcaggaagtaccagctgagactgatatccgcatcgagcgtggcatcggccagcgcgatcgtggccagcacctcattggacgtcagctccggtgccacgtcttcgaaatcatcggctacccacaggtgcactacgcagggtgtgtctggtgcaaaacgctgcagctgttcggccagctggccagtggtgagagggggattcatggttactccggttacaggttgcacggcatcagcgccgtgacgtcacggcagccgggccactgcggaggacgcagggtcgagggacgaagccgcacgcgccggcggagcggactgaatgtcccgcggaacggcggggaacgggtgagtcatgaggcgaagctgccttgcggacgaagcggcccggctaaggtgaagtcacggcgcagcccgatggtcaggagggagagacggcgaggtatcttcatcaagggctgctttgtgccagtagcggacgtcagtatcaggcaccggaaaaagggcataccggcgctttaa

SEQ ID NO: 83069 - DNA, 696 bp, Glycine max
  Peptide Sequence Number=SeqID_199847
atgagcggtcagcagacatatactcatcaagctttgcagcctggacaagtttgtcagatgaaagcatctgttggtagaccccgagaattcgaccctgaaacatttcttaataccgcgctggaatgcttctggcaaaaaggatatcgggcaacatcaatgtcagacctcatgaaagcatctggccttgcaagtgccagtatctataagctttaccctgataaacgcacaatctatctcgcggccttacagcaatacatggatgaaggtgcttccagagcagcagaacgcgatgcggagttttctccagaaatggcattgcgcgaaacgttagaatttgtagcgcttttatcatcttctcctgatggagaaaaaggttgttttaccattgccgcggccagtgaacttctaccgggtgatgcagaagtaaaaagtaaggttcatcacaaattcaactcgataatcaatcagttggaaaaaatattatgcagaggtcagacgcagcaactttttcggtgcgatgaaagcccacgaacaatggcaatcagcatttttatgatgctggaagggatgcgagtttatgggaaaattcagcccgaaattgacgaactcaaaaagagtaacgaatttattgtcagatcggtgctctcaaacagacatgaagatgggaaaggcctctccagacaggcatcaacatga

SEQ ID NO: 83070 - DNA, 363 bp, Glycine max
  Peptide Sequence Number=SeqID_199848
atgcaatgcgggctgacgatggagggattccacatccggcagcggacccgtctgagcgcgcgtaaaccccatggccacccctggctttcgccagcggtggccgcgccgcaacagcaacagcaacagcaacagcaacagcaacagcaaaagccggggcccccttcggcttcccggcaagccgggtcgtcgagccctatgtcgctaagcggcaaagccgccaagcgccaccgaacccctgcgggtttcgtccgcgagcggtttcgggctgatgtccagggtcaacggctgcagacggctgcgccgtcgcgttcaccgtcccggcctgtcgccgggactttaaggtcagtccgcggggcggcctga

SEQ ID NO: 83071 - DNA, 1497 bp, Glycine max
  Peptide Sequence Number=SeqID_199849
atgggtggtgatacagcatttttggagcaccccatatcagaagatacacttcagttactctttgaagcctccaactcttctaacatggaaaagtccttagagattctcattcagaatgccaaatctgattctgggcgtttggaactagcttctaaaaggattctccctgcagtacttaatatagttcactcactcactcatgcttcacatcaccatcaccatcagcataatcatattctttgtttgtctttcaagctcctcagaaacttgtgtgctggagaagctgcaaaccaggactcatttcttgagcttgatggggtggcggttgtttgtagtgttctgaggtcagaggctgcttgttcaggccctgatcatggattggttcggtggggtctgcaggttctggcaaatgtttctttggcgggaaaacagcatcaatgtgctatttggaaagagctctatctggatgggtttgtatcacttgctagacttcacaccaaggagacttgtgacccgttgtgtatggtgatttatacatgttgtgatggaaacccggaatggtttaaacggttgtccagtgaggatggatggtttgtaatggcagaaattgtgagaactgcctcttctgctagttttggtgaggattggttgaagttgcttctttcaagaatatgcctcgaagagtctcaattgcccgtgttgttttccaaattgcagtttgcggatgttcctaaggttgaagttgctgagtcaaaagatgatcacttttcatttgaacaagcatttcttctgcgaatcctatcagaaatcttgaatgaacggcataaagatgttactgtttcaaaggatgttgcattgtttgtttttgggatattcaagaattctattggggttcttgaacatgcaacgagagggaagtctggtcttcctagtggctttgttggggttgatgttcttggctactctcttaccatactgagggacatttgtgctcaagatggtgtgagaggtaatacagaggattcaaatgatgttgttgatgcgctattgtcatatggcctcatagagttgcttttgtatttgcttgaagcccttgaacctccagcaataatcaggaaaggactcaaacaatgtgagaatcaagatggtgctagttgttccttcaaaccatgcccttataagggcttcaggcgagacatagttgcacttattggcaactgtgtttatagaaggaagcatgcacaagatgaaatccgacacaggaatggaattctacttctattgcagcagtgtgttactgatgaagataatcctttcctgagagaatggggcatatggtctgtaaggaatatgttggagggcaacgatgagaaccaaaaggtagttgctgaattggagattcaaggatctgctgatgtgcctgaaattacttcacttggtctccgagtggaagttgatcagagaaccagacgtgcaaagcttgtaaacatcccgtga

SEQ ID NO: 83072 - DNA, 162 bp, Glycine max
  Peptide Sequence Number=SeqID_199850
atggcacggagtgtggaaattcctcgtgtgaaactcggaactcaaggccttgtgccatacagggagcttggcattggaattgtaccatatagccctcttggtcgaggctttttcggtggcaaaggaattgtccaagatgtgtgtcaacagctagctcactag

SEQ ID NO: 83073 - DNA, 1134 bp, Glycine max
  Peptide Sequence Number=SeqID_199851
atgggtaactacaggttcagattatcagatatgatccccaatgcctggttttacaaactcaaggacatgggaaaaacaagaaagcaaaccccaacaactcattccaggaagaaaaagcaaccttcaccagcctcaacccaaaaagcatcaaaaccaaagcaaccacaccaatacaatctcagaaagtcttactatttcacaagggagcttaccccaaatgatagaatctactcctcaccaacaccaacaaataaccaaaatgccaaatacaccaattcccttgaaccccccagaaaatcatccaaacaaagactcaagaaaagaacttcaaggacttcttctcctaagcttgttgttgtctctaacaataacaactcctcatcaccaaatgatagctccactgaatcagagtaccctgacccagaattcagaacagaccgtgttcttccaactgaatcattcgatgaaacggttccttgggccaactcttgtgcctgcagggtacactccaacgccaaggacatcatcattgatgttgacaacaattccatagccagaaaagatggtaagctagaagggtatgagtatgaatgtgattccttctcagaccttgtgcttccaccaattgtgaccaagcctgcaatattcaatgacttgctcagtgatgtcaagaagaaagaaaccaaaccaagaagcaaaatggctgcacatgaagagccaaacctgaataaggggcctctgagagttaaaattgtgaaggaagacacttcatcaatgaaggaacataagaacacctacggaaggagattctctgtgagctctccgggagtgaggcttagaatgaactcgccgcgaattgcgagccggagaattcaggcacatggccggagaagcgtgtcctcggccccccggagaagcctctcggatagctttgcagttgtgaagtcatcactgaatccacagagggatttcagagaatcaatggtggagatgattgtgcagaacaacataaggacatcaaaggatttggaggatcttcttgcttgctacctttctttgaattcagatgagtatcacgatctcattatcaaagtgttcaagcaaatatggtttgatttaactgataataactag

SEQ ID NO: 83074 - DNA, 765 bp, Glycine max
  Peptide Sequence Number=SeqID_199852
atggcacagagtgtggaaattcctcgtgtgaaactcggaactcaaggccttgaggtttcaaagttgggatacggttgcatgggccttactggtgcctacaatgatcctcttcctgaagaggaaggcatatctattattaagcatgctttcagcaaaggaatcacttttttcgacacatctgatatttatgggccagaccatgctaacgaaattgtggtcggaaaggctttaaagcagctaccgagagaaaagatccaaatcgcgacgaaatttggcattacaaagatcgactcttctggaatgtttgttaagggtacaccagagtacgctcgctcatgttgtgaagccagcttgaaacgtcttggtgttgaatacattgatctctattaccagcacagagtggacttatctgtacctatagaagaaacaattggtgaacttaagaaactggtggaagagggaaaagtgaggtatattggattatctgaagctagtccagatacaataaggagagcacatgctgttcatcccatcactgctgttcaaatggagtggtccctatggactcgtgacattgaggacgagataattcctctctgcaaatttacacatccacgcttccgagctgagaacttggacaagaacaaaaaattgtatggcaaaatagaaagccttgctaccaaacaacagtgcactccttcccagttggcactagcatgggtgctccaccaaggcaatgatgttgtgcctattcccggtgagtga

SEQ ID NO: 83075 - DNA, 1167 bp, Glycine max
  Peptide Sequence Number=SeqID_199853
gagactggagctggggccatagctatgttttgcaattgctttggtgctttgaatcgatgtggaaggagggatgattctgaagaccagccacatgaacaagtggttgcaactaaaatgtttagctataactcattgagatcagcaacaggagattttcatccttcaagcaaaatcggtggaggaggctatggagttgtctacaagggagttttaagggatggtactcaagctgctatcaagtctctttctgtagagtctaaacagggaacccatgaatttatgacagaaattgatatgatatcaaatatacggcatccaaatcttgtggaactgattggctgctgtgttgagggtagtcaccgaatattggtttatgaatttttggagaacaatagccttgcgagctctttgcttggttcaaaaagtaaatatgttgctctggattggccaaagagggttgctatttgtcgtggcacggcttctggtctaacttttcttcatgatgaggcacaaccaaacattgttcacagggatatcaaggccagcaacatattgttggatgggaacttcaatccgaaaattggggattttggtctggcaaaactttttcctgataatgtcacccatgttagtactcgagttgcaggaactgtgggatatcttgccccagaatatgcacttctggggcaacttacaaagaaggcagacgtgtacagttttgggattcttatgcttgaaataatcagtgggaaaagtagtagcatagctgcctttgaggatgattatttggttttggtggaatgggcttggaagctgagaggagaaaataggcttttggaccttgttgattcagaactaagtgaatatgatgagagtgaggtgtataggttcctcatagtggctctattttgcacccaatcagccgctcaacatagaccaagcatgaagcaagtattggaaatgctttgcaaggaagttcatctcaatgagaaggcattgactgagcccggaatatacagatggcacagcaatggaaagaggggtggttctttgaatgagacatcatcttctcaagcaatcaagtacaaaagaaccgaaaatccacatgaagcaccttcaactcacttcagtggtacagatattgtgacagagatgcttccaagatga

SEQ ID NO: 83076 - DNA, 948 bp, Glycine max
  Peptide Sequence Number=SeqID_199854
atgacgggtttaacatcttcccaaggctacaacttctctgcttttgtctattcatggaaaggtgtttgttccgatgccaatagagaacatgttgttgacttagtcttttctgcctattctcttttgcaaattcttcttcgtacaagttgtctttgtctttcacatgccaccaagtttgtgctgaaacaatttccaacgccattaacgttgagccagtggcaacacgactttattcaccatatgcaagacccaccaacgctgcataatactccagcaatagattctgctcttgtcacactcttctgtggatgggcttgcaaggttcgtaatgaaggtttagctgtaagtagtaacaatttagggttgagttctctttctactgccaagtccttacagtccttgtctttcagctcttctgcctcatctcttaattccaatcttttcatatgggaaatagagagcagctcatgcaatgttggatctacacaaagaccaattgatacaatctttaaattccataaagttatacgcaaagacttggagtatctagatgttgaatctagaaagttgaatgatggcgatgagacaattctttggcaatttaatggaagatttcgtcttttgtgggatttgtatagagctcatagtaatgttgaagatgagatagtatttccagctttagaatcaaaagaggcacttcataatgtgagtcattcgtatatgctggaccataagcaggaagaacaattgtttgaggatatttcctatgttctttcagagttttttgtccttcatgaagtcttgcagatgacccatatgttagaaaatttaactcagagtaattttggaacctctgatgccaataatagtgatgatatcaaaaaatataatgaacttgctactaaggttcaggggatgtgcaaatccataagaatcaccctggattag

SEQ ID NO: 83077 - DNA, 276 bp, Glycine max
  Peptide Sequence Number=SeqID_199855
atgtacgatattaacttcagttcttatcctctaagcataagctatgcagggagaacaagaatgttccagttgaagcatttcactaaaatgagcaatgtagaagagtactacaaatacgtgctcgaaacaccatatgctctaacaggcacacacaatcttgcaaaagcaacaacaaagggaaacactgttgttttgtttgtagttagtgccaatgacaagcagtggcaaacttctaaggagactctaaaagtcgtgcttaattcctttgaagtttag

SEQ ID NO: 83078 - DNA, 546 bp, Glycine max
  Peptide Sequence Number=SeqID_199856
atgtatttgggtgtgagcactataagagaaattacaagcttcgggcggcatgttgtggcaagttatttacttgcagattttgtcatgacaatgtcagcgatcactctaaggatagcaagaaatatatgtgtatttgcatgcgtgctactgagtgaagagaaggcacatgagcttgcattgcatgtaattgcaaagataaaaggatatggggatatagctaaggttgtagctcttgataatcagaagcttcttgctcttaatcctataattcatgtacttcctatcaaatgcaagaaaaagttaacgtgtatggtggagctgtgttattggtttaccattgcttttaaattttcccctgcagaattggtagaagatgtgaatcggcgccttggtattgagaagactatgtttgaagcatcaaatcagagaatatcgaagtcattcatcaaacaatatagtcaaaagttagtttgttacctatacatgtatactaatgtccataaatattttgttgtcgttgagtttgcatctatactatttgagtga

SEQ ID NO: 83079 - DNA, 1158 bp, Glycine max
  Peptide Sequence Number=SeqID_199857
atgaagaaccacagtcttcctctggagttgatagaagaaattctactgaggttgcctgtaagatccatcttgcgtttcaaatgcgtgtgcaagtcatggttttctctcatctccgaaccccaattcgctgtttcccattacgacctagccgccacacccacccatcgacttcttctcagatcagactattatttctacgctcaatccatcgacacagacacaccgcttaacatgcaccccaccacagtgaatttacttctcccccctccatcacctccacgcgatcccggccccagcaacttcaaccattactacgattctcgctttcaacccgagattctgggttcatgcagagggtttttacttttatactacatcacccgcagagaaatcattctatggaacccctcaattggtctccataaacgaatcacggacgttgcatatagaaacataaccaatgagtttctctttggctttgggtatgacccatcaacagatgactatttgcttattctcgtttccacgttttttataactcctccagaagtcgggctccatgttttctccttcaagacttgctcatggaaggaatactaccctagtctttcgtatgatgattgcggcaataaatgcagagctgggtcgctgttgaacggggctcttcattggttggttttctctagggataagaagaggcatgtgatcattgctattgatctgatacaaatgattttatttgagattccactgttggatagtttaatttccgaaaaatatctaatagattgtttaagagtaataggaggatgtctcggcgtgtgttgctgggtccaagaacgtgaagtcactgaaatatgggtgatgaaagaatacaaagtgcaatcatcttggactaagtcctttgttattccgaattatgatgaatacattcacttttcccccatatgcatcaccaaagatggtggaatttttggatcaaataatggagggaaatttttaaaacttaataaagaaggagagtggcttgaggaactcctatatggtcattacgaatggtcgtactgtcataatctacagtctgctttgtatagagagagtctactgttgatccctggtgtcattggagaaacgagtgaggatgatgaccagaaataa

SEQ ID NO: 83080 - DNA, 282 bp, Glycine max
  Peptide Sequence Number=SeqID_199858
atggagtatactggcatcaactccaatgcctctgagaatggcatgggtccacaaaatacacatggcaccctacttgacactctaaaacaagtgtcaaccctccatgttagccctggaacaggagcacggataagagaaggtgttgaaatgctgctgaaggactcgctcaacaagccagattggctaagcgaggctcattcgcttagcgaggcagccagctcgctaagcgaatgcaaaaccctagaagatgttgagctagagagcagcgcgcttagtgcgtag

SEQ ID NO: 83081 - DNA, 279 bp, Glycine max
  Peptide Sequence Number=SeqID_199859
atggagcgatgccgtgaggaggagctgagaaagctaaaggctgatcatgaccaactagaggctcatgtcagatgtccccacgactatggatatcaaaatcacattttaaatcgtagaatcgtacgattccataaagccttgttgcttaatggttttttcgttttctttgtagtttcttcctccgtgcaacgcgcttgctgccggagtgcgacggtgaggtgcagcggtgaagggatcctccgcgagacaatgaggtgcattgtgcaagttcaacactag

SEQ ID NO: 83082 - DNA, 1134 bp, Glycine max
  Peptide Sequence Number=SeqID_199860
atgcccatgtttggtctggccgacgtcaactccttttacgccagctgtgaggcgctgttccgccctgacctgcgcggcagaccggtggtcgtgctgagtaacaatgacggctgcgtcatcgcacgcagcgcgggcgccaaaaaactcggcataaaaatgggcgccccgtggtttcagataagggggcaggattttgccgaacgcgtgcatgtgttcagctcaaactatgcgctttaccactcgttatcgaacagggtcatgatggcactggaggaaatgacgccgaaggttgagcagtactccattgacgagatgttcctcgatttaaccggcatcgatggctgcgaggactttgagcacttcggccggcgcctgcgcgcgcacgtgctggccacgaccggcctgaccgtcggcgtgggcatggggccgacaaaaaccctggcaaaatcggcgcagtgggccagcaaggagtggccgcagttccgcggggtgctggcactgacgccggataatccgaagcgtaccgcgacgctgctggaaaaccagcccgtagaggagatatggggcgttggccggcgcatcggcaaacggctcaacctgatgggcattgaaaacgccctgcagctctcacgcgcgcaccctgccctcatccggaaaaacttcagcgtggtgctcgagcgcaccgttcgcgaactcaacggggaatcgtgcattcccctcgaggagtttgcgccggcgaaacagcagatcgtctgcagccgctcttttggtgagcgcattacgacaaaagtggccatgcaggaagcgctgtgtcagtacgccacccgtgcggcggagaaactgaggaaagagcgccagttctgccggcgcatcagcgtttttatccggacctcgccgcacgcgcagggagaggtcttctacggcaacagcgccggcgagaatctcaccctacctacacaggatacgcgcgacgtgatcggggtggccatgcgatcgctcgaccgaatctggcttgacgggcggcgctatatgaaagccggcattatgctcgatgacttcacgcccaacggcgtcagtcagctgaacctgttcgatgaggataagccgcgggcgaacagcgcgcagctgatgaag

SEQ ID NO: 83083 - DNA, 270 bp, Glycine max
  Peptide Sequence Number=SeqID_199861
atggctttaccattagaagggctgcgcgttattgagatgggccagcttattgccggccctatggctggacgaatgcttgctgaatttggcgctgatgtcataaagatagagccccctggcaaaggcgatcctttacgcaagtggcgcatgttgcacaacggaacgtctgtctggtgggcagcgcagtcgcgcaataaacgttcggtcacggtggacctgcggcagccagagggtcagcagattgccatgtcactgctcaactctgctgat

SEQ ID NO: 83084 - DNA, 659 bp, Glycine max
  Peptide Sequence Number=SeqID_199862
cagcagaactgctgacagaggtgaatgcaatgctgatcccaccgaatgaacacgtcctgttgctggcagagcgcgggctgaaactgttatccgatctgggccggacgcaggccacactcgccgcctaccgcagtgccttacgccactattttgctttctgccgccagaaccggattgaacctgaaaaggcccggttcgaagacctggctgcttacatcagtcctcagttacctgttatgcctactcctgcggccagcgccacgctccagctgcgcctgtcggcgatccttctctgcgctatcctcaaccgcacggtgataccgatgctctgcgcgagggcgggcgtacctttagaagacagcggcggaatgataaccagccaccgtggacgggcttcagcggtgaccgcactggccagcgtacctcagtctgccatgcattatctgcgcatccgtcctatccaactggctgtctcgttcgttaaagcagaccgggtcgcgcacataataagtgtgctgattgaccacgatccggaagccgcccagcctgaccggacccgcgacgaagttccgctgacacccgataagaaaggcatcgtggaacagggcgccgagaaaattgaacaggctcttaaaagaccgccctttaaacccgaatga

SEQ ID NO: 83085 - DNA, 504 bp, Glycine max
  Peptide Sequence Number=SeqID_199863
atggaaaatggtaatgtgatagtgaacggttcccctgaatatgttcggtcctgttgcgagggtagcctccaacgccttggtgtcagctacattgatctctattatcagcactgtgttgacaccactgtacccattgaagacactgtgagcgatgccatcaaacactttttgttacttcttcatattggagagcttaaaaagctggtccaagagggaaaaataaggtacataggattgtcggaagctagccttgacacaattagaagggcacatgctgtttatcccattactgctgtgcaaatggagtggtccctttggactcgtgaaattgagcaagatattgttccactttgcagtaaagatgatttaaaggagattatagatgccgtaccaatatctgaggtgtcaggggatcggaccactgatgcatttgttagatgttcatggaagtttgctaatactccaccaaaagcattactatatataccagttatgcacctttga

SEQ ID NO: 83086 - DNA, 330 bp, Glycine max
  Peptide Sequence Number=SeqID_199864
atggagcgttgcgatggaaacgacgtcgttggaggaaaaacgataaagatgaagatgaagattgcaatggtggttggagttagaaaggaggttttttcgaaggctgaaattggaacgcgagggacccttgatgggtgcactccatttcgcgtggggagcacgacttttcgagttacgtgctttcctgcaatcgaggtctatggtgtgtatcatcgacgtgcacctgttatagcgccaagttccgtttggcttgggccaccaaaaagcaagctttatgcagtcagaaaaacgaataataatgtgaacccaaaggaaaaagatagcttataa

SEQ ID NO: 83087 - DNA, 324 bp, Glycine max
  Peptide Sequence Number=SeqID_199865
atggagaagagcctttggtggaggaactgtgtacaaatgtctgatgatttgaataatgttgatggaaaagatggtaatcaagttaatggtttgcctagggtagatgttgtgtttggtcatagggtagaagttgtgtctggtaataagttggagattgggatgaaatttgacattgtcaaagtttttgttgaggttgttagagattacacaatttatcatggaagggatattaattggaagaaaagggatttaattagagctacatttgtttacaaagtgaatgagtgtccttgggagatttattgtgcatgggcagacaaataa

SEQ ID NO: 83088 - DNA, 450 bp, Glycine max
  Peptide Sequence Number=SeqID_199866
atgataactcacttccaacactcactcttggcagatgatccattcatgaacgacgacgcaagctctcaagcctcaatgaactccttcaagtgttcgagtttccagttctgcgacccgggccacgaagatgagcacgccaccccaacagacggacccgaacgcaaaaagtgcacaccattattatcgtaccgtatcgaagaaccagaacccaatttcacgaaaccgtttaactactaccctcctcgtatgaactcttcgtgcggctgcagcaggttcgggtcgagccacgcgtgtccgaggcttacgaggatccggtcgtgcccgcacgagcggaggagccagcagcagcggtcgatgatgttggaggagatgtacaagtataagagacgctttttcaacaccgttggcgctgttgagaacatcggttttcagcatccagatcgcgtgtag

SEQ ID NO: 83089 - DNA, 1176 bp, Glycine max
  Peptide Sequence Number=SeqID_199867
atgccgttcgcgcgatgcaacagccagattccggcgccgctgccgtcgccgattccgaccgggagaggcacgcggtccgccgcgaacgagatcttcagccagtttctcgagaagacgctgcagatcccggagctgacgctgccgggaccgcacctcccgcccgcgccggcggagatcgacttccggtcgctgactcttgtctccaccgatctgatgctgcgctctgccagggagttcggcgcgttccgaatccggtgccacgggatctccggcagcgaactcggaaccatggcggacgaagccgaacgcgtcttccagaaatcgcgaaacgtcgtcgtcgtggagcgcaacggaactggcggagagatgattccctgtgttcgctccagcaaaggtgcactggaattcgccgctcagacgattaccggcgaccaaacgcatcggaacttttgggttcacatggggaacgttgcaagtagattggatactatagttgagcaagtgactatggttctacaacacaaaacatctaaagagtttaaggagcggattcaagatacagagtcttggatttgcttgtgcaggtatccgcatgataatgttcccaaacaaaacgaagacacctcggttaagaaaaaagacaaattatgtgatcatgctttgcgcttctaccttcctatggagcaatgtatattttacgtccaaactgaaagaggtcccctgtcatttgacgcaggtccagagaacatagttgtcaccgttggcaaacaactagaggagtggagccacggtgtattcaaatgtgttcctggggaaatgatcttcatgccgagtttccagagtagccctgcctctttctccatagagcttgtgtgcttggcctcttcaaatgatctaagtcacagtttagacaattctgacaactgtgacaagataatatccttggctgatcaaatccttattgtattttgtctggttaagaacaattctcatttcttcaatctaacggaagtatacaccttcagtaaagagaaagatgcgaaaggaagaaagaaaaggagtataaatgtactaagtgaaataatgagaataaaaagtataaatgccaaacaggtcaacttgaaagtagacatgccaaacggatcaacttggcttgttggatccgattcattttga

SEQ ID NO: 83090 - DNA, 216 bp, Glycine max
  Peptide Sequence Number=SeqID_199868
atgacaaccataacacctcccaaaatgacaataacggagatgtcatgcagcccaagtgtaggaatgaagctcatgaagttaggttgtatcatccttggtgatgattcagttgggaatggtatcatcataggtgtaggaggcctaaatgcaggggttgtggtggaagacttggtgattgtggtatttgcatcgttaatggctgaggttaacctttag

SEQ ID NO: 83091 - DNA, 439 bp, Glycine max
  Peptide Sequence Number=SeqID_199869
cggtcgtcggtgcagatcttggtggtagtagcaaatattcaaatgagaacttgaaggccgaagaggggaaagggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactg

SEQ ID NO: 83092 - DNA, 1071 bp, Glycine max
  Peptide Sequence Number=SeqID_199870
atggaattgcctgatacaatcagtacagccatgtacaaagggagattctgcactagtggtggagttaagtctcagcttggttatgttgaaacagatccatctggtcgatatggtcgtttcagggatgttctggggaaaggagcaatgaagactgtgtatagggcatttgatgagttactagggattgaagtggcttggaaccaagtcaagcttggtgatgtctttcactcaccagagcaactccagcgcctttattcagaggttcatctccttaagcacctcaaccatgactctatgatgatcttctatggttcttggatcgatgtcaacaacaaaacctttaactttgtcactgaattgttcacctccggcacccttagagagtataggcagaagtacaagagagttgatatcacagcagttaagaattgggctcgccagattctaagtggtttggagtatttacacagccataatcctcctgtgatacatagagatctcaaatgtgacaacatctttgtcaatggccatcaggggagggtcaagattggtgatttaggcctggcagctatacttaaaagctcccaacatgcacacagtgtcataggcacaccagaattcatggcaccagaactgtatgaagagaaatacaacgagctggtagatatatactccttcgctcaaatatacaagaaagttacttcgggaaagatacctgaagctttttacagaatcgaaaatttggaagcccagaagtttgtgggaaaatgtttggcaaatgtctcagagagaccatcagcgaaggagctcttgttggaccctttcttagccatggaacaacttgaaattcaattgccaccaagcataccagcattatttacaaataaatctttcaagcttagttgccctgcaccatttcccagtgagcatcgcgatcaaacaaagagcgcggatatgacaatcaccgggtcaataaacgaagaggacaacactgttttccttaaagttcggatatctgacataatgggtatgcacaatttcatcccacattttgcagtaatcttacaataa

SEQ ID NO: 83093 - DNA, 474 bp, Glycine max
  Peptide Sequence Number=SeqID_199871
atggtttggttggcagtgtctcttcttgcggatggtctggctgttgctaggcagatatgtttgattttaggattggcacttgcattcattcttggaataggattgcactttggtgctaaaatatttacacaagatgctaatgttctgcagatatgtttgattttaggattggcacttgcattcattcttggaataggattgcactttggtgctaaaatatttacacaagatgctaatgttctgcagatatgtttgattttaggattgacacttacattcattcttggaataggattgcactttggtgctaaaatatttacacaagatgctaatgtcctccacctcattcaaattgggatcacgaattggaatgggatcaggaccttgggagttcctaaggagctcatgactgcacatggcagacaccgtagttatagcttcatattaggcctaggtttcagtggtgtttgttga

SEQ ID NO: 83094 - DNA, 174 bp, Glycine max
  Peptide Sequence Number=SeqID_199872
atgattgaagtagatctgaggtattcaggaagtgatttgcatggtgtcacagctaaagttgtggatatgcctcatcactatgttgaagttcatcctgagattcgtaaacaattctgggattctcagcattggccaaagcatatacttgtccgatatacatgttcacaaacttga

SEQ ID NO: 83095 - DNA, 229 bp, Glycine max
  Peptide Sequence Number=SeqID_199873
atgaagaccaataaccaccaacagcaacaaccacaacacgaacacagaggaagacgaatgataagcaaaaaaggaggaagaagcacgaacaccaacgacggtgggaggaagaggaagaagtatatggtgagaggaagaggaaaaagaagcggcgtaagaagagaaacacgaaggataagcgctgtatggacgaaattgcatatacatgcgaggataagtgtgaattttt

SEQ ID NO: 83096 - DNA, 228 bp, Glycine max
  Peptide Sequence Number=SeqID_199874
atggagagggagatggtaatcgtgatggtagacacattaccagtattctactatgaaaatggtgggttacacaccttcaagctttgtggatatggtcttcaccgacgaaaggatcaaaccataacccctgctaggtttcctaacctccatttttccgaggttacgactcgagcgcaacgtgtgcttgtcatggagaagccccggggcattccattgagcattgtatga

SEQ ID NO: 83097 - DNA, 1747 bp, Glycine max
  Peptide Sequence Number=SeqID_199875
gccgaggatcagcagcaccggcaccagcagggcgacgcgggtcatcttgacgatggtggccacttccgtggtggcggggtcgatgttgctggccgcgccgaccacctgcgccacttcgtggatggtgccgccgatgtagatgcccagcgcctgggtgtcgaaaggcagccagcccgcgtggtaaagcaccggatacaggaacatcgacagcgtgccgaacagcaccacggtggccaccgccacggcgctcttgtgcggctgcgcgcgcagggtcggctcgaaggccagcacggcggccgcgccgcagatggcgctgccggcggcggtcagcatggcggtgtcgcggtccagccccagcatgcgctggccgacccaggtgcccagcagcagcgtgcccaccaccaccgccaccgacaccgccaggccgggcaggccgacggcggcgatctgctggatgctgatgttcaggccgtagaaggccaccgctatgcgcagcaggcggcgcgcggtgaagttgacgcccacgccccagtcgaccggcatggtgccgcgcaggaagttgccgtacagcatgccgcagacgatgccgaccaccagcggcgaaaagcccagctggcggatggcggggaagtccgccagctgcatgaccgcggccgacatgaggccgacgaacaggacgccgttgagcttgtcgcgccagggcgtggcggtggcggccgacgcgccgggagttgcggcaggcgcggcggcgggaattctgatatcaatgccgccatggccgccggctcgccaggaactcatgactcccgatcaattgctcaccttcgccaccgtggccgacgccggcaatatcagccgcgccgcccagcagctgcacctgtcgcagccggcggtttcgggccagttgcgggccttgcaggaatggttcggcgagccgctgtatcgccgcagcggccacggcatcgccttgaccgaggcgggcgagcgcctggccgagcaggcgcgccagctgcgccaggtgtaccgccaggcgcaggccgtgcgcgaatcgtggcgcggcctggaaacgggcgtgctgcggttgggggccagcaccacgccggccagctacctgctgccaggcctggtggccgatttccgccatgcctttccggccgtcagcctgcacctgtccgatggcaatacccgggaaatcgtcgaacgcctgccggcgctggacctggccttcatcgaaggcgacgtgcccgcgggcctgccggccgacaccgccgtgcatgcctggcggcaggacgaggtggtggccatcgtgcgcgccgaccatgccctggcgggcaagggcgcggtcacgctgcgggatctggcggcttcgccgctggtgatgcgcgaacccggttcgggcgtgcggcggctggtcgagcgcgccttcaccgatgccggcctggcgccctcggtcggcttggagctggccggggtggaaggcgtgaagcaggccgtgcgcgccggcctcggcgtggggttcgtgtcggccatgtcgatgcggcacgaggatggcgcgctggcggcgctgcggctgttgccgcgacccttgacgcgcaccttgagcatcctggtgccgcatgccgacgcggccgcgcgcgccgccccgcgcttcctggcgatgtgccaggcagtgcgggcggggcagggagtcatctagcgcggggagccgttgccttcttcgtgaggcaggcgcctttcccggcgccgc

SEQ ID NO: 83098 - DNA, 675 bp, Glycine max
  Peptide Sequence Number=SeqID_199876
atgaggaaaggcaagagtgaagcaaacagtgaaaagaagaaggatactactctaaatgaaggcaaggaagtaccttatcctttggtaccttcccggaaagaaaaagaaagacatttagccatatttcttgacatcttcaagaagttggaaattactttaccctttggagaagcacttcaacaaatgcccctctatgccaaatttttaaaagatatgctgacaatgaagaactggtacatccatagtgacagaattgtggtagaaggcaattatagtgttgtgattcaacacagtcttccacctaagcacaaagatcctggagttgtcatgataccgtgttccattggtgaggtttttgtaggaaaagctctcatagacttgggagctagtatcaacttaatgcctctctccatgtgccagcgacttggagagatagagataatgcttacatgcatgacccttcagttggcagatcgctccataacaagaccgtatggagtgattgaacatgttttggtgaaggtgaaacaccttatatttccaactaattttgtggtgatagacatagaagaggatgctgatattcctctcattcatggtcgcccattcatgtctactgcaagctgtgtagtagatatgggaaagaagatgttgcaaatgggaatagaagattag

SEQ ID NO: 83099 - DNA, 738 bp, Glycine max
  Peptide Sequence Number=SeqID_199877
atgaggaacgcattcctttcccgtttaatgacaccctgcgtcatgcttgtcatgctgatattctgcagccagcagggatatgtcgtttataaagattataagaaagttacgaataagttagcgaatgctgataagccggcgctaaaaaaacctgatgctgaaaaatcctttgggcttttcaccgccgcagtgcgtcaaagcgacgcgccggccgcggcaaaagcgccactgtcggcagagattgagggcattattcgtagcgatgaatcctggttatcgttcgccgtgatcaagacgcccgccggtcagcagagctaccgggaaggggagccgctggtgggctttgacgatgcctattacgagggggcgaaacagacgctggccctcaataaaccggcgtatttcaagggcggcgttgacagcgccccggttaccaaatcgaaaaaagatgccggcgccgacagcctgcatctcgatgattatctggtgttaaaaccgttaatcgataaaggccaactggaaggctttactattaatccacggaacgcaacgcctttttaccataatgcaggactggaaaaaggcgacgtggtgttgaaagtcaatgacgtcgatatgacgcaagaagcgcaggcgaaaaatatcattgccaactggtcgaaaatgaaagaagcggatgttgtcgtcagacgtcacgctcaccttgaaaatattcggattaatgttttaaacaattaa

SEQ ID NO: 83100 - DNA, 1090 bp, Glycine max
  Peptide Sequence Number=SeqID_199878
atggcagaatcgtcaaagaaacgaaagggttcttccgcctccgcttcggcttcaagagctcatcgttccggagccactagcgcatccacagcaccaattccaccatcattgtcctcttccccagtgttttcttccaacgaacagcagaaacggtactccaatcttttctcatctcgttccattatcgaccctaactttattgatatggaattcttttctgctgaaacctttgattgcattcaagcctttcagaacttaggtcttctaccttttaggtcattacaattgcctatttatcctgaattggttaaagctttttattgtaatcttgaaattcaggacagcactctaatttctgaaatttttgggataaaaatggtcattgaccagtcccttttccatgacttaaccaaattacccagtgacggtgtaccatttgaaggtacactgaatgacgactggaaatttgatttctctgcccatgatgcccgccagttggtttgcaccaacaatgcggatatgaccggacgtcttcttgccgggtcattggcttttgaaagccgcatccttcactatttaattgtgcgtattttgcttccacggtcttccaaccttgcccaggtttctgaggaagatctaattatcatgtgggcctttcatacagggcgtcaacttgactgggcacacttagtcagatatcgcatgcataaggcattgcgattaaatgctccattaccatatccacagcttgtcactctctttttccaccattttcaaattcctcttgattctgaaccttacgttccaatcaagagatcctttttaattggtgctgctgtgattgcttcttttggttaccgcaaagagcttgatggctcttgggtcaaaaagggtgctccacccgctgatgatgaaagcaaccaaccagttgaagataattcctctcttcttcgaaagcttttggaaaagttcgatggtcttcaaacttttgttggtgacaagtttgataatatggaattgcaagtcgacatgcggtttgatgccatggaatcaaggatcaccaaagttgaagaagatgtctccttcatcc

SEQ ID NO: 83101 - DNA, 660 bp, Glycine max
  Peptide Sequence Number=SeqID_199879
atgcatgaagaagctcaaaggcttgctgttttaaacaaaaagctgaaaagcaaactaaaattgcatatcactaaattggcttcaacacaaggtgaggtgaataaattgaaacaagaaaatgaaaaagttgtttcaagttgtaaagccactggttgtgattatacctctacttctttttacatggatgatcacaagtctttgcaaaccaagtttgaaaatttcaaaatggatcactatgctaaacgtatgaagttgcaaactgagctttcttatcataaagatatgtttgaaaaattaaacaaaggaaagagtaatcttaatcacatgctcactgtgcaaaaacatactacagataagaccagcttggcatataacatgcaaaccaccttttcaaagaaaactaagtttgtatcctcaaaaggggtgtgtctaaaagctaaggactcactatggtacttggatagtggttattctaggcacatggcgagtgataagtccaaactctctgactttgtgtcaaaagatgggggatacgtcacttttagagacaataataaaggaaaaataatgggagaagggaatattggaaatcagtacaaaactcaaataaagaatgttttatatgtggaaggactaaagcacaagctcctaaagcattag

SEQ ID NO: 83102 - DNA, 516 bp, Glycine max
  Peptide Sequence Number=SeqID_199880
atgacatttggaagttgggaacaatcatacaattatctacctttatggttgacagctgctcaacactttgtaccaggtacaatagtaacatacaaaactccatcttcaatggatgattgtgaggatgagtctcctaggatgattcttaatcgtgtattatgggcttttaagccatgcattaaaggctttcaatattgcaagccaattgtgcaaggtatgagatcaggaaatcacgatttgaggcaaagtccctcgcaatgcgagaagagtttccacaagcagtggattggttggaccaaatttccaacagtaaatggacttaggcctatgatgaaggaaaacggacatacgtactctgaagacatatatgtcatgatgcaagaaaatcaacatagtgctacctcgcattatgttcccatgcatgttcgagaaacaggagaatttgaggttcaaggaattgaaaatatatggcttagtcgacgagcaatggcatgcactgccaaattaaatgaatga

SEQ ID NO: 83103 - DNA, 144 bp, Glycine max
  Peptide Sequence Number=SeqID_199881
atggggttattggtggccatgaattcgacagaacctgttggctgcgaggtctatgtccatcttggggaagaggggaatcaatctatccatagcattgaagtagttcaagtctaccttgtgacagtgactagagtgcttctctga

SEQ ID NO: 83104 - DNA, 336 bp, Glycine max
  Peptide Sequence Number=SeqID_199882
atggcatcctattctaatatgtacaaagataattggacccaaccttggcccatgggctcagaaatctaccctgaggttcatgagaaccctagggccttcttcaacagctctagcccaatcctctcggagcctcttgctcatagctctagtgaatggtcacttcatagggaggattgcatcatatgtagtttcacccaccaaattaataatgcgaaggaggaatgtggagttgggggcggtggagagatgacattgggaagggaagaaagggagagggagagggagaagaagaagatgaaggatgatgaagaagaagcacagtggttgagtgaatga

SEQ ID NO: 83105 - DNA, 489 bp, Glycine max
  Peptide Sequence Number=SeqID_199883
atggctttccctatggctgccacaacctttcctccagaacgagatcgacccgcgagcagtattcaaacttgtaaatggagaagtgttcgttttgggcatcgctccaacattgatgatttcaattttctcaaacttcaccaagagcctcaagttggtttgtggtttatagagagagaaaggttgagcaagctcggtaagcaatggagcctattgagtgttgagacagtttatgcattacttccttgcaagagaagtgtttgttctatggatatcacttgtcacgacatatcaatggtaaaagttgaggagagcaacagacttgaaaccttgaagaaattttttggttgtttacaggtagatgctttgctagtgtctttggagaactcaacaccgagaattgatactcttattgttttaataataacacatctatctcatcctacacttttaagtagcaagaacaacacctatggaccaattgtaccttaa

SEQ ID NO: 83106 - DNA, 235 bp, Glycine max
  Peptide Sequence Number=SeqID_199884
cgctcttgcgccgaagatgaacggggctaagcgatctcccgaagctgtgggatgtaaaaaagaatcggtagggggagcgttccgccttagagggaaggacccgcgcgagcagtgctggacgaagcggaagcgagaatggcctaagatcaggccgaagggcgtagtcgatggacaacaggtgaatattcctgtactaccctttgttggtcccgagggacggaggaggctaggttag

SEQ ID NO: 83107 - DNA, 222 bp, Glycine max
  Peptide Sequence Number=SeqID_199885
atggaggagtttaatgctcaggtggcctggccaggagaccagccctcttcttctggagggggtggggcctctgcagcccaggagccagagaccgaggagccaccagcaccagcagaggagcaaactattccagttcagaccccacaaccatctccatcctctgcacctgctcctgaggagacccaaacatcggcactggatttgaatgaagaccagccatag

SEQ ID NO: 83108 - DNA, 204 bp, Glycine max
  Peptide Sequence Number=SeqID_199886
atggagaattggcgaacagcgctacgcaataacttcgcggggctccagactcgtaggtggaggatgcatgaacagcgtcaggcaatgacattcatggggctccgtaaaaaagtggagaatggagaattgcgccaggcaatgacattcatggggctccgtaaaaaagtggagaatggagaattggcgaacaacgctactcaataa

SEQ ID NO: 83109 - DNA, 277 bp, Glycine max
  Peptide Sequence Number=SeqID_199887
cttgggaggattgatggggacccggtgttcagagaaacgaggatatgggctacgtgggagtacgtgagctcagttggaggtgggctacaggggatgagtggtacctggagatatgtcgcgggggtcaggagaccttggggacgtcaggcgagctcctggcagtcaacagataaaaggaacaaagaccacaaagcaaggaggcttgtggaagctaagggagcctctggtaatcgattaccagcctgtgtaatcgattacacagagggatgggtcactg

SEQ ID NO: 83110 - DNA, 261 bp, Glycine max
  Peptide Sequence Number=SeqID_199888
atggctccggatagaatgcagctacagaacatgtataagaaggagcatgaatctttcaaagaatatgcccaaaggtggagggatctggcagctcaagtagcgcccccaatgatggagagggagatgataacaatgatagtagacaagaagccttgggccaatggagagaataagaaggagggaggaacccatgttgtgacagtcgttcctacatcagccaatatcaatccttctcattacccaccaccctatcagccatga

SEQ ID NO: 83111 - DNA, 689 bp, Glycine max
  Peptide Sequence Number=SeqID_199889
atgggtgttaagtacctcgaagcggtcaagcgagggtcgcatgctatcaaacaatggtccccggacgaaattacgggtgcagaagacgacagtagtctttttctgtttgtgcggagaaattatttgtgtatttctgcacgtcacctcacttcacgggtcagtatgacaggcattgactatgcggagaaattacttgtgtatctccacacgtcacctgacttcagggtcagtctgacagaaattgactgtgcggagaaattacttgtgtatctccgcacgttacctgacttcagggttagtgtgacagaaattgactgtgcggagaaattacttgtgtatctttgcacgtcacttgacttcagggtcagtgtgacagaaattgactgtgtggagaaattacttgtgtatctccgcacgtcacctgacttcagggtcagtgtgacagaaatcgactgtgcggagaaattacttatgtatctccgcacatcgcctgacttcaggggcagtgtgacagaaattgactgtgcggagaaattacttgtgtatctccgcacgtcacctgacttcaagcttagtgtgagagaaattgactatgcggagtgtcgcaacctacccttcggcgggagggcgacgcgagactcgcgggatgcgtgttccacgaaaggaatatgcgcggagtcgccaccaac

SEQ ID NO: 83112 - DNA, 198 bp, Glycine max
  Peptide Sequence Number=SeqID_199890
ggagaccttgggaaggcatcacttatgctagaaggcttcactgccctccttactagcagcccagatctgttttgtgctcggcttgatgccatctcagatgttttagtcctggttcaaggtgtgaagagagaggctgtcccaaaaggacagactcctttcaacgacacaagagacaaggttatgaaagagtttgcctaa

SEQ ID NO: 83113 - DNA, 138 bp, Glycine max
  Peptide Sequence Number=SeqID_199891
atggccgaccagcaagcgaccaagtccaaagccaaaggtaagcaaaagatgcacctagttgctcatgatcctgggaatttaaataaaacaagcgcaagctcggaaggtagtcatacctcacaaaacatatatgtttag

SEQ ID NO: 83114 - DNA, 312 bp, Glycine max
  Peptide Sequence Number=SeqID_199892
atgggaaacaaggctctaatgaagggggttcctaagatcatttcgttattaaggattcacgatgtcggatacaatgtccaggacatcctgcctgaaaatactggaattgctaaaagcattgaagctgcaggatccacgatgtcggatacaatgtccaggacatcctgcctgaaaatactggaattgctaaaagcattgaagctgcaggatccacgatgtcggatacgatgtccaggacatctggcccgaaaatactggacatataaatctgttatatctttaacagattattgtgcagttagcaagagataa

SEQ ID NO: 83115 - DNA, 261 bp, Glycine max
  Peptide Sequence Number=SeqID_199893
atggggctccgaataagatttgatggtggagggtgcgcgaaaagtgctatgcaatcaattcgtggggcttcggactcagaggtggaggatgttgcacgaccagcgctaggcaatcaattcgtggggctccggattcaatggtggaggatgcatgaacggcaaaaaattcctggggctccgaataatatggtggaggatgcacttacagcgctagaatatcaatttgtggggattccgggctcaatggtggaggatgcatga

SEQ ID NO: 83116 - DNA, 948 bp, Glycine max
  Peptide Sequence Number=SeqID_199894
atggcccagttccggaaaccgccggtgtccagcccgcatgcgtacgacggtgaccagggcgagtacctcacatggcaggacccgggttcggacctgggcatccgcttggaactgtttgaagggaaggatgtgcctgagatgcctgtatcccgactcgatgcctgtttccagcgactgcgcgagcagcagcgcaaggcgctgattcccttcatcactgccggtgatccctcgctggaggccaccgtgccggtcatgcatgcactggtcgatgccggcgccgatgtgatcgaactgggcgtgccgttatccgacccgatggccgatggcccgaccatccagcgcagctccgaacgtgcaatggcacgcggggcgggcagccggtacgtgctgcaggccgtggcgcagttccgagagcgtgacgcgcagacgccggtagtactgatgggctacctgaacccggtggagatccacggctacgccgccttcgccaaggcggccgtggaggccggtgtggatggtgtgctgctggtcgacctgccgccggaagaagccggtgaagcgcagcaggctttcgatgcggccggcctggcgctggtgctgctggcctcgccgaccaccagcgaggcacgtgccgacaagctgctggcgctggcccgtggctatctctattacgtcagctttgccggtgtcaccggcgcgtccgagcggctggacagtgatgctgccagcgcccgcctgcaggccctgcgtgcgcgcgcttcggtaccggtggtggctggcttcggcatcaaggatgcggccagtgcggcggcgatggcgcgccaggccgatggcgtggtggtcggcagtgcactggtggcggtgctggccgaagcgggctcggctgaagaggccgagcagcgcgctggagccttcctggccccgctgcggcaggcgctggatgcgtaa

SEQ ID NO: 83117 - DNA, 303 bp, Glycine max
  Peptide Sequence Number=SeqID_199895
gctgctccagatcaagtcaagaactggttccagagcaatcctgagttccttaaaccagctgatccggagacatctttgtttctaaatcagaagtcgcaactggcagcattcttagcaagctcaaaatctaaagaaagtcttgctcagaatctcaaagaagttctccaactacttcaacaggaagtggaagaagaaccttccaagaaggaagctgaatcatcagagactaatgatgaccaagaagatgatccattctaccagaatgaagatgactgttttggtatatcattggacgacgattaa

SEQ ID NO: 83118 - DNA, 309 bp, Glycine max
  Peptide Sequence Number=SeqID_199896
atgcagaatcagaattgcaaaatgctctcgatgaattgcagaaggtttcaagtccctattatcagcatcctggagagaatccagaatcgtgccatgagaagagctttgctgtcaaagaataagtttaagttcgttgaccaaacgatttctattccgtatcagagtagttcgatctatgatgcatgggaacgatgcaatgtcatggtgatttcttgtatcactagaacccaaattccaaaaatagcaccaagcaaggtgtatattgacgatgccagaatgctatgggaagatctgaaagggcaattttga

SEQ ID NO: 83119 - DNA, 989 bp, Glycine max
  Peptide Sequence Number=SeqID_199897
atgaggggcactgtgcatgagcctcaggcgcacctaggggcaggtcaaaagttctcacccgtcgatggtggaccattgggtactagtacccttgccttgagagggttgcacacccttgccttcagagggctacacgaccttaccttcagagagctacatgccctcgccttcagaggactacacgacctcgctttcagagggctacacgccctcgccttcagaggattacatgtcctcgcctttagagggctacacgccctcacctacagaggactacacgtcctcgccttcagaggactacacatcctcgacttcaaaggactacacgtcctgcattcagagagctacacaggactacacgtcctcgccgtcagagggctgcacgccttcgccttcagagggctacatgccctcgccttcagaggactacatgtcctcgccttcagagggctacatgcctgcaccttcaaaggcctaaacaccctcgccttcagagggctacacgtcctcaccttcagaggactacacgcccttgccttcagaggactaaacgtcctcgccttcagagggctgcacgtcctggctttcagagggctccacatttgcgcctttagagaactcaagttcctgggccacccctctgatcttcgaggagggccaactgtgggagcacaactgaaggaggaggcagggaacgcgcctgcaagacacccagtggactcggagaagtccaacagggtccaggggtttccagctttgattatgaacctccgtcagttctacggagtgcctgtcacccccagcagggtcatcaggcccctattaacaaggctttcattgagaagtattgtgcccccaggtaggcgtagggcgaggcatcacagtagcgggcaacagatgcactgccaccacctcagctcatctacaaaagctggagtgttgcctacgacatgtggccgaccagtaggcgaccaagtccaaagacaaag

SEQ ID NO: 83120 - DNA, 552 bp, Glycine max
  Peptide Sequence Number=SeqID_199898
atgcaagaaaagactagctctataaagtgcttcaaatgtcttggaagaggacacattacttctcaatgcctcaccaagaacaccatgattatgaggagtcaagacatttatagtagccaagatgaggctactacttcaccttcctctagtgaaagtgaagaagcaaaaggggaagaatctagtgaagaaatctacccccaagaagaaggacaacctttaatagttaaggaggagtgtaaagaggtaagtgtctcctccaagaggttagctaagaaggaaaggaattttgaaataaagacaaattttaaagaaatttcccctcttagacaacctccacattttctcctttgtaaaaagacacttgttagcattgccacacctcttgggcttgagcttattcctcaagtaaaggagttgttggatgagggtttggttcgcaagagcttaaatccttatgctttgttggtgcccaaaataggaataatcaacatgaaaatacagaaaaaggtgttgagggaaaaagccaagagtttcaagaacctcgggatttga

SEQ ID NO: 83121 - DNA, 804 bp, Glycine max
  Peptide Sequence Number=SeqID_199899
atgatacaagattgtgatgaagacggtgtcatcctgaacgtccagcacattcgaactcccctggtcccaatacatatcaagatgtgcgaggcagctctgtttgaccatgatcatgcagcgtgtgaagtatgtcctgtgaatgtaaaaggatgcccgaaggtacaagaggacatacaagggctgatagacagcagagaactaatcatcacgaggaagggcaaagaagtgtgcgtcattacccccgagtttcagcgggtggaaataagctataacagtggggaatcaactactactccactagtgattagcttgccaggacctatgccgtatgcttctctaaaagcggtcccttacaagtatagtgccacgatgttggaaggtgggcaggaggtgcctttgccctctctaactcctgcgatttctgtggacaacattgctagtgacagcaggattctgaggaatggacgtgttatccccactttgtttgcaaagaaagtgaatgatccggcagttaaacaggtggcagtgaacggccccggtacaaggaaggaagtaggccaatccaatgggactaacaagaattctgatcatgacgaaattctgaaactgatccagaagagtgagtataaagtagtagaccagctgttgcaaactccctctaagatatccattttgtctctgctattgaactcagaagcacaccgtgaggctctaatgaaggtgttagaccaagcttttgtggagagggacgtgactgttaacccaattggacagtatagtaggaaacattactgcttgcaataa

SEQ ID NO: 83122 - DNA, 333 bp, Glycine max
  Peptide Sequence Number=SeqID_199900
atgtcgtcatctgcacctttgtcatccagagacggcgagtccgatgacatgcgggggtaccttatggttatccgcaccttttgtcaaccagaggcaagcgagcccgttgacatgctgagactaacatcgtcttctgcaccgtttgccaatcgcggtttttactctcgtcgtccggaaacattcaagtccaacgacgcgcgagattcttctctgctggctagggacgatcgagtgcaatggcgaagggaagtgtcgcggttgtccaactttgtcgttttcaagacactaagggatattgactggccggatgacgttccgctcgaaggaaattag

SEQ ID NO: 83123 - DNA, 129 bp, Glycine max
  Peptide Sequence Number=SeqID_199901
atgaagaaagaaagagtgtccaaagtacgctacatggcttgtaaagaaagatatttggtgggtggattatggtgttactactcacataagtgtgaccatgggttgcctgtggagacgactgtcaaatga

SEQ ID NO: 83124 - DNA, 685 bp, Glycine max
  Peptide Sequence Number=SeqID_199902
cgtgctgctggtggatcgcatcaaaaacagcaccaacggctcgctgcaaacggaaaaagccacggcagcgattgagaacgcgctggcgaataacggcaagttcagcctggtctcaaacgatcagcttaatcaggcgaagcaaacgctcggcctgtcgccagaggatagcctcaactcgcgcagcaaagcgattggcctggcgcgcatcgtcaacgcgcagtgcaaaccggcgaaatcatctggtcgggcaacggcgttgcacaaccctgatccccggctgcagcatctggttcagcaacaatggccgacggcgcaagctgccggtacgcagcgagcagggcgatctgctggcgcgccggacaccgtcgcagcccatcccgtttgtcgatcgtcagcgcgaataccgcatcctgcgtcagttgcgtactacggcgctggcgccgcagccgctgacgtggcaggcgccgtggctgctgcagcgctggctgccgggcgaggtgctgtcgccggatcagttcagcgcgcagcgcgcagcggtgctgacactgctgctgcgcctgcatcaccagccgctgaccggttatcgcttacggctggcgccgttgctgcagcgctactggcagctgtgtcagcagcggcactggcgctggcagcggcgcttaaaccagttgctgcagcgcggtga

SEQ ID NO: 83125 - DNA, 544 bp, Glycine max
  Peptide Sequence Number=SeqID_199903
atggtttgtaatgaccatgctgatatgaccgacagattgcttgctggctcattcacctttgaatgtcgcattatgcattatatcctttgtcgagttttgcttccacgttccataaatcttgctcaggcctctgacgaggatttaattttgctatgggctcttcaaaccggtggccaaattgactgggcccatcttgtcaggtatcgtatatataaggcattacgggctaatgcacctcttccatatcctcatcttgtcactctgtttcttcagcattttaatattcctttagaggatgaaccttttgttaaggttaaaagatcatttgctattggtgctggtgttgttgcctccttcggataccggaaggatgtggatggccaatgggtgcataaacaagacctgccccctcccattcctgatgaacgcacaccctccccacccccgcaacgagatacctcctcttccttatcgaatgacgttctcactaagctacgggatctttgggctttcattggcgatcgcttcgatgcaatggactcac

SEQ ID NO: 83126 - DNA, 948 bp, Glycine max
  Peptide Sequence Number=SeqID_199904
atggaggcgattttgtcgcacttatgcccctgtggcagcgctctggagtatagctcatgttgccagcgatatctgactggcggtcagcttgcgccgagtccgtcacagctgatgcgttcccgctatagcgcattcgtgatgaaagatgtcgattatttaatcaaaacctggcatccacactgtgaggcgccacgctttcgcgccgatatcgaaaaaggctttgccaatacgcagtggcttggtttaaccgttttcgcaaccgataacggccgtagccccgatgaaggcttcgtcagctttatcgcgcgctttactgaagataaccgtcccggcgcgattattgaacgttccagattcttaaaagaaaacggacagtggtactatattgacggcacccgaccattaattggtcgtaatgacccctgcccttgcggctcagtaaggcccggcatcagcaattgcaaacacaacaggattttccccgcgatgcattcattacaacgtaaagtactacgcaccatttgccctgatcagaaaggcctcatcgcgcgtatcacgaatatttgttacaaacacgagctgaacattgtacagaacaatgagtttgtcgatcatcgtaccggccgcttctttatgcgtaccgagctcgaaggtatctttaatgacgccaccctgctcgccgacctcgatagcgcgctgccggaaggttcgatccgtgaacttaacccggccggccgtcgtcgagtggtcattcttgttaccaaagaagctcactgtctcggcgatctgctgatgaaagccaactatggcggtctggatgtcgacatcgccgcggttatcggcaaccatgaaacgctgcgcacgctggtggaacgttttgatattccttttgagctggtgagccatgaaggattgagccgcgaagagcacgaccagcggatggggtga

SEQ ID NO: 83127 - DNA, 273 bp, Glycine max
  Peptide Sequence Number=SeqID_199905
atggcaagttcaacatgctttcaacaaatttcttcacaaataactatcatgaagcagaaacctagcaaaactacccattatatctcccaaaacccaatacccacgaaaatcaaagatgcgcttcacgactccgaaaatgccttcctttcgcgatttggagcagaaatgatgaccaaaggttggagctttgttggagcttcaatggtggaggaagaagaagagaatggaaacgtgagagagagagggaaaaggcttctgaaattttggggctga

SEQ ID NO: 83128 - DNA, 615 bp, Glycine max
  Peptide Sequence Number=SeqID_199906
atggcgatcaggccgatgcgcgccatcggcaggcgcagcggcagcaccagatcgcgcggcgtaaccggccgggaaggcggtaccgaccgcccccgccggcgcgccgcacaccgcgccgaccgatatgccgctgaagatcagcgcggtggcgcggccctggctggcttccggcaccagatggcggccgtagttggcggcgaacgaccaaaagcctcctacgcagacgcccagcagcacgcggcccagcagcatcatcgggaagttgacggcctgcgccgccaccaagttggacaccatcagctgcacttacagtcccagcagggcaggcgtctgtccagccggccggaagccaggctcaaccctggtgcggccacggccgccactatgcccggcgtggtgaccatcagcccggcggtgccggtgctgacgccgagcgaaggggcgatgttggtcttcacgccgatcggcacaaactcggtggtgaccatgacaaaacaggcgaccgtcagcgagaagatcgccggccacggggatgatgcaggtttatctttattattcagcataatgccgctcgtcttgggtgaatgcgcaggccgcgctcggggcgcggtgtga

SEQ ID NO: 83129 - DNA, 249 bp, Glycine max
  Peptide Sequence Number=SeqID_199907
atgggtgccaagtacctcgaagtggtcaaacgagggtcgcatcccaataatggatgcattacctgcattctctccctcacccaaattcgtgcactgtgcatttttgctttattttttcatctctacgcatcttcagcaaacaacaatccaaatgaacttgctatgtgcgcctactgtgctaagcgagttcttcttttggggatgaacattcatcttcctgaggggatacctatggctaagcggggctaa

SEQ ID NO: 83130 - DNA, 588 bp, Glycine max
  Peptide Sequence Number=SeqID_199908
atgaccgaccctctcaatgagtcaatctcatgttttctcataagggtggacccttgggtactagaacctgtcacctttagaggactacacatcctcaccttcagagggctgcacgccctcgccttcagaaggctacacgccctcaccttcagagggtcatgtaccttcaccttcagaggactacacatcctctcctttagagaactacatgtcctcaccttcagaggactacacgtcctcgccttcaaagggtcatgtaccttcgcctttgtagggctacacgccctcaccttcagaggactacacgtcctcgccatcagaggactacacgtccccaccttcagagggctacacgccttcgccttcagaggactacatgtcccccttttcaaagagctgcacgccctcacccttagagggcgacacgccctcacctttagaggactacacgtcctcgccatcataggactacattccctcaccttcaaaaggcgacacgtcctgaacttcagagggctgcatgccctcacctttagagggctacgcgtcctcactttcagtgggctccatatccacaccttaagataa

SEQ ID NO: 83131 - DNA, 950 bp, Glycine max
  Peptide Sequence Number=SeqID_199909
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgccaggccggtagcgtcaagtcccggaagtcagccaagcacgccacgtccgactggatgacgctggagaaggaacgcggcatttcggtcacctcgtcggtgatgcagttcccctacgatggccgcatcgtcaacctgctcgatacgccggggcatgccgacttctccgaggacacctaccgtgtgctgaccgcggtcgattcggcgctgatggtcatcgactgcgccaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 83132 - DNA, 134 bp, Glycine max
  Peptide Sequence Number=SeqID_199910
caccgttgttgttcggatcgatttcaacgtcgggtgtgatttgggtccgacgttgtttcagaaatctataaagacggtggaggttgcacccgttgttgcttttaaaaatttcaacatcgggcttatgcacaccc

SEQ ID NO: 83133 - DNA, 327 bp, Glycine max
  Peptide Sequence Number=SeqID_199911
atgtacatcaagtatggcccaaaatacatcatgaagcatagccaacaaaacaagttatccaatgaaacaaaaaccccccacacttattcccaaaacaattccaaagctccaaaattccttaaggatatggtgatatcatggaaagggaaacaaggctcaaaagggctatcaaaggaattaattcaaggtaagtccatttggctagaagcttataagaacaaaattgcctcaatcatttccaaatatgcatgtgaattaggaagcatcaacaagaatcaagccaaggctattgtgcaggcaatcaatggggcaaaacacaccaaatga

SEQ ID NO: 83134 - DNA, 415 bp, Glycine max
  Peptide Sequence Number=SeqID_199912
atgacttcgaagatacaaatattggggcgcctaggcgtgttggccatgtatatcatgaattcaattattacaatgttgtatttcaacggaagagtatatgaagacaatgatggtgtaatatttgaaggcagtaaaaaggccattcagattaaacgcggaattagtttcaatgctttgaaaaaaaaattggagataagatttttagtttcaggaaaatatgttgcgttgcaaatttgtgatgacgaagatgttgaaactatgatcgaaagttttcaacaacaacaacaaatgtcagttctagaattgtacgtagaaaatgatgttgctggtggttcgatgtttcatgctgcaaattctgttacgtcatgtgaacgtaatgtatctcatcatgaatcggaactgccaagaaatataa

SEQ ID NO: 83135 - DNA, 942 bp, Glycine max
  Peptide Sequence Number=SeqID_199913
atgaaggctgacatagaggccatgaaagagcaaatgaccacaatgatggaagccatgatgagtatgagaaaaatgatggaggtcaacacggctacggtcgttgatgcaagtactgccactgaggtggaccagactcacccatctggcctcaatcaattaaatcctccagtctcagatatgaacaagcattccttcccaccatatggcttgcctcccaactatacaccatccaatgttgcacacgctcctgatgagaatgtcaataactccactcccatactcattgagagtcaacaaccccaatctagtcaggcacaggtccctcaactcatgggggagacacatgaagtaccccgagaccacactctagccgactccgagccttgcctcgaatatgctactgaggggcaagcattaggaaaagtccctcctgctaaggtggaaaaggagaaattggatcatatagaggaaaggctaagggccattgaaggaggcggagattatgtttttcctgacatggtagagttgtgcctggtgcctgacatcgtcatccctccgaagttcaaggtgtcggattttgataagtacaaggggactacttgccccaagaatcacctgaagatgtacatcaggaaaataggggcatactcgaaaaatgaaaaattgttgatgcatttcttccaagaaagtcttattggggcagccatcacatgttatactaatttggaaccttcccagaacatgtgtaagaaggagcatgaatctttccaagaatacgcccaaaggtggagggatctggcaactcaagtaacgcccccaatgatagagagggagatgataacaatgatagtagacatgttaccggtgttctattatgagaagatggtgggttacacaccttcaagctttgccgatttagttttcaccagcgaaaggatcgaa

SEQ ID NO: 83136 - DNA, 192 bp, Glycine max
  Peptide Sequence Number=SeqID_199914
atggttcaagttgaagaagtggggggacattgtcatgaaattggtggagtggcctatgggatatggatcaagttgaagaagtcagagaccttagtatggctggactttgtggagtgtcctaagcctatggttcaagttgaaaaagtggggaccttgatatggatttggtggagtagccagcgatttgtctag

SEQ ID NO: 83137 - DNA, 184 bp, Glycine max
  Peptide Sequence Number=SeqID_199915
gttaattagacaagtttgtgaagtgctgattttcatctgctcgctaagccaatctgctggcttagcgagccatctgctgagtgcactattcccttggctgagcgcgaggaagaaggatgagttgtgcatgttcgctaagcgagggttcatcccgctaagcgcaccgcttcagtccattcgctga

SEQ ID NO: 83138 - DNA, 820 bp, Glycine max
  Peptide Sequence Number=SeqID_199916
atgcactgtttcggtatcgccggagacgagatagtgcccccagtagagatccttgacatcgcgcaccagcgcatatgcgcaggtgggcggcagccagccgatctcgtgaaccttcttcaggtcaagctggatacaatcaggcacggtggcacggcggttctcgtaatccgagcatcgacagctctagccgtcgagcagcacgcagcggacggaggtgaacaccacttcgccggtgtcccagtcctccagcttgttgagacagcacaatccgcagccgtcgcacaggctttcccattcctcgccggtcatctcggtcagcgatttggttctccagaacggcgccatattggcaggcggcgaaggggtcattggcccgcgaaaggccgccacgtcaagcacttccgacataaccatgccacggttttgcgtcgggaatgggttgaagcgcagaatatcgacggtcgcattgccttaaacaggaaatatcgccaggtgcaggaagaaaaagacgataaaaaaggccgcaaaaaacggcatatcctgctccggatcgatagcttcatcgactccggcctgtggacggctgcggcaaggctggtggatttctgggaagatgtcaccatcgcctcccgcaagctgcatgtccgcggctggaagaagctcctcgtcaatctcacctgcgacgcgctgacctttggaacggcgggatcggtcgtgcttctggcgcttgccatgcccgctttcgaagaaaccaagaaggactggcgttatcgcggtgacttcgcagtcaccttcctcgaccgatacggcaacaccatcg

SEQ ID NO: 83139 - DNA, 234 bp, Glycine max
  Peptide Sequence Number=SeqID_199917
tcccgaaccgtcggctgtcggtggactgctcgagctgcttcgcgcgagagcgggtcgtcgcgtgccggtcgggggacggattgggaacgggccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 83140 - DNA, 261 bp, Glycine max
  Peptide Sequence Number=SeqID_199918
atggttaaggaggagtgtaaggaggtaaatgtctcctccaagagaacacttgttagcattgtcatacctcttgagcttgaggttattcctcaagtaaaggaattgttggatgagggtttggttcgtaagagcttaaatccttgtgctttgttggtgcccaaaataggtattatgaggcaccaaatccctatgatagatgtaccactcattaagttgataaggaactatgttccctcatgggaagatgcccacaaatcctaa

SEQ ID NO: 83141 - DNA, 771 bp, Glycine max
  Peptide Sequence Number=SeqID_199919
atgttcttcgtgctgcgtgcggttggtatcgatccgctgccgatcctgttcggcgatggcagcatggggccgagcgtaacccagcaagccggtcaatccggacggaccgctgccgaggggggcgcggttgccaatgatgagacaacgcagttcgcccgcaccgtactggctgagacggaagacgtctggagcggcattttcaagtcacgcggccagacctacacgccgccgaccatggtgctcttttccggacaggttcgttcggcctgcggctttgcttccgcggcgtccgggccgttttattgccccggcgatcgcaagctctacatcgatctgagcttctataaggaactggcaaaccgttttggcgcttccggcgatttcgcacaggcctatgtccttgcgcatgaggtcgggcaccatatccagaacctgctcggcattctgccgaaattcaaccagatgcgtcagcagatgagcgaagcgcaggccaaccagatgtcggttcgtgttgagcttcaggccgattgcttcgccggtgtgtggggttactacacggaacagaagggcattctggaggcgggcgaccttgaagaagctctgaatgcggcacaccagatcggcgatgacacgctgcagcgccgtagtcagggttacgttgtgccggaaagcttcaatcatggcacatccgcccagcgcgccaagtggttccagcgcggcttcgatagcggcaagctggaatcctgtgatacattcagcggtgatgtttaa

SEQ ID NO: 83142 - DNA, 219 bp, Glycine max
  Peptide Sequence Number=SeqID_199920
atgcaagtcgcaggaggcattggtgcgtttcgtgacgacgtgacacctgacactagtgtcatcaatgctgttagcgcgttgcaggagggtgcaggccagcagaggccatttccgagggttgcagtctgcaacgcgcagaggttgcaagatgtcgctaggttcaatggcgatttggttgggcaaaagtgccagcaccagcagcgatttgcgttgcttgag

SEQ ID NO: 83143 - DNA, 411 bp, Glycine max
  Peptide Sequence Number=SeqID_199921
atgcaattcattgaagtttcccaagcaagctttgaagccaacaaaaatacaattagaaatcttgagattcaagttgggaggctagcaaaccaaattgttgaaaggtcttttatgaccataagggaagaaaagtcaatagaaattaaagcacacaaggagagtcttatcaaagagcatgattcaagagaaaatggtgaagaaaaggaagcaaaatttgaagagagaacaccaaaacaaggaagaaggcatgaagaagtggataaatttttaaaaggttttattgccttgctcaccaacacttcctctgcaatggtttggaggtcacttcatggatgcatgaatttcatggagtttctacctaagaagagaaagaaggatgatgtgttctttatgacttatatgccaccttaa

SEQ ID NO: 83144 - DNA, 549 bp, Glycine max
  Peptide Sequence Number=SeqID_199922
atgaaactggcagcagttaacccagtaattgatttcaacctcgacagcttactggctaccgaaggagtgactccaatggactgtaacttccctccgacagttgcacctgtcatgtggccagaaatcccacagaacggaaacagacaacaatatcagcaaccgtggcagtttgatgcattccaccaacccctttgggggagggaagaagacaacactaacatgactccagaaaactcactctggagttatgactcatcggcaaattcagtattagcaattagccatgatttgagcagcctcaacattcatcaggttttccctgtctctattttgtcagagccagttggaaaacctggattttattcagccagcaaggaagaagaattgttacaagcttttcagatgctgcaaatgatgaatttaaagaggatatacatcaagctgaacctattttcaattttcctgttttccaagatgatgcttctttcaagatgctgtctcctttactctctcttcgaaagcattacccttgtcatgggtgatccatga

SEQ ID NO: 83145 - DNA, 414 bp, Glycine max
  Peptide Sequence Number=SeqID_199923
atggcagtgaagaagtgttattgcgagaagcaattccaagacacagcagcggatcggaaacggcacgttctgggtattcaacagcagcaggccaaagctcgctggtacgattccttcaaacagcaacaaatccctcccggattttgccgttacggcgactcttgcaaatatctccatcccattcccaacaacaatctacagcagcccccagtcctaaccacaccgtcaccgtcaccgccaccagttagtgagcaacacaataataaatgtgcagggaatgtggtaggagtttcattggacaatcttccccccttgcttcagcctccacctgaagcagatgtttggagtagttttggggatgagaggcattgtaaaggagctaacgagaataagcatggattggttgtgatttag

SEQ ID NO: 83146 - DNA, 174 bp, Glycine max
  Peptide Sequence Number=SeqID_199924
atgacaaagctgaatggaacaatcccaaatcaacaaacatgggacctcatgatcaagttccacatcactatgttgttgggtgaatcatctggggctgtcatgaaactgtgcatacaaacattggagggtcgtggcatgagtttagcagagaaagggtattgtgatgtgcgttag

SEQ ID NO: 83147 - DNA, 573 bp, Glycine max
  Peptide Sequence Number=SeqID_199925
atggtttttacttttccaatagtgaaccaagccttgtcgtgtatgaggggtgatgttgtgtatgggaaaatgatgcactgtgtggcaactcagatgggtttggatggggatttgaatttttgtaataccatggttgatgtttatgtggaatgtaggtgcgttgatagtgctcgctgtgtatttgatgagatgtcgctcagagatgaggatggaaatggaaccaaatgtggttatgcttattgtgatgttgcaagcatcttgtgcttccatgcattaagagctgccataagagtggcaagttggttcaaagaaatgcaaagcctagaagtgcatttgtggaacattgaaactttaacactagttatattggcatttgcaaagtttggcagtctttctgagggtgaagatgtgcacaacttagtcatacaaactagtaacatcactcagggtgctatgatgtcaggtttcattcaaaatggcccttttgtggaggccatagttttattccaacaaatgcgagctgaagatcttaatattgtccctgaaatttggagaaatcttcttgatgcataa

SEQ ID NO: 83148 - DNA, 633 bp, Glycine max
  Peptide Sequence Number=SeqID_199926
atgtcagatgtttccgatgatgctaccccaacatggtttgatccttgtcttgatccctcaagtccatatcatattcatccaagtgaaaacccatcttccgtttctatttatccaacactggatggtaacaattaccattcttggtcccgttcaattagaatggccttgatatctaagaacaagataggttttctagctggcacaatacctgcaccagatgtccatagcccttcctatccttcttgggaacgttgtaataccttgatcagtgatctactccgcatcgcagaactccaagaggaaatatatggtctaaggcaaggctctcgttttgttatggattattttactgcacttaaatctatgtgggagagcatttcttgttcgttctcaaatcctgcttatggacctgttaaccgacgtggaggaggtgctcctgtaggacaatctaggagcaatactcgcactttctccaacaaaaagtgcgtctattgtggtcgtaatggacacacagtagacatatgctacgccaagcatgggtatccccctggtcatccgcgacattcggggcggccacgtttccacaacaaagagagctcttcttcttccactactgtcaacaatgttgcgtag

SEQ ID NO: 83149 - DNA, 372 bp, Glycine max
  Peptide Sequence Number=SeqID_199927
atgcccactccaaatcccagaattaaacctttgttggttcaagctgggtttttagatgttgcaaaggttgaacaagttaaaatcgatgaaactttagtgactgctttggttgaaaggtggataccagagttacacacgcttcatcttcatgttggtgaatgcataatcaccttggaagatgttgctctacaactaggtttatgcattgatgcaaaacccacaccacaaaaactagcaggccactgtagggaatacattctagggctgattggtggggtgttgatgtcagacaagtcagggaacatagttcaactgatgtatctacccttattagcatattttgatcgagctagctatacagctagggtttga

SEQ ID NO: 83150 - DNA, 168 bp, Glycine max
  Peptide Sequence Number=SeqID_199928
atgcagggtacggtaatgaagggcaagaaaatcatcccaaatgacacagcttcacaatattatctgtggattggttctaccttatcaattggagatgttagaaggtgcaaaatcatgccgatggagcatccacatccatgtcaatgtagggccacaaaacttggatga

SEQ ID NO: 83151 - DNA, 1064 bp, Glycine max
  Peptide Sequence Number=SeqID_199929
atggtgacaaccaatgatgcaggcgtagtagtagattggtggtatttggacacaggttgttctaaccatctaactgggaataggcagtggttgattaactatgattccagcaaagaaagtagaatcaggtgtgctgatgatgagtacttggttgctgaaggaatgggagatgtgctggtagaattgaaggatggtggaactgtcttgattgaaaatgtgtggtatgtgcctggcatgaagagtaatttgatgagtgtaggccaattattggagaaaggttactcagtaactatgagaggtgcagtgctgcagctgtttgataattctgataaactggttttgaagtcaaaactgagcaggaacaggacttttaaatgcaatgtaaaagattctggtgtgaaagtattgagtacagtgactgaatcacagagctggctatggcataggagatttggacacttgaatttcaagagtctaactcagttgagtgagaaggagctagtgacaggtatgccaaagattggtgtgtgtgacaagacctgtgatgtgtgcttgaaaggcaagcaaaccaaattgccatttgctgatcagtcacctatgagagcaagctctccactacatgcagtgagttctgacatttgtggtcctattgaagtgccaacacttggaggtaataaatactttattactttcattgatgagtttactagaatgatatggctgtatgtcatcaagcagaagagtgaagcattagaggtgttcaagaaattcaaagctgtggcagaaacacagagtggccagaaattaaaaatattgagaacagatggtggaggtgaatacacctcaaaagcatttgaggaattttgtgaagctcaaggtgttgtccatgaggtcactccctcatacacaccacaacacaatggacttgctgaaagaaggaataggaccttgcttgatatggcaaggagcatgttgaaacaaaagaacatgcctcatgagttttggggtgaagctgtaacaacatcagcttacattctcaataggtgtcctacaaagagcttgaa

SEQ ID NO: 83152 - DNA, 324 bp, Glycine max
  Peptide Sequence Number=SeqID_199930
atggcgagtagtattattccactcttggccatgattattgtacaattgggctatgcagggatgaatattacctcaaagcttgcaatacaatctggcatgcaacctcttgtacttgttgcttatcgccaaatttttgcaactatttcccttgctcccttcgctttttggtttgaacgctcatacaccctatgttcaaggaaccttatagttcttgaaccatttaggcctaaggctatttctcccatctcagattctgcatccaacttctcgtcctctatcaacacaacatcgatccagagttctacttctgggatgataagttga

SEQ ID NO: 83153 - DNA, 192 bp, Glycine max
  Peptide Sequence Number=SeqID_199931
atgagggacttagaaatgttgggtatggctacgtacttggctctatctagcgcggctcggctgaaaagtagttttatccttgggtctaatttcaacttgtcattcatgtcttgcaagaaacagatggctgtagctatcttcatgggccatagttcaacctcctcagcgccgccgctaatgttaattttgtag

SEQ ID NO: 83154 - DNA, 117 bp, Glycine max
  Peptide Sequence Number=SeqID_199932
atggccacgatgccgaaaactaaacatggatttcacttgatgatggaaagggggggttgctttatgacgacaacggatgcagcatcttttgggaagatcaattcagtggaggaataa

SEQ ID NO: 83155 - DNA, 603 bp, Glycine max
  Peptide Sequence Number=SeqID_199933
atgtctcagcttggtcactccacagggactatttctactgggctagcgtatgtgctaatgtcatggaccatagagaggaaaggtcccctttatgtgtctgtgttctcccctttgctgcttgtcatcattgctgttgctagctgggctttgcttcacgagcaattatacgttggaactgccattgggtctctgctgatagtgttggggctatattttgttttgtggggaaagaacaaagagatgaataagatagacatggttgaagttgaaggcacagtcatggaggcaataaaggaaagcgagaaggatgaggtgaaagacctggaattgcaaccctatgatccttccaacggtaatgtcatgttatgggaaaaatgtttttattttcatcttgagcaactcccaacaaagaagtttgatagttctttagagggaaagagaccagctacccatgatggagaaggcgatatcattatttccatcacagaagacgaatgccaaggagaaatagaggggaatggggaggcttggttagcgagaaagatgactaccacaaatggtttcaatgtgaaagctttcaaaacaacaatggcatatacgtga

SEQ ID NO: 83156 - DNA, 147 bp, Glycine max
  Peptide Sequence Number=SeqID_199934
atggatgcgtattgtacaattaaagcattgatgttcctgactaatgctaatgtagttgtttggcctattgtgcaacgaacaaaactagatgacaacattttccttaggcaaaatgatgaccatttgccaatgtgcactgcagtgtag

SEQ ID NO: 83157 - DNA, 323 bp, Glycine max
  Peptide Sequence Number=SeqID_199935
aagcgttaggtgtggcaaagccttcagtagctagttaccttagccaggagatactggcagagcaagaagctgatagagtgcatggattacctgcgcagcctccggttaagttcaacaatatggtggttatattactgtcaatgaaactcaaggaacaacactgttctattggtttttcgaggccactcacaaaccagaacaaaaactcgttctcttatggctcaatggagaatcacaaaccagaaggtcaggaagtgagtgcagtaggagtaaacattgataatcacatgaatgaaggcagtggctggattacctcagcctaa

SEQ ID NO: 83158 - DNA, 450 bp, Glycine max
  Peptide Sequence Number=SeqID_199936
atggaggagacacatggaatgccccaccacaatctagccgacttcgagccttgcctcggatatgccactgaagggcaagcagttggtggaatgggaaagttggatcatctagaggaaaggctcagggccattgaaggaggtgaagattattcctttgctaacctagaagagttgttcccaatacccaatatcatcacccctcccaagttcaaggtgctggactttgacaagtacaaggggactacttgccccaagaaccatccaaagatgtattgtcggaagataagggcatacgcaaaagatgatgaattgctgatacatttcttccaagaaagtcttactggggtagttgttacttggtacactaacttggaaccttcccgagtccattcttgggaggacctaatggttgccttcgttaggcagtgtcggtataatggcttcggatag

SEQ ID NO: 83159 - DNA, 285 bp, Glycine max
  Peptide Sequence Number=SeqID_199937
atggcgccctttacatgtgcatgcggaaaatacaataaggaagttgtgcttaggtataggcttgaggtgatgatcaaccagggaaatgaaagcacaaaattcctgctttgggaccgtaagtgcagtgaattaattggtcaatcaactgatgtagttaataagcataaaattgaagatggtgatgttgatttgaatgcttcaccccaagcacttgataagctgctgggttatgaacttgctttcaagataaaggtgcaacccaagttcggaattttgttgttttga

SEQ ID NO: 83160 - DNA, 903 bp, Glycine max
  Peptide Sequence Number=SeqID_199938
atggatcatgtgctgaaagaatgtgaggagccaggggtggaagtggacgatgaggattatgataattatccttttagccctgacctaagcccccccccccctaaacccaaacgttggtctattgatggtgtctcacaaaccaatgactatgggacccaccctacactagaaatagagtcgtccatgatgaatgttggaatttctttggagaacttttctcttatgacacttataaaggagcctaacctcttaagtgaagggaagaaaggggacatgatgggacaagtaaaaggggatatggaaccaaaagttttaccaagtttagggaaaaaaagaggtaggggaaaaggattaggggaaaaccctaatatgaataatgagacagaggaaggaaagaaagactttgtggagagaccagagataaagggcaagaggagtatggagatggtggcgaaaggtgactcgatggaggtggaggatgaacaccttaacaaaaaaaattcaccaagcaagaccactcgttattcaagagggtctcaatgtaatgttaatggagacaaagaagaaggtagggagtataattttctgaggaatttagggtatttgaagcattatttcggtgtggactgtaagggatgtggaaaggctaaagcaagtgctctgatccttctctggaaagatttgcttaagcctctagatgactacccttgggtttgtttgagggatttcaaccaagttagattaacgaaggagatggtgaggggagatgctccaaacttgacttcgatgagaaccttttatgttggtttatctaattgtggtcttactgatatttgtcaagttgggttctgtctcacttggtcaaatatgataaaagacccctacaatactcaagaaaagtag

SEQ ID NO: 83161 - DNA, 795 bp, Glycine max
  Peptide Sequence Number=SeqID_199939
atggcgaagagcgaaaagtcatgtcgttgcggcacgatgcgatgggccatgcaaggtattagaaaggggggagagacgtataatggaaacgccatcacgacggctcaccatggtggcgtgatggggcataaggagatgtgtgagatagggaatgggatgagagtcgttgtggcggtgcgaggcggcgtcaacgactctgttgctacttgggtcgaacaagagagaagaagcagggataagagtggttccgtaatgagaagacagaggtcattggaaatcgcttcaccaattgagcatggcgaagtgcgactgtgcatgatgatgtgggagtcaatgtttaatgcaattaatttgagtttggccattgttgccttttcatttgctttgattcctggtgtagttatgtggttttgtacaaatggtgcacacaacaagattatacaagacattaacaacatggtcatggccaagccaaagaagcaggggggagatgatgcttacctgccaccctttgtggtgactccaccatggtttcgaaccatcaggccaccctctgtggtgactccaccatggtcgtcaacaaggcctacacgtgcttctctcctcgctcccactattttatcgttattccatggtagtgtaggagcgttgccgtcaccattcgcccttggacccttcgctggtggcgttaggccgctacccccatggtggcctcacgccgcaagaccttgcactagtggcgtcacaggcagcacgctagtggtttccactttgggtgtgctgttttctacgtga

SEQ ID NO: 83162 - DNA, 429 bp, Glycine max
  Peptide Sequence Number=SeqID_199940
atggctgcctgtaaatctgtcaatgttgatctcatgacctatgtgccgatgttattcactttacaacatattttgcacatctacgacaactcctttggtttagtgccacacaaatcaatttgtggcaagaatatgaaggagatcagtggggtcctgatccaaggagaaagaggactgcaaagggtcgtcccgtttcaactcgcattcctactaagatggacgaagacgaaaatgaacgagcaagaagaacggaagtcggggtgtgagatcccgacttccgtgaagtggccaaaacagagttgcggcggaggaggtgtgggtatgggtaacgaggaggtgagatgggaggttagggataaagtgggaaacagagagaaaaagggcataaaggaaaagaaagaaaaagaaaaagtgtcagcctttggttaa

SEQ ID NO: 83163 - DNA, 426 bp, Glycine max
  Peptide Sequence Number=SeqID_199941
atccgtcctttatggagacactacttccaaaacactcaggggcttatctttgttgtggatagcaatgatcgtgaccgtgtagttgaggctagagatgagctccaccggatgttgaatgaggatgagttgagagatgctgttctcctggtatttgccaacaaacaagatcttccaaatgctatgaatgctgcagaaatcacagacaagcttggtcttcattctctacgccaacgccactggtatatccagagcacatgtgccacctctggggaaggactatatgaagggctggactggctctccaacaatatagctaacaagagcttcatttatagtgtacgttgttcatatttagtgcccgtaaactacgagtggctattggctaacaccttccacttccctcacatttctcctcctggtttttaa

SEQ ID NO: 83164 - DNA, 738 bp, Glycine max
  Peptide Sequence Number=SeqID_199942
atggttcgcgtgctcggaagaccagcttttcacgacaccactctaatatcttctggtcatctctgttaccttggtggcgagtggaggcaagatgttgcttttgcgggttttgaggttccaatacaaatggacatatctgctcaaaaaatgatatttggtgtgcctgggattgatcctcaaagaagagacgagctaatcaaggtattagatatcgatctttcctggagattgcataaagtatctgatggacaaagacgaagggtgcaaatttgtatgggtctcctcaaaccattcaaggttcttcttctcgatgagataacggttgaccttgatgtcctagcaagagctgaccttctgagatttctaagaaaggaatgtgacgagatgggtgccactattatctatgcaacacatatatttgatggtcttgaggattggccaacaaatattgtttatgtagcccatgggaagctgcaactagcaatgcctatggacaaaagaacagtagaaagttggctgcggaaagaacgagatgaagatagaaagaaaaggaaagagagaaaagcagctggtcttcctgaatttggaaagcaagttgtgggaagccatgtaacaggggatccagcgcgtgctgcagttcaagtaattaataatggttgggctgcaggacgattaaattccaccattgctggcgaggaaaactttctcctgagctcaaaccgagtattgaggcagtag

SEQ ID NO: 83165 - DNA, 255 bp, Glycine max
  Peptide Sequence Number=SeqID_199943
atgatcatatttgaaaccacagatctgcaagtgctctgttatggttccgttagggatgtatttggtggagaacgcgaggctgaccgaatcgaacctatcgctgtgtttttgcttgtgatggtaaggcttgcgatggttctgcttgatgaggttgcgacggttgttttcctcgtcggaggagtccttgttggccacgatgatgaccgagttgcggtgagtggggaatataaatcatcgactcattttggagggtag

SEQ ID NO: 83166 - DNA, 222 bp, Glycine max
  Peptide Sequence Number=SeqID_199944
atgttcttacatatcaagtggcatcaggcattgaatgaatctcctattggacataaccagtcccctaaagttacctcagaagttgtggccatcgctgaagatattaatgacatgtcatttatcagtgcacaatcagttgaagtcacctcacatacaacagacaagggacatgatggtttattggaggaagatgaaaatggagcagagcaaaggatagtataa

SEQ ID NO: 83167 - DNA, 327 bp, Glycine max
  Peptide Sequence Number=SeqID_199945
atgtattgttccttctctcttgacacctcttctccttcttcacccatgaacaaattccaacacaaagaacaaaacaaacccacacaagaagtgagcaatctctttctcactgcacactggtctctttttattctctatctacatcatcacggaagggtaggggaagtgaatagaaagggaaagggagtgttttggaaagaagggggagagtgccggttacgcttcagttttttcgaccgtttcctcgaggagcgcacagtgtggacagatgaaaatggtaacggcgtggctttcggcagcttgcgtccactatttaagccggcttaa

SEQ ID NO: 83168 - DNA, 801 bp, Glycine max
  Peptide Sequence Number=SeqID_199946
atggccagtggcgtgactacagtggactgcgagaaacaggtgagatcatggaggctgctacgttctctcatgcaactactaatccccacatgcaactgcgccaccattatagaagacgaccaagatctaacaacaacaacaaacgagaccctccgaaacacaagaagcaaatattataattattatacaccatcgtcatcatcactgatgagctccaccaccaatatcacaggcacgatcttcggataccgcagaggaaaggtgagcttctgcattcaggcaaacgccaactccaacaacccaattctcctcctggagttggcagttccaacagccatcttggccaaggaaatgagaggagcaaccctcagaatcgccctagagagcggtcgtggtgatggtgacgacgacggcaaagcagacacacttttgtcgacgcctttgtggaccatgtactgcaatgggaggaaagtgcggtatgccgttaagcggaggccctccaacactgatttcgaggcgctgaggttgatgggttcggtagttgtcggaaccggggttatgaagtgcaaggagttggtgagttggaagaaattagaagaagatgatcaactaatgtaccttagagcgagctttaagagggttcgtggctcagacaactgtgaatctttccacttgattgatccagagggagacatcgatcaggagcttagtgttttcttttttagaccagagctagaatacaacatccctcctagttgtgtaggacatggtgcccagattccgatgaatcaaaatgaatga

SEQ ID NO: 83169 - DNA, 2829 bp, Glycine max
  Peptide Sequence Number=SeqID_199947
atgtacatactctcttatttctcaactattgcccttctcttcctctttcattattatttcaatgctcctatgggaagaaccaaagtctccaccctctttgccaatagccataacaacaattacatgcctccttattccaacaccattagacaaactcttgaaaagttgatggggactcaaaaactgaggaagaggagaaagtctactcttggttatacaccctggctcagtctcacaaaaacttggtcttcgagcttaagtttcacagaagccgataggagactgagggaaaatgggccaaatgttccacttgagtattcctttccaagatggtggcatcttctatggaacgctcttttccatcctttcattatcactctgattgttttgtcagctctgtcattcattacctgtgacagtccaaatgggtttatcatgctcatattggttatcatcagtgtcacccttcgtttctatcaggaatacagcagctcaaaagcagcaatgaagctttcagaatttgtaaaatgtccaataaaagttcaaagatgcgccggtagagttgttcagaaagaacttgtagttcaagttgatcagagagatgtagttccaggtgacattgtgatttttgaacctggtgacctctttccaggagatatcaggttgttatcttctaaacaacttgttgtaagccaggcatcactaacaggggaatcttggacaactgacaaaactgctgaaatcagagaagatcacagcactcctttattggatttgaagaacatctgctttatgttattaacatcacagggcacaagcgtggtatctggtactggaacaggcctagtgatttccactggatccaatacttacatgagcaccatgttttcaaaagttgggaagaagaagccaccagatgaatttgaaaagggtctcagacggatattttacttgcttatttctgtcattctagtagttgttaccatcatgtttgtgataaattacattacatctcttaatttgagccaaagtgttctttttgccatctcagttgcatctgccctcaatcctcagatgcttcccctcatcattaacacatgtcttgcaaaaggagcacttgctatggctaaagacagatgtatagtaaaaagtttaacatctatacgcgacatgggatcaatggatattctttgtattgataagacaggcacccttacaataaatcacgcaatcatggttaatcatcttgactgcaggggtttaccccaagaaaaagtcttacgctatgcctttttcaactcttactttaagagtgatcagaagtatcctctggatgatgcaattctggcatttgtatattcaaatggattcaggtttcagccatctaagtggaggaagatagatgagattccttttgacttcataagaagaagagtatctatcatcttagaaacagaagacaaacactcacaattctttggcaggttcctggtaacaaaaggagcactgttagaagtattgagagtttgttctttcattgagaatttcgataaagatgaaatttcgcccttctcttcagatgattatcagcggattttaaatctctcagaagatttgagcaatgaggggttaagggttatagcagtagctataaggaagctgaaaatgccgcaaaaatgcgaaacaagtaatggaagcaaaagagaagaggaggatattgaaagagacatgatgttccttggcctcataacatttttcgacccaccaaaggactcagcaaagcaagcactgcggcgtttgtctgagaagggagtgaaggcaaaggttttaactggtgactccctctccttgacaacaagggtatgcagggaagttggcataagcaccactcatgtaataacaggtcccgaactagagcaacttgaccaagacactttccatgaaacagttcaaagagccacagtactagcccgtctcaccccaattcagaaacaacgagtggtgcaatccttgcaaacaattgaaaaccacgttgttgggttcttaggagatggagtgaacgattcactagccttagatgctgccaatgtaagcatttcagtggactcaggtgtagccattgccaaagacatggctgatattatcttacttgagaaagacctcaacgtgcttgttgcaggagtggagcatggtagaatctcttttggcaacacaatgaagtatgtaaagatgtcagtgatagctaacttgggaagtgtcatttcactcctcattgcaacacttttattcaagtatgagctcttaacttctagacagcttcttactcagaatttcatctacagtgtgggacagattgccattgcttgggacaaaatggatgaagagtatgttaagacacctcacaagtcctcagagagaggcttgtccatgttcatattgtggaatgcaccagtgtgcaccctttgtgatgtggcaacacttttgcttcttcggttttattacaaggcttacaccgatgtgactcgaaagtttttccattctgcttggttcgttgaaggtcttctattgcagaccctcatcatccatttgataaggacagagaaaaatcctttcatacaggatgttgcatcttggcctgtgattttctccactgttgtgacatctgcaattggaattgcacttccattcacactcattgggaagatcttgggattctccgttatacctatctcatatttcggatttttggtgcttctttttctggggtattttgcagttggccaagtggttaagagactttacatattggtttataagagatggctttga

SEQ ID NO: 83170 - DNA, 1425 bp, Glycine max
  Peptide Sequence Number=SeqID_199948
atgagcctaagtgcaacaataaggtttcagccttgtgatctcatgattacgagttcttctctactcatggagtttgataaagtgagggctgtgatatctggagaaggagatatactatctcatcctaacaactataacagtccaagacaagatgtcttaatagacaaattggcagaagaaccaattagaattaggcagcaacttgatacattttcttttggaacagtcgctgatgagataagtcctacaatcaatggcttctttgctgatagaaatgaatatgatctggattgtcctacacaggggttttcttctatccctgaggccattgaagatattcgtcagggaaagttagttattgttgtagatgatgaagatagagaaaacgagggggatctgataatggcagcatcaatggtgacaccaactgcaattacatttattgttgagtatggaactgggatagtgtgtgtaagcatgaaagaagacgacctagagaggctgcaactcccactgatggtgacactgaaggataatggagaacaacttggcaccgcattcacaatgacagtggatgcaaagcaaggcactacaacaggagtgtctgctcaagatagagcaacaacaatcctgaaacttgcatcaagaaattcgaggcctgatgatttcaataggccaggtcatatatttcccctgaagtacagagaaggaggggttcttaaaagaccaggacacacagaagcttcagttgatcttgctgtgttggctggcttggaacctgctgcagttttatgtgagatagtagatgatgatggttcaatggctaggttaccaaagcttcgacaaatggcaaagcaagaaaacttgaaaatcatatccattgctgatttaataagatacaggagaaagagggagaagttggtagagtgtgcttcagctgcactgataccaaccttgtggggacatttcaaagcttattgctatcagtcatttctggatgggattgagcatattgcgatggttaaaggtgagataggtgatgggcaggacgtacttgtgagagtacattctgaatgtctcattggggacatttttggggcaacatgtcaatgtaaaaaccaattaaaacttgcattgaagcaaattgaagcagcaggtaggggtgtcttggtgtatctccgaggaaatgaaggtagaggtattggcttaagccacatggtccgtgctagcccattggaagatgacaagtatgaggaattgcagttacctgttgattctagggagtacggtattggagcacagatactacgagatctcggggttcatacaataaggttaatgacaaaatatcctgctgagtacgacgggctcaaaggttatggcttaacagttgcaggagaagttcctcttttgacaccagactaa

SEQ ID NO: 83171 - DNA, 477 bp, Glycine max
  Peptide Sequence Number=SeqID_199949
atgttcttacatatcaagtggcatcaggcattgaatgaatctcctattggacataaccagtcccctaaagttacctcagaagttgtggccatcgctgaagatattaatgacatgtcatttatcagtgcacaatcagttgaagtcacctcacatacaacagacaagggacatgatggtttattggaggaagatgaaaatggagcagagcaaaggatagaatatgtcagaaaatctatctgcagcgtttgtgaatgctgggagaaggctgaaaatgaagtgacaagtttaaagaaccaagtccagacactgactctcagaaattcaatacttgaagatagagtcacccatctagacagtgcacttaaggagtgtgttaggcagctaagacaaacaagagtgcaattgatgaatggacagcccaaaagaaagcaaaccaccaaggtagagctagaggtactccctacgccttgcaactaa

SEQ ID NO: 83172 - DNA, 168 bp, Glycine max
  Peptide Sequence Number=SeqID_199950
atggattcaatagttcaaagagtttgtgacgtagagagattgaaaggttcagagaggttgtggcgtagagagatcgaaaggttcagagaggttgtggtgacgaaaggttggggttattttgtgtggatcgaaaagtgcagaaaggttatggcgcaatacaggggttag

SEQ ID NO: 83173 - DNA, 3280 bp, Glycine max
  Peptide Sequence Number=SeqID_199951
ggaaggggttaatgcgattttactcacaagtacttgtgctttgggaacaaattttggtctgaaaatcgttgctttgcagagtataagatcttgctcccacgtctctgattacttgcaagcttcatctgcactcatggatcccaaccagcctgtgggtgaaaactacgccaatcccaggacttgcttctttcatgtcctcttcaaggctgcagccttggcattttacattctctcggccctctttattgataactttgtcatcattttcgtggtgactgtccttcttgccgcccttgatttttgggtagtcaagaatgtcagtgggcgaattttagttggattgaggtggtggaatgaaattaatgatctgggtgagagtgtttggaaatttgaatgtcttgaccacgagtcattggctcggatgaacaagaaggactcatggcttttctggtggaccctgtatcttacaagaatgttagacaaacagctctcggggcaccgtatggatcgctccatttgtgcctggttctgggaacaagccatttcaccaggcgactccttcaagccctcggctgggaaagaaagaagggaggggaaaagatcgcttaagacccgctccgtcatcggcctcatgatcaccgcctcacacaacaaagtctccgataatggagtcaaaatcgctgacccaagcggcggcatgctctctcagcattgggaatccttcgccgacgccctcgccaacgccccttctccccaacacctcctcctgggatctcggtgggtggggactggcaagtcgaagtgcttttggggagagacacgagaccaagtggagatgctttgcttcaagcagctaaacaggcatgaacaaggttttaaattacagtcaatcttcccgcggattttgaagtcttcatttcgcaatgtttatcgcatcaaccattcccgaccccgaaaatccccatttccgtttccgaaaagaaccgaatgcgacgagtctctacttctacattacctatccaatgggtggctaaacgacgcgcgaaacctcctccaaaattcctctggaggtgacctccacttgcgtgttgttcgctggacctcgctactctccaacttctcccgccacggttttgtggccgaagctcgcacactcttcgacataatgccccacagaaacctcgtctcttacaattccatgttgtccgtgtacctccgctccggcatgcttgacgaggcttcccgcttcttcgacaccatgccggagaggaacgtcgtgtcttggaccgcaatgctcggtgggttctcggatgccgggaggatcgaagatgcgaagaaggtgtttgatgaaatgcctgagagaaatgttgtttcgtggaacgcgatggtggtggctttggttaggaatggggatttagaggaagcgaggattgtttttgaggagactccttataagaatgtggtttcatggaatgctatgatcgcggggtatgttgagagagggagaatgaatgaggcaagagaattgtttgagaagatggagtttaggaatgtggttacttggactagcatgatatctggttattgccgtgagggaaatttggagggggcttattgtttgttccgggctatgccggagaaaaatgttgtttcttggactgctatgattggtggctttgcttggaatggcttttatgaagaggcattgttgctttttcttgagatgttgagagtttctgatgcaaagcccaatggtgagacctttgtttctcttgtttatgcttgtggtggtttgggtttttcttgcattggcaagcagttacatgctcagctgattgttaacagctgggggattgatgattatgatggtaggttgcgaagaggtcttgttaggatgtactctgggtttggtcttatggactctgcacacaatgtgcttgaaggtaatctgaaagattgtgatgatcagtgttttaattccatgataaatggttatgttcaggccggtcagctggaaagcgctcaagagttgtttgacatggtacctgttcggaacaaggttgcatccacctgcatgattgctggctatcttagtgccggccaagtactaaaggcttggaatttgtttaatgacatgcctgatagggattccattgcgtggactgagatgatttatgggtatgtgcagaatgagctcattgctgaagccttctgcttgtttgttgagatgatggctcatggtgtttctcctatgagttctacatatgctgttctatttggagccatgggttcagttgcttatcttgatcaggggcggcaattacatggtatgcagttgaagacagtgtatgtatatgatttgattcttgagaactctctaattgcaatgtatacaaaatgtggggagatagatgatgcatataggatattctctaacatgacttaccgggacaaaatttcttggaacaccatgatcatgggcctttcagatcatgggatggccaacaaggctttaaaagtgtatgaaactatgcttgaatttggaatttatccagatggccttacattccttggtgtcctgacagcatgtgctcatgcgggtcttgttgataaagggtgggagttatttcttgccatggttaatgcttatgctattcaacctggtttggagcattatgttagtattatcaatcttctgggccgagcaggaaaggtgaaggaagcagaggagtttgtcttgaggctaccagttgaaccaaatcatgccatttggggagcattgattggagtatgtgggtttagtaaaacaaatgcagatgttgctaggcgtgcggccaaacgactgtttgagttggaacctttaaatgcaccaggccatgtggccctttgtaacatatatgccgcaaatgataggcatattgaggatactagtttaagaaaagaaatgaggatgaaagataagggtatgaaagcttcagagcaggattactttgaacagctttcaagctcattcaggtgcttagtggatttgatcccagctgaaaaatgtaagtttgatggggtgaacaacaaagtggtagtggatgcagctaatggggttggtggagtgaaacttaaatatttagggaaattgttgaatggtttgattattgaggttcggaacagcagtgaagatggaggtgtactgaatgatggagttggtgctgattatgtgcaaaaagagaaggttcttccaaacagctttggttctaaagacaccgggataaggttagtctgctga

SEQ ID NO: 83174 - DNA, 288 bp, Glycine max
  Peptide Sequence Number=SeqID_199952
atgaagaaagtgttacttgcgcgtaagtttggaaggaagcggagtcctcgtttagaggaaaggagaggaacacgtcaggagtggggcccgtttagcaatgaggtggaaactggttgtgatgtgggcccccaccacgagcttgtcgcttaccatttggtcgctacgttcggaggtgggcctaccctcgccaaccaagtcacgcaccctttaaccaacgtcttcttgcaaaaggcccaatgctttattattattaccatcgacaattaccaatgtgattcacaaaaataa

SEQ ID NO: 83175 - DNA, 891 bp, Glycine max
  Peptide Sequence Number=SeqID_199953
atggagctagttctagtttgtaggtgtgttagtttggatggagatgctgatcggcttgtttattttattgtgccacctgaaagcagtggtaggattgaccttgttgatggggacaagatactatccctgtttgccttatttattagggagcaactaagctttcttaatgagaaagaagacatgaaaaattgccaccaagcccatcttggtgtcgtacagactgcttatgcaaatggggcatctactaattaccttaaactgttgggacttgaagtcaattttactccaactggagtgaaatatctgcatgaaaaagccaccgaatttgatattggtatctactttgaggcaaatggccatggaactgtcttattttcagaatctttcatagagtcgttggaggctagaactaatgagatttctttaggatccaaaggttcagaaggggaaaaagctgctctgagattattggctgtcagtaagttgatcaatcaagctgttggagatgctttgagtggattgctcttggtggaagtcatattacagcatatgggatggtcaataaataaatggaatgaactttatcatgatttacccagcaagcagctcaaggtcaaagttgctgacagaacggctattgttacaacaaatgcagaaactgtggttgtgagccccccgggtctaaaagaagccataaatgaagaaactgcttggtactcctcttctgcatttacagctaagtacccccaaggtcggtgctttgtgcgaccatctggcactgaagatgttgttcgtgtgtatgctgaggcatctacaccggaagcagctgatacacttgccaactgtgtggctaagcttgtggatcaattcttagggttcaatagctcctga

SEQ ID NO: 83176 - DNA, 237 bp, Glycine max
  Peptide Sequence Number=SeqID_199954
atggtgattttccaccttggagatgcagcggaagacaaaggaaaagaggattgcatcaagcttagcgaattaaatgcctcaagatgcagtagtggggcgtgcttagcgagatggtctcgcttagtgcaattccaaacccgagaaggatttgggcttagcgggtatgacccgctgggcccaattaacatgagggtccagacagagagggaattgcgcttagcgcactggtgcgcttag

SEQ ID NO: 83177 - DNA, 1200 bp, Glycine max
  Peptide Sequence Number=SeqID_199955
atgcggccggaagttcaagcccacaacatcacatacccttattccttgatacagttgattcaaggaaaattatttcatggtttgccgaatgaagacccatatgcacacttggctacatactttgaaatctgtaatacagtgaaaattgtcaatgtgcctaaggatgcaataaggctgagtttgttctctttttcattgtctagagaagccaagaggtggctacattcatttaaaggaaacagtttgaagacttgggatgagttcctggatgaatctttgagtgaagcacttgaaagattccgtagcttgttgcggaaaacaccaactcatggattctccgaaccaattcagcttaatatttttatagatgggttaaggtcacagtccaagcagttattggatgcttctgctggagggaagatcaaattgaagacccctgaaaaggctatggagcttattgagaatatggctgcaaatgctttattggcacaaaacaagttgttagctaaacagctagagatattggctgaaacactgagtaagttgcctaatcaattgcaagtgattcaaccttcacatctagttgttttgcaggttgtagcatatgaggaagagctcatgagtctgggctttcagcaaggttctaactttaatcagaatcaagggcaatggaggtcacatccaggaaaccagttcaacaaagatcaaagtggaccatccaacaggcctcaaaatcaagggcatagcctttatgagaggacaaccaagctggaggagactttggctcaattcatgcaagttactatgtcgaatcataagagcacaaaatctgccataaagaacctggagatccaagtaggacagctggccaagcaaataactgagaattcttctggaagttttggagctaacactgaaaagaatccaaaggaagaatgcaaagctattatgaccagaggcaagaaggcaatcatggtggagaatgaagggaggggtagtgaagaacaagagctagtagctgaaaatgacaaggaaaaagaaggagatcagttgagagagatagaaataaatgatgaaaaagaagaagaaaaaaatgaaaaaaagggagaaaggaagacaaagagtgagctagctagagaaaggaagaaagaggttgtcccatgctcaaggaagagtaccatatcctttggtatcgtctaa

SEQ ID NO: 83178 - DNA, 419 bp, Glycine max
  Peptide Sequence Number=SeqID_199956
atgccaaacgacagcgttctgagtcttttcttcttcgttaccctcttcacatgccttctctctgctacttcccacgatgaccatattttcctaccgagtcaactccatgacgatgactcagtgagttgcactgcaaccgacccaagccttaactacaagccggtgatcggaatcctgacccaccccggcgacggtgcctctggccggctcagcaacgccaccggggtttcttacatcgccgcctcctacgttaaattcgtggagtccggtggtgctagagttattccccttatctacaatgagtcacctgagaaccttaacaagaagctcgatttggtcaatggagtgctcttcactggtggcaaaaaaattaaaattaagaaagaagatatggtacaagggatattcgcatttttaag

SEQ ID NO: 83179 - DNA, 2139 bp, Glycine max
  Peptide Sequence Number=SeqID_199957
atgaacataattacccttattcgcaaccgcgccatgaattctgctcgcaggattctcatcggttctagaaattcatcgttttccgggtccacacctgcaaaatctgaccacactctttccattgctaacaattcgctgaaacctcgtttctatcatgaccactccaatcaccacctttttcaaattcatcgcacaaagggtattgctcagaaattttttggcttaccctcttcgaatttcgccccttcaccaatgcatttcagttttagcacatttaacagcgacgtttccaccttcaaggttcgaaatttctcgaactctgttgagacccgcatcaatgacaacaattttgagaggatttacgtacagggtggaatgaacaatgtgaagccgttggtggtggaaggtgttcataaggatgatgagagtgttgcaggagagaagaatttaggtggtgatgtgaatgcgagcgtgggaaagagtaaaggggaggactcagaggtggaaaaagaagcatggaagttgttgcagggtgctgttgtgacttattgtggcaaccccgtgggaactatggctgcaaatgatcctggtgacaagctacccttgaattatgatcaggtctttattagggattttatcccttcagcacttgctttcttgcttagaggagaaagtgagatcgtcaagaactttcttcttcacaccttgcaattgcagagttgggagaaaacagtggactgctacagtccagggcagggcttgatgcctgcaagtttcaaagttagaactgttgctcttgatgaagataatcatgaggaagttttagatcctgattttggggaatcagctattggtcgtgttgcacctgtagattcaggattgtggtggatcatcctcttgcgggcttacgggaagctcactggtgactgcagcttgcaagaaagggcggatgttcaaacaggcttaaaaatgatccttaacttgtgtttaacagatgggttcgatatgtttccttctctgttagtcactgatgggtcttgcatgatagacaggcggatgggcattcatggtcacccccttgagatccaagcattattttactcagctcttcgctgctcacgtgagatgcttgttgcaactgatggaaccaaaaatcttattagagccattaacaacagactcagtgcactgtcatttcacattagagaatattattgggtggatatgaaaaagatgaatgaaatatacaggtataaaactgaagagtactccatggatgccatcaacaaattcaacatctatccagaacaaattccgttgtggttaatggattggattcctgaagaaggtggatatttgattgggaatttgcagccagctcacatggacttccggtttttctcacttggaaatctttggtctattgtctcatcattgggcaccccaagacagaaccatgctattttaaatctgatagaagcaaaatgggatgatcttgtggggcatatgcctcttaagatatgttatcctgccttggataatgaagagtggcgcatagttactggctgtgacccaaagaataccccttggtcatatcacaatggtggatcttggccaacccttctgtggcaggtcagctcagatatattgttggctatccactttgtcctgtgtcttactacctcaactattgaacccctaattttggtggctctgatcgttgggaataagacacagggaggagtacttaccaggccaccaatagaaactcattctgcagaaaattggaaattaaaaccatatacacctgaattcacattggcatgcatcaaaatggggagaattgaacttgcccagaaagcagttgctttggctgagaaaagactgccagttgattcttggccagaatactatgatacacgtactggaaaatttattggaaaacaagcccgaatgtatcaaacatggaccatagctggtttccttacatccaagatgcttttgaagaatcctgagatggcatccatgttattctgggaggaggattacgagcttcttgatatatgtgtttgtggacttagcaagagtggcaggaaaaggtgttcccgtggtgccgcaaggtctcaaattcgtgtatga

SEQ ID NO: 83180 - DNA, 435 bp, Glycine max
  Peptide Sequence Number=SeqID_199958
atgtccgccatggatatgtttaagtccctttccattcaaactgatgcaaccattaagcatgatgtttctgataaagatattttatgtcatggacgcattttaagtgctttggctgataacatatataagattttttgtcataccaaaacttctgttgagttatgggaagcacttgaattgaaatatggatctgctgaaaaaggtttaagtcattactcttgtgaaaaaatgattgagtttcaaatgattgatggaaaatctatttcagatcagatccacgaatttgaaaacattgtttatgacatgaaattgaaaggaattgttttgcctgacattatgcttgtggctttcatgatatcaaaattgcctccttcgtggactgattttgctcttttttgcttgaagatgatcctaaaacttatggtgaggccatga

SEQ ID NO: 83181 - DNA, 1551 bp, Glycine max
  Peptide Sequence Number=SeqID_199959
atggcgcagacccaaaccctatccttcattcacgagatcgattttctcatctcccataaacttcaagtgatttcgtacaaatggctgagccgcaattatatggtatcgtccgatgaagcaaagaggttgcttcaggagtttgtgcaaaagcatgagggtgggttggaggtcgtgtatgctttgtctggctggttaaaaagcaaccatcctagttaccacgtaaggcttgttaccgggccaaagcttgaagatggaaacaggagtaacatgaaattgcttcctactttttatgcagaagcacaacaagaatttgatggggattgctcagttcagatatatagtgtgcaagctagcattccaaaggatccagctgtgctttggaatgctgagttcattcaagcagaggagctcttcaagcaaccttcctcagttgacaattgtttgagggataatagcttacttgtcaggttcagtggggtctttaattcttttgtacgatggaatgtggatggcccaacagtagtttctgcagctcctcaatcaaaatctctaggtgagggaccaacaaagagtaacatagttcaccaaccttctaaaaatatagcatgtgattctattgacaaagtcgataccaaaccacagagtgtggtaaaggaagtcaagagtgaaagcaatggtatagggaatactgtagttcatgataacatcaacacacctactgcagacaaagaaaaggcacctcccttacccacaggccaaaagaaagtacaagctgataaaagtggttctgttaatggaggttcattagcaagcctttggggccgtgcatctgcaaaacccaggccttgctcctcatcagcagaaaataataacaaaatttcaaatcctcctgatgtctccttgagaaggtcttccaataggaaaagaagggttgtctttgatttctcagatgaagatgaagatgaagatgatgttgtcagtttagcatcacctgatttcccaaataaacaatcatctctagattctacaccaaatgacaaaaaaacatcagagaaaaccactctgaattttgattcacaggaagaaaataaatcaacggttaaggaagagagagcaacagaccaaaaagctcgcctaccactgagagaaaatgtatcagctatcagcaagtgcacaaatactgggaaatcatcttctgagaagttacagagtggtgctcctgaagtacatttaagtaaacatagtgtaaacaatccccctccatgttcacctaagaggagaaaagtgatgaagaccaggattgatgaacgagggagagaagtaactgaagtagtctgggagggggaggagacagaagagaagaaacctgataaggttacaacaaagaaatctgacagtaatgcatctaccaaagctatcgatagtgctccagcaactaagaagccaccagccaattcaaatgccattagtggaaaaggaggaaaaaagaaagcaggaaactcaaaggatcccaaacagggcaatattctttcatttttcaagagagtttga

SEQ ID NO: 83182 - DNA, 438 bp, Glycine max
  Peptide Sequence Number=SeqID_199960
atggaacgacagaacaagcaagcagatcacaaatcacaactcagatctagtaaaacaaatttccaaagcctttgcgagaaaacccaaatctggtattcttctcttcccagatccaaatctgcgatttctggtcgcgtcggcgcggttgcgaattgttggggccgcgccggagtgaggttagggatggtggtgggtggcggatctgggccagagatggtggtcggcgctcgagattctttagcttgtcctcacgtcgtcctcgttagaggcggtggtgtcagcgcagaagttgccttggaagtaatcggacttcgtcgacgggaagaacaacggtggctccgggcttcgggtttaggaattaggaccatagcgaaggagtccatggcgagtgagggggatttgagagaacgttgtggtggagattggtggctccgatga

SEQ ID NO: 83183 - DNA, 2877 bp, Glycine max
  Peptide Sequence Number=SeqID_199961
atgctaggaaatgagacagatcatttggcattgctcaaattcaaggaatcaatatctagtgacccttatggaatcatgaaatcttggaatagttccatccacttctgcaagtggcatggaatctcatgctaccccatgcatcaaagagttgtggagttgaacttacatgggtaccagttgtatggacccatacttcctcaacttggaaacctctcttttctaagaatcttaaaacttgaaaacaacagtttcaatggaaaaatcccacgggagttgggtcatttgtcacgactagaggtactctatctcactaacaactcattggttggagaaattccttcaaacttgacaagttgctctgagctcaaagaccttgacttgtcagggaacaatctcattggtaaaataccaattgaaattggctctcttcagaagcttcaatacttttatgttgcaaaaaacaacttaacaggagaagtcccaccatccatagggaatctttcatccctgattgagctctcggtaggtttgaacaacttagagggaaagattccacaagaagtttgtagcctcaaaaacttgtcactgatgtcagtgcctgtcaacaaattgtctggtacacttcctacttgtctttacaatttatcatctcttactttattctcagttccaggcaatcaatttagtggttctctttcacccaacatgtttcacacacttcctaatctccaaggaattagcattggtgggaatctattttctggtccaatccccatttccatcacaaatgcaactgtccctcaagttcttagtttttctgggaactctttcacaggacaagttccaaatctagggaagctaaaggatcttaggtggctaggtttgtctgaaaacaatctaggtgagggaaattcaactaaggatttggagtttttaagatcactgacaaactgtagtaagttgcaaatgttatctatatcctacaattattttggaggtagtttgccgaattcagtgggcaatttatccatccaacttagccaactatatcttgggagtaatctgatatcaggaaaaattcctatagaattaggaaatttaattagcttagcgctcttgaacatggcatataactactttgaagggactattccaactgtttttggcaagttccagaagatgcaagcattaattttgagtggaaataaactggtaggagatataccagcctccataggcaacctcactcaattgtttcatttgcgtttagcacaaaatatgctgggaggaagtattcccaggaccataggaaattgccaaaagttacaacttctaacccttgggaaaaataaccttgcaggaaccataccctcagaggtttttagcctttcctcactaacaaatttgctggacttatcacagaactccttgagtggtagtttaccaaatgtagtgagcaagttaaaaaatcttgagaagatggatgtctctgaaaatcatctgtctggtgatattcctggaagcattggagattgcacaagcttggagtacctttatttgcaagggaattctttccatggaatcatacccaccactatggcttcactgaaaggtcttagacgtttagacatgtcacgaaaccacttatctggatcaattcctaaaggtctgcaaaatatttctttcttggcatacttcaatgcatcatttaacatgttggatggagaggtaccaactgaaggtgtcttccaaaatgcaagtgagttagcagtgactggaaacaataaactttgtggaggtattccacagttgcatctaccatcatgtcctatcaatgctgaagagcctacaaaacatcataatttcaggctgataggagtgatagttggtgtgttagcttttctactcatactgctatttatactcactttttattgcatgaggaaaagaaacaagaaaccaactcttgattcaccagtaactgaccaggtgcctaaggtttcataccaaaacctacacaatggaactgatgggtttgcaggtagaaacttaataggatctggaaattttggctctgtctacaaaggaactcttgagtcagaagatgaagttgttgccataaaagtcctgaaccttcaaaagaaaggggctcacaagagtttcattgctgaatgcattgcactaaagaatattagacatcgaaatctgattaagattttgacatgctgttccagtacagattacaaaggtcaagaatttaaagctctaatctttgagtacatgaaaaatggaagcttagaaagttggttgcattcatcaatagatattgaatatcagggtagatccttagaccttgagcaaaggtttaatatcattactgatgttgcttcagcagtgcattatcttcactacgagtgtgagcaaactatccttcattgtgatttaaagcctagcaatgttcttcttgatgattgcatggtagctcatgtaagtgattttggcttagcaagattgctctcaagtattggaatatctcttttgcaaagtagcacaattggaataaaggggactattggttatgctcctccagagtatggaatgggttcagaggtgtcaattgaaggcgacatgtatagctttgggattctgattgtggacccgactattctccccagtgaactcgaaaggactgctggcagtgaaaagcttggccctgtgcatccaaatgcagagaaatgtttactttcactttttaggattgcactcgcttgctcagtggaatcaccaaaggaaagaatgagtatggttgatgtccttagggagcttaatctgatcaaaagcttttctccttttgaggttcgagggaggctaagctaa

SEQ ID NO: 83184 - DNA, 1056 bp, Glycine max
  Peptide Sequence Number=SeqID_199962
atggcgcgtactcctaaacctaaaggcggcccctccgctgcggcctccgccgccactgccttcttcaaacccggtactgccgtcgaagtcagttccgaggacgacggtttccggggatcctggttcaccggcaccgtcatccgccgcctcgcctccgagaggttcctagtcgaatacgacaacctcttggcggacgacaaaaccacgaagaagttgagagaagtcctcggtctccgccacctccgccctcttcccccgacggagactgaccgcgaattcaaattcggcgacgaggttgatgcgttccacaacgacggttggtgggagggccacataacccaggaattggagaacgaaagatttgcggtgtatttcagagtgtccaaggagcaattggtcttttccaaggaacaactcaggctccaccgggagtggttaaatcacgattgggtcccaccactgcagcagaaacaacaaaggcaacagggcaatggtgaatcgaagaaagtgttgttgacaccgaatgtgaaatctgttgaaactgtaaaggggaaggggataggtgtgggggcgatagttgaggttagcagtgatgaagatgggttcagtggagcttggtttgctgccactgttgttgaggcactggggaaggataagttccttgttgagtaccatgatctgttggctgatgatgattcccagcttagagaggagattgatgctctgcacattaggcctcatccgctggacacggatgttgatggtcaattcagtattcttgatgaagttgatgctttctacaatgatggttggtgggttggtgtgatttccaaggctcttgcagattcaaggtatgtagtttacttcaggtcttctaatgaagaactggagtttgagaactcccagttgaggctgcaccaggactggattggtggcaaatgggtcatgccttgtaaggttgaattcaaggctttaaattgggcactattgcggtgtagcatagtagagcagccccaggttgctacagggggatgccatggtagtggactggtttaa

SEQ ID NO: 83185 - DNA, 439 bp, Glycine max
  Peptide Sequence Number=SeqID_199963
cattggattccagagagtctctatgcatattttcacgaatggtgtcagaaggtttagtccagattgcttctcatttactagtgcagtaggtgcatgtgctaacttggcagttctgtattgcgggcaacagcttcatggtgtaattgttcgtagcggcctggataactacttagaaatatccaatgcccttatttatatgtatgccaagtgtggaaatatagctgattcacgtaaaatatttagcaaaatgccgtgcacaaatttggtctcctggacttcaatgataaatggatatggggatcatggatatggtaaagatgctgttgagttattcaatgaaatgatcagatcaggtattatgataagaatcttacagggtggatcgtttgatacaggctacgaaggtttggatgacgccacttccggtgaaggaagataa

SEQ ID NO: 83186 - DNA, 552 bp, Glycine max
  Peptide Sequence Number=SeqID_199964
atggtgtttatggcagttctaagtgcttgtagccatgctggtctagtggacgaagggctgagatattttagattaatgaccagttattataatataacaccagatatagagatatatggctgcgtggtggatttgtttggtcgtgctggaagagtgaaggaagcttatcaactaatagagaatatgccatttaatccagatgaatctatctgggcagcccttcttggagcttgtaaagtgcataaccaacccagtgtggccaaatttgcagctttgagagctttggatatgaagccaattagtgcaggaacttatgcgttgatatcaaatatttatgccgctgaaggaaactgggatgattttgccagctcaacgaagctgaggagaggcattaaaaataaaagtgactcggggaggagctggattgaattgaaagaccagatttgcagttttgttgttggagacagatttgtctcttccaatgaacaggtgtgtgaagttctgaaattgttgatggtgcatatgaaagatgctgatatggacctgatttag

SEQ ID NO: 83187 - DNA, 3228 bp, Glycine max
  Peptide Sequence Number=SeqID_199965
atgtccgaagaaatgtacggcgtgctcctttattacaagtacgctgaaattcccaacctcgacgacctcctcactttctaccactccaactgctcctccctcagcctcctcggtcgtgttcggctttcttcccgcggcgtcaatgtcaccgttggcggcaacttatcctctctcgagatccacatcgaagccctcaaagcctacaactctctgtttcacgacactgatttcaagctcgccaattgtcatcagccattaaacgacaaagtagcccaggaatgtggattcacttctctatctattcggatcgtcgatgaacttgtcactctcagttctcatccgctgttaaagtcaccggatatctcaaatgccggaaagcatctctctgcacttgacttccattcttccctccacaataccaacagggagagtccagaaaatgaccttgttttacttgatgcaaggaatctgtatgaaacaagaattggcaaatttcatgtgcctaatattgaaactttggatccacaagttaggcagtatagtgatttgtcctcttggatagatgataacggtgagcggttgaaaggaaaaaatatcctcatgtattgtactggtggaatcagatgtgaaatggcatcggcatatattaggtcaaaaggtgctgggtttgagaatgtgtttcagttatttggtggcatacagcggtatttggagcaattcccagatggtgggtttttcaaaggaaagaattttgtttttgatcaccggatatcagttggaagttcagatgctaatgttattgggacctgccttatttgtcaatgttcatttgatgattactcgtctcgctgccggtgtgcttactgccgaatgcttgttttggtttgtggtagttgccagaatgcatccagtttcaaaggcagaacagcatcactagccaagaaactcaagaaaatggctgaatttgtttttatcaatgctcctcatgaattgccattcatttaccaaatccccgtgtccgagctcaatgtgaattgtgcatcatcattgccacctagtcctcctccacctttggagaattgcaagaagaagtttgcatggtttttggcacccaactttgatggaagtagtggtgttgattggaaggtagcagacggtccattcgatgcacttcaataccagcagcaaactgatggatatgatatttctgtatcacacttgaagaatgtgttttcccaacaaggaccattcgatggaatcttgggattttcacagggagcagcaatggctgccttaatctctgcacaacaagaaaagctgaaaggtgaaatggactttaaatttgtagtcctgtgctctggctttgctctccggatgaaagagatggagtgtggccctatcaagtgcccgtctcttcatatttttggtaatgagcatggtaaagacagacaaatagctaaccaagctagcaaggaacttgtttctctatatgatagtgattgttctgggatcgttgagcatgattgtggtcatataattcctacccggtccccttacattgatgggatcaaggatttccttgggcgttttcgttcctattgcactgacaaggttgttgttgatattggacaaccaacctccgcgtctcatccgcagctactaaaagatggggatctcacaccgggtatatctacggaggaatacatcctaagaagaaaaaagttattggatcttctcccagagaagagtttggcaatcattgctgctgccccagtaaagatgatgacagatgttgtgccttacacatttcgacaagatgctgattacttgtatatcacaggctgtcaacaacctggtggtgtggccgttttaggacatgactgtggtttatgcatgttcatgccagaagctaagcctaatgatgtgatttggcaagggcagatagcaggagttgatgcagcattagatgcattcaaggctgacaaggcatatccaatgaaaaaattgcaagaggtgaatcaccagcttgaagccgatgttatcacagctttgcagtctaaaaagtccattttcatctccttgatccttccagatatgataaggggatcatcaaaattgttccacaatgtagagactgcaactccagcatatatggaactggaagccttcaaaacgctagcttactgtaacaatgtaagggatctaactgtttatacccatcaactgcgatggataaagtcaccagcagagctcaagctgatgaaggaatctgcatcaattgcttgtcaggctcttttgttgacaatgctacattcaaagacatacccttttgaaggtatgctagcggcaaaggttgaatatgaatgcaaaattagaggtgctcagcggatgggattcaatcctgtggttggtggtgggcctaatggaagtgttatacattattctaggaatgatcagagaattaaacatggagaccttgttttgatggatgttggatgtgagttacatggttatgccagtgatcttactcgtacctggccaccttgtggtagcttttcttctgctcagaaaggactcaaagagcttgggattttgagagatgttggaagcagttcctaccataagctgaacccaacttctataggtcactatctagggatggacattcatgattgttcaatggttagcaatgactgtcctctgaagccaggtgttccaacaaaggcccgtagagacgatggggaccagcgtgatgctcgtatgagatgtgtcacgcatctttggtgttttgagttggctgcgcacgtgcacgacatgacgatctttgatgatggcgacggtgtgacactggccggagatgcgttaggcgtcgtgcgcgtgaacttcacgctccagggcccgccatggtgtcacgtgcggcggtttttagttggctgcaaacgtggacggtgtgacgatcttcggaaaggtggccagaaaaacttaaacaggagaagaagcacggcggggaggttgtcggagagtgggtcgcacaccggaaaggggatcgtgtgtgagtgtcatgcgccggagtgtggcggcggaagaggtcgcagttggcgggtgcatgttactgttcacgcgaaaggaacactggcgaaaaggggaaaacaaaaacaaagtggaaccaaaactgtttggtgcgtgacggcggcagcggcagtcgccagaaaagtcattgggaaatga

SEQ ID NO: 83188 - DNA, 586 bp, Glycine max
  Peptide Sequence Number=SeqID_199966
atgtggaatgggattgcgagggctcaatcgctgaagaaggttatcgatggtggtggccaaggcggtccacgccagcgggaaaaagttaaaggtggtttggcgggtgctgtggattgcggtgttgaagctggtatgacagccatggaagacagccatggactctcaatgaaagcacaaaaaatgatagggccgttgattaagcatatttcttcactcatcaaatggacaaggtctacctccaagacaccacactcagatgggaatgttcttcaatttgaaaatggttacgtggtggagactgttgtggaaggaaacgagattggggttgtcccttacaggatccgcgtctctgaggaggatggtgaactctttgctgttgatgcaattaacagcaacattgttcggataactccaccgctgtcccaatgtatggttgctcgtcctcttgagggatacactggccatgtggatggaaaaccaagtgatgctcgtttcaatcatcccaaaggcataactgtggatgataaggggaatgtttatgttgctgatactcagaatctggccatcagaaagattggagatgctg

SEQ ID NO: 83189 - DNA, 99 bp, Glycine max
  Peptide Sequence Number=SeqID_199967
atgtgggtgggaggacctacgtcctacagtatcaagtgcaccgaaggctcattgggttgcatgtggctctatacacttgagttgagaagggtcggataa

SEQ ID NO: 83190 - DNA, 903 bp, Glycine max
  Peptide Sequence Number=SeqID_199968
atgactgcggagaaaggtgatgcgaaatgtggaagtttcaatgtccgagaaactttgctggacttgtacctgttatacttggaggtgactagaagaggaggatatcaccaggttggtcgagaaaagaaatggggtgaagtagtctttgccatgaaattggaagcgaatagtgtaaagttatgtgctcaagttgaaaagctttatgcacatcttctctaccagtttgagaaattgtacttctataggcatcctgcaaagcaagctggatctatcagcaccaaaggtccacttcaaaagaagcggaattcaacagctagtttatctcatacaatgaatattaaagatggtcagatggtgacagagatgtccaaggactactcttgccacatgacagattccaacttagcaggggcagggtatgtggaacagccggtgtttttaccgccaccctcgaatgtcaaagaaatgaagaaacgccgaggttctccaccgggacgaaagactgcatatcagatattcctcaagcatgaatgtgctcgattgaaaacttgtagtcaggccttagatggccggaaaatccttcgtttggctattgatacatggaggaatatgtctgacattgagaaacagccatatgtggaggaaagcaagaagaacaaggaagcaatgaatggtcacaataaacagcagagcacccaagataccataaaggaggagaagtggcatagtctgagtggtgattatcttgtaacttcacaacctgagacagataactcccttgtcaacaaagcagctgctgggttagttcttaaaatgactgaaaaagcaccaacggatccttcatatctaatggagtgggatgcttattgttcactggttttgccaactagggaatccgagtaa

SEQ ID NO: 83191 - DNA, 435 bp, Glycine max
  Peptide Sequence Number=SeqID_199969
atgcatggtgggcttgaagttaggtctacaagagaagcaaatacaaccatgttggggaagcatatttggacgatcttaaaagacaccactaaacctagggttcaagtggttaatgccaagtatcttcatggggaatccatccttcgtagtcgtcagtttccaggagcatcctgcacttggatgtctttgatggaagctgcagaatctctggaaccaggattcaaatttcgagtaggacaaggtgctctatctatttgttatgaccgctggtcatcaagagctattgtgtgtaatcaactgggagatgtggatattcatatacaggacggcgcttcagaggatcaacagatggtcattgtgcatgtccgccctgctagtctaaaatcgaaagtgttagcagatgccctaggtgtcttcttcactaggagtagctaa

SEQ ID NO: 83192 - DNA, 222 bp, Glycine max
  Peptide Sequence Number=SeqID_199970
atgaaatggcaaacgcgaattgaaaccctaattcgcacgtgcaaaaggcgagaagcgaatcggggaacacaaacgggggtgcaggaagaggaatatgtagatttgggaatccgcgaaaaggaaaaggaagcagcgatggaaggagaattttaccgtagatctacgatttggggaagaaaatttgcgattgggaagtgccgggcttaccttgtttatagatga

SEQ ID NO: 83193 - DNA, 1241 bp, Glycine max
  Peptide Sequence Number=SeqID_199971
atggggtctctggttgctgaaacagccatgaagaaaccaatgtggttgtatccaaaggttttgggttttaatccttctgaaagatgggggcactcagcttgcttctctggggggcttatgtatgtctttgggggctgttgtggggggctacattttggagatgttctgtgtttggaccttgaaaaaatgaattggagcaaacttgccaccacaggtgaaaagccaggcccaagagatagccacagtgctgttcttgtagggcacaaaatgatagtttttggtggcacaaatgggttgaaaaaggtgaatgacactcatatattggaccttgttaccaaagagtggatttgtccaaaatgtgaagggactcctccttctccaagggaaagtcacacagcaaccctagttggtgatgaaagactagtgatttttggtggcagtggagaaggtgatgcaaactatttgaatgatttgcatgttctagaccttcgaaccatgaggtggacttctcctgtggtcaaaggtgatttgcctgtgcctagggacagtcacagtactcttgcaactgggaacaagcttattgtttatggtggagactgtggtgatcagtatcagggcgatgttaatgtgcttgatatggatacaatgacttggtcaaggttgaaaattcaaggctcttccccaggagtcagggcaggtcatgcggctgtctacatcattggaggggttggagataaacgttattataatgacatatgggtcttcgatatctgcacttgttcgtggactcagcttgatattcgtggtcaacaaccacagggtcggttttctcacacagctgttgtagcagacatggatgttgccatatatggcgggtgtggggaagatgaacgtcctttgaacgaattgttagtgttgcagcttggagcagagcatccaaatgggcgttacaacatttccatgtgcaaagtttttggaacttgttggaaccatgaaaagaggaccatacacggaggagcagataccaactcgacaactccacgcaatgggaataataatatggaagtcttaggcacttcacaacagaagaggaggagaatggctgttgcaaaggtgtgggatgttgattcagaacaagaagaacattctctttcactgtcccagcattcatctccatctcaatctgatcaagaacagaccccaggtcaaaaagcaaattttcctgtcatggattctcagag

SEQ ID NO: 83194 - DNA, 549 bp, Glycine max
  Peptide Sequence Number=SeqID_199972
tggccgaaagaggcatggattctgggtcaagatgtttctgtcgggttcactccaaccattatatttgccattttggttccggccttgcctcttaagcctcttaagagggacaggacgagctctaagaggtccttggaaattcaacaattgagggagcgtaagaaagagtatgacttgaagacagcaatatctttggttaaagaaacagctaaaaccaagtttggagaaacagtagaagcccatttccgcctcaacattgaccctaaatataacgatcaacaattaagagcaacagatatttgcgtgattcaaatttgtcaccatgagcaggtcaggacaaccacgggatttgaagaagatatttccgtgattcaaatttgtcaccatgagcaagtcagggaagaagatatttgcgtgattcaaatttgtcaccatgagcaggtcaagacaaccacaggatttgaagaacttggagcaaatgccatattggcagtttctcttgcagtctccagagctggtgctactatcctgaaagttcctctttataag

SEQ ID NO: 83195 - DNA, 177 bp, Glycine max
  Peptide Sequence Number=SeqID_199973
atggctacagccaggtgggaactcaagcatcccgtttatggcattgtgatactacggttgggaatttacacaaacagacccaatgtttccaagatgacgttcctaaatgaaaaattctacgcgattccggaatttcaacagacactattgacaacaacgaaacaagtactaacgtaa

SEQ ID NO: 83196 - DNA, 423 bp, Glycine max
  Peptide Sequence Number=SeqID_199974
atggctagaacacgaggtataggtcgtgccataggtagacttgtaggcagagatagacttgatgaccaggatgcagctgatgttcccgagaggcgtaggcctactgccttagcccataggcaacgggttcatcagatgactgcggatgcacgtgatatgactgacgacgtccctgatgtggctgcggaggcacctgagatgcgtgcggacgtagagggtgctgatcgtgctgaggggtcagatgctgatgatgctactaagagattccctggtgggccacgtgacccgtcagtgttgacatcatttgcggaccacgttgcacatgctgtttggagtggacaggaacgtcctgatttgaagttagtgtcacatgggaggaagttgacactgattgggaggccagtgcctgagattgaaggcctg

SEQ ID NO: 83197 - DNA, 486 bp, Glycine max
  Peptide Sequence Number=SeqID_199975
atggacacccgtctccgtgtgattggtgatcccatgaatggagttcaacggtacaccaaaatgaaatttgacggagctgttccgtttctcattcctatgacgaggtatattataaattgtggcaatattaaggttgaggttggttttccaacggtcatatttctaacggtcatattttgttgttgcaaaatgcctatatatatctctttcctcttttctagaaatgacagactgagagctctggtttctttctgccaaaaatttatctctttcttttcctatacaaaacttaatttttgtgagagcaagagcattggtgttcataaggttcggggatcctttcgctgcacacgatcggaaccaacgggttgtcgtatcttaggagaggagcgcaatcagaatttcttacccgtgcagtgggggcgttttctctctaaggatagcgtttacgcgcttcaacccaggctatttaattctttcccttaa

SEQ ID NO: 83198 - DNA, 192 bp, Glycine max
  Peptide Sequence Number=SeqID_199976
atggccctagctgaaggagtgaaggaagcaatctggcttaaagtcatagtgaagcaagttaacaaggaacttaaactctgttttcagattgagcatgctcagcagttggcatctggaacccgcagtcgatttggcaaacaacgggttgttgcttccatgcaggttacttatgagttatgtgttggaaaataa

SEQ ID NO: 83199 - DNA, 1521 bp, Glycine max
  Peptide Sequence Number=SeqID_199977
atggttcaggagtttgtaaggctggaggacaaggaccaaaattgtgctggtaaggagaaaaaggccaggagagtagggaaggaacatgtaaagtccaaaacaattagagacctgattgccaaggagagggaggaatggggagagattgggaattggtgtgtacatggggaggataaggtcatgagggaattcaatcatttcattgattcaatggaattggttgagccactcttagttagtagaagctttacttggattaggctcaatgacagtaataagagtcatattgatagagccttggtgtccatggagtggtatatggcagaagaaagaaagcttcaaggtgtgtatggaggaggcttggaagaggatggagattcaaggttgaaagggtatatacttaaggagaaacttaaggggttgaaaggatgtattaagagttggagtaaggagaaaagttgcttatataaaattgtgacaaaggtgttggctagtaggttgagaaaggtattggtgggtgtcattgatagtgcttttttgacaggaaggcatttactttatagtgttttggtagccaataaggttgtggatgaagctcgaaggcttaaaaggaagtgtttggtgtttaaggtggattttgagaaggcgggtgattcgataaattggaggttgagcggcttagtgagagaagcaaagaggttcgatctatttaaaggttactttgtgggaaaggataaggtggaggtgaaccttttacgatatgcatatgacactttatttgtgggagaaacatcattggagaatgtcatcacaattaaaaccatcttgagatgttttgaagttgtgtcaagtttgaagttccattggtggttgttaataagttggttaatctctaaagggatttccttttggggttgcaaggagggaaggtggaaaattgtttgggtaaatggaggtaggttttatgggagaaaggatcattttggagtgatggaaggtggtgtagggggtggtcgtaactttagtttttggaagtatgggtggttagatggggtttcaattgccaataagtttggtaggctttttttggtatcggatcaacaagataaaatgataggtgacatgggtaggtgggttgatggtgtatggttgtgggagtttaggtggcaagagacaactatttgggtgggaagaatatttggtcttgtaggaacaattattttcaaggaagagtcatttgcatcacagaagattttggatgatatgttttggagttggtcatcgatgaagaattgctatgttgggggacaaggcaaaacgcagatgcaaaacgcgcgcacgatggagatacgcacgatgaggaaggccatcactactcaacattactcgaagtggacatattcctcccaactcaatggtttcttaaggatcttcttgggtcatgtggctactgccaagtcatctatggctactgctctatcatctcttactccttgtggaagcaccttgtcctcaaggtga

SEQ ID NO: 83200 - DNA, 507 bp, Glycine max
  Peptide Sequence Number=SeqID_199978
atggttggagcattctcgcaaaacatcgtgaccctgactggtctccctatgatcttacttagtgagagtgacctgacaaacccattgtgtgaaccacctggagtactaattgattcagcaaggacacttgttgcgtccaagattccagaggattcagtggatgatagaagggaggcattgcttagagcaagcaatcttgccctaacaaggggggtgacaatgattcttgatatgggaagatattatcgtgggttttcaactgaactttcttgggatgatttttcagggtgtgataacaaagtcagccatgccttgagcgaatggatttatataggtggtgtcaaagctttttctgatgggtctttgggttccaatagtgcattgctttatgagttaccagctggctgccttactggtgattcatttcaggttgctattcatgctataggggacaaagcaaatgaccttatcttggacatgtttaagagcagcagaaattttgcatag

SEQ ID NO: 83201 - DNA, 186 bp, Glycine max
  Peptide Sequence Number=SeqID_199979
atggacgaagcaatcgattccaaagacaatagtggttatcaatggtggatccacacttatgtgacgggttgcacattgatgtttagaatgaagaagaaggagaataaagaatgtggtttgaagaatcactcctccggaattggtgtcatacacaaggtagtgttccttgataaaccaattccttga

SEQ ID NO: 83202 - DNA, 1821 bp, Glycine max
  Peptide Sequence Number=SeqID_199980
atggcttttatggtcagtgagtatgacgaacgcgtggcccaggtgatattgtcgccagcatttcacagcggtggtaatggtgtgcagtttgcggatcttggggcagaactgcttgctgaaataagcgattggatggcccctctacatcaacacggatcccatgccgaaacccgaggaatcggtctcaacaacgaaggggacactgaaaagttgggtgagtggttccgcgatttgggcataatggtggacgaatcgccggtaggacccagtcaagcccaagaacccgcacaactgcttgggagaggatggtactggccattgcgacagagctgtgattttggagggatggaattcaccctattgcagagtttgaaagacgcaatccaagtgtttgagatgagcccggaagtcgcgactataaaccaagatatcatcgaagaagaccagcacaaatttgcgaatgaatggatggaactcattcatcgtcgtctggaacatggacggtgcgttacagaggccaaatggcatcacgacggacgtcgtgctccaccatgcgaatttgatggaaaccttgagcaaggtccatcttcaagaaccaagatgagttgcccaaatcatcaagaagctccaacaccgaagagaagtacgggctgcgactgggacgaattagctgccgctagagcatatcttccacctgccattcaatctcccgtttctggtagtaagggtagcggtggattgtgtggtctgttggccagggtggtgggagctaggagctgggagctgggtctaagtttggaaaagggccgcgattctgtgcgtgttgaccaggtgtcggacttggccatggtgtatttcgaatgggccaagatcgacgttgtcgtgaatagtaatgggctcgccgttatgtttgaaggacattgtgagggtaaaagcgcaaccctgaatcgtaacggtgacatcgcgacaaaccttatcgcacttgatctctgtgtcattgtcgaccatgactgccagagcagggatagattggggacgcaaatggaggaagtgagccaatcagtcgtggacaaagttatgggtgctaccactgtccacgagaatgatgacgtcatgggcatggacagtgcccactacgcaaaaggtggtcgaagctggtgtcttaatagcgcgtggaggctgagctgggcagggttatggtctgtaggtggtggtggtggggaaatgggcttggaaagcgctcgctgcagttgtagcacaagccacgcttgcggcgggatgccatctcagcctggagggggaggagtggtgtcgggggcaaggtggagatgggttgaagaatatgggaagggccaaaacctcgcggcgtatttcaggaatgagacccgaaataaaacaactaaggaggaaagggggcaccacgggggtcgtcgtagagggatagagcgaaacagagctcgggggcctgaaggaacgaggaccaggaaggttgttggtcgttgcggtagagccactggaactagctcagggcagccccgtcaaggtagaaggaagccacctggaggcgctcctcctcaggggttcatacagggaggggaaggtcgcggggagtgggttggggaagaagctttgagggactggaagcggtgtgctggttttgggttagaaggggaacaaggcaaaacgcagatgcaaaacgcgcgcacaatggagatacacaccatgaggaaggccagcactactcgaaggatccgcttgggtcttgtggctactacaatgtcatctatgactgccgctctatcagaatttcatggtgattaa

SEQ ID NO: 83203 - DNA, 1692 bp, Glycine max
  Peptide Sequence Number=SeqID_199981
atgctcgaagccgacataatccaaccaagccacaaccccttctcgtcccctatcctgttggtcaaaaagaaagatggaacatggcattattgtgtggattaccaggctttaaacgccgtcactattaaagaccattttcccatgccaactattgacgaattgcttgatgatttgggacaagcatcttggttctcgaagcttgatttacgtcaaggctttcaccagataagaatggtcgaggatgacatacataaaacaacatttcgaactcaccaaggtcactacgagttctgggttatgtcgttaggcttatgtaatgctccctcgacgttccaggccgccatgaatgacacacttcgcccatttttacgaaaatatgtcgcggtatttttcgatgacattctggtttacagcgttgatctggactcacatatgcaactcaattacttgggccacatcatcttgtcccaaggcacagccccaaacccggacaaggtagcgactatgattgcttggccaataccaacgtcccccacggctctccgagggttcttgggattgaaagggttctatcataagttcattaaagggtactctgcaatagcttcaccccttacatgcctcttacgcaaggaaaaattatgttggtccccagaggcgcaacaagcctttcaccaccttcaacaggcaatggttcaagcccctgtcttggtcaaccccaattttttgctcccattcaccattgaaatggatgcatctggttcctccatggatgcagtactgcttcaggacgaccacccaattgcttattacagcaaagacattcaagtgcgtcccgatgcccacttcgatctcgtcattcatcaagaccttattcttcgacacggtcatatttggatcccgttcccaacaccatttacgataatcctcttagaaaaattccattcttctcatctcggtggtcacactggggacgatgttcgctggtatgtcgcgcaatgctccacgtgtcaacagaccaagtacgagataaagaaagttgatgaccatttctcaaagggagcccatttcggtgctcttcctacgcatcatacggcatacaaggtcgtcgtgctattcctcgacatccgcgaattattccgattaagtggcactaagctctgcatgagtactgcataccatctacaaattgatggtcaaatgaaggttcttaaccagaccctggaacagtatctctgcgcgtatgtccaccaccaaccatcttccgaatggtcatacaacacgaccatacatgccggtaccgggatttcaccgttcaaggccatctatggcaaatcacccctgacaatcgcccaatacttgcaaggcaattcttccatagatggtcctttaccttcttctccgataactcttccccatgccaattctaataaccatcctttggttacacccttaaccattttagattggaagttggacaactctatttcgccaccactcaagcaggtcctggtccaatgggaagggttggctccagaagaggtttcctgggagtcatgggatgagttgcgccacattcacaaccttgaggacaaggttgttttcgaggaagggggtgttgatagcaattcagcatataccaacacaggccacatcacagaagctaatagctacaatggcaagccaatgaga

SEQ ID NO: 83204 - DNA, 1005 bp, Glycine max
  Peptide Sequence Number=SeqID_199982
atgtcttggactatagctccaccagcggtacgtcgccgtagttcccgccgagggggtcctcctggtcgacggagaaaggttggtcgtggcggtgattttctagcgttggcggagcttttccagcttggcggcctccttcttggcggcctttttgctgacttgggcctccgacgatgttgtggcggcggcggggttttgggaatccgaagacgacatcgttttggcgtgggagtgtgggttttgcgagaggttttttttagtggattgtgtatagtagacctcgtcgcatggagctctgacctttttgcgagcggaagcgcaagagacggaagggtatttattactgactactttttcaaagcaaacctcgccgaagatttttcttacgcagagataatggttgaagtaaaaatagatagattacaagagacatccaaggataatgttctcacaaactacactatagaagctacattgtttgattctggaagctggtacacctctgacgggaatcctgatctcctttcatctaatttggcagacataaagctccaaccatcaagtgcaccaacacaaccattagggtttcatggctatgtgcttacaggggaactgcaatcaccaaagctttggtctgcagagaaaccatacctctataccctagttgttgtcctgaaagatcgatctgggcgcgttgttgactgtgaatcatgtccagtaggatttagaaaagtgtctaaagcccacaaacaactgcttgttaatggacatgcagtggtaatcagaggtgtgaacaggcatgaacatcatccacaagtggggaaggcaaacatagaatcctgcatgatcaaggatttagtcaagcaaaacaatattaatgctgtgaggaactgccattatccccaacatcctcgttggtatgggctatgcgatttgtttggcatgtacatgatagatgaagccaatattgagacacattattttgactactcaaaacatctctag

SEQ ID NO: 83205 - DNA, 978 bp, Glycine max
  Peptide Sequence Number=SeqID_199983
atgacatatacaatttatgcttctggggatgtcattatagaatgcaatatgaaaccaaaccctgatcttcctcctttgccacgtgtgggaatcgaattaaatgtggaaaagtctttggatcaagcaacttggtatggaagaggaccatttgagtgttatccagatcgaaaagctgcagcccaaattgcagtctacgaacataatgttggtgagttgcacgttccatatattgttcctggagaatcttcaggtagggcagatgttagatgggcaacattcagaaacaaaaatggttttggaatatatgcttctaagtatggtagctctccacccatgcaaatgagtgcaagctactacagcaccttggaatttgaccgtgccacacacaatgaagagctcattgaaggagatagcattgaggtatttataacttgcttcaatatttctgcatatgtttcttccagaagagattctcattttctccaccctcgtggaccaccacctcttctccaacatcctcgctgcccaccaccattgtctcttcttccatcactgatgaggacaaatctgactccacctaactctgatctgaaaaagaaaggagcttgggtctcacaactgcatgggaaccacgcaccacgttgggatgactgtggcgacgatggggaggaagtgctcgagcggccacagcggcttgaacttggcgctaatcctgcatatggtgctgttgagaataacaccgctccacagcatttcacagcggcggagaagaaacgaaggaagcaagggatcaaagcgagaacggaaattctcaaaggttgtgcagtcattgatgacggggttgatgtcggggatggcacaggtggcgaggccaatcttggcaaagtggatggtggtgagctggaggagccaactggacttgccggtgtagccgtgtatgacaatgagggttctgatgatggttttatgttgatgtga

SEQ ID NO: 83206 - DNA, 735 bp, Glycine max
  Peptide Sequence Number=SeqID_199984
atgggggtgtctggtgggagtgaagatggtgaaggttgggctgatatggtgggtgtcacagttgagggtatgtatgttgcccaccatgacgtgaagagtcgtggtaggggtagacgacaaggagagaaacttggccacatgcgactgaatgaagttgtacgtgctgccaccgtctaccagaatagtaacctgatggtggcgcagagatcccagaaggcgaaatgtttgcggtgtggggctgccttccatggcattcaaactaatttgcgggagcaacaaagtttccaccttcggaggatatggcgggtcgaaggggaccgggttagaaatgggctccacgtcaatgagaaggtgcaagcgaggcatgcagcggtgaccgtgagaccacttgtcgtcgcagtggtaacacagcccctggtcacgatggactgccagctcctccgccgtgaggcgcctgacctggattttagagggattaagatgaagaggtgttgcaggtttgggcgtgaaaggggaatgagacacggacaggatgcgggggtcgcagcggcggtccaacatcttgtcctcctggagtcgcacgagtttggtcgcttgaggcagggaaatcggtcgcagagcctaaacttcccggcagagttcaggaagcaaaccagagacaaaggctccttgagggtcgtcatagaaggagggcgtgaaactcgactcaaatgcttgaagcatcgccgaccatga

SEQ ID NO: 83207 - DNA, 231 bp, Glycine max
  Peptide Sequence Number=SeqID_199985
atgaatagggagtctactttgatttggcaggatgcgaagaggatgaatacgaagtgcagtatagggagatacaacagcagtaattgtcttagtgcatttattacgatagtgccttggtggtgtaagttttatgtgggatgggaaagcggtttttggaagttcagaaggcaatctgatagcagagtaagcggggatatgaagcgtgtaggtatcgggaaaagtaagggttga

SEQ ID NO: 83208 - DNA, 267 bp, Glycine max
  Peptide Sequence Number=SeqID_199986
atgaaggcagaggcaagtaatactttgaataagaacagaagtaaggatgctgcggaagggtcttctcagcaaaatgaacaaattgaagatgaagaatttacctgctacttctgtaagaactctggacacatgaggaaagagtgtccaaagtacattgcatggcgtggttgcctgtggagccaaatgcctaatgatgatgaaagattcatatttgtaggcaacgacaaaagggttgcaatggaggctataggaacttttagattatag

SEQ ID NO: 83209 - DNA, 429 bp, Glycine max
  Peptide Sequence Number=SeqID_199987
atgttgttgctggcaattttgtgtctggcctgttggttggtggtctttcggcatgtttcatcgaaaaataccagggttgtttttagaatgaaggatttgagtggtgaaattttgtcttgcacactttgggagcattactatgctcagttcctatcctatttgaatgaacgtggggatgatgggccgatggttgttatattgacgcatgccagaataaaagatgcacatggaagttatctagcttcagtgaccaattccttcaaggcgtcaaaattattgattaatgatcctatattagaaattcaggaatttaaagagagatttaggtgtttaggtgagtcaagttttgctacttggcgatcaagcacgctcacaagtttcagggggaagtcagctatcatcaaaggattcgtttctttcaaagactga

SEQ ID NO: 83210 - DNA, 510 bp, Glycine max
  Peptide Sequence Number=SeqID_199988
atggctatggttccatatgcttcagccattggaagttggatgtaccagatgatttgtatgaggctagatattggccatgtagtgggagttgtaagtaggtttatgtcaaatccggaactaggatttacccaggaaaagagtgttttgcgtaatgatagtcatagtgcaatacatctggcaaagaattcaacatttcattctagaacaaagcacattggtctccgctatcacttcatcaaaactttgattgaggatgaggtgttaacattgagagagatccaaagaagtgaaaagatgaagaataagaaggttgttgtggctggtgtctcgctaagcgaggcttgtgcgctttgcaagaatcatccgctaagcgagacatcagtccacttagcaagtcgggagaatctttcaagcatttgcacgctcaacgcgtcatcagctcattcagcgagtcgtttgtcttctctcgcactaagcgcgcctagtggaaaatcattaactcgcacttaa

SEQ ID NO: 83211 - DNA, 2784 bp, Glycine max
  Peptide Sequence Number=SeqID_199989
atggaggataatcccccttcaagtgttttagatgggaccgttgttgggatcaaatttggtatggctacacgccaggaaatttgtacagcatccattagtgactcttcaattagtcatgctagtcagctgtcaaatccattccttgggctgccccttgagtttggcagatgtgaatcttgtggtacttctgaagttggaaaatgcgaaggtcacttcggatatattgagttgccaattccaatatatcacccaagtcatatcagtgacttgaaacggatgctgagcatggtctgcttaaactgcctaaaattaaggaaaaccaagcttccagcttcaagcagtggtttagcccagagattaatatctccttgttgtcaggaggataaggctgctctagtttctattcgggaagttaaaacaagtgatggggcttgttatctggcgttgaaagcaatggaaattattaagagaattccgatagagacaaaaaaaaagcttgctggaaaaggatattttcctcaagatggatatgttttgaagtatcttccggtgccaccaaattgcttgtctgtgccagaagtttcagacggtgtcagtgtcatgtcgtcggatccttccataacaattctcagaaaattgctcaggaaggttgaaatcataaaaagctctagatctggtgaaccaaatttcgagtctcatcacgtagaagcaaatgatttgcagtctgtggttgatcaatattttcaaattagaggaacttctaagccagcacgtgatatagagacacattttggggtcaataaagagcttactgcatcctcaacaaaagcatggcttgagaaaatgaggacattatttataagaaagggttcaggtttttcttcccggaatgtaattactggagattgttataagaggataaatgaagtaggaattccggttgaagttgcccaacggataacgtttgaggagagagttaacatccacaacatcagatatttacagaagttggttgatgaacatttgtgcctgacctacaaggaaggtgggtcaacttattcactcagggagggctcaaaggggcacatatatctcaagcctggtcagatagtgcatcggaggattatggatggggatattgtcttcatcaacagaccacctacaacacacaagcactccttacaagccctttatgtttacatccatgaagaccacactgtgaagataaatcctttaatttgtggaccacttggggctgattttgatggtgactgtgtccatctgttttatccgcaatcacttgctgctaaagctgaagttgtggagctattttctgtggagaatcaactgctcagctctcacagtggtaatttgaacctacagttatccacagactcgttgttgtcactgaagatgttggtcaagagatgtttttttgatagagcagcagctaatcaattggcgatgtttattttgcttcctttgcctcggcctgctttgctcaaggccagttctggtgatgcttgttggacttccatccaaattttacagtgtgctttacctttgggttttgattgcactgggggacggtatttgattaggcagagtgagatcttagaatttgaattcagcagggatgttctgcctgcaaccgtaaatgaaatagcagcttcagttttctttggcaagggtcccaaggaggcacttaatttctttgatgtattgcaaccctttttgatggaaagcttatttgcggaagggtttagtgttagcctggaagagttttcaatatccagggcaattaaaaggataataagaaaaagcattggaaaagtttcttctctgctgtatcagctgaggtccttgtacaatgagctggtggcgcagcaactggagaagcacattcgagatgttgaacttcctatcattaattttgctctaaagtcaactaaattaggagatttaattgattcaaagagtaaatctgctattgataaggttgttcagcagattgggtttttagggcagcaactttttgataggggaagattctactcaaagggattggtagatgatgtggcatcacattttcatgcaaagtgttgttatgacggggatggttatccctctgctgagtatggactgctcaaagggtgtttttttaatggtttggatccatacgaagagatggtgcattcgatttcaacaagggaaataatggtgcgttcttcgagaggattatctgaaccaggaacactctttaagaatttgatggccatccttcgggatgttgttatctgttatgatggaactgtcagaaacatttgtagtaattccatcatccagtttgaatacgggatacaagctggagacaaaagtgagcacttattccctgctggtgagcctgtaggtgtgttggctgcaactgctatgtcaaatcctgcttacaaggctgtccttgatgctagtcctagtagcaactcttcatgggagttgatgaaggaaatattactctgcaaggttaattttaggaatgaacttgttgatcggcgtgtcattttgtacttgaatgactgtgattgtggagggagttattgccgagaaaatgcagcatattcagttaaagatcaattgagaaaagtcagtctcaaggatgcagctgtggagttcattattgaataccaacaacagcgaactcaaaaggaaaattctgaaactgatgttggacttgttggtcatatttatttggatgaggttattggatttccttttcattcaatttga

SEQ ID NO: 83212 - DNA, 225 bp, Glycine max
  Peptide Sequence Number=SeqID_199990
atgcaaagaacctgcataaaaaaggagcaagccacagaatcggtaccgaaaacgcgaaagggaacgaaaatgcctttgcatgaaaacggaaatgcagaagaacgcaaacgcaaaatcgaagcacctcgttgcgcgaaaccgatcgaaacaacaaagagcgagagagaaagagggtttcgaaggggaaagactcctgggttttggggagcggggttttggggatga

SEQ ID NO: 83213 - DNA, 561 bp, Glycine max
  Peptide Sequence Number=SeqID_199991
atggctgctatcttagctcggaaatcactccttgctcttcgtgcgcgccaattggcttcatcttctcgaattacgggatctgtgggtgtggagaaggcatcaaaaggagataccatttcttttgataatgcaagaaattctccaggacagtatgatttatcaagaattaatcatttgcatagtagttttgttcctgaagatgttcctgatgctgcttccgagaaagacctgggtaacgagtttttcaagcagaaaaagtttaaggaagctagagactgctattcaaggagcattgccttatcaccaacagctgtagcatatgcaaatagggcaatggccaatatcaagctcagaaggcaagcttatgctgaggatgactgcacagaggccttaaatcttgatgatcgttacataaaagcatactcacgaagagcaacagctagaaaagaacttggaaaaattaaagaatcaatggacgatgctgaatttgccttgaggttggaaccaaacaatcaagaaatcaagaaacagtatgctgatgctaagtctttctatgagaaa

SEQ ID NO: 83214 - DNA, 141 bp, Glycine max
  Peptide Sequence Number=SeqID_199992
atggtgccctcaaaagaggatgacaaggaggaagaaattggtgccggcggtgctctggtggctccgagacgtggtgttcctgttgtcacagcggaggtggatgaacccttgcgcttcttggatgattctgccatttggtga

SEQ ID NO: 83215 - DNA, 309 bp, Glycine max
  Peptide Sequence Number=SeqID_199993
atgggaggtgtatttaaacagcctaaaacgctaaagggagtggcgttttctacttatccaaaatcgccaacactaccagcgtcttctatgggttcccaaggcattgatgtgcaagtgctagagaggaaaaggagacacaagcaactgggggctggaaccaatagtgaccatgagagaacaccgaaaaaagtgcaaaacaggggattggtaagatgtgtcggaggtgggcgagtctggcgaagggatcattggagagtgagtatgccaggaaaaggcttatgcactgatgttggttttgaggatagataa

SEQ ID NO: 83216 - DNA, 357 bp, Glycine max
  Peptide Sequence Number=SeqID_199994
atgaaagaaactgaccatttattactagaaatgctagaaatagtggctgggcaccaaaacatcaggctgaataagatcaaaaggggcataacttttatcagaattggaaaggaaaatggcatgatggataagcacaaacccgaatggtggctggaaacatggtacacggagctcaaacaccagcagggaaagtggcatgtgagggcacatgtggaagtctccaataacagggcttcaggggattgccagtctagaggttctgcagtagtatgtatgaggacaggttctggagatcatgtggcagaagggacaggacaaacaatgaaggggagcaaatggagaaaggaagttgtgtag

SEQ ID NO: 83217 - DNA, 1011 bp, Glycine max
  Peptide Sequence Number=SeqID_199995
atgcagagacccagcttgttacagtcctcatcaacacaaaactggctgagtccacaaggtagctcatctggtattattgttaaaaagacggtcagagtagatattcctgtggacgcatatcctaattttaactttgttggtcgcctcctaggccctagaggaaactctctaaagcgtgtagaagcaagtactgagtgtcgtgtcttgatcaggggccgaggtagcattaaggatccagctagggaggaaatgatgagaggaaaacctgggtatgagcatctgaatgaacctctccacattctagttgaggcagaattaccagttgaaatagtagatgctcgcctgatgcaggcacgtgaaatacttgaagatttgctcaaaccggtggatgaatctcaggatttctacaagaagcagcaacttcgggagctagcaatgctgaatggcactcttcgtgaggagggttctcccatgtctggttctgtttcacccttccacaacagccttggtaatgctgtcaacgaatgccctgatctgcgatcggggcactggcatcatagtgccagttctaacttgttctatgtgcagtgtgtttatattgagtttgggggaggtttaaagatggtagcacgtagtaaaggtccaattgagtttggtgaatttgcttttatagtgttggttaaggccattacctttcccacctcctcctcaccaactccgctacactacctcggtcgcaccgtagccctgccacctccttgccatcgtcacctcccttcactccaaccttcgttgtgccgcagcacccccacctccttcatggccatcacgcttccctctggtcttgcccagtggcatcgtcgcgccaaagcgcgtgaggttactgaggtcaccgccaccttcttcatcgtcgcacgaggtcccttctctcctccttcatcatcgctgcaaccttgtcgcggaggtccatggccttatggactgcgaattcataatgactttacggattga

SEQ ID NO: 83218 - DNA, 225 bp, Glycine max
  Peptide Sequence Number=SeqID_199996
atggatcaagtagagaaggataggcaggaaaaaatcagaaatgttttggaagaaaggaggatcaaggagataactccttcaccagagtggcacctttcacaacctatgactaggcttagtacaataagacaaatcccttatcctctcttcaatttcattgcactggggcctaatatcatccaaatccatccaccaaaccaaaagaattgggcaatccccaattaa

SEQ ID NO: 83219 - DNA, 765 bp, Glycine max
  Peptide Sequence Number=SeqID_199997
atggaggtacttatggcagaacgggccaatctagtctttcacaataaagtgataggtggaactgccattaaacgacttattagcagattaatagatcactttggaatggcatatacatcacatatcctggatcaagtaaagactctgggattccgtcaagctacggatacatccatttcattaggaattgatgaccttttaacaataccttctaaaggatggctagtccaagatgctgaacaacaaagttttattttggaacaacatcatcattatgggaatatactgctgtacgaacatcagatgctggatatctttacacgcagacttgttgaagtggttcaacacattgttgtacgtcgaacggattgtggtaccattcaaggaatttcggtgaatacccagaatggaatgatgccggaaagaatatggatacaaacattaattggtcgtgtattagcagacgatatatacagaggttcacgatgcattgccgttagaaatcaagatattggaattggacttatcaatcgatttaaaacccttcaaacccaaccaatatctatccgaactccctttacctgtaggaatacatcttggatctgtcgattgtgttatggccaaagtcctactcatggtcacttggtggaattaggagaagctgtaggtattattgcgggccaatccattggagaaccgggcactcaactaacattaagaacttttcatactggcggagtcttcactggaggtactgcagaacag

SEQ ID NO: 83220 - DNA, 246 bp, Glycine max
  Peptide Sequence Number=SeqID_199998
atggaagaagatctgggaggggaaggtgaagccttacacagagtgagtgagggcaagtgtgtgaatagtagcaatcaacgacagcgaataacagcaaaaggaacacaaaacaaaactaagatggcgcgtgagtcaaaactcaagacaagtgtacctatgccattgcggtttcaaaccgtgtcagaacttgcaacacacataaacataacaactgaaattttgatcgttgttagaaattttttttga

SEQ ID NO: 83221 - DNA, 381 bp, Glycine max
  Peptide Sequence Number=SeqID_199999
atgggtggtccagaattgtttctcattcttcaaaaaaaagatatttatgattatgggaagagaaattgtattaagaggaagaaagatgataaccttccagttgacatcaaattgcctgttaagcatgtattatccagagagcttcagctgtattttgacaaagtggccgagcttactttgagtgagtctgaatcagttctctttaaagaggcattagtaagtttggctactgattcaggacttcatccactagttccttatttcacatgctttatagctgatgaggtttcccgtggtttgaataattatcctcttctatttgccttgatgcgagttgttagtagccttctgcaaaaccctcacatccatattgaaccatat

SEQ ID NO: 83222 - DNA, 2409 bp, Glycine max
  Peptide Sequence Number=SeqID_200000
atggccgaattttcacatatttttgtagattttgatgagattgttcgtgccactttagataactatgagtggagtagacaaaatgaagaagctgatgtcagggcagaggcacatcataattgggtggatgaggttatccggtgtgaaggtcggggtggttcagttattggtaatgacaatcgctctagttgcttgatcatccagccacgaccagaaataaagggtccttcccttttaactagagaagaaattgaaaaaccacaaatatgggctcagatatgtattcaaagaatggttgaattagccaaggaaagcacaactatgcgtcgtgtgctggatccaatgtttgtctactttgattctagacaacattgggctcctcagaaagggttagcaatgataattttatcaaggatggcctacttcatggagaactctgggaatcagcgcttaattctagcttctgtgatacatcatctggaccacaaaaatgtcatgaatgatcctcaacttaagacctgtgttattcaggttgccacatctttggctatgcaaattagatctgagagtggcttggcagagattggttttgttggtgtcctttgcagacatcttaggaaaagccttcaagcctctagtgaatttggtggagagcaagaattgaacttaaatatctcacttcaaaattccattgacgattgcttactagaaattgccaatggggtaattgatgcccagccactttttgacttgatggcgataaacctagaaaatattctacccggtgttgttggtagagcaaccattggatctctgatcatccttgctcgtgcagtcactttagcattaagtcacttacattcacagcagggatttcctgaagctcttcttgttcaactcctaaaagtaatgttgcattcagatgtggaggctcgcgtcggagcacaccttatattttccattcttctttttccaagttccttccatacgaatgagatttcctctctgcggtccagatatctaggtcaacacaacaaaaggcattctcatgctccatctgtgtctgcatctgcttcaattacagctttacttgaaaagctccgcagaaacagaaacaccaaggtagaaaatcatgggaatattgttcatgatcaagaaagggatattgtggcagaagactggaagcagggctgtggcttaaagaattctcctaacttttacaaactcacttctatcattgataaggctacaggatcaccaagtttgactgacacagaaccatatgttatgaaactaactgaagatcaaatggcccagctgctttctgccttttggattcaagccaatcttcctgataatttaccttcaaatattgaagctatagctcattcattcatattgacactaattgtcttacgcataaagaacctgaaagacagagatagcctggtgatccgcttcttccagcttcctctgtctctctggactatgttgttggaccaaagcaatggaatattgtccccagcttgtcagaggtctgtctatgtattgtctgctggcatgctggcctttgcctgcaaaatatatcagattcctgatctgaatgatgtgtttgcatcattgccaatgtctaatgttgatccattcttgagtatcagtgatgattatcgagtatatgctaagatccatgtggatgtgagagaatatgatactgctgctgataatcagtttgcatgttcagtattatcagagttacagaacaaaatacgtgaatgtcaatcgatcataagagatgctatggttcataatttagctaatatcactgagctggatgcaggtgaactggctatgctattgttagagaaatttaagcccggtgaagagtttgtgttcggtccacagtcaatgcttgatcagaatcaaataatttttcattcccaggagtcactgtcatttgatggggattttccctcaaattcagcaggtgaagatgacacaatcagtgaagcatctgtctctgacctttctcgatttattccaaagatgcctctatccccttcggcacctcatgttatcagcattggacaacttatggaatcggcattagaggtagctggtcaagtggcaggaacagctatctccacttcgccccttccgtacaacaccatggctagccagtgtgaatcactcggtacatgtgcaaggaaaaagctttcaaattggctggcctttgagaatcattacagccaagcacttgatgataaatcgtttttggcaattgctgatattaggaactcagcacctgagaaggtgacaaatggtggtgggcatgcccaattgccaagggaccccatgaagctgcctcctgctagcccctttgacaatttcctcaaggctgctgggtgttag

SEQ ID NO: 83223 - DNA, 321 bp, Glycine max
  Peptide Sequence Number=SeqID_200001
atgcctctatccccttcggcacctcatgttatcagcattggacaacttatggaatcggcattagaggtagttggtcaagtggcaggaacagctatctccacttcgcccctttcgtacaacaccatggctagccagtgtgaatcactcggtacatgtgcaaggaaaaagctttcaaattggctggcctttgagaatcattacagccaagcacctgatgataaatcgtttttggcaattgctgatattaggaactcagcacctgtgaaggttgcattgattgcatcctttaacaagccaaagtcctccagaaaggtcaactaa

SEQ ID NO: 83224 - DNA, 1407 bp, Glycine max
  Peptide Sequence Number=SeqID_200002
atgtcaatcacaattcgcaaaacacatccataccgtgcgcaagataaccccaagatgctaatagtgacttacgagggtgagcatcgtcacgttcttccgttaactgccgctgccggcggcccttcatcagtacaggttgctgtagttgtgttctgtagttgtttttttcctcacctattttgtgtcactagattccaagaggctgaggatgactgcacagaggccttaaatcttgatgatcgttacataaaagcatactcacgaagagcaacagctagaaaagaacttggaaaaattaaagaatcaatggacgatgctgaatttgccttgaggttggaaccaaacaatcaagaaatcaagaaacagtatgctgatgctaagtctttctatgagaaagatattcttcagaaagcatcaggggttctgagaagcactgtacagggaactcaaaaagtgggaaagtcagaggaaaaagttaatggagacagcatccaccccatttcacgtagtactcaaaagtctggactagctgaagttcatcatcataaaaaggataataaacggcaaatacttgttaaagaatcactcttaacagaggatgttgatggcagagaaataaaagccagaagctggcctcaatcacaaggagatgatggttctaagggaggtttgagtgcaagcaacagtttggagcagagaaatcacagaattaccaagccagaaatgaaagcttctgttcaacagcttgcttctcgcgctgcttctagagccatgtctgaagctgccaaaaacgtaacacctccaactacagcttatcagtttgaggtctcctggagaacattttcaggtgatcttgctctgcaggctcgtctattaaaggctatatctccccatgaattgccgaaaatattcaaaaatgccttgtcttctaccatactaattgagatcatcaagtgtcttgcatctcttttcactgaggacatggatctggttgtcagttatttggagcatttgaccaagggatttcctgaagctcttcttgtgcaactcctaaaagtaatgttgcattcagatgtggaggctcgcatcggagcacaccttatattttccattcttctttttccaagttccttccatacgaatgagatttcctctctgcggtgcagatatctaggtcaacacaacaaaaggcattctcatgctgcatctgtgtctgcatctgcttcaattacagctttacttgaaaagctctgcagaaacagaaacaccaaggcagaaaatcatgggaatattgttcatgatcaagaaagggatattgtggcagaagactggaagcagggctgtggcttaaagaattcccctaacttttacaaactcacttctatcattgataaggctacaggataa

SEQ ID NO: 83225 - DNA, 691 bp, Glycine max
  Peptide Sequence Number=SeqID_200003
caacctaatcagctagcaagaattggcacccagaatccccagattccactacctccgcaacggccaccaccttcatcggtggcggccgctatcggaaatggtggctatcagggctctatcagaccaggatcaatggctgatagagccaggatggcaaagatacaccaacccgatgcatcactcaaatgtccacgatgtgaatctacaaacacaaagttttgctactacaacaactacagcctctcacagcctcgccacttttgcaagacatgtcgtcgttactggaccagaggaggtgcactcaggagcgtgccagttggaggtggctgcagaaggaacaaaagaaacaaagggaacagtgctagatcaaagtctcctatgaaaccttcaacaggttctacctcagccagtgctaactcttcttctagtggctgcacccctgatcatgtgatgatgactcatttgccaactccaacaccagctcatcaattcccattcttggcctctttacatcattataacagtgactacgcttctgggggcattggatctcatttgggggcgatcacaacacctttggtggctagaaatggcaacactactagtgatgttgagtttcaaatcggaactagttcagcttcatcacttggtaatagtggtggaggggctatgttgtcaaataatggccttg

SEQ ID NO: 83226 - DNA, 603 bp, Glycine max
  Peptide Sequence Number=SeqID_200004
atgcaacttactaacgatgtccataaagagcaaggtggcacgatgggcagtgtacttgggaggcaatgccctaaaatggattcccttggtgaagcggaattggtaaaggttgtagcaaaccagtggggcacttggtctcgcactttacttgctgacaaacacgacattgtgaaacatattggcgcacatccttccatatctatgaatagaaaaaattatcctataaacggcgaagtgtttttgcggcacccaagtggccacccaaaggggatgaatggaactcctcgagtagagtgggctcttgtggtcagtaagaataatgaaatgctgacccaagaggtaatgcctccattttcggactacggagagaacagcacccatgaaggtcctggacgcataagtttcgatagtgaaaagtttgtcaaacaaagaagtcaagggattggcaatagaagcatagtcctgtataaaacatcggtagaatcccataatgcctacgaaaccacagagctttgttatggacaatggtgcaagccatccgagcatggcactaattttttacagatcgggggtggcaccggaagcggagactatgtgtcccag

SEQ ID NO: 83227 - DNA, 1944 bp, Glycine max
  Peptide Sequence Number=SeqID_200005
atggccggaaaaggagagggactcgccatcggaatcgacctgggcaccacctactcctgcgtcggagtctggcagcacgaccgcgtcgaaatcatcgccaacgatcagggcaaccgtaccacaccctcttatgtcgccttcaccgataccgaaagactcatcggagatgccgctaagaaccaggtcgccatgaaccccatcaacaccgtcttcgatgcgaagaggttgattggtaggagagttagcgacccttctgttcagagtgatatgaagttgtggccattcaaggttactgctggtgctggtgaaaaacccatgattggtgtcaattacaagggtgaggaaaagcaattcgctgctgaggaaatctcctctatggtcctaacaaagatgcgggagattgcagaggcttaccttgggtcgactgtgaagaatgccgttgttactgtgcctgcttacttcaatgattctcagcgtcaagccaccaaagacgccggtgtcattgctggcctcaatgttatgagaataataaatgagccaactgctgctgcaattgcatacgggcttgacaagaaagccactagtgttggtgagaagaatgtcttgatctttgatcttggaggtggcacctttgatgtttctctcctcaccattgaggagggtatctttgaagttaaggccacagctggagacactcaccttggaggggaggattttgataatagaatggtgaaccactttgtacaagagttcaagaggaagaacaagaaggatattactggaaacccaagagccttgagaaggttaagaacctcttgtgagagagcaaagaggacactctcatccactgctcagaccaccattgagattgattctctgtttgagggcattgacttctattcaaccatcactcgtgccaggtttgaggagctcaacatggacctcttcaggaaatgtatggagcctgtggaaaagtgtcttagggatgcaaagatggacaagagctctgttcatgatgttgtccttgttggtggctctacaaggattcctaaagttcagcagctgttgcaggacttcttcaatgggaaagatctttgcaagagcatcaatcccgacgaagcagttgcttatggagctgctgtccaggcagctatattgagcggtgaaggcaatgagaaggttcaagatttgttgcttttggatgtcactccattgtcattgggtttggagactgctggaggtgtcatgactgtattgattccaaggaatactaccattcctactaagaaggaacaagtgttctctacatattcagataaccaacctggtgtcttgattcaagtttatgagggtgagagaacaagaaccagggataacaacttgttgggtaagtttgagctgtcaggcattcctccagctccccgtggtgtccctcaaatcactgtttgcttcgatattgatgctaatggtatcttgaatgtctctgccgaggacaaaacaactggccagaagaacaagattaccattaccaatgacaaaggaaggttgtcaaaggaagaaatcgagaagatggttcaagaagctgagaaatacaagtctgaagatgaggagcacaagaagaaggttgagggaaagaatgccttggagaactatgcctacaacatgagaaacacaataaaggatgagaagatcagttcaaagctttcctctgaagacaagacaaagattgataatgcaattgagcaggccattcaatggcttgataccaatcagcttgcagaagctgatgaatttgaagacaagatgaaggagcttgagggcatatgcaatcccattatagcgaagatgtaccaaggcggagctggtactggtggtgacgtcgatgatgatgctccacctgctggtggtagtggtgctggccccaagattgaggaggttgattaa

SEQ ID NO: 83228 - DNA, 1878 bp, Glycine max
  Peptide Sequence Number=SeqID_200006
atgacccacctcgagacatctcattccgttccatgcacaccaccatcttcttcctctaaccactcaccgcagtcaccatccgacacctttcctcgtctgaaactggaggtatcccgcttcgatggttcagaccctacagggtggatattcaagattacgcagttttttgaataccactccaccccggaccaggaacgcctcaccattgcctccttctacatggaaggcgcggcactggcttggttccaatggatgcatcgcaatggccaactcacttcatggcctgcgtttctccacgccttgcacacacgcttctcctcttccacgtacaaggaccccacaggtttgctctgtaaactcactcaacgttcttctgttcaggagtatctctcggagttcgaaagcctcgcaaatcggattctcggtctcccggcaccattcttgctaagttgttttatttctggcttatctccggcgattcaccgtgaagttcaagcgctacaaccctactccttgacacaggctactcaataccctcggccgtctccggcccctgctccctcggccgacctcaacaccctcggccatctccggcccctgctccctctcgacctagccctacccctacccttccacccctcctttcccagtcaccaaaaacacctacgtcctcaatacccttcaaacgcctctcccccgcaaagcttgcccttcgaagagaaaagggattgtgttttaattgcgatgagaaattctctcgcggagacaaacgatgagcctttccaagataccggccaacctaccctttccccatttcccgacgacgaaacgccttccgacacctcctccgctcagataagcctccatgccctgtcgggtcacttagctcccgagaccttacgagtcaatggctttattggtaatcgtggtgtgtgcatattgattgatggaggaagcacacacaacttcctccaccaagctttggttacatcccttggtttgtctacgacggctactactctgcgggtgaccgtgggtaatggggacgagcttcactgtcatcagctatgtccggcagtcaccgtgatcattcaggcgcaaccattcattgtcgattttcacgttctacctcagtgcggcgccgaggtggtattaggcgtccaatggttgaaatcgttaggccctatcctaactgattattccaccctcactatgaaattcatatatggcggaaagctcattgagctcagtggggcacgtgcccagaatcttgaccacatctcaccttcccaactccggcgcctcgtccaatccgataccactagcagttacttccacattcgcctcgacccaccctcgacctcaacatcaccaaatatcccgacaaccactacccagcagctttacccagtagtttctagaattgtcacaggaggtgcaacttattgtgctattgcatctctccgattaatgggattcattggagataatattctctcaagttgtgcttcatcttctttgatagatgcaccattgctgctggactggatcttgcagaggcagggaactgatgggggttttcaaggtagaccaaataaatccagtgatacatgttatgcattttgttgtcaaagccttgacaagcatcatatgtttgttaggattggagccgttttaaggattctagggggctgcaaatttgttgacagtaaggctctacgtggatttttgctttcttgtcaatataagtatggtggtttcggaaaattccctggagagtatccagacctgtaccactcctactatggagttaccgctttcagcttgttggaagaatctgctttgaaatcactttgttctgaactgggaattcactga

SEQ ID NO: 83229 - DNA, 201 bp, Glycine max
  Peptide Sequence Number=SeqID_200007
atgaaacgcaacaaagcgacggtcttgacattcgctgagaaatgcaagaatatattggcatcaaactggcaaggttcccttaatactatcaaagctgatgccaaaggaagcaaggggaatatccatacatctaagattaagtacatagtcagaagggggcagccatacctttgggtgccagaaaacgatttgcataatgtg

SEQ ID NO: 83230 - DNA, 2742 bp, Glycine max
  Peptide Sequence Number=SeqID_200008
actatatttcctcacattcagaggactatacgtcctcacattaagaggactacacgtcctcgccttcagagggatacatgccctcgccttccgaggactacacatcctcgccttcaaagggcaacatgccttcgccttcagaggactacacggccttgccttcagagagctacacgcactcgccttcagatgactacacgtcctcgccttcagagggctagatgccctggccttcagatgactacacgtcctcgccttcatagggctgcacaccctcgcattcagaggactacacgtcctcaccttcagaggactacagatcctcgccttcaaagggctacacgccctcaccatcagagcactacatgtcctcgccttgaggactacacgtcctcgcctttagagggctacatgccatcgccttcagaggactacacgtcctcaccttcagagggccacacgccatcgccttcagcgaatacacgagctcaactcaagagggctacgcgccctcaccttgagaggactacacgtctcgcctttagatggctgcatgccccagacataagaggactacacggctgcacgccctcgcacgtcctcgccttcagaggactacacgtcctcgccgttagaggaatacatgccctcgcattcagaggactacacatcctcgccatgagagggctacacgccttcgtctttagaggactaaaggtcctcaccttcagaggactacaccttctcaccttaagaggactagacgtactcacctttagaggactacgcgtcctcgcctttatagggctgcacgccctcgccttcagaggactacacgtcctcatcttcagaggactacaggtcctcgccttcagagggctacgcgccctcatcatcagatcactatacatcctcaccatcagagcactacacctcctcgccttaatgactacaggactacacgtcctcgccttaagaggactacacgtcctcgcattgaggactattagtcctcaccttcagagggatacacgccctcaacttcagaggactacacgtcctcgccttgaggactacagagggcagcacgccctcgccttcagaggactacacgtcctccctttcagaggactacacgtcctcagcaacagagtactacacgtcctcaccttcaaagggctacacaacctcaccattagaggactacatgtccttgccttcagagggctacacgccatcgctttcagaggactacacgtcctcgccttcagagggctacacgccctcgcctttagaggactacacttccttgccttcaaagggctgcacaccctcgccttcagtgggctacacgtccttaccttcagaggactacacgtgctcaccttcagaggactacacatcctcgcgactacatgtcctcatcttcagagggctacacactctcaccttcagaggactacaggtcctcgccctgaggactacagactgctgcacgccctcgccttcaaaggactacacgccctcaccatcaaaggactacacgccctctccttcagagggctacaagccctcaccttcagaggactacaagccctcaccttcagaggactacaagtcctctccttcagaggactacacgtcctcgccttcagaggactacacgtcctcaccttcagtcggctacacgccctcaaattcagaggactacaccttctccgcatcagagggcaacaagtcctcacctttagagagctacaagccctcgtcttcagaggactacacgtcctccccttcagaggactacaagtcctcgccttcagaggacaacacgtcctcaccttcagagtactacacgtcctcaccttcagacggctacacgcccgcaacttgagcggactacacctcctcgccatcagagggcagcaatggactacgcgcctgccctttagaggactacacgtcctccccttcaaagggctgcacgctcttcccgtcctcaccttcagaggactacatgtcctcaccttcagaggactacacgtccccgccttcatagggttgcacggcctttcctttggaggactacgcgtgctcaccttcagagggctacacgcccttaccttgagaagactacacgtcctcaccttcagagggctaaactccccctgccttaagaggactacaggactactcgtcctagcctatagagggctagacgcccacgccttcagagggctacacgccctcgccttcagaggactacacgtccttgccttaagaggactacacgtcctctccttcagaggactacacgtcctcgcctccagagggctgcacgccctcgcccgacctcaccttcagaggactacacggctagacgccctcgtcttcagagggttgcacgccgtcactttcagaggactacacgtcctcaccttcagaggactacacgtccttgcctttagagggctagacaccctcgccttcagagggctgcacgccctcgccttcagaggactacacgtactcaccttaagagaactacacatcctcaccttcagagggctacgcgccctcaccttgagaggactatacatcctcaccttcagtaggctgcacgccctctccttcagaggactacacatcctcgccttcagagggctgcacgccctcaccttcagaggactacacgtcctcaccttcagaggactacacgtcctcaccatcaacgggctacac

SEQ ID NO: 83231 - DNA, 321 bp, Glycine max
  Peptide Sequence Number=SeqID_200009
atggtggtactgtcacagaagggttccttagaggcactggtactttgtttggtacttatgctggaggattccttggggagcaaaggcttggtagaattggctatcttgttggaagtcatctgggcagttgggttggtgacagcagaaactgaagttcgcgaaaaatccgaacgatctgaaagttccttttttggtgaaactcctgtttatgacggctctgaaggctccagtgtttatgaatcacctctcgatgaagaatcgtatgcctataaatctactgaacgtcagagctatgaaacatatgaagattctgaactgtga

SEQ ID NO: 83232 - DNA, 2934 bp, Glycine max
  Peptide Sequence Number=SeqID_200010
atgttaccggtggttgaaaacaccgcgagtccacccgaaaataaattcaaatctaggactcttgataagcccatagcttatcacagaccacataagcataagagctctaacacaagaaaagctagagagagagagagaaagtggagcgagaaaaatactgaaaccctccttcgccattctcgttctgctccgtccctctcgatcttcgccagggattctctggcaggtattgttgatctgttcggttctagatcttttcgggcgggttttgttgacggctccgtcatgtcttccctcagcagagagcttgtttttctcatacttcagtttctcgatgaagagaaatttaaggagactgttcacaagttggagcaagaatcgggatttttctttaacatgaggtattttgaggatatggtgacgaatggggagtgggatgaggtggagaagtacttgtctggttttacgaaggtggatgacaatagatactccatgaagatcttctttgagatacggaagcagaaatacttagaagcattggacaaacacaatgaacagctatccaagtatggagatacaaaatctgcacgaggcataatgctggctgaactgaagaaattgatagaagctaaccctctgtttcgtgacaagcttcaatttcctactttaaagaactccagattgcggactctaattaatcagagtttaaattggcaacatcaactttgtaagaacccaaggcccaaccctgacataaagaccctttttgtggaccatagttgtgggcaaccaaatggtgcgcgagccccatctcccgttaccaatcccttaatgggtgctgtcccaaaggctggaggattcccaccccttggtgctcatggtccatttcagcccacaccagctgctcttccgacatcccttgctggatggatggctaacccatctcctgttccacacccttcggcttctgctggacccataggtttggcagcagctaataatgcagctattttaaagcggccgagaacccctcctaccaataacccagctatggactatcaaactgctgattcagatcatgtattgaagagaacaagaccttttggattatcagatgaagtcagtaatctaccagtaaatttgcttcccgttgcttactctggccagagccatggtcagagctcctattcctctgatgacttgcccaagactattgtgatgactctcaaccaaggttcaattgtcaaaagcatggatttccatccacttcagcaaattctacttcttgttggaacaaacatgggtgatgtcatggtgtgggatataggcagccgtgaaaggatcgcacagagaaattttaaagtatgggaacttggatcatgctctgtggctttacaagcatctctttccaatgattactcagcatcagtcaatcgggtggtgtggagtcctgatggaacactttgcagtgttgcttattctaaacatattgttcacatatattcctatcaaggtggggatgatcttagaaaccacctagagattgaagctcatgctgggagtgtcaacgatctcgctttttcttatccaaacaaacagctttgtgttgtgacctgtggagaggatagggtcatcaaggtatgggatgccgttactggtgcaaagcagtatacttttgagggtcatgaagcacctgtatattctgtatgccctcatcacaaagaaagtattcagttcatcttctcaactgcaactgatggaaaaataaaagcatggttgtatgataacatgggttctagggttgactatgatgcacctggtcattcttctactacaatggcatatagtgctgatggaacaagattgttctcgtgtggcacaaataaagaaggggaatcatttctagtggaatggaatgaaagtgaaggagcagtaaagcgtacttatcatggtcttgggaagagatctgtgggtgtggttcaatttgataccaccaagaataggttcttagctgctggtgatgagtttatgatcaaattctgggacatggataatacaaacatgttgacaagtgttgaggcagatggtggattactggcttctccctgtattagatttaacaaggatggaatactgttggctgtctccacaaatgacagtggagttaaaattctagctaatgcagaaggaattaggctgcttcgaacagtggagaatcgtacatttgatgcttctagagttgcttctgcagctgttgtgaaggcacctaccattggagcttttccttctaccaatgtaactgttggaacaagccttgctgatagagctcctccagtagcagccatggttgggattaataatgatactcgaaatttagctgatgtgaaacccagaattgttgatgaagctgtggaaaaatctaggatatggaagctgacagaaattaatgaaccatcacaatgccgctccctgaaacttcctgatagtttatcatctatgagggtactgtcagatattaaaatcgtatatattcataatatttttttggtttctaggttaatttatacaaatcagggggttgcaattttggctttggcagcaaatgctgttcacaagctttggaaatggcagagaaatgagcggaacactactgggaaggcaactgcaagtattcaaccacaactatggcaaccttctagtggaatactgatgactaatgatataagtgatactaacccagaggatgctgtgtcatgttttgcactgtcaaagaatgattcatatgttatgtctgcttcagggggaaaaatttctctattcaatatgatgacatttaagaaagaatctatgtactggttatttgtttctgattcttcaatagacgagataataagcacagtgactgtccgtagatatttatgcatttactggtag

SEQ ID NO: 83233 - DNA, 570 bp, Glycine max
  Peptide Sequence Number=SeqID_200011
atgaagaacccaaaaacctggcaagacaagtacgtccactttgaaacacaagggcaatcaaatgagtggtcgcaaagtgttaaaaagtacctcggcaggagaaaacttcttggcattgaaattggtaaaaaatgcgtcggcggcaaagtgatcggcgaactcgatgaggacgctatagcgatcttcgagagtggaactgaagggaagggaagcttacctgatgaagagaaggtggtggaaacggtcgaggtggggtccacagaagggaatgaagtcgtggaaggagaggtagttggggacggcgaggatgaagaggagagaagaaagagaggtctgggttgggagcgaggaatgggaagaggttcggaacaagtggagtgcgcctctgcgttcgctgaatttagggttgttggattgggattgggattgggattgggattgggattggaagatggtttggggatccagagggtggtcctcttccaccgagtggactcggagcaagaacatgcctcgccgggattctcaaattcaacggtggtgtttctgtttatcggaatatgtgtttga

SEQ ID NO: 83234 - DNA, 2354 bp, Glycine max
  Peptide Sequence Number=SeqID_200012
ttggacagcttcagcttctttcttcaacagtgactatgctggcagtaccaaccccttctctaacagccaccctggcccgtggaggaaattatccagcagcagctgttcccctggttgctttgggaacacagagtgggacaatagatgttgttgatgtttcagccaatgccgttgcttcaagtttatcagtacataatggtattgttaggggactacgatggctaggaaattccagactggtttcattttcttatactcaggctaatgaaaaatccggaggatatattaacaagctagttgttacctgccttcgaagtggccttaacaagatgttccgagttatgcaaaagccagaacgtgcaccaataagagctctgagaacatcttcatctggaaggtatcttctaattttgtttcgtgatgcacctgtcgaggtttgggcaatgactaaaaatcccatcatgcttagatcattagctcttccatttacggtattagaatggactcttccaactgttccgcgtccttctaaagatcaaacatctggggcatcagatgaagcatccaaactatcaaaaacttcctcttcagattcaaaagagggttctagcacagagggatctcaggatgacacgtctgaaagttttgcatttgctctggtgaatggggcacttggagtttttgaagtgcatgttagcattgtccacagaccgaaatggccttcttcttcatttgtatcatcggatggattaatcactgcaatggcctaccgtttgcctcatgtggtcatgggagacagaatagggaacataagatggtgggatgtgacaacaggacattcttcctcattcaacactcacagagaaggaatccggcgaatcaaattctcaccttttgtaccaggggaccagagccgggggcgtatagctgttctgttttatgataatactttttctgtatttgatttggattcaccagaccccttagctaattcacttttgcaacctcaatttcctggaacccttgtattggaacttgattggttgcccttgcgaactgttaagaatgatccactggtactgtgcattgctggagcagatagtagttttcgtcttgttgaagttaatgctacaaccatagaaaagagacctcacttaattccaggaactccttcatctaaaggggatcttcgcacctacatgatcgacataccacctcttggcgactcagtggtgcctgagatgctcttaaaagtattggaaccatatagaaaagaaggttgcatgcttgatgatgagagagcaaagttgtatgctagtattgtggataaaggttgtgccgcaaggtttgcatttgcagctataatatttggtgaatcctcagaagctctgttttggctacagctgcctcaggcacttaaacatttgttgaacaaggtattgagaaagcctccaccaaaagaatccacagcagcacctatctctgatgttgatgatgagacatctctactatctcggatatcatcaaagggaaaaccgacggaagaaacaggaagagatgtattgagtcaaggtcaactaaggttaatggcttttgaccgagaagagttgtggaaaagtgctagtgaacgcatttcttggcatgaaaaattagaaggtgaagaggctatacagaaacgtattcatgagctggtgtcagttggaaacctagaagctgcagttagtttattgctttctacacctccagagagctcttatttctacgtcaatgcacttcgtgcagttgctctctcttctgctgtttcaaggtctcttcatgaacttgcagtgaaggttgttgcagccaacatggtgagggctgacaggtcactctctggcatgcatcttctatgtgcagttggaagatatcaagaagcatgttctcagctacaagatgctgggtgctggacggatgctgcaaccttagctgctagccacttaaagggatcagactatgcaagagtgttgcaaagatgggcgagccatgtcctgcacactgaacataacatctggagggccctgattttgtatgttgccgctggtgcactgcaagaggctttggctgctcttcgtgaggctcagttacctgacacagctgcaatgtttatccttgcatgccgtgaaacccatgcagaagtagtttctaacctaggtattcttgacgaagaatcaagttcatcagttaaggatgagctactaaacttgcgagctttagatccaaataatgaagatgtcattgcagttaatgaatatttagggcaatatcaaagaaagttggtgcatctatgcatggattcacagcctttctctgaataa

SEQ ID NO: 83235 - DNA, 2217 bp, Glycine max
  Peptide Sequence Number=SeqID_200013
atgtactggagggctctgagactcggtgtgtgttatccttcagcttcctactccttttataggcttaagcatataggtgattttacttatccaaggcttgcagattttggtgctgcaatatccggggcaaataaattgcaatgccaacaagttcttgaagagctagatgtgtataagcgattaaaacttacactggagttggtaaagaaagagatggaaataagcaaaattcaggaatcaattgctaaagcaattgaagaaaagataagtggtgagcagcgtcgttacttgttaaatgagcagcttaaggccataaagaaggaactgggactggagactgatgacaaaacagctcttactggtaaattcagggaaaggattgagccaaagagagaaaaatgcccacctcatattttacaagttatagatgaagaacttgcaaagctacagctgttggaggctagttctagtgaattcagtgttacccgtaactacttagactggttgactgcactgccttggggtgaatacagtgatgagaactttgatgttactcgggcgcaaaagattcttgatgaagaccattatggattaactgatgtgaaggaaaggatactggaattcatagctgttgggaaattaagagggacttcacaagggaaaattatctgtctttctggtccacctggagtgggcaaaacaagtattggtcgttcaattgcacgtgccttgaaccgtaagttcttccgattctctgtaggaggattagctgatgtggctgaaatcaagggtcatcgtcgaacctatattggtgctatgccagggaggatggtacaatgccttaagaatgtgggcacagccaaccctcttgttttgactgatgagattgacaaattgggcagaggacatgctggtgatccagcaagtgctttgttagagcttctggatccagagcagaatgctaattttctggatcactatcttgatgttaccattgatctatcaaaggttctttttgtttgcactgcaaatgttgtggaaatgatacctaatcccctgttggatagaatggaggttgttgctattgctgggtatattactgatgagaagatgcatattgctagagattatctggagaagaccactcgtgaagcttgtggaataaagcctaaacaagtggaagtgactgatgctgctattcttgccctaatagaaaactactgccgagaagcaggggtcaggaatcttcaaaagcacatagaaaaaatttaccgaaagatagcgctacaactcgtgaggcaaggggaaatgattgatgcaaccgtggaaccaataaaagaaaatatagactctgatgaatttggtcaaaatacagttcaaaataagaactccgagttggtggagggtagtgatcctgaaaaagagggtgaaacctctgataaagttgacaaggtgcaaacagatctatcatctgatgaatctcaatgcctcgaggttgcaaaagaaagcgaggaagataaggaaattaaaacaaagactatagaaaaagtattggttgatgagtctaatttaactgactttgttggcaagcctgtcttccatgctgagcgcatctatgatcagacacccgttggtgttgttatgggtcttgcttggactgcaatgggtggttccacactgtatatagagaccacacttgttgaagaaggggagggaaaaggaacactgcaccccactggtcaattaggagatgtgatgaaagaaagtgctcagatagctcacactgttgccagagcaatactactggaaaaagaaccagaaaatcctttctttgcaaactcaaaactacacctccatgtccctgcaggggctacaccaaaggatggaccaagtgctggttgcacgatgaccacttcactgttgtcccttgccatgaagaagcctgtgaagaaggatctagcaatgactggggaagtgactcttacggggaagattcttcccattggcggggttaaagagaaaaccatagctgcaagaaggagtgaagttaagactattatattcccttcagctaacaggagagattttgatgagctagcacctaatgtgaaagaaggtcttgatgttcattttgttgatgactacatgcagatatttaatttggctttgggtgatgatcaatctcagaatatagagagagtcattaatgttctgtag

SEQ ID NO: 83236 - DNA, 162 bp, Glycine max
  Peptide Sequence Number=SeqID_200014
atgaggaaggtcaaagacaacatgtgtactaggatcagaaaactaaatgagtttatggcaggcctcaacatcaagaacatggcgacgtccatagagcaccctcaagcaaatggccaggccaaagcggctaacaaagtaattatagtgaaactaaagaaatga

SEQ ID NO: 83237 - DNA, 522 bp, Glycine max
  Peptide Sequence Number=SeqID_200015
atgtgcatagactatacaaacttgaatcgtgcttgtccaaaggatgcataccccctcctcaagatcgatcgcttagtagatggggtagcgggatatcgaatgttgagtttccttgatgaatatttaggctacaaccaaatcaagatggacttagaagatgatgataaaatcacttttatcaccgaatcgacaaactattgttacaaagttatgccatttgggttgaaaaatgttaaagtcacataccaaagactaatggatgaggatctaaaagaggtgtttggacaacttcggaaacacaacatgaggctaaaccccaaaaaatgtgtcttcggggtagaaggagggaattctcagataaggagtcctaggaacatgaaggaaacacaaaggttggttggtagaatagcctccttgtctaggttcttgccaagaatcatcgagaaggccaaatcgacaatgaatcttcgtaaaaaggcaaagaacttccaatggaatgatgagtgtgaagaaaccttttga

SEQ ID NO: 83238 - DNA, 624 bp, Glycine max
  Peptide Sequence Number=SeqID_200016
atggagaatccaacaaccactcatttgaaggcggcaaagagaactcttcgctacatcaaaggtacaacaaattttggcttgcactattctacttttgattattacaagcttgttggatatagtgatagtgattggagtggagatgtggatgaccgcaagagcacaaatggttttgtgctctacatgggagacactgctttaacatggatgtcaaagaagcagtcaattgttactttttctacatgtgaagtagagtatgtagctgctaccatattaatagcgttggctaagaacccagtttaccatgacagaagtaagcacattgatatgcgctaccactacattagagagtgcatcacgagaaaggatgtgcatttgaagtacatgaagactcatgatcaagtaactgatatcttcaccaagccacttaagaaagaagatttcatcaggcttagaagtttgattggagtaacaaaaccaagtttacgagggggcctaggatcttcttcatcaatggattcctttgcttcttggaagatgaatggcagcggaatggagaaggaagagagagaggagacgccacttcaaggagaagatgagtctagaagaagttcaccaccatag

SEQ ID NO: 83239 - DNA, 1446 bp, Glycine max
  Peptide Sequence Number=SeqID_200017
atgctcccaggcccacccagccgcaacaacttcggatccgcagatctgagtcctcacggcctcatggcattcccctccggcagctccatctccatcgtcgacacccgctccatgcagttactctcctccttccccatccctcctccaccttcctccgccgcgcccttcgtcaccgccctccgctggtcccccctccccctcagccgccacctcctctcctccgaaccctcctccaaccacctcctcctcgctgccgctgaccgccagggccgcattgcgctccttgatttccgcctcaagtccgccctcctctggttcgacaccgactccaaacaaggcgtccaggacctctgctgggcccaggcccgccccgattcctacctcctcgccgcgattaacggtccttccactctttctctctacaacgcctccaccggacgttgcgtttggaaatacgacgcttcgcctgaatacttctcctgcattcgccgcgatcccttcgattcgcgccgcatctgcgccgtcggcctccgcggctttctcttgtctatcgtcctcctcggagactccgaggacgccgtcgtcatcaaggagcttcagattccgaccgattccagcgaattggttaagctcgagagagacggtgccggcggatcgtctgccaccgcctccgcggcgtcgcccgcggctgccgcctttccactttataccgcgaagttcgccttctcccagcagtggaggcacattctgttcgtcacgtttccgagggagttggtggtgtttgacttgcagtatgagacggtggtttttaacaccgcgctgccgcgtggttgcggcaagtttctcgatgtgctgcctgatccgagtaacgagtggatttactgtgctcatcttgatggcaagctcagcacatggaggaggaaacctggggaacaggtacacgttatgtactcattggaagagttgatgccatcagttggtacctctgtcccttctccttcaatactctcggtccttttatgccaatcagattccatacttcagaacattggcaagaattattctgatgtaccaagttctccttaccttcgtgaggattttgagaatccttttgatttttgttatgagtctaatattgtttccaagatacatttgatctccatttctgatgatggaaaaatgtggaactggctcttgactgctgaagggcaagcaaacacccaaaaaaatgataagaagttagatttggtcaacaatgaccatacggtatcacatcctggggccaactctaacaccttagtatcttctgctggtggacgtgacctaaatgcaggcaggcaacgagagcgtttcaatgataatagaagccgcctgcagacctcagtctttggccaggaagaaatttcaatgaagggtaaatggtatattttgaaggaaaccaattaa

SEQ ID NO: 83240 - DNA, 222 bp, Glycine max
  Peptide Sequence Number=SeqID_200018
atggccaccgccgagagggaaatgagtgttgaaaaggcgaaaaggattgggttgagcagaaagcatataacgatgtttatgaagcttatgagtgtgggttcaatcattgcctttgacaattactctttgactgtggtaccaaatggtgggcagccaactacacctcttggtgaaacccaaatgaccaatttggctgaggaggacgaggcccctcgggggtga

SEQ ID NO: 83241 - DNA, 213 bp, Glycine max
  Peptide Sequence Number=SeqID_200019
atggaggaacaagcccagggtggccttaacaaaggatgtcaaaagaactcacgtcactctttgaaatttgatacactggtggtaataactccctcatctagaacctttcctatgttattgaccaccctctctaaaagtttattcaagaagctagagaagttgctagactccccactgccagtagaaggtgaatccccttctagagaagaatga

SEQ ID NO: 83242 - DNA, 354 bp, Glycine max
  Peptide Sequence Number=SeqID_200020
atggcgcacagcaccggatccgatgacagtagttgccaaggattctccctcactcaacaagagatttctatggcttcgtatgaatataactcttcagataatcagtttttgtatttttcataccttcacgatgaggaccaccacgaatatgatgatgatgaacaaactgcatataaaaggagagcgatcactgatcttggtggttatcttccaccacccctagggttgaaaatcactatgacacctgaaatgctgcaatcaaccaggacaagccaagttgcagccaataacaaggttgagaaactgaaggcggtgcagtttccaatgaatatgctcaagatcggctattttaag

SEQ ID NO: 83243 - DNA, 951 bp, Glycine max
  Peptide Sequence Number=SeqID_200021
atgagcacagtaaatccactcgttactcggatcaggcagcacatcgagaaacttgccgcaaccacgcggcagcgcggtgttaaaaaccaccgtctcatactgcaagtcaaacaccaccaactccctcggaaacgtgacgaacagaatgtgcctccactgctgggagaaggcgaacttcgcggtataaagtggaaaggcggcagccgcgggcgacgccgcggaggcggtggcagacgatccgccggcaccgtctctctcgagcttaaccaattcgctggaatcggtcggaatctgaagctccttgatgacgacggcgtcctcggagtctccgaggaggacgatagacaagagaaagccgcggaggccgacggcgcagatgcggcgcgaatcgaagggatcgcggcgaatgcaggagaagtattcaggcgaagcgtcgtatttccaaacgcaacgtccggtggaggcgttgtagagagaaagagtggaaggaccgttaatcgcggcgaggaggtaggaatcggggcgggcctgggcccagcagaggtcctggacgccttgtttggagtcggtgtcgaaccagaggagggcggacttgaggcggaaatcaaggagcgcaatgcggccctggcggtcagcggcagcgaggaggaggtggttggaggaggggcggtgacgaagggcgcggcggaggaaggtggaggagggatggggaaggaggagagtaactgcatggagcgggtgtcgacgatggagatggagctgccggaggggaatgccatgaggcccattgattcccatgactcttgcggttgcgttgttactgttgctgctgctctcggactcgccagcatccttcactccgatttcgatccagtgcaagggcccaagcgtgtttttcttgccttcgatcgttcgcttttgatttccgcttcttacttactacacaaatga

SEQ ID NO: 83244 - DNA, 156 bp, Glycine max
  Peptide Sequence Number=SeqID_200022
atggtcaaaggtgactttagtgctattgcaacagtaagtaagaagcggaaatcaaaagcgaacgatcgaaggcaagaaaaacacgcttgggcccttgcactggatcgaaatcggagtgaaggatgctggcgagtccgagagcagcagcaacagtaa

SEQ ID NO: 83245 - DNA, 384 bp, Glycine max
  Peptide Sequence Number=SeqID_200023
atgtctcttcgggatagaaggaggaaattcttaggcttaatgctgacacatagaggaatacacacaaaccttgataaatgtcaagccattttagagatgaggagtcctaggaacatgaaggaagcacaaaggttgacgtgcaaccctccagtgccttcaaaacctggcactagtaagatactcatagtatacctctcggtctccattgaagccataagtgacatccctgtccaagaagaaaacaatgagttaagatcagtatactttgttagccaaatgttgcaagatcaagaaactcagtatcaggtaatggagaaagtggcatgggcattggttactactgctcagcgtcttcaacagtattcacaaagccatgggattaat

SEQ ID NO: 83246 - DNA, 453 bp, Glycine max
  Peptide Sequence Number=SeqID_200024
atggcttgtcccttagtggtcgtgtacatgaaatgtttggttatatttgccaattgcacttcaaccattaaattagtatgtcattgtgagttaatgacttggaaagatcgtttctttgcgttctatattcgcgtcgagctttcgagactgggctccggggcaccagggggatcggaggaggatgtatggggcttgccgttagcagggaggtggggaggtgccatgagaaagggatgcgacatgatttcggctggtggtggtgacttcgcagaggaagaagatggagaggcaagtttggccatgacggcctcgaggcggtccaggctggtgaaggaaggttcagcgtctgccatcgaaggacaacaggtcagaccaattgatgggagcaaagggaaagataacaagaaagagaccttgaattcaaggacaagggacctccttactacacaaaag

SEQ ID NO: 83247 - DNA, 1389 bp, Glycine max
  Peptide Sequence Number=SeqID_200025
atgggagaaaacaacaacaagtttcactgttgtggtgatgatgatggcttcgacgagccactgtatttgaagtaccccgcgctgcaagatctggagtgggaaggcaccctcatttgccttcctcccgatttatcgtctctgtcaaataacttcacccctaaggttcttccactatcgatgtctcccccatcggagaccaccgtcactcgggttcctcctatgttgccgccggtggaggatgccacctacgttcaacccaacctccaagatcaattgtcagcgttacagaacatcaatgcgaaccaggttgctcccatgtggccaggctcccaaatcaatcactcgctgtcacggaagggcagttcttcgaagtccaatgagtgcaggagatggagtgaagaagaacacaggttgtttctgcatgggcttcaaaaatatggaaagggagattggataaacatttcaagaatcatcaaaacaagaaacccaactcaagttgctagtcatgctcaaaagtatttccttcgtcaggcctcaagtaataaaggcaaaagaagaaacattcatgatatggtcctaccagatggtcctgtccctcaccgcatttaccagcagaatggagtttcttttcgaaatcttgatggccctatcactcaccacattaatcatcagaatgggcgcaagcagatcaaatatcttggatcaagccttggctacttaaatcctagccataccaaaaaggccaacactctatctaaggccgatttgggccaatgtttcgagtatcactgcaatcgaggacattcaaccgaagagtgtatcattttgaaggacaaaatagaagatttcataaagctgggacacttgaaggattttatccacaagactcaatcttatcgacttcagaatagttataggcaagacaaagacaaaggaagagatagagattgcagtcaccagtctcaaactgagagtgaaagaagtcgaagccggaagggcaatgacctcggactgaaaaaggcgactatgttgggtatattggagttagagctccttcatgtgacaacccactattcggcttcgccaaagaaagaatgggaaccaagggatgtctatgactatacaatagaatggtttgaagatttgatatgtgatggtgcatgcccacatctcctacaacatacttctcagtcgcccgtctctaaatgctctgaatgccatagagccaaaggatccaaggagttagatctagacctgagaaccaatgacaacaacggggcactcagcgcgtcgtcagctcgcccagcgagtcgtttgtcctttctcgcacttagcgagcaaatcgcgctaagcgagccttcagaatctgaaacgccaaggagcctttaa

SEQ ID NO: 83248 - DNA, 432 bp, Glycine max
  Peptide Sequence Number=SeqID_200026
atggagagttcatgcatatgcggtgtttcacacattttgaatttgattgtatgtgatgggttgaaggaaattgactcttcaattagtaaaataagggttgcatctttcaatcaatttgagtatgttgaggctgcatatgagctcactcttctaactagtgaaggaggatgtcctaaagagatggattggaaacatgctcgtgtatttaaaatgtatcgtgttgacaaaaccaaagagatgctaaaaaaattagatgatctcataagaaaaatgtttgctaaatatgctttggaacatcccatttccattgatagtagtaattctagtactttggcttcaaatcgtgcttcacaaggtaatgccaatgatgctgatgaggatgaggattgggatgacaaatttagattaaaaataaagaaaaaaacatggtga

SEQ ID NO: 83249 - DNA, 396 bp, Glycine max
  Peptide Sequence Number=SeqID_200027
atgaaaaataaaagttgtaccgaaagtgtcaatgcattaagtcctttgtcattgtttactccctctcaatgtcctactaaacctgaagtagttggtgctccatcacaatcagaacaagtgccaggggttcccacacaacaagggccgcaagttccatctggatcatctgagccaccgaaggttgataacaaccggacaacaattgttgttgcaaaggcatgtgagggtgaccctaatgttgttagtatgaaacttgttgatttcaatgagagaactcttgtagaacttgcaaagatgatcaccgtagatgaacttccttttaaatttgttgaatatgaagggtttaggaattttatggaagcggctcaaccttattttaaaattcctctcgtgtga

SEQ ID NO: 83250 - DNA, 2208 bp, Glycine max
  Peptide Sequence Number=SeqID_200028
atggttgtgctgagcgagggtcttacacaaattctaatacctgtgactgcgtttattggaattgggtttgctttgcttcaatggcttttggtgtcaagggtcagagtctcttctgctgatcacacggaagcagacaacggatatagaaaaagcttaatgggagattcagagttggagaatggtgttcagagtgttgaagttaccaataagtgtactgaaatccagcatgccatttctgttggagctacttcatttttgtttaccgagtataagtacctgactatcttcatgggagtgtttggtgcaataattttcgtctttctgggatctgtgaagggctttagtacacaaagtgaaccttgcacttacaatgaaggcaatatttgtaaaccagcacttgctaatgccatctttagcaccgttgcattcttgcttggtgctctaacctctgtcctttctggctttcttggaatgaagattgcgacctatgccaatgctagaactactcttgaagcaaggaaaggaataggaaaggcttttgttattgctttccggtctgatgactgggagggactttacgagtctatcaccggctatggccttggaggttcatcaatggcactctttggaagagttggaggtggcatatacaccaaagcagctgatgttggtgctgacctggtggggaaagttgaacacaatatccctgaagatgatccgcgcaacccagctgttattgcagacaacgtaggagacaatgttggagatatcgctgggatgggttcagacttatttgggtcttatgcagaatcatcatgtgcagctttatttgtagcatccatatcatcgtttggaacaaatcatgatcacacagccatgtcatatcctctcatcataagctccatgggaattgtggtttgcttgattacgactctttttgcaactgatctgtttgaaattaaaaacgtgagccaaatagaaccatccttgaaaagacagcttcttatctcaactatattaatgactgctggtattgccatagtcagcttcactgccttaccatcagaatttaccctctataactttggagccaaaaaggttgtcaaaaactggcaccttttcttctgtgttgctattggcttatgggctggacttgcaattgggtacattacagagtactacactagcaatgcttacagcccagttcaagatgtggcagattcctgcagaactggagcttcaacaaatgtgatttttggattggcactgggatataaatcagtcattattcccgtatttgctattgctattgctatttatgtaagcttcagcctggccgctatgtatggaattgctgttgctgcacttggaatgctcagtaccatggccactagtcttgccatcgatgcttatggtccaatcagtgataatgctgggggtattgctgaaatggctggaatgagacatgagatacgcgaaagaactgatgctctcgatgctgctggaaacaccacagccgctatagggaagggttttgctattggatcagctgcacttgtgtctcttgcattgtttggtgcttatgtgagcagagcaggcatcaaaacagtgaatgtgatgaccccaaaagtttttataggtttgattgtgggagcaatgcttccctactggttttcagccatgacaatgaagagtgtcgggagtgcagctctcaaaatggttgaagaagttcgtaggcaattcaataccattcccggtcttttagaaggaagagcaaaacccgattatgcaaattgtgtaaaaatttccactgacgcctcacttaaggagatgatccctcctggtgcattggttttgcttacgccacttattgccggaacattctttggggtagagactcttgctggggttcttgctggttcactcatttccggtgtgcaggtggcaatttcagcttcaaacactggtggtgcatgggataacgccaagaaatacatagaggctggtactaccccacatgctgtatcacttggtccaaaaggctctgatgctcacaaagcagctgtcataggtgacactgttggagaccctcttaaagatacttcgggtccctcacttaacattttgatcaagctcatggcagttgaatcattggtatttgctccattctttgcagctcatggaggcttaatctttaaattactctga

SEQ ID NO: 83251 - DNA, 1092 bp, Glycine max
  Peptide Sequence Number=SeqID_200029
atgacaattcttcgcttcttctgccccttctttatactcttcttcactccaatagcttctgtgcaagcgttcaccggaacctatggtataaattatggtaggattgcaaataatattccttcacccgatgaagttgttactcttctcagagcagcaaaaataaggaatgttagaatctacgatgctgatcacagtgttctcaaggcatttagtggaactgggcttgaaattgtagtggggcttcccaatggccagctgcaagacatgagttcgaatccagaccatgctttgaactgggtaaaagaaaatgtacagtcatttcttcctgacacacgcattcgtggaattgctgtaggcaatgaagttttgggtgggacagactattctttgtggggagttcttctgggcgctgttaaaaatatttacaatgctaccaagaaacttcatctagatcaactggttcagatttctacggcaaactcatttgcggtttttgcagtttcttaccctccctcctctggtaaatttgataataatgttaatcagtatatgaagccactactggagttcttccaacagattggctctcctttctgtttgaatgcttaccctttcctagcctatgcgggtgatcctgaacatattgatataaattatgcactttttgaaccaacaaagggaatttatgatccaatgtatcatctgcattatgataacatgcttgatgctcagattgatgcagcctattctgctttggaggatgctggatttgacaaaatggaagtcatagttactgaaacgggctgggcctcaaatggagatcaaagtgaagctggagcaaatgcaactaatgcaaggacatataattataacctgcgtaaaaggcttgcaaagaggaaaggaacccctcatagacctaaaaatgttgtgaaggcatacatttttgcattattcaacgagaacgagaagcctgggcattcatctgagaagaactatggactgttcaaggctgatgggagtatatcatatgacattggctttcacggacttaatgctggacattcatctcttttgtctcttaaggtaccataa

SEQ ID NO: 83252 - DNA, 963 bp, Glycine max
  Peptide Sequence Number=SeqID_200030
atgttctctgtgaaccccaaacccttctccgccgtagccgtagccatgtcagggtcacactcacagcaagcccaaccaaaatccccaatccccacagagaattacccagtcccactgtcccctcctctccccccaatctcgaaacaactggaactgagcagggccatgagcgccgcttcaaactccagcctcttctccctctcccccgccgatatcctctaccacgacgaccacctcatcgcagtcaacaagcaccccggaatctactgcgagaccctcctctcctccctcgcctcccaatcccaccagctccacctcgctaatcgactcgaccgcgacaccaccggcgtattgctcctaacaaagtcccacaaggtcgccgccaagctcgtcaaggccttcaccgatcacaaggttaagaaaacttacattgccctctgcactggtcctcctccaaattgggaacgggtcaccctcagatccggtcacggtaggtccaagttcggcgcctggcgagtctacgctgcctccgacgtcgggcgtgcgctaccgggcggctcggttgtccgctccatggagacttccttcgagttgttatcggtaaacagaaaagggaacttcagggaagtctctgattcagaattcgggaacgttgagggtgaaaatgtcttagtggttgaagaaaaggcggtgaaagaggatggtaacaacgagagcgagatagtggtgagagcgtatcctcggagtggaagaacgcatcagattcggttgcactgtcaatacctagggatttctatagtgggagatgtgaaatatgagggtgtgtacgagtggaaaggcaccactcatcatgcacatcaccttcacgcagaaaccttgtcatttgaacatcctgttactggtcttcacgttaagctacgtgctcctctaccaccatgggcaactcacgcgtttcagccttga

SEQ ID NO: 83253 - DNA, 1389 bp, Glycine max
  Peptide Sequence Number=SeqID_200031
atgggtagtcccttttcgtggttcatctgtatctttttttttaatcttaaatcagtattttccatttttctaactcgtgtgcatgtgctttgtgtgaatgcagacggatggggaaatcgttgggttaaatcagattggaaaaaagatgagaacctggctggggagtggaaccacacctctggccaatggaatggagacgctaacgacaaaggtattcaaaccagtgaggattacagattctacgctatttcagctcagtaccctgaattcagcaacaaggataagacactagtcttccaattttctgtcaagcatgaacagaagcttgactgcggtggtggctacatgaagttgctcagtggtgatgttgatcagaagaaatttggtggggatactccttacagtattatgtttggcccagatatctgtggttacagtacaaagaaagtacacgctattcttacctacaatgacacaaaccacttgataaagaaggatgttccttgtgagactgaccaacttactcatgtttacacatttatcctccgtccggatgcaacctacagcatcctgattgataatgtggagaagcaaactggtagtctctactctgattgggatcttctccctccaaagacaatcaaagatcccgaggctaaaaaaccagaagattgggatgacaaagaatttattcctgatcccgaggataagaaaccagaggggtatgatgacatcccaaaagagctcccagatcctgaagccaagaagcctgaagattgggatgatgaggaagatggtgagtggacaccccctaccattgccaaccctgattacaagggcccatggaaggcaaagaaaatcaagaaccccaactataaaggaaaatggaaggcaccattgattgataacccagcatttgaaaaacatttatcagatttcaaggatgaccccgacctatatgttttccccaacttgaagtacgtgggcattgaattgtggcaggtgaaatctggtactttgtttgacaatgtcttaattactgatgatcctgaatatgccaagcaactggctgaagaaacatggggcaagcacaaggatgttgagaagacagcatttgaagaggctgagaagaagagggaagaggaggaatcaaaggatgacccagttgactctgatgctgatgaggaagaggaagatgctgatgaagctggcaatgactccgatgctgaatcaaagacggaagctggggaagacaccaaggaagagggtgtacatcccccggcccccctacagtacacttgtggtggatgggttttagtgcttcagctagtagctagcatccatgaggagtatgccatcgttgtcttagactgcatttatgatcactaa

SEQ ID NO: 83254 - DNA, 495 bp, Glycine max
  Peptide Sequence Number=SeqID_200032
atgtaccatcaaatagataaaagcaaatgcttaaaatttataaaaagttcgccattaccatcggcgtgtttaagaaaattgaaaaacacgaaaaatcagggtcgcgatctagtgagagaagagaagaaggaagggtttgataccatcgaaacgctcctcgaagaagaccttggcggaagtgatggacaagagagagagaagaatgagaaagcggaggtcagggtttcgcaccctaaacgccatcgtcatcgacggaacagagccagggatgtagaaatgaaagtgagaggagagctgtggctacttggaattttagtgagtgagatccctgttctctatatagcggatcaatttgctttgggttttcagtacagtgggcaaatttggaaaatgatgtggctcagtcctacgtggacaccaggtggcagtttccgaccaattgtcttatgccacggtgagttcagtgtcaaactaatcacacgtgtgattcggtag

SEQ ID NO: 83255 - DNA, 189 bp, Glycine max
  Peptide Sequence Number=SeqID_200033
gagaaatggaaacagggcaaaaattaccccaccgtgagagtagagatgggatgggaaaaacagaataaggttcggggacgagcaacgataatacttcctgtccacgcgggtgccatgcctatctacatggctgtatacaccaaaactgttgcgcacgtactattaatcttatttcagtttactcgctaa

SEQ ID NO: 83256 - DNA, 1470 bp, Glycine max
  Peptide Sequence Number=SeqID_200034
atgccaaaggcgatccccttcatgaccgatgcggtgatcccgcagccgcagcagttgtctgccacaattgagtatcagctgacgcagcaaggcggtcacgtcggcttcgtgggcggcagcctgctgcgacccaaaatgtggctggagcagcgcgtgccggactggctctcaacttatctggatatgcaccgattacggcgagcaggagcgcagcctgacggagaaagtggccgatgtgcgccgccagctcgagcagggcgaggtggtgctgggagcgctgttatgtcagccaggcatccagtcatagccgttaccggttccagcggcgccggaaccaccaccaccagtctcgccttccgtaaaattttccagcagctggatctgcacgcggcggaagtagaaggcgacagtttccatcgctatacccgtccggaaatggacatggcgattcgtaaggcgcgcgacctcgggcgtcacatcagctactttggcccggaagccaacgacttcggcctgctggagcagactttccgcgactatggccagagcggacttggccagtcgcgcaaatatctgcacacctacgatgaagcggtgccgtggaatcaggtgccgggcacgtttacaccctggcagccgctgccggaaaacaccgatgtgctgttctatgaaggcctgcacggcggcgtggtgacgcagcagcataacgtggcggaacatgtcgatctgctggttggcgtggtaccgattgttaatctggagtggattcagaaactggtgcgcgacaccagcgagcgcggccattcgcgcgaagcggtgatggattcggtggtgcgttcgatggaagactacatcaactacatcacgccgcagttttcccgcacgcacctcaacttccagcgcgtgccgaccgtggatacctcgaacccgtttgccgcgcgtgagatcccgtcgctggatgagagctttgtggtgattcattttcgcggcctggagggcatcgcttttccttatttactggcgatgatccagggctcgtttatttcccacatgaatacgctggtggtgccgggcggcaagatgggactggcgatggagttgatcatgacgccgctggtgcagcgggccgcgctcccggctggattacagctccaccacttcgtagctgtgcgttatctcgacgcccttgcccagcatgatcgcgaccgagcagtacttctccgcggacagatccaccgcgcgcgccaccgctttatcgctcagcgctttgccgctgacaataaaatgcagattgatatgcgtaaaaatgcgtggcgcttcttcgcggcgttccgaggtcagtttgacttcacaatcggcgacatcgttgcgccccttttgcagaatcgacaccacgtcaatcgcgctgcagccgcccgcagccatcaacaccatttccatcgggctgggcgctttatcaccggaattgcc

SEQ ID NO: 83257 - DNA, 1255 bp, Glycine max
  Peptide Sequence Number=SeqID_200035
atgagccgttcggtgcgctggatgccttcacgcgcgagcagatgcagacgctgctgctgacgttatggcgcgataccggcaagcagattctgctgatcacccatgacatcgaagaagccgtctttctcgccagcgaactggtgctgctgtcgccgggtccgggtcgcgtggtggagcggctgaagctcgactttggtcagcgcttcgccgcgggcgagccgtgccgcagcatcaaatccgatccggcatttatcgaacgaccgccggacgtcccgcgttcgtcgcctgcgctggccgttttcccgccagctgtcgctgagcctgctgagcgtagccgtgctgctgctgctgtggtggggcgtgaccgcgctggggctgattgcgcccttgttcctgccgccaccacagcagggctttatggatgccacgctatggcagcaccttggtgccagcctgacgcgcatgctggtggcgctgttctttgccgcgctgatcggcattccgattttactgatttatctggcaattttcgctccggtgactttgtccaccctggccggcgtgaagaatacgcagcaggtgcggatccgtgccgctcaggcgctgggggcgacgcgcgggcagctgctgcgttttgtcattctgcccggagcgttgccggagattctcaccggcctgcgcatcggtcttggcgtgggctggtccacgctggtggcggccgaactgattgccgcgacgcgcgggctgggctttatggtgcagtcggctggggagtttctcgccaccgatgtggtgctggcgggcatcgcgcgccgactgacgccctggaatggagaacagcaatgaacgaacgagtgaattttaccgcgctgggtccgtatatcggggcgcaggtcagcgatgtcgatctcagccatccgctgagtgacgcgcagtttgagcagctttatcacggtctgttgcgtcaccaggtgctgtttctgcgcgatcagcgcattacgccggagcagcagcgcgcgctggcgatccgcttcggcgatctgcacattcatccggtttatccgcatgctgaaggcgtggaagagattatcgtgctggatacgcatcaggataatccgccggacaacgataactggcataccgacgtcacctttattcagacgccgccggcgatcgccattctggcctcaaagctgctgccggagagcggtggcgatacgctgtggaccagcgggattgccgcttacgaggcgct

SEQ ID NO: 83258 - DNA, 354 bp, Glycine max
  Peptide Sequence Number=SeqID_200036
atgtggcatgctaggcttggacatgtgcatttgaattctatcagaataatgatgtttcttaatcttattcctaaatcttccattgatttaaaacaaaagtatgaaacatttattcaagcaaagcaacctagaaagggttttactacatgtattgaaagagaaactgtcgcaacctacccttcggcgggagggcgacgcgagactcgcgggatgcgtgttccacgaaaggaatgcgcgcggagtcgccaccaacgtttatttgaggaaaacgtcggaaaaaccggaaaagacgcgatctacgaacttttaagtgaaaggttcgggagttgtatttacgcacggggaaggtgttag

SEQ ID NO: 83259 - DNA, 429 bp, Glycine max
  Peptide Sequence Number=SeqID_200037
atggttggagcattctcgcaaaacaaagtgaccttgagtggtcaccttatgattttacttaatgagagtgacctgacatacccattgcatagggtgtcatatgctaaacaacagaaaaatgcgattgataagttggtacaggaatacttggcgactggtataattcaaaacagtagtagtccctttgcaaggccaatagttttggtgggtaaaaaggatggatcatggaggttgtgtgtggattacaaggatcttaacaagcatacagttaagaacaagttcccaattcctttactagatgatctgttggatgaattggctgattctagcattttcatccttcaagttaacaaagtcgactatatagatttacctattgcatcaactgtcatgcaaaaagatattgaagcaacaaacaagatagcttaa

SEQ ID NO: 83260 - DNA, 786 bp, Glycine max
  Peptide Sequence Number=SeqID_200038
atgccattaggacggaggacttgggctggaatacttttgaaacaaccttgttcagaaccatttctgggccagcccactccccctcaactcagattgtggaatagcattatcccaactcagaaacaaatattgaagctaaacttgccacatacaaattgtttgcctcgcaacattgcaacttcatcttccaacactgtcttttgtgaattggacacaacccccagcggagaaagtcattgccggagaagaccgctactgttaggcattggagcattaactgcaaatttacaaccaacaaatttggtctttgctcaagaaaaaccagacagataccgagcttttgtggactatgaagatgggtattcttacgtatatcccattgattggaaggaatttgacttcagggctcatgattctgcattcaaagacagatatctacagttacagaatgtacgggtgagatttataccaaccgagaagaaagacatccgagatttgggtcctatggaagaggttatatacgatttggtgaaacatagatacgcagcaccaaaccaaagaccaacaataaatgacatgcaggagaaaaccatagatggaaaacattactatacctttgaatatatacttacatcaccaaattattctagtgcctcctttgcaacaattgctataggaaatggaaggtactacacgttaattgttggagccaatgaaaggcgatggaaaagatttcgagatcagcttaaagtggtagcagactcctttaggcttcttgacatctga

SEQ ID NO: 83261 - DNA, 369 bp, Glycine max
  Peptide Sequence Number=SeqID_200039
atggaaaatttggaggaagagcaacatggggttgttgtgtatgtacttgatgaaacgatccccgatgttttgaatgaatcaagttatgaatttgtagtcaatgatgatgttaatgcaaaagaacaagaaactggtagtggtgatgatgataagggtcttttgttagttaatagcggattgtttgaggaaagtggtgaaattgtaccaatcattattaatggtttggttgatattgttgacattaatatgatgaatattactagtgatgaagtggagaggttcttatttggtgacctaaagtggcatacttgttttactattggtatgcacgaattgatggattttctattaacagaaacaaagttgtga

SEQ ID NO: 83262 - DNA, 1040 bp, Glycine max
  Peptide Sequence Number=SeqID_200040
atggtgcggcgagaagaagcgaagaagaaagaagaaagaagaatgaagtgcaacaacaatgcatacgaagagggagaggagagggagaccttttttaaatttaaaggtttggagtggagggaggtgcagagcagaatggttctatcaaacaagaaactgaagcttaagctgagagctgaattagcccaaagaaactccaacgccgccgccgaacccccttcatcttcatcttctactaataataacaactctctcaaaactcttctggactctgccacccctaaagccagattctccaaaagagagaagcgaaggaagcttcgatccgaccaaccttcacaacaagccaacaaggaaattcaaactgaaacagaagctgagggttcgcccaataagaagagaaagaggaagaaggtagagggcgatgacgtggcagcaaatggagtttccgacacaccaaagaacaagaagaagaagcaaaaacagaagaagaacaagaacaagaacaagaagaaatccacaacggcggaagaaaacgaatctaatggtggaggggaaatgccagaggctacagagttaaccaaaaccaatacaactaccagtaaagacaatggtgatgctcctacaaacacgaaagcttatgttggaggaattccctattattcaaccgaggatgatattcgaagttattttgaaagctgtggcaccataactgaagttgattgcatgacttttcctgaaactggcaagtttagagggattgccattattactttcaagactgaggctgcagctaaaagagcattggctcttgatggagctgacatgggaggactctttcttaaaatccaaccatataaagcaactcgagccaataaagcctcagattttgctccagaaattttggaggggtacaataggatatatgttggaaatttgtcgtgggatataactgaggaagaactaaggaaattcttcaatggttgtgagataacatcgctacgattcggtatggacaaggagacaggagagtttcgagg

SEQ ID NO: 83263 - DNA, 1407 bp, Glycine max
  Peptide Sequence Number=SeqID_200041
atgttgggtgccccaagcaattcccggaatgtgggtgttattgccccaatagcaattgggtccatagtgggtgccaacatcttgggtggtggggcttttgatggagcatccatggacccagcagtgtcttttgggccagctgtggttagctggtcatggactcatcactgggtctattggcttggcccattcattggttcagctgctgctgccattctctatgataatatctttatcggtgacgatgactctccaatggaggatctgtttagcaatttgccagatgaagttctaagctgcatagtttcttttctgccaaatgaatcagcactagaaaccagcctcatatctactaggtggagagacctatggaaccaagtccttgtcagacatggaaccacacaagacataactggtgttgttgctggttttctgtctcgttttgaagagctagatccattaaaacatccccgcaaacttcaatttcactttgccgatcaagacactgcactctttgcatccattgcaactaacagtaagcttcttcttgatttccctggtggtgggaacaaagacctcaaaaagcaatatgaactgaagttcatgttcaacaaagatctcaacactgttccccccactttcttagtcaaaacgctttatttgaaatcagtgagccatttgactagtgagttggtttcctccatcgtttcaaatttggagcatcttgagaagttgatgattgttgagtgcactgggttgcagtctttgttcattgagtctgaatcaaagcttcacaagttaaccatattagattgcccccagttgaagtctctccatcttagaacttctaagcttaaaaggttcagacttcatggacctcttccaaagatttggccagaatcccatttcaacctcagccatgccatgcttgatttcagacttggaccaagctgtgctgacttcaaggctcaagatttcaaccaaacactgttgacaataaagaattgtgaagctctcactttatgtgagtggacttttcaggcattgatatggccatcgatttctccaagtgggaacttcatattctataaaataagagagttatggtggattcacaaccataggggtgaaaatagcatggaagccttagtctcctttttgaaattatgccctgctttggagcaactttttgtgacgaatgattctacaagttattcggctccacggtccaattcatgtttaacgcaagcaactaaatatagtacaaaattggagcatctaaaacggataaagtttatggggtttacaaatcgagtggatgaaatctcagtggcaaaaagattaattgaattagtcaggggagagcctccaaagatagagacttgcttgaatgcagtgctcgtgtag

SEQ ID NO: 83264 - DNA, 315 bp, Glycine max
  Peptide Sequence Number=SeqID_200042
atgtttgaagaagttgatatgaatgaagaaaatcaagaggaatctggtgtgaatgaagaaaatggagaggaatctggtgtgaatgaagaaaatggagaggaacctggtgtgcatgaacttgttgattgttcagatgccttaaatacttttcaggtatttgctacctgtgatgatattttgcattgggctcaatctgttgcgtgtgatattggttttgtggcggtgattatgaggtcaaacaaagatattggaattagaggaatgatctcatttgttttattggttgtgaagggagtggtcagtatagggccatga

SEQ ID NO: 83265 - DNA, 939 bp, Glycine max
  Peptide Sequence Number=SeqID_200043
atgacggtggtcggactcttcctcaccgccacgaagctcgccggagctcttttcactctcaccgtcgccgccaacgccttctcctactcccgctttcgcaagaagaaccttcgccgtttccgctcccccatcgacgaatcccaagacactctcgcacactttaacatcgccgaaggggaagatgagtttttctttggtttggcgacagcgccagcacatgttgaggacaggcttgatgatgcttggatccagtttgctgagaaaaagagaggtggaggtggtggtgactcagaggggaagcagagagtggatgctgtgattggttctgcttctggtgatggtgggtcccagcaggccataacatctccgcggagcaggaagcctcttaaggtggcgatggaggccatgattaggggaattgagaagtacatggaagtggaagtgcaagaaggagaagaagaagcccgtcctaatgtaactgcttggcataatgttccacgcccggaggagaggttaaggttttggtctgatcctgaaacagaaataaaattggccaaggatactggtgttacagtttttcgcatgggaatagattggacaagaatcatgccaatggagccagtaaacagccttaatgaatctgttaactatgctgcattggaacggtataagtggattataaatagggttcgatcatatggaatgaaagtgatgctcactctttttcatcactcacttccaccctgggctggtgagtatggaggttggaagctggaaaagacagtggattatttcatggactttaccaggttagtttttcctttagtggctgttgtctgtatgctatggcctattattactctagctgctgtggatgtctctcaagtttcaagtgagattaacagctaccctgtgccagcctatggttgtaacttgtaa

SEQ ID NO: 83266 - DNA, 852 bp, Glycine max
  Peptide Sequence Number=SeqID_200044
atgttagaaagagaagcaagtcttgagagctctaaaatctggattgaaccaaagcatcaagcaactgaggttaaagttccagtaatatactacctttcccgaaatggccagcttgagcatccacatctcatggaggttccaatctcttctccacagagagtgctatgtctcaaagacgtgatagatagattgagttttctccggggacaaggaatggccaacatgtattcttggtctacaaaaaggagttacaaaaacgggtttgtgtggcaagatttgtccgagaatgatttcatttacccaagtagtggccatgagtatgtcctcaaaggaacacaaatgatagaagcttctttgagctttcgatcctgcgaaacaatatcaacatcaagctccaaaagttccactgaagcaagcaattctagcacgggtgcagactcccctgccaccataacgaggagaagccagtcattgaactcgagtgattacaagtattactcggcaaataaatgcgaagagtttgcagggaaagctactattgcgtcgactcagactgaggagaagcgtagggaaaggataaaaagggaggagcaagttgaagagtgtgaaggaaatggtgatgcaaaggagttgggtgagaatgaagaagggtctttgccattttctagatctagttttggaacgttggaagggtctttggagggttttggatcagcagatatcagaagccagagggtagagaatgaacgtccaagtgggaggatcaaggcttcagaagttttgatgcagttcatcagtgttgaaggtgtattccatgggaagggaaggcttgggcttgggttctgtaactaa

SEQ ID NO: 83267 - DNA, 420 bp, Glycine max
  Peptide Sequence Number=SeqID_200045
atgacttcctccttttcgatcaaggtgatctccaacttcttaagccaatgtcatcgtgtttccttgaaggagtttaatactggcagatgttggaagaagcagctaaatatagcaaaagatgcccggcgtgtagatgtactatgttacaggatatatttgagctacaggcttgtggatggtacttcaaaatataaagaattacatgaaatggtaaaagaggcaaaggctaaactggaaactgaagttggtccagtgacagcaagagttctggagaagaagtcgccgtgcaatttcttggtgttcgggttggggcacgacggcctgatgtggaacgcgctgaatcacgggggaaggacgatattcctggaagaagaagagtcatggattcagcaaatgagaagatttccaatgatggagtga

SEQ ID NO: 83268 - DNA, 1158 bp, Glycine max
  Peptide Sequence Number=SeqID_200046
atgggttccatcagagggatcaagaagaggaagaaagctgacaacaaagatggcccagatgcctctgcaacctcattcgattggtggcatcacttctccctcagaatctcaggacctttagctcgatctaaaaatatagagaaatttgagtctgttttcaagatctcaaggaagacgttcaactatatatgttctcttgtggaagaagacatgctggccagagcctcaaattttgttgatctaaatggcaatcgtttgtctttgaatgatcaagtagctgtagctctcagaaggcttagctctggtgagtcattgtcaaccattggtgaatcatttcggatgaatcagtcaactgtttcccaggtaacatggaaatttgtggaaacaatggaagaaagagggctccaccatcttagttgggcttcaactgaaatggaaatggaggagataaagtccaagtttgagaacatacggggcctttctaattgttgtggtgccgttgacagcacacacataatgatgactttgccctctgtggatgctttgaatagtgtgtggcttgaccgtgagaagaattgtagcatggtcttgcaagccattgtggatccggatttgagattccgcgacatagttactggatggccaggaagtatgagtgatgagcaagtgcttcgaagctcttcttttttcaaactggctgaagaagggaagaggttgaatgggggtaagaaaacacttccagatggaacactgtttagggaatatattataggggatacaggctttccccttttttcatggcttcttacaccttatgaaggtaaaggattctcaaatgttcaagttgagtttaataaaagggttgttgaaacccaaatggtggccaagaaagcattggctaggctgaaggatatgtggaagataatccaaggtgtgatgtggaagcctgataagcacaagttaccaagaattattcttgtttgctgtatactacataatatagttatcgatatggaggatgaagtactgattgatatgccctcttgccaccagcatgattcgagatatcaagaccaaactagtgaatttgctgacaatactgccaccattatgagagagaagctatctctctacttatctggcaaactgccaacttga

SEQ ID NO: 83269 - DNA, 759 bp, Glycine max
  Peptide Sequence Number=SeqID_200047
atggggaaggactacatttcaacacccactcctggaatccaagttgccatatttgttgacaagctgcttgaatcagctgaggatacctacaatttcttggtgaattggctacaaagatttccacagttcaaatctcgtgacttttttatatcaggagaaagctatgctggtcactatatccgtaagtttgcagagttaatctttgatcgaaacaaagatagaaacaaatacccatctattagtcttaaaggttttattgtagggaacccagaaactgattattactatgactataaaggccttctggaatatgcatggagccatgcggttatatcagaccagcaatacgacaaagcaaaacaagtatgtgattttaaacaatttgaatggtctaatgaatgcaatcaagccatgcacgaagtattccaagattactccgaaattgacatattcaacatttatgctcaggcatgtcgtctaaacagcacgtcctcaatagctgatcatagcaacagtaacagccccgaatcatttaccaaggtgagaaatgattatagactaaggagaatgagaaattttgggggctatgacccttgttattccaattatgcagaagaatatttcaatagaaaagatgttcagtcatcttttcatgcagatgccagaagagccactaacgttaacataacatggaagtggagacgcaaagtgccggtgataggaacacaatattgcgttgaggctctggattacctctaa

SEQ ID NO: 83270 - DNA, 261 bp, Glycine max
  Peptide Sequence Number=SeqID_200048
atgtgggacttagctaatgaagcacagaagagattacatgcacacacgtttaacaacccatctggattcaagctaaaccaaaccccttataactgttcaattatggtgagattagtgactgggagcggtgcacactcttgggctaaggtagctaaatctagtagtagtggattactatgctcgctgcacggtctaaagaatgcaactaacagaaataatatatcagtagtctgtagaaccaaggaacctgattgctactga

SEQ ID NO: 83271 - DNA, 900 bp, Glycine max
  Peptide Sequence Number=SeqID_200049
atgggggaagcaagtgagggattggagggcagaatagagtgtgggcaggagtatggcattaaatctgccatggcagcagcacccgctagagctcgtgccgattacgattacctcatcaagcttcttcttatcggcgacagcggtgtggggaagagttgtctacttttgaggttttctgatggctcattcacaaccagttttatcaccaccattggtatcgattttaagataagaaccattgaactagacagcaaacggattaagttacaaatctgggatactgctggtcaggagcggttccgaactattaccacagcttattaccgtggagccatgggtatcttgctggtttatgatgttactgatgaagcatctttcaatagtaatctcccttccctgcttggttttttctatccagatattaggaattggatccgcaatattgaacaacatgcttctgacaatgtaaacaagatacttgttggcaacaaggctgatatggatgaaagtaaaagggctgtacctacctccaaagggcaagcacttgctgatgagtatggtatcaagttctttgaaactagtgcaaaaaccaacatgaacgtggaagaggtcttcttttcaatagcaagagatattaagcaaaggcttgcagacacagattcaagagctgagcctcagactatcaagattaaccaacctgaccaggcaaccagtggtggtcaacctgcgcaaaagtcggcttgctgtgatgcggatagattatcacaacagcttgatcatttgcagaatatcggtccgaatgttttttattttgttggctggcttaggaatctagacgcaaacccaataagtttgcacgtggaaggaaaatggaagccttgccatttcaccgcaatgtga

SEQ ID NO: 83272 - DNA, 3066 bp, Glycine max
  Peptide Sequence Number=SeqID_200050
atggcatggtttagagttgcttccagcatagtaaagcatgatgcaattaggagaaatctctatcgaggtgcgaaaaggaccagcacagtccttccatcaacaagtagaattagaaaatttcacaccacggttgtcaaatccaaagagcaaaccgcaccggtgcctcgccccgtgcccctttccaagttgactgacaacttcttggatgggacgagcagtgtctatttagaggagcttcaaagggcttgggaagctgatccagacagtgtagatgagtcctgggacaatttcttcaggaactttgtgggtcaggcttccacatcccctggaatttctggacaaacaatccaggagagtatgcaattgctgttgctggtgagagcataccaggttaatggtcacatgaaagccaagctagatcctctgggtctggaggaacgaaaagtccctgatgagttagaccctgccttttatggcttcactgaggctgatcttgacagggaattctttttgggtgtgtggaagatgtctggctttttgtccgaaaatcgccctgtgcagactcttaggttcattttgtcacggcttcagcaagcctactgtgggagcattggatacgagtacatgcacataccggaccgtgaaaaatgtaactggcttagggacaggattgagactcctacacctacacagtataatcgggagcgtcgcgaagttatctttgataggcttgcctggagtacactttttgaaaatttcttggccaccaagtggacttcggcaaagaggtttgggcttgaagggggagagagtgttattcctggcatgaaagaaatgtttgatcgggcatctgatcttggggtcgagagcattgttatgggaatggcacataggggaagattgaatgttttgggtaatgtagtacggaagccacttcgtcagattttttgtgagtttagtggtggtcagcctgcagacgaagttgggctctacacaggaactggtgatgtcaaatatcatttgggaacatcttatgatcgcccaaccaggggtgggaggaggatacatttatctttggtggcaaatcctagtcacttggaagcagtcaacccacttgtggttggaaaaactcgagcaaagcaatattactccaatgatgtggacagaatgaaaaacatgggggttttgattcatggagatggtagttttgctggacaaggtgtggtctatgaaacccttcatcttagcgctcttccaaattacactactggtgggactatacacattgtgttcaacaatcaagttgcatttacaactgatcccaagtcaggaagatcttcacaatattgcactgatgttgccaaagcattaaatgctccaatctttcatgtgaatggtgatgatgtggaagctgttgttcatgtctgtgaacttgcagctgaatggcgccaaactttccattctgatgtggttgttgacttcgtgtgttaccgtcgatttggccacaatgagattgatgaaccatctttcacacagcctaaaatgtataaggtcatccgaaaccatccatcagctcttgagatctatcagaaaaaacttttggaatcaggggagctgacacaagaagacattgataagatacataagaaggtcacatcaattttaaatgatgaatttttggctagcaaagattatgttccaaaacgaagagattggctttcagcatattggtctggtttcaagtcacctgaacagatttcacgtatccggaacactggtgtgaaaccagagatcttgaaaagtgttgggaaagcaatcacaatcttacctaaatttttttctcctcataaagcagtgaagaggatttatgaacaacgtgcccagatggttgaaacaggggaagatattgactggggatttgcagaggcacttgcctttgccacattgatagttgagggtaaccatgttcggttaagtggtcaggatgttgaaagaggaacgtttagtcaccgtcatgctgtagttcatgatcagacaacgggagagatatattgcccccttgaccatgtgataatgaatcaaaatgaagagatgtttactgttagcaatagctcactctctgagtttggagttcttggatttgaattgggttactcaatggaaaatccaaattcattggtgatctgggaggctcaatttggtgattttgctaatggggctcaagttatatttgacaatttcttgagttctggtgagtctaagtggctccgtcagactgggcttgtagtgttacttcctcatggttatgatggccagggccctgagcattcaagtggaagattggaacgctttcttcagatggctgatgaccatccttatgttattcctgagatggatcctactcttcggaaacaaattcaggaatgtaactggcagattgtgaatgttacaactccagcaaattttttccatgttttacggcggcagatacatagagaattccgtaaacctctcattgtgatgtcacctaagaacctgcttcgtagtaaggcttgtagatcaaatttatcggagttcgatgatgttcaaggacacccaggttttgacaaacagggcactagatttaagcgcctcataaaagaccaaaataaccactcagatgttgaggagggtatcagacgtttagtactctgctctggaaaggtttactacgaactcgatgaacaacgaacaaaggaagatgcaaaggatgttgcaatatgtagggtggaacagctttgtcctttcccttatgatcttgtccaacgagagctcaaaagatatccaaatgcggaggttgtttggtgtcaagaagaaccaatgaacatgggtggatacacttatattttaccccgactcataagttccatgaaggctgtaggtaggggaggttatgaagatgtcaaatatgttggtcgtgctccctctgcagccacagctactggtttcctcaaggttcaccttaacgagcaggctgagctagttcagaaagccattcaacgtgagccaatcaatttcccttactga

SEQ ID NO: 83273 - DNA, 162 bp, Glycine max
  Peptide Sequence Number=SeqID_200051
atggcaacgaccattctagaacctgctttggcaggagcgaggatttcagctcctagaaatcgaacacctttaagtttggccatttcagaatctagccatcaagtggaggaagaggaagaggaaggggacgaagacgaacatgacgaagaagatgatgaatag

SEQ ID NO: 83274 - DNA, 295 bp, Glycine max
  Peptide Sequence Number=SeqID_200052
atgatgcatgcacctgactcaacactcaaatgcaatgtggtacgtaccaacaacaaccaaatctcaggaaatagcctaagcgtgtccacacgacactctcacttagggaattgtgcagagtttgtcgagaccacccgggtgtgcacgttgtcacaaaatgcccttttgcgggagcgtgaggcgaggctcacgggtgcgctttccaaaggaggaaagatgcgcgaagtcgccaccaacgtttatttgtggaaaacgtcggaaaaaccgaaggaaaccggtcaaaaagaatatccaa

SEQ ID NO: 83275 - DNA, 429 bp, Glycine max
  Peptide Sequence Number=SeqID_200053
atgggtcgttacacaagtccttctaacaactcttatgcagttggtttgaaggataatggtgagaaaaagaataaagaaggagttgaaaaagaaaaagagaaaaatgatgaagtgatggctaatgaaaaagtggaagagaaagtggtgagtgaagaagagaagcataaatcaaagaaacaagccactaacaaaggtaaagttgtagtaaaccatccaccgatggagcaccttccttatctacatgctctgtcaaagaaagataaggaaagacagtacaagcttttcttagacatttttaaacgactgcaaattaacattcctttttctgaggcgttggagcagatgccaacgtatactaaattcatgaaggatttgcttacaaagaagagaagaattatagatgatgaaataatggtgcttgagccataa

SEQ ID NO: 83276 - DNA, 420 bp, Glycine max
  Peptide Sequence Number=SeqID_200054
atgaactcgctaagcgagcatgctgcgctaagcgagttcatcaatactcattatagcctcagcaccttcctggagacacctgtggtactggctgagggagaatccttacccgcttactccagatactgcaggatgcccactaatatcagagagattgaggcagctttgtgtatacccgaccgagggtttgttttaaatgctgaaggccatcctcggaagatcctcaggaaagatctaacaactctttctcaagtttggagtgttctctcatactccaacctggcttcgacttcccacacctcagatttgactgtagatagagctaggttaatctttgacttagtctctcagctggacatgaatgtaatagctctcatctctggccatatcacatctatggcccagtctaactccctctag

SEQ ID NO: 83277 - DNA, 666 bp, Glycine max
  Peptide Sequence Number=SeqID_200055
atgtgtttgcggtccaacttcacattgacaaatgcacaagaaatcaagagtctttcccagtgtttgatagatgtcgatgataggaaactagacaaaggtgatgatgagtgttatgagatagaaattccacctaatcttttaataagaaacttcattgatcctattgaagcaattgtcaaccatatctacccaaatatccaaaagaagtataaagatgaggaatttctcaaatctagagctatacttgctataacaaatgaggtggtggaccaaattaatgactatatactaaacatcatcccagaatttagatcaggcctatgcaacggaacaaggctaattatctatagaatgaccaaccatgttattgagatgactagaagacagttctcacttattgtgtcatatgccatgacaatcaataaatctcaaggtcaatctcttcaatgtgttggattatatcttcctcagccaggtctcaatcagggccaaatttatgtggcattctcaagagttcagagcaaaagtgaattgaaaattcttatccatgataaagaaggaaaaccactaaatacaacaaccaatgtggttttcaaggaagtactacaaaatctgttgttaagtgcagggttattaactaaattaaaagttgtaacagcttcatga

SEQ ID NO: 83278 - DNA, 615 bp, Glycine max
  Peptide Sequence Number=SeqID_200056
aattacaatccaaagatctcagattttggtttggcaaaattggggccttctgagggacaatcacataattacaatccaaagacctcagattttggcttggcaaaattgggaacttctgagggacagtcacataattacaatccaaagatctcagattttggcttggaaaaattggggccttccgagggacaatcatatgtaactactatggtctctggcacgtttggttatgtatctccagaatactgtttaacaggcgccttgtatgtgaagagtgatgtctccggatttggtgtagtgctacttgaaatactgacaggcatgcgaacatttgacgcaaaacggccaacagggcagcgtaacctagttgaatggaccgagcctcttctctcttccaaaaaaaagttgaaaacaataatggatacagagataaagggtcaatattcacttgaggcagcctggcaagcagcacaacttactctaaaatgcctaaaatttgtccctcaagaacgtccttctatgaaagatgtagttgagacattggaagccattgaagctatccaaaacccacaatttgcaatgtacatctcaaccaccccctcggcagggtcgtaa

SEQ ID NO: 83279 - DNA, 156 bp, Glycine max
  Peptide Sequence Number=SeqID_200057
atggcattaggggtcatggcagctcgcccaggaaggcataggttgcatcttgtacctcactcccataggaaagaaaaggaaagaaatcctcaagaggctaacattaacctcccatacttccatggaaaggacaatgtagaggcttacgtagattga

SEQ ID NO: 83280 - DNA, 759 bp, Glycine max
  Peptide Sequence Number=SeqID_200058
atgggtgtctgcttctcctctggcccgacacagaactcttcttccctcgaccgaccttactattcaggcaagtcttctttctactttttctcaccctttctaaacacaagacatatgggttcagcaagcactaactgcaaaaacgtgggaatcaccgaaaccacgagcagcagcaccgtaaatagacagttttccgtgattgtgagtggaagcatctatcgtcgtcccctttctcttcctcttcctccacctgatggcctgattccgaaatggccaaacttgaaggttttcgattttgaggagttgaaatctgccacaaacaatttcaggcatgacacattgctgggtcaaggtggcttttgccgagtttacaagggatggttggatgaggataccctcgcccctaccaaagcaggctacggaatggtcgttgccataaaaaggttgaaccccgaaagcacgcaagggtttgtccagtggcagacagaactaaacatgagaaggctttctcaccccaacctggtcaatttattgggttactgttgggacgatgatgagcatcttcttgtgtatgagttcatgccaaagggaagcttagacaattatctattcaaaagaaatcgtaacttagaattactttcttggaacacacggcttaaaatagctattggtgcagctcggggattagctttcttgcatgcttctgaaaacaacgtcattcacagagatttcaagcccttaaatatactacttgatgag

SEQ ID NO: 83281 - DNA, 1287 bp, Glycine max
  Peptide Sequence Number=SeqID_200059
atggcaaacagcaaatatgagtatgtcaagtgttttgaagttgaggatgaggtcatgtttcctaatatcattcttgtttggatcaaggccagtaaacttcataaacctcacgatttaaatgccttgaaattgatgaactcttgcgctgttaaagttcttgaagagtatgcagacgtagtccttgcatatgggttcagtgatgagtatacttttgttttcaagaagacctccaagttctatgaaaggcgtgcaagcaaagtgctatccatctttacttcttttttctcatccatctttgtgagaaaatgggatgaattctttccatacaaggaactacaatgttctccttccttccacgggcgagtcatagctcgtgcatctgtagaagctcttcaagtgtatcttttgtggcgacagaatatttgtcatttgactaatctgcatgagcaatgcctttggcgtcttgttgaacgtggaatgaatgggaaggaagcatgggatttcatcaaggattttgacaaaaaaattaacaatgtgactcccgagtatgtgaggtcctttgaatttgatagcaaattgatgccatctacatggattgtagttcgaatagatggatgccacttccacaggttttctgagatacgtgaatttgtgaagccaaatgatgatagagctcttaacttgatgaatttgtatgcagtcgctgtcttagaaaagttttgggaggatatagtctttgcttttggggttagtgatgagtatagctttattcttaagaaagccactaatctttatcaaaggagagctaatacaataatttcagctattgtgtctttcttcacatccacttatgtgaggagatggaaaaacttcttccaacaaagtgagttaaagtaccctccttcctttgatggacgagcggtgtgctatccatctactgagattctacgggactacctttcatggagacaagtggattgccacatcaacaatcaatataactcttgtttctggaagttagttgcatctggaaaaagcaaaagggaagcccaaaatagtttaaagggtgctcagttgcaaaagaaaattaaggaattggctattgactacaataatttaccagtcatgtaccgacaaggatcctcggtttatagggacaaggtagatattgctctaattcatcaggagaatggagagtttcctgaaaattatggaaaggttattgtaggacatattgacattattggaccaaccttttggttggaacacccaaacatccttgattaa

SEQ ID NO: 83282 - DNA, 1242 bp, Glycine max
  Peptide Sequence Number=SeqID_200060
atgggtctccgcttctcctctggctcggcacctcactcctcttccctcaacggctctcactgttcaggcaagtcttcaacttttcctcaccctttcaatattctgggcgaaacacgacatgggtcgtttcccttttcatcgaatgcgaattttcccatgatgggttcgattcctctgttttcaggttcagcaagaactggctgcaagaacgtggggttctccgcaaccgggaagagtcagttttcggagattgcgagtggaagcgacgatcgcgaagagtctcttggtcggattctgaaatggccaaacttgaaggtgtttagttttgaggagctgatttctgcctcaaggcgtttcaggtatgacatacaggggttagtgatcggtaaaggttgttttggcccagtttacaagggatgtttggatgagaatacccttacccctgccaaagtaggctatggaatggccgttgcgatcaaaatgtttaaccaagattacttccgagggtttgaagagtggcaggataagcttcttctagtgtatgagttcatgccaaagggaagcttagactatcatctattcagaggaaacataacaccactttcttggaacacacggcttaaaatagctattggtgcagctcggggattagctttcttgcacgcctctgaaaacaatgtcatattcagtgatttcaaggcctcaaatatacttcttgacgggaattacaatgcaaagatctcagattttggctttgctagatgggggccttttgaaggagaatcacatgtatctaccagggtcattggcacatatgattatgctgctccagaatacatagcaacaggacttagtgtaacacaaacagtcgatgctgtggaaggccacttgtatgtgaagagtgatatctatggatttggtgtagtgctgcttgaaatacttacaggcatgcgggcacttgacacaaatcgacctcaaaccatgcagaacctagttgaatggactaagccttgtctttcttccaaaaaaaagttgaaagccataatggatgctaagatagagggtcaatattcacttgaggcagcatggcaagcagcaaaacttactctaaaatgcctaaaatctgtccctgaagaacgtccttctatgaaagatgtagttgaggcattggaagccattgaagctatccaaaacccacaattcgcagcgtacatctcatccaccccctcggcagggtcgtaa

SEQ ID NO: 83283 - DNA, 208 bp, Glycine max
  Peptide Sequence Number=SeqID_200061
acataatatcaaaattcccaacggtaagaattctcgtaattgggttgctaacgtggtgctcaaatttcatgatgatccaacggtgaacgagttcaagatcgtcttttttctgagacaggttaggtggcctgcgggaaaaagagagggttttgggagaagagagaagaaacaacattgtgaggcagaggaggctgaggagtccgtctga

SEQ ID NO: 83284 - DNA, 264 bp, Glycine max
  Peptide Sequence Number=SeqID_200062
atggtgaacgtggtggaattgcagaaacagttgcagaggtggcagcagagtgggaatgtgaatgtgaatgtgaatgttgatgccaacggagaactcatgtatgtcaaggtcatgactgatgaacagttggaaactctgaggaagcaaatagccgtttatggcaccatttgtgagcaacttattgagatgcacagaacactctcagctcaacaggatcttgcagaaaatgacagggcaaaaatatcgacaataccttttccctga

SEQ ID NO: 83285 - DNA, 102 bp, Glycine max
  Peptide Sequence Number=SeqID_200063
tccttggaggtttccacgttggtctcagtttctgtcatggtcctcatggatttgaacttgctgttgggaataaatttgtatgtccacgatctaagtcatcat

SEQ ID NO: 83286 - DNA, 294 bp, Glycine max
  Peptide Sequence Number=SeqID_200064
atgttggaggatgtccagctagcagatcatgaaattaacatcatggagaaagaggcagctgaaattctcaagctacttcagtgttatgttttgcttaatttgttaatgtacatggtggtctttgtggaagtgcttttggttaagagggcaagtagttggaggaagcgattaaacaaagtgaagaagaaattcaaggaacatgaggagtcccaaatttcagagatgaggagggatcaatcagaaactgcagctgctatctcagatggatataggggaacttctggagatatatag

SEQ ID NO: 83287 - DNA, 150 bp, Glycine max
  Peptide Sequence Number=SeqID_200065
atggcatgcacatttgcatgttcatattttttgcagattctagcacaacttataaaggatgtgctacctgtgctgagagcacgtataagcactttactagttgctgtcacgaagaagtatgcaagctatggagagatcactgggagggag

SEQ ID NO: 83288 - DNA, 453 bp, Glycine max
  Peptide Sequence Number=SeqID_200066
atggacaaaatcaattcccgcaggcaagttgctgccatgaaacagtccctctttgatcagggatatctggatgagcagtttatccaactggaagaattgcaggatgatgctaatcctaacttcgttgaagaaattgtcactctttactaccgtgattcctccaggctcatctctaacttggaccacacactggaaaggaacccagtggatttcaacaagctggacacaattatgcaccagtttaaaggaagcagctcaagcatcggagccaaaaaggtgaaagcagaatgcactctgtttatggaatattgcagggcaagaaatggagaaggatgcaggaggagcttccaacaaatgaagaaagaatatgcaacactgagaaagaagcttgaaacatattttcatctggctaggcaagctgggcccgtggagacagcatttaggcccaagtaa

SEQ ID NO: 83289 - DNA, 2019 bp, Glycine max
  Peptide Sequence Number=SeqID_200067
atgaactgcaccgacacaagtcgtgtttgcacttctttcttggcctttaagcctcatcaaaaccaaaccttggctgtgatacaaagcatgtttgatgtgttgcccggtgagatcaccgttgaaggcaatggctgggattatatattcatcaggaaaaactgttcttgtgctgctggtatgaagaagtatgtgtctaacaccacactcactgtgaaatccaatggaggatttgagcatgatttggtgatggaagcctatgacaggcttgctctcttgcccaacaccacgacgcgttgggcaagagaaggcggtatcatatctctgagcttgttctgtagttgctctagtggactgtggaactatctgatgagctatgtcatcagagatggggacagtgttgaatcactagcaagcaggtttggggttagtatggatagcattgagacagtgaatggcattgacaatcctactgttggttctctcgtttatatacctttgaattcggttcctggtgagtcttaccacttgatgaatgatactcctccagctccaaccccttcgccgtctgttaataatttttcagctgaccaagtcaaccagaaggctcatgtaccccatgaatggatcataggaggtttaggggttggtcttgctctgataatattaaccattattgtgtgtgtggccctaagatcacccaattgtttggttgaagccggaaataatgcaaaagattcttcaggaaagatctctaataagttctatgtttttggaaatccaagtttgttttgtggatgtgtcaaacctgtggaccagaagcaaactgatggtgaatccagcagtcaccaaattaccggtaccaaaacatcaactctaatacctgacatgttggacatggataagcctgtagttttttcatatgaagaaattttttcttcaactgatggtttctctgattcaaatctacttgggcacagaacatatggctctgtttactatggtctcctcggtgaccaggaagttgctattaaaagaatgacatctactaaaactaaagaatttatgtcagaggtaaaagttctgtgcaaggttcatcatgctaatctggtagaattgatcggctatgcggttagccatgatgagtttttccttatttatgaatttgctcagaaaggttcactcagcagccatttgcatgatcctcaaagtaagggtcattcacctctttcttggatcacaagggtccagattgcacttgatgctgctaggggccttgaatacatacacgagcatacaaaaactcgttacgtccatcaagatatcaagacaagcaacattttacttgatgcttcctttagagccaagatatcagattttgggttagcaaaacttgtaggtaaaacaaatgagggagaaaccgcagcaaccaaagttgtaaatgcatatggatatcttgctccagaatacttgagcaatggccttgcaacgaccaaaagtgatgtctatgcatttggtgttgttctttttgagattatatcagggaaggaagccattattcaaacacaaggccctgaaaaacgatcattggcatctattatgttggcagttcttaggaactcacctgataccgtgagcatgtcaagcacgagaaacctcgttgatcctattatgatggatatgtatccccatgattgtgtatataagatggccatgctggcaaagcaatgtgtggatcaggatcctgtattacgccctgatatgaaacaagttgtgatttccctctcacaaaccctgttgtcttctgttgagtgggaagccactcttgctgggaacagccagttgaaactggtgaaacattggtacaaggctaaggcttacttgacaaggtggatcaaaagatcttctggaataaaggacggcccaattatcaatcaagagaacgtcccctttttgccaaggaatggcaacagattcttcctccagaatgtggagacaatcatagacaatgtgagagggtaa

SEQ ID NO: 83290 - DNA, 156 bp, Glycine max
  Peptide Sequence Number=SeqID_200068
atgaatctactccaaaccaatattgcaccccaaaaagccatgagtttaacatcacaagtcaaatccaagatcattttccaattgaagtatgccacacatttgaaggactctcggtcatcattcgctgcagtaaagggaaatcgttacaaaggatga

SEQ ID NO: 83291 - DNA, 282 bp, Glycine max
  Peptide Sequence Number=SeqID_200069
atgacggatgaaatgggagatgaggcatgtgctaaatttgacaagcaaccaaaggaaacgtattcattatactgcattgttaacggaagaagaaaagtatttgctgcttcagagtcatggtggactttcaacttaggaagtagcaattggcaaagagtgatgattagagtgaaggattggatgttaagatgggagtatcatagtgacgggtgtagagaatggaaactctgggagtgggaggggcatcaaatcgagtctaggacagggctgcacatggactga

SEQ ID NO: 83292 - DNA, 300 bp, Glycine max
  Peptide Sequence Number=SeqID_200070
atgatgacaatgttggcagtgattgtcccaacgcagaaggtggtccggcaaatgaagctggttggaaatgccgcttcggaatgtgttgagccacaagggaacgcacataactcagtgatttcaggattgcctcagaggcctaacccgaagggttctggaaggttcgagggcggaggtgaggggagaggagaggcaatcagcgacggcgcgacgaagaggctccggaagcttcttgaggaaggaagatctcaacctggatatggcgggaagttgcctcagagagagactgaacgtggttga

SEQ ID NO: 83293 - DNA, 813 bp, Glycine max
  Peptide Sequence Number=SeqID_200071
atgatagatcatttttgttcaaccattattgctgaatgtgatattaatctgaatcgaccatggtcaagatctttgaatcaccaaactggtgctttagcaatatccacaaatacatctcctttgcctgtatctagttttacctctgaggcaatcctgaaatcactgagttatgtgcgttcccttgtggctcaacacattccgaagcggcatttccaaccagcttcatttgccggaccaccttctgcgttgggacaatcactgccaacattgtcatcattgttgagtaaatccttcaattcccaactatgtccagcaagtgtcacagaatcagtggagaaggattcagtcacttcatctatttctaagttatcaaaaattgaaaaaattgatgaaaaagacaaacttgggttcattgctcatgatattctacaatggcgttggcttgagaaacagcagtcatcatcaatgaaagctgacagtgatcatgctgtaaattcacaaggcatgagagcatataatttcttagaagttggtgctgcagctctacttgaaggagacattggagctaagatgaaggggcaaccatggaaatattttgggactgatgacatgccttatctggatcaattattgcaggcttctccagtaacatcatttactaattctgcatctgcttgtccccacctgagagcaataacagcatctaaacgcacaaaagcaggccctcgtcaagtttggcatgttcttctatcagataactttctgctcagatattttttattctcattttttgttgtttcatctctgttttaa

SEQ ID NO: 83294 - DNA, 360 bp, Glycine max
  Peptide Sequence Number=SeqID_200072
atggcaatgctacaactcacatttctgatttctccaatcgagaagtcaagtgtaatacttagtactatccttaagtatgcccttgtaaactcaagaggggagaggaaaaatctgcattcagtgctttttgactatgttctgcatcaaattaatgaaaattgcatagctactggaatcaatgaatatagtgatgatgagatccaaccccttgcaagtctacttgctcaaacaaatgcagccgaggcatttcatatttctgttaaacttggggtagaaggaattggggagcttttgaggagatcaattgcatctgcactatcgagatatcccaacagtgaacgtctaaatatggcagaataa

SEQ ID NO: 83295 - DNA, 1263 bp, Glycine max
  Peptide Sequence Number=SeqID_200073
atggcagtgagaataaacagctccattcaaaacaccctctgtctcctcaaccctcctctgttttccctccgttacagagcttcttccctgaagttgaaaccccaattgcattttcgtcaaaacccctctcgaggagctttattctgcacatgcgccaccaccgatatcactccccaaagtaccgaacactttgtcctcactacccctctctactacgtcaatgctcctccccacatgggtagcgcttacaccaccatcgctgccgatgccattgctcgcttccagcggctattggggaagagtgttatatttattactggcacggatgaacatggggagaaaattgcaactgctgccatggctcagggttccacccctcctgaccattgcaatctcatatctcgatcttacaagacgctttggaaagatttagatatttcttacgacaagttcattagaacaactgatagcaagcatgaagcaattgtgaaggaattttattcaagagtgcttgccaatggtgacatctaccgagctgattatgatggactttattgtgtaaactgtgaggaatataaggatgagaaggaacttcttgataataattgttgtccagttcacctaaagccttgtgtttcaaggaaagaggacaattacttttttgcactgtcaaaatatcagaaggcattggaggatactctttatagaaatccgaattttgtgcagccatctttccgtttaaatgaggttcaaagttggatcaaaagtggcttgagggacttttccatttcccgagcatcagttgagtggggcattcctgttcctgatgacaagacccagactatatatgtatggtttgatgctttactaggctatatatcagcactatctgatgatcaggaacaacctgatttacttaaaactgtttcttcaggttggccagcttcactgcacttgattggtaaggctgcacaaattgttccaacttacacggggttgtcttacgatgagatgcttcttttctgcatggatattctacgcttccatgctgtttactggccagctatgctaatgtctgctggactaagccttcctaaaatggtatttggccatggattcttgacaaaggacaaggctattcatttcctggggagtgttgatagaccttgggaagtttatgtgagaagggatatgaaccagctcaagactcagacactcagtaggcctgaactattagtgtttgtgcagtatttgtgtctttag

SEQ ID NO: 83296 - DNA, 615 bp, Glycine max
  Peptide Sequence Number=SeqID_200074
atgagatttccggcgcttttcttcagaaaacgtgatatctcccctcttctatcattggtaatcagacacgaaaacaccctttgccatttcttctgcactacctctgagttaagttcttctcaaaccccttcttcgcagttaccaccaccacatttcaaatcaacatttgacaacaatgccttaacaaaccaatttggcttcattcgcctccaagagatttcaataaaccacacagacgaccaaacccatgacgagtttgcttctgatgtggaaaaggtttatagaatattaagaaagtaccattctagggttcccaaattggaacttgctctcagagaatctggagttgttgtgaggcctggattaacagagcgtgtgttgaatcggtgtggtgatgccgggaatttggcctataggttctattcatgggcctcaaagcaatccggtcatcgactcgatcacgatgcgtacaaggcaatgattaaggttttgagtaggatgcggcagttcggtgctgtttgggcactgattgaggaaatgaggcaggagaatcctcacttgattacgccccaagtgtttgttattttgatgaggaggtttgcctccgcgaggatg

SEQ ID NO: 83297 - DNA, 120 bp, Glycine max
  Peptide Sequence Number=SeqID_200075
atgacgcctggataccaattagggtcaatgagaataggacagaactcagagggtcgaaataatcgacatactattagaaaaaataatgaaggtgcccaatcccagagtttcacgtgttaa

SEQ ID NO: 83298 - DNA, 290 bp, Glycine max
  Peptide Sequence Number=SeqID_200076
atgaattgctttgtggtgtgtcagtctcgtttgtgggtagtgaccattgtgttctacacatgcattttgatcccattgatgaaactaaagagggcacttgcaagcatgtttttgttctcttgtgagaccaaaggcatggccaaggagatggagttcccagaaattccttccctgcccgtggcaaggtacgaggatttgaagggtcataactgtgatggagagaaacaagagatttgttccatttgcttggtggagtatgagggggaagatgcagtgagcaagctgggaag

SEQ ID NO: 83299 - DNA, 327 bp, Glycine max
  Peptide Sequence Number=SeqID_200077
gttgataaagctcacattcactatgaaaatctctctctgtcatcagcttgtgaggctgttctggagattggtaatgttgggaatttgtatatggatcagcgtgcaccatggtctctctttaagcaagggggcactgctgctgaagcagctgctaagagagacaccaagtggggtgggcttaagggtggccaagtcatggctcaacctaaaccagtctttgctaggattgaaaaccaaactgaagtggaagacaaaggggttgcagtcagaaagactaagaaaagcaaagcgaagccgaaacaacctcaagaagttgccggagcctag

SEQ ID NO: 83300 - DNA, 537 bp, Glycine max
  Peptide Sequence Number=SeqID_200078
atggcttataggaaaagaaaggcaccatctacacccacccaagttagatttgacagatcaagattcacttcccaagaggcttgggaaagatacagacattattgtgcctaggaagcttctgccagagaggaacatggcggtctactatatagagttcgatgagttcaaggaggaactcgaaagaagccactgggacgaggagttgactgactttggggatggcaacattgatgttgccattgtgaaggaattctatgccaacctctatgaccccgaggacaaatcacctaaatttgcactcctgaggcctgatcctcaggagttggctgctaagctctgtatcccagggaagggattcgagcttaatgctgatgggcagcccctgaagattttgaggaagaacttgaccaccttagctcagacatggagtgttctttccttatctaacttgattcccacctcccacacttctgatgtcactcttgacagggctagactcatttatggcattattatgaagatggatatgaatgtggg

SEQ ID NO: 83301 - DNA, 219 bp, Glycine max
  Peptide Sequence Number=SeqID_200079
atggaatacgattcgctttcaagatgccttggtggtgaaatggtagacacgcgagactcaaaatctcgtgctaaagagcgtggaggggatctttcaattgagaagatccatcgacctgagacgaagagaaagaaagatagcaacaaccatctcatctgggaaaaagccatctttttctcaacaatgtctttgtcatttgatccaatagcgcttcgttag

SEQ ID NO: 83302 - DNA, 1262 bp, Glycine max
  Peptide Sequence Number=SeqID_200080
atggagggaatgtgggagaacattcttcgaaaccatcagcactcgctgaaatccctattccaccggagcaagccttcttctcccaacgccgccgccgccgatgagtccgcctattcccccaaacccatccccctgctctctcatctcgccaactccgtcgtctctcgctgttccaagtcattttcctcactttcttcttccatttccatttcgcactttcatatccattttccatttaccatttaccatttcaggatccttggaatgtcgccacaggaattgcaacactgcttcgattcggaactccccatgggcgtcaaagagcttctcacctacgccagacacctcttggagttctgttcctacaaagctcttcacaaactcattcataactccgatttcttaaacgacaacgatttccgtcgtttaaccttcgacatgatgctcgcttgggaggctcccagcgtccacaccctctcagataacccttcttcaagttcaagtaaagaggaaaccgctggtgatgaggatgacgcctccttgttctattcgagttccaccaatatggcgcttcaggtcgatgacaagaagacggtgggtctagaggctttctcgcggattgctcctgtctgtgttcccattgctgatgttgtaactgtccacaatctcttccatgcactcactagtacttccgcgcaccgccttcattttcttgtttatgacaaatacctaagattccttgacaaggttatcaagaattctaagaatgtgatggctgtatctgctggaaatcttcagcttgccgaaggagagatcgtcctccatgttgacgggacaattccaactcaaccagttcttcaacatattggaatcactgcatggcctgggcggttgaccctcaccaattatgctctgtactttgagtcactgggagttggtgtatatgagaaagctgttcgatatgatctgggcacagacatgaaacaggtcataaggcctgatctgactgggccccttggtgctcgcctttttgataaagctgtgatgtataaatcaacttctgtagtagagcctgtttattttgaattccctgaatttaaagcaaacttgcgtcgtgactattggttggacattagtctggagatcttgcgtgcacacaagtttatcaggaaatactaccttaaggaggtacaaaaatcagaagtgcttgccagggctcttctgggcattttccgctatcgtgcagttagagaagctttccg

SEQ ID NO: 83303 - DNA, 801 bp, Glycine max
  Peptide Sequence Number=SeqID_200081
atggcacttttctatcttggattcaaatcaaaaaaggtgactgatatttgtgaggaagcaacttttgtcagtgatatcagagttggtgagatacatcccttggaagtggcagtgaaaaagtcccttctggacactggaaaagcggaagctgcacaggcaacagtggaccaagtgaaggttgaaggaattgatacaaatgttgcagtaatgaaggagctactattcccagtcattgtatctgccaaccgactacagcttttggcctcatggaaagacttttacaaatcagcagcctttttgctactctcctgttatatgattataagggggtggatccagtactttattccatccatttttatgtttatggcaattctcatgctctggcgaaggcatctcagaaagggaagaccattagaagcctttatagtaactcctcccccaaatcgaaatgctgtagaacaactgctgacgttacaagaggccattacacagtttgaatcgcttattcaagctgcaaatattattctcctaaaattgagagctcttctactggcgatattaccacaggctacagagaaggttgctctattacttgtattcctagcagcagtgtttgcctttgttcctccaaaatacatattgttggtggtattcgttgagttttacacaagggagatgccatataggaaagagagtagtgatagatggataaggaggattagagaatggtgggtcagaataccagctgctcctgtccagctcgttaagcctgatcatgagtccaagaaaagaaaatga

SEQ ID NO: 83304 - DNA, 1770 bp, Glycine max
  Peptide Sequence Number=SeqID_200082
atgaagcaaaagtcttctgagttgccaaatgacttggttggtgaaaattttaacaggaatattgagcagatgtgggaacttttaggggatgatcaagtcttcataattggcatacatggaatggcaggagtgggaaaaacagccctagtaacttatattgagaacgatataactagaaagggcagttttaaacatgccgttgttactgtttcccaagtttttagcatttttaaattgcaaaatgacattgcaaatagaataggcatgacacctgatgaagatgatgagagaatgagagctataaagttgtccttagtgttggaaagaaaagaaaaaacagtgcttattttggatgatgtttggaagaatattgatctacagaaggtgggagttcctcttagagtgaatggcattaaattgattctgacaagtcgtttggaacatgcaacacctgcaaaacttcctcatgaagtagaaaagattgcaagatcaattgttaaggaatgtgatggcttacctcttggaatcagtgtgatggctagcaccatgaaagggggactgattaatgatacagcaagtttggagagagtattggatgagggacttaccatagttgataaactcaaaagccattctttgttgttggaaagtgattatctccatatgcatggtttagtgcagaaaatggatgcaagtcactacaatatgtgccccccattaggacagctacaggcattatctagattgaaaatttcaggaacttccattgagaaagtaccagagggtttgggaaagcttatcaacttgaaatggcttgatttgtctgagaattacaacttgacattgttaccagggtctgtgctacctggtttaaccaataagcaataccttgatatctgctataattatggtcatttggcaaaggtaaatgcagaagatgtacaagggatgaccatgctagaacattttgcaggcagttttcatgattgggataacttcaataattatgtgcaggcaaccttggacagaggtagtggacctaaaacttatcatctccatttgggaatcggtcctggatattctttggattattcttatgactataactttctaacaaacgatgagtgccgaattgtgagttttagggactgcacaaaattagaccatgtgcttccaacagacattgcaagattgtgtatagcagagaataaacaatggagatgcttgtgtgatgttctctcatttagatctccttctttgatgtacattgatattcgagtttgtccaaaactagagagcttgttttgtttgactggtccatgttccttgtgcagtaatctccaaaaccttgaatctttgaatcttacaagtttggaaggcccagctgaaacatggaaggaaaatgaagtcaaagcaaaaaatattcttcttggtggcatgttctctcatatcaaacatctcgaggtctcaaaatgccacaagatagagaaattgctgacaattgggccactgctacagctcaaaaacttggtctcacttgatgttaagagttgtgatttgatgaaagagatattcacagtgagtatcactgaagatgtgggtcgtgttaatgaaattactcttcccaagttaacaaggttggagtttagagagttgccacaattgaagaccgtgtggtggggaattatcaaatgtggattatctccaaaactgaacatcagtgactgtccccaactagaaacacctcctattttacaaagtatttcttga

SEQ ID NO: 83305 - DNA, 1110 bp, Glycine max
  Peptide Sequence Number=SeqID_200083
atggttctgatgttgggcctagtggatgcccccttctccgaaatacactcattgtttaagctccttgtccttgcagcttgcagaggcaactcaactaatctattaaatttttctctcaacaaacaaacacaaaagtggattaggggagagcgaagctcagcaagctgtagatcaataagaatcccaagcagagttcaagcactcaaatctgatggtggtaaatggaagaagagagggcaagaagcatctagtgacactgatgacgacgatgacgatgacgatgcacctcagcggtttaataaaaatgacccttaccttatgagtcctgaggagagactggaatggaggaggaacataagacaggtgttggataggaaacctgatgttgaagaggagttagaccctctggaaaagaagaaaaaactggagaagcttttggaggattaccctcttgttgtggacgaggatgatcctgattggccagaagatgctgatggttggggattcagcttgggccagtttttcgacaagattaccattaagaacaagaaaaaggatgatgatgatgatgacgacaacgatgatgttgatcgtccagaaatcatgtggcaagatgataattacattcgtcccatcaaagacataaagactgccgaatgggaggagactgtattcaaagacataagtcccttgattattctcgtgcacaatcgatataaaaggccaaaggagaatgaaaaaattcgggatgaactagagaaggctgtgcatatcatatggaactgcaggttgccctcaccaagagtaagtagagttagtaaagtcagacacttgttgcctttggttcctgatactttagcatgtgttgcgattgatgctgttgttgagactgaactggttgctgcacttcaagtatcaatattcccagaaattatctttactaaagcaggcaagattttgttccgtgataaagccattcgcagtgcagaagagtggtcaaaagtcatggcttacttttactatggtgcagcaaaaccatcctgtttgaatagtttgacatattctcaagaaaatattccttctattgtcactgacaatccagtgtcctga

SEQ ID NO: 83306 - DNA, 699 bp, Glycine max
  Peptide Sequence Number=SeqID_200084
atggctaggaaaactcatgtagtttttgactcattaaggatctcatcttccatggatgtgagattgaaaagtaaggtctatggattttatgatgaatgccagaggaagtatggcaatgccaatgcttggcggtattgtacagatgtgtttgactatttaacactttctgcaattattgatggaactgtaaatatcttttactccctcctcttcaagtatctaccccccatgtgcctctgtgcatcttggtgggtgctttgtgttcatgggggcctttctcctgacattcgaacaattgatcagataagggtcattgaccggaactgtgaaattcctcatgagggtcctttctgtgatctaatgtggagtgatcctgaagatattgaaacatgggcagtcagtccccgtggagcaggttggctttttggatccagggtcacttcggagttcaatcacataaataaccttgatcttgtttgtcgagcgcaccaactcgttcaggaaggccttaagtatatgttccaagataaaggccttgtaactgtatggtctgcacctaattactgttaccgatgtggaaatgtagcttctattctgagtttcaatgaaaatatggaaagagaagttaaatttttcaccgaaacagaggagaacaatcagatgagagggcccaggacaggcgttccatatttcttataa

SEQ ID NO: 83307 - DNA, 630 bp, Glycine max
  Peptide Sequence Number=SeqID_200085
atggaggggattaaggtatatttaatgcaaagaattgtgagtcagatggaaaagatgctgaggtataatggtccaatttgtcctaaaattcaagagatatatgagaagataaagagagaggctgggggttggactcctgaatggtgtggtgatgatcaatactcactatttgaggtgtctaagaactttgaaaagtttgtggtcaatataaacaaaagaacttgtagttgcagaaagtgggatctgaatagcatcccttgctgtcatggggtagcttgcctgtggcagaacaattataatccagaggcctacgtggctgcctgttataggcatccaatggcccagatttatggcctgaaaatggatttccaccagtgcatccctctgctatccgaagagcacctggtagaccaaagaaggcaaggaaaaaagcaaattatgagccacaagacagttggacacaacaaacgaacttgtaaaggtaaaacaagggctgacagggagattcctaaaggtgaaaacaagaatttgaaaaggaaaagagctgcaccccgatctgttccaaataagaaattaaggatggagccaatctttaagtctggacttggtgaaacatctgcatcagcgtaa

SEQ ID NO: 83308 - DNA, 249 bp, Glycine max
  Peptide Sequence Number=SeqID_200086
atggaaagcagtgggtattcgcatagcactggttctgggctcaatagacgtcgtgttcgttgtgaatgcgacttagatcctccattggtcactgcctggactgacaataatgtttgcagaaggatttttggttgtgggaactataagcaaatgatgcttggctaccaagtggtgcaagagatggcacagatgaaacttgactcaatggagttgcagcagaagaagctcaactcacatgaggtgcagtag

SEQ ID NO: 83309 - DNA, 336 bp, Glycine max
  Peptide Sequence Number=SeqID_200087
atgattccatgtgaactagttcgtaaaatgagtatcttgagaagagaaaataaaagacgccagctttggccaagaaagacaaagaaaacaaagtatagcagaagaagagaaggtggctatgttgggcaaaataaagaagcgaaaattgccgtcgtcaaagttgagggagtaactaaaagggtcatagttgaaggtggtgttgttattggagcgagccttgatttgcctcttcatatatgctctgaccctccaaaacaaactcatcaaccttctcttagcatgcagaaccaccaagcgtggctcaaattcaaaatcgcaacacatgattatgaatag

SEQ ID NO: 83310 - DNA, 471 bp, Glycine max
  Peptide Sequence Number=SeqID_200088
atgcctatgacctattccggcatatttcagggcttcatcagattcaaagccacgtcgcggcttcgttccgctcctctcagacattctcttccctccatttcatccgctccttttcaccgcaccgccattcgcctccgccaccactcctgctccgccgcgcttcaagtcgtcaagaacacgcgccagaggaccttcaagtttccgttttggcaccaacgcagctccacctatggtcgtttcgcctaccaggacgtctccagtgacgaatccgatgtcgaattcgcgtcttctccctctcacaaccaacaactgggtgattcaactcacgagaacattgacgattggagatggaagctcaccatgcttatgcgcaacaaagacgaacaagaagcggtgtccagggagaagaaggaccgtcgcgatttcgagcaactttccactttagctaccaggatgggtttgtataggtag

SEQ ID NO: 83311 - DNA, 597 bp, Glycine max
  Peptide Sequence Number=SeqID_200089
atgccagaagtaacagagttgcaccctgtgcctgatgctcatgtaccagtaatgagggtatatactcagtggtgttggccaaatccagtaatgctttgtgctattgaagagggatcagttggacttcaaatttgggatcctagaagatatcccaatgataggttccatctaatgccaataattacccctgcttatgcttgcatgaattctagctacaatgtgtcgtcaattacattgtgtattatgacagaggagtttcagaggggaaatgaaatatgtgagattgaaaggcacatttatggcatgcttcagtgtcatccacatcctggtgactcttcagacaaatccagacctttccactgctccaacttcatggcgctgcaacgtaagcaaggagttcctgtcaacgatggtggacagtttgatataagactaactgttgaagaatttaagcattctgtcaacatatacactctatggatacctggaatggatgtccatgtcccccatgtgaaacatcgtaatatacctacctttgtatttcctggcagtgttcgaccttcccacccatctaaagtaacttgggagattaaatga

SEQ ID NO: 83312 - DNA, 249 bp, Glycine max
  Peptide Sequence Number=SeqID_200090
atggagaaggagcagcttgaatatgtgttggtgccattgggtctgttggtgtatctgacataccatatctggcttgtctacaccattgtacacaaccctcttcgaactgttattggccttaatgctgagtctcgtcatcagtgggttctttccattatgagtaatagttgtttcttttggacatgtcctaactgttcatcaattattcctagtcataccaagagtgttaggtctagcggaagaggctaa

SEQ ID NO: 83313 - DNA, 189 bp, Glycine max
  Peptide Sequence Number=SeqID_200091
atggggaaccccggactgaacaatcgcgataatgggcagcagcaacgcttaggcataacagaacccatctcattgggtggacctactgaatatgatgtcatcaagacacgtgaacttgagaagtacttgcaagatgctggcttgtatgagaatcagcaggaggcagttaggaagtgcttggcaggctag

SEQ ID NO: 83314 - DNA, 393 bp, Glycine max
  Peptide Sequence Number=SeqID_200092
atgggggtgcaaatagcaaccagacccacttgggccctccagaagatcctccagaatgcggttgcttctagaggaagccaccttgctcgcctgggcgagctgggtggcaagcatctcccccattttcctataaatagggggagaagtgaaggggaatttggttcagccctcctggtaattcaagaatcacttgaaattagtggaaaaaattggttccgtgaaaaagatccgagccaaggcacttccataaggtttctgtatcgtttccgtggggatttacgcgatgattttaagctgttcttcgacgttcttcgttcgttcttcatcgttcttcggtcttcaaccggtaagttcccgaaaccaaacttttcaattctttctatgtacccttag

SEQ ID NO: 83315 - DNA, 498 bp, Glycine max
  Peptide Sequence Number=SeqID_200093
atggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgcccccctttgccattcagacacagtcgtgttcgatggcaagcagagaccaagtttggtcattctgcacacatgatacgcggagataccttacggttatccgccccccctttgccattcagacacagtcgtgggctgacacagtcttctgcaccttttgttcctccggggacaacaaagtcatttacatgtggaaatttcatggtcacccgcgactctcgtcagccgagaggagcgaaattagtgtcatacgctgattttcggggacctttgcttgatgacatgcgaccattctttggtccttgtgaggtgcttggcgccagtcattag

SEQ ID NO: 83316 - DNA, 116 bp, Glycine max
  Peptide Sequence Number=SeqID_200094
gtgaccgtttggatgccatggatgctcattttgaaggcatggatacacggattactcagcttaaagacaacatgggtttcattcgctgttgctttgatccaccgactgctccatag

SEQ ID NO: 83317 - DNA, 552 bp, Glycine max
  Peptide Sequence Number=SeqID_200095
atgttcatttgggttacaagagatcgattacttgggccacacagtatcaggcaagggagtaacaatggatcaagaaaaggtcaagcagtcttgaattggccatatcctataaatctaaagcaattgagaggcttcctcggtctgactggatactacaggaaatttatcaaaggttatgtgtcaatcgcaactcctttatccaatctgttgaagaaggaaaactttcattggaatgaccacacttccatggcttttgacaatttgaaagctgcaattaccaaggcaccagtactggcattgcctgatttttccaaagcctttacattggaaactgatgcctctggtataggcattagggctgtattgagtcaggaacaacacccaatagcttttttctctaagaagctcacacctaggatgcaaagactgtcagcttatataagggagtcctatgctatcatagaagcagttgcaaaattcagacattatttacttgggcaccgatttgtgatcaaaactgaccaaagaagcctcaagtcactcactgagtaa

SEQ ID NO: 83318 - DNA, 1560 bp, Glycine max
  Peptide Sequence Number=SeqID_200096
atggtcgtcgttgtctcaggtgaaactggttgtggtaagaccacacaacttcctcaatacatattagaatctgagattgaagctgcacgtggagctgtatgtaacataatctgtactcagcctagaagaatatctgctatgtctgtttctgaaagagttgcagcagagcgtggggagaaattgggagaatctgttggatacaaagttcgcctggagggtatgaaagggagagatactcgtcttcttttttgcaccacaggtgtattattgcggagattgcttgtggataggaatttaaaaggtgtaactcatgttattgttgatgaaattcatgaacgtggaatgaatgaagattttcttctcattgtcttgaaggaacttctccatcatcgtcctgatttgaggttgattttgatgagtgcaaccttaaatgctgagctattttcttcatactttaatggtgctccaactatgcatattcctggttttacatttccagttcgagcacattttcttgaggacattctggaaaggactggatatcgattgacaccgtataatcaaattgatgactatggtcaagaaaaaacatggaaaatgcagaagcaagctcaagctttcagaaaaagaaagagccacattgcttctgctgttgaggatgctttagaagttgcagaatttaaggggtatagcctacgcactcaagattcattgtcctgctggtaccctgactcaattggttttaaccttattgaacatgtgctttgccatattgttaagaatgaaaggtcaggtgctgttttggtttttatgactggttgggatgatataacctctttgaaggatcaacttcaagctcatcctttgttgggtgatcagagccgagtattgcttcttgcatgccacggctccatggccagctctgagcagaggttgatatttgaaaatcctgaaggaggggtgaggaaaattgttcttgcaactaacatggctgagactagtattaccatcaatgatgttgtctttgtggttgacattggaaaagcaaaagaaacatcatatgatgcattaaataacactccttgtttgcttccatcttggatatcaaaagctgctgctcggcagagaagaggaagggctggtcgtgttcaacctggtgaatgctaccatctttatcccagatgtgtttatgatgcttttgctgattatcaattgccagagcttttgagaacacctttgcagtccttatgtctgcaaatcaaaactctacaacttggaagcatctctgagtttttatctagagctctacagccaccagagcctctatcggttcaaaatgctattgaatatttgaagattattggggccttagatgagaatgaaaatttaacagttttagggcacaaattggcaatgcttcctgtggagcccaaacttggcaagatgctcattttgggagctatcttcaagtgtttggatcccataatgactattgttgctggtcttagtgtaagagatccatttgtaatgccgtctgacaagaaggataaatggtggtga

SEQ ID NO: 83319 - DNA, 441 bp, Glycine max
  Peptide Sequence Number=SeqID_200097
gtagtcttaccacttggtgttcataaagaagtagacgctcatctccttgcccatctttcacaaaaggctagaaacaagtgggattttatggaagattccttgcataactcaagtgattctagaagcattccagccaatgaaagaatgtatgaacagccagagcccgtgacccataatagtgttgtcaaggagaaaatccttcaacgaaaaagtttgcaactgcatcatcagcaacaggattggcaggagtctcctgaagggcaaaagatgcttgaatttcgtagaagtcttcctgctttcaaagagaaggatgcatttctgagagttatttcacagagtcagtgtgagggtgagcctttgtgcaacgataaggttgctatcttttgtaacttggaggtcacaagttcaaatcttggaagcagtccctgtttgattgggtag

SEQ ID NO: 83320 - DNA, 3426 bp, Glycine max
  Peptide Sequence Number=SeqID_200098
atggagttatcatttgttgtcatgtggaatgggatgttcatgatacctttttactacaggttggctcagcattttaatgatgatgacttggaggagatagaagatccaaggaggactcttccgcaatgggctactaatacagagaagagttcatataatggtggatggtctaggcgggatagttcttcaagaggggcaaatagttcaaacccaagctcttctaatgtttataatcattcacaagttaagcctcaaaccctgcccgtgtccagcaccaatacactgaaccatagaattgcacgaagagatgaaccttcctaccatgccctgaatggaaacacaagtcagcaacagaccgttagttcccgaatttcaaatattcatggtgcagattatgagaaaatgtcatctcagcaagctttcaagaggacccttccgtcatctcttcaaccttctgcaacaagggctcttccttcttcatttgcatcagacagcagattaagaaacttaaaagataacgcgagcagtagtcaacttcatgatgcatataagaatcgtccccatggagtaggacctagcacgtccagtgacaggggctacattcgtgaaaattttggcaggggctatgatgaagatcgtttcttgtatcaaaatggtgggaataggattcttccttcacctttgatgctcggaaaggttatatctccacagtttgctacttctagtgaatctgcgtatcgttctggagcaggtgatgaaagggctgctgaaagtgatgagagactaatttatgaggcagcattgcaggatatcagtcaacctaaaacagaatatgacttacctgctggtgtattgtctgtctctcttctgagacatcagaaaattgcattggcttggatgcttcagaaggaaaccaagagtttgcattgcttgggggggattttggctgatgatcagggccttggaaagacaatttcgatgatttccctcatcctggcacagaggacattacagtcaaaatcgaaaatagatgatacatgcagtcataaaactgaagctttgaatttggacgatgatgatgacaatggtagtgttgatgtggaaaagcataaaaatagcgaagaatctgatgatataaaacctagtagagaaccaagcagttcaacacaggcacctggtagaaaaaggccagctgctggtacactagttgtctgccctgctagtgttcttcgacagtgggccagggaactcgatgaaaaagttggagatgaaaagctttctgttttggtttatcatgggggcagtaggacaaaggatcctgttgagctcgcaaaatttgatgtggttctaacaacatactctattgtgactaatgaagttcccaaacaaccattagttgaggaggatgatattgatgaaaaaatgggggaaagatttgggttatcctctgagttttctgttagtaaaaagaggaaaaagccatttaatggaaataagaagagtaaaaaaggtggaaagggaattgacagttcttctattgaatgtggttctggtcctcttgccaaagttggttggtttagggttattcttgatgaggctcaaacgataaagaatcatagaactcaggtggctagagcttgctgcagccttagagccaaaagaaggtggtgcttatctggaactcctattcaaaatactattgatgatttgtatagctactttaggttcctaaagtatgatccttatgctgtatacaaatcattctacaatacaataaaagttccaatatccaaaaatactattcaaggttacaagaaacttcaagcagttttaagggccataatgctacgtcgtacaaaaggaactttgcttgatgggaagccaataatcaatttgcctcccaagacaattgagctcagtaaggtggatttctcgattgaggagcgggcattctacaccaaactggaatcagattcgcgttctcaatttaaggctaaagagctgggcatgcaaaacaactccgatggaggtgaaattgcaaggttagggtcatccaagggttatggttgcacgggagaggtgaccaccatgtgcaaagcacgacttgaacggatgtcggacgtgccaccatgccctggtcaagggagttgtttggctttatggagaagtggcttgtgggagttgccaaaaaagttgctggataagtctccagcagtggtcagagaagtcgccaaaaaaggggaaaagggtccactggggacagtggatcctcagcgaaacatgattttcgtgattcctttgtcaggctctagataccatgcatatgctgctgctgggacagtgagccaaaactatgctaatattcttttaatgcttttacgtctccgacaggcttgtgaccacccgcttcttgttaaagattttgattctgatcctgttgggaaggattctgtcgaaatggcaaaaaatcttcctagggaaatgctgattaatctttttaattgtttggaatcaacctttgctatatgtcttgtttgcaacgatcctcctgaagagcctgttattacgatgtgtggtcatgtcttctgttatcaatgtgtatcagaatatttgactggtgatgataatacgtgcccgtcagttaattgtaaagaactaattggcgatgatcttgttttctccaaagctactttgaggagttgcatctctgatgatggtggcagtgttagttttgcaaattcacatctttgtgattattcactagtgcagcagcgtgactacacttcatctaaaatcaaagctgttcttgaggttctgcagtcaaattgtaaattgaagatttctagttctgacttaccgaactcctctggaggttgtagagattcaccttctttggataatttacatgttgaagactgcgattcagattggactagcatgctggacttagttgagacatcgttgaaacaatttggtatacagtaccggagacttgatggtagaatgactctgggtgcgagggacaaagctgttaaggatttcaatactgaacctgagataactgttatgctgatgtcactaaaagcaggaaaccttggtttgaatatggttgctgcatgtcatgttattcttttggatctttggtggaatccgacaactgaagatcaagctattgatcgagctcacagaattgggcaaactcgtcctgttactgtgacacgaatcactataaaagatacagttgaagataggatactggctcttcaggacgacaagagaaaaatggttgcatctgcttttggggaagaccatgctggcgcgtctggaactcgccttacagtagatgatctgaagtatcttttcatgtacctgctgacatcggttgcacaagttggcaggcaaggcgaggcttggttgatccaagtg

SEQ ID NO: 83321 - DNA, 1389 bp, Glycine max
  Peptide Sequence Number=SeqID_200099
atgatttacgacactgtactagccaagagctttagtcgttatgatcagaaaaggttgggatatggagcatttgtgagctgcttgctcatagttttgagtctttgcactgtgtttaagccttacttgggtcctgtgcatgttttgaacctgaagctcttcatcgatgttgacaccaaaatgctgatcaccagaagctcttcacaaatagccaaagttgaaggaaaagaaacaaagaaagaggaactactatgcacttcagaagaaagaacaaaattttgccaagcaaggggagacatcagagtccatggaaaatcctccactgtatacattgtttcatctaagacaactatgtcggaaaaaaacatgtcatggaatttaaagccttatgcacggagggacgatgtagatgcaatgattcgtgtgagagaatggtcagtgaaagcagtaaatgttagccagaaagctccccaatgcacccaatatcacaacattccggctgtattattttctaccggagggtatgctggtaaccacttccatgaattcactgacattgttattccactgtttttgactgctagacaattcaatggagaagtacaatttatcataactgataaacgtccttggtggatttcaaagcacaaaccacttcttaagaagctgtccaactatgagactatggacattgatggagatgatgaagttcattgcttcccaagggtgaccgtgggtctcaaacggtatcaaaaagagctaagcattgagcctcaaaagtattcctattctatgaaagacttcagggatcttttgagaagttcctatgcattgaagagagttgaagcaatcaaaaccagagatggtctacgtgggaagccaaggctcatgattctttcaagaaaaagatcaagattcttcaccaatacagatgaaatagcaaaaatggctgagagtttgggctttgatgtcattattaaggaagcagggtggagcatgtggggctttgcaaatgttgtgaattcttgtgatgtgttattgggagttcatggtgctggtctcactaacatacttttccttccggaaaatgcagttttcgtccaagtagtgccttatggtggggttacattggactggcttgccacaaatgactttggaaacccctcaaaggatatgaacataaagtacttggaatacaaaataagcttggaggaaagcactcttatacaacaatacccgttagatcatatgtttataaaggatcccccactgattgagaaaataggatgggaagaatttaagtctgtgtatttggacaaacaaaatgtaaagcttgatgttgataggtttaggcctacattgcagaaagcccttgagctattgcatcaataa

SEQ ID NO: 83322 - DNA, 543 bp, Glycine max
  Peptide Sequence Number=SeqID_200100
atggcaatgagctcaattcataccttgtacgctttttctttccgtttgtgtttcccaaattcatctccacaatttaagcctctgaatgccattccactaagaagaacaaaacactacaacaacaacaacaacaacgttaaatttccccgagaaagaacaaggaccagagcaacccttgatgatgttgaaacagaccaactttcctcaatcccacttgttgaaaatgagaaagccaaaaaggatgtagaggaaagtgtgaaagtgttaaaagatgcagctaagacaagaaaggtagcagcagaggagattctttctgcattgtctatcattgagaaagcaaaagttgatccttctgccttttttgaaacccttggtggaaaggaatcccctgggaggacctggatgctaatttttactgctgagaaacaactaaaaggtggtcgatattttcctctcacagctgttcagaggtttgatgctgctttgtttctagctggaaaagcaagggagatcatgacacaagaaacgtttgatgggtgttaa

SEQ ID NO: 83323 - DNA, 1391 bp, Glycine max
  Peptide Sequence Number=SeqID_200101
atgttcacagttctgcttctcttctcactccttcttaccacctctacttcccacaacataatatcataccctcatttccaacaactcaatgtcaaacaaatcctcacagaaaccaaactcaacccaacaaatacctacaaacacctccaacaccaaaaactcaacattgccaccgaagcatcttcaccggcaaaatataaactgaagctagttcacagagacaaagtccccacgtttaacacctcccacgaccaccgaacccgattcaatgcacgaatgcagcgagacaccaaaagggtcgccgccctccgccgccatctggccgccggaaaacccacctacgccgaggaggcattcgggtcggacgtggtttccggcatggagcaaggaagcggagaatacttcgtgagaatcggagttggaagcccacctcgaaaccaatacgttgtcatcgactcaggcagcgacattatatgggtccaatgcgagccctgcacccaatgctaccaccaatccgaccccgttttcaaccccgccgattcctcctcctacgccggcgtctcctgcgcctccaccgtctgcagccacgtcgacaacgccggctgccacgaggggcggtgccgctacgaagtttcctacggagacggctcctacactaaaggcacactcgccctcgagacactcacgttcgggcgaaccctaatcagaaacgtggccatcgggtgcggccaccacaaccagggaatgttcgttggcgccgccggtctcttgggcctcggaagtgggcccatgtctttcgtgggtcaactcggaggccaggccggcggcacctttagttattgtctagtcagcaggggaatccaatcgtccggattattacaattcggacgagaggcagtacccgtaggtgctgcatgggttcccctgatccacaatccgagagcccagagtttttattacgtaggactttcgggtctgggagttggaggattgcgggtacccatatccgaagatgtctttaaattatccgaattgggcgatggaggggttgttatggacacaggcaccgccgtgacacggcttccgacggcggcgtatgaggctttccgggatgcttttattgcccagaccacaaacctgccccgggcttccggagtatcgatttttgacacgtgttatgacttgttcgggtttgtgtcggttcgggttccgaccgtgtcgttttacttctcgggtgggcctattttgaccctgccagctaggaactttttgatcccagtggatgacgtgggaagtttttgcttcgcgtttgctccttcttcttctgggctttccatcatagggaacattcagcaagaagggattgagatttcggttgatggagctaatgg

SEQ ID NO: 83324 - DNA, 1545 bp, Glycine max
  Peptide Sequence Number=SeqID_200102
atggaggttggagggcatcatataatgaatttcaccttggtgatttcagatccaaagcaggatgttgaggctgagccaaaggctgttgaggctgagccaaaagtgaaggataaggaggttccttctgttcaagatgaagaagatgaaccagagatgacaaaaagacacttgaatgttgtttttattggtcatgttgatgctggtaagtctacaactggaggccagatacttttccttagtggtcaagttgatgagcggactatccaaaaatacgagaaagaggctaaggacaaaagtcgagaaagctggtatatggcttatataatggacacgaatgaggaggagagggtaaagggaaagacagttgaagttggaagagcacattttgagactgaaacaacaaggtttactattttggatgcacctggtcacaaaagctatgttcctaacatgattagtggtgcatctcaagctgatattggagtgttggttatttctgctcggaagggagagtttgaaactggatacgagagaggtggacaaactcgtgaacatgtccagcttgcaaaaacgctgggtgtgtctaagcttcttgttgtcgtcaataaaatggatgagcctacagtgcaatggtcgaaagaaaggtatgatgaaattgagtcgaagatggttccatttttaaagcaatctggatacaacagtgggaaatgttatgtcttgctgaaagcttgggatgagttgaagatgactggtagtttctttgcgcaaatgctgagcaggtttgagatcctcgatgtcttgtttttaccaatatctggtctaatgggtgcaaacatgaaaacaagagtggataaaagcgtttgtccatggtggaatggaccttgcttatttgaggcacttgacgctattgaagttccactgcgagatcccaacggtcctttcaggatgcctattattgacaaattcaaagacatgggaactgttgttatgggcaaagttgaatctggcagtgttcgtgagggagattccttgttggtcatgccaaataaggatccagtgaaagttgttgccatatttattgatgaagatcgtgttaaacgtgctggacctggtgaaaatttacggattagattatctggtgttgaagaagaagacatattgtctgggtttgttctatctagtgttgctttaatttccatggaaactaatccaataccagcagttaccgagtttgttgctcagttggtgatccttgaattgctagacaatgctatttttactgctgggtacaaggctgttctgcacatccactctgtggttgaggaatgcgagattgttgaactcttgcagcaaatcgatacaaagacaaagaagcctatgaaaaagaaagttttgtttgtgaagaatggagctgttgtagtgtgccgtgttcaggttaataactctatttgcatcgagaagttctctgattttccccagcttgggaggttcactcttcgcactgaaggaaaaactgttgctgtgggaaaagtcactggtctgtga

SEQ ID NO: 83325 - DNA, 688 bp, Glycine max
  Peptide Sequence Number=SeqID_200103
atgaaccaggtgatccaaacccctgaacaacaacaatacttggccaagctcctagggtatgattataccatacaataccgttccggcatcgacaatatagcggcagtcgccctttcagggattgttccaccaggtcaatgtctcatcctttcccttcccaatctcgaatgcttggtcgacatcaagcgctctgtgctccattcatccgcttatcgagatcttctcgataagattcagcaccagcccgaggcctacccagatttctcactccacacaggatggatttgctaccgcggcaagctttggcttccgactgacaatccttatattcctatgttgttggatgagtttcattccaccccactaggaggacacatgggtgaagctaagaccctgcgcaggctccgagacattttgttttgggataatatgcaccgcgacgttcgccgcatggacctttctcttgatttcatcacgagactgtcaccatcccatggattcaccaccatcttggtggtcgttgaccgttactctaaaggtactcatcttggtgcattactgccgaaacactccacccacaaggtagccactctcttcattgatattgtctgcaaactgcatgtggcaccaaactccggtacagcacaacctatcatcctgagtctgacggcatatcatcctgactccg

SEQ ID NO: 83326 - DNA, 270 bp, Glycine max
  Peptide Sequence Number=SeqID_200104
atgatgaaagattcatctttgtgggtgatggcaaaaagatgtaaaaaagggaggtacaacaagcaaaaagggacagaaataaagaaaagaagaagaaaatcagaagaagcccaagtccaggagaaaaataaatcacatggtgacagtacaagtggaggcttcaatcccttctctgtctctttgacgtttaagaattcaatcggagcagctagaggaaaaaaattggaggaatctcaaagaaccgctagagatgctgttatcgctggctga

SEQ ID NO: 83327 - DNA, 258 bp, Glycine max
  Peptide Sequence Number=SeqID_200105
atgaaggttatacatcttgtagaagctcatgatacacttcatcctcctcgagcatcatatcgatgtgatctccatgtgatagagggttatccaaagagcgtaaggacctacaaagccaagcttctacaagaagagatggccaagagaaccgaggatggactactcatcaaaggcaaggaaggaggaagctacaaggagctaaattggagcaccttggagatttccttaatggctcacttagcgacaccagctcgctaa

SEQ ID NO: 83328 - DNA, 159 bp, Glycine max
  Peptide Sequence Number=SeqID_200106
atgaggtcatgggggttggacctgaatcaggaaggtgaggccctaacggattcttctgagtctaggccttggtggatgactctaaagaacctcgtgccagaggacgttgggacacaatgtgtaacgacccgccttgtcactacgatatcaccactctaa

SEQ ID NO: 83329 - DNA, 294 bp, Glycine max
  Peptide Sequence Number=SeqID_200107
atgaggattcttttgataggccaaggttcaaaaaattctaaggttgtgtctcaatgggggcttttatcgtgggagcccgatcttgatatctggggcgcgcgcgacaatgatgatttggaaacaacgtgcaaaattagtcatggccatagccaggagggcactcaagcatcccatttacggcattgtgatactacggtcaggaatttacacaaacagacccatcgtttcccaattatgttctttcatcagttcaatgaattcatccattcttatctcggttattcaggaaaataa

SEQ ID NO: 83330 - DNA, 549 bp, Glycine max
  Peptide Sequence Number=SeqID_200108
atgatgtcaacaactaatgttaaccatagcttgtttgaagaacaagatcagatccctacgcagatggggctgttcaatattattcctttcccaccaaaccaaacctacccacctttgggttgtcaaacagtaactttgaaatccatcagtgcaatagctccttcactttcatctgctgcaaatttttctgaaaccctactttcaaccgctgttaatcaaagaccacgagaagaagatctcacttcaagtttggtaggaggaggtggaggccaactcctttccttgagcagatcgagagtgaattcatgggcatgggaggaagtaagcgattgcttgatgggtaaaagaattggaggagatgataatcatcatcatcatctaggggtttctgccatgaagatgaagaaaatgaaggcaaggagaaaggtgagggagccaaggttttgcttcaagactatgagcgatgtagatgtgttggatgatggctacaagtggaggaagtacggacagaaagtggtaaagaacacacagcacccaagtgatcagtga

SEQ ID NO: 83331 - DNA, 219 bp, Glycine max
  Peptide Sequence Number=SeqID_200109
atgttgaagaacggtcgagaatcttcgcgtaattactcaaagaaatgttacggaagcgcctcggcttggattttcttcacagaaacaatttccctcagcaaatttaagagaatacgaagggaggagcttgccacccagctcgcccaggcgagcaaggttgcttcctccagaagcaacagccttctggaggaagaatctggaaggccgaagtgggcctga

SEQ ID NO: 83332 - DNA, 138 bp, Glycine max
  Peptide Sequence Number=SeqID_200110
atgagtttgtacatgtacaaccatcgtttggaagcaatggctccaaagaagcttctctctaagagggcaaggaaggaggccactggagaaggatctagtgcggccccacatgcggatatagaatttgacggacactga

SEQ ID NO: 83333 - DNA, 662 bp, Glycine max
  Peptide Sequence Number=SeqID_200111
atgaaaaaaacatggcttaccgccctgctggcggcctctgtcaccctgctcagcgcctgtgacaaccacaacgacaacaaaattaaagtggcgatcaataccggaccggatgaggcgctgtggcagaccgtgaagcaggtggcacacgataaatatcagctcgatgtcgatgtggtggcgtttaacgattacgtgcagccgaacgaagcgctgttcaataaagatgtggacgccaacgcgttccagagcctgccttatctggagatgcagtccaaagagcgcggatataaatttgccgtcgtgaccaataccttcgtattcccgattgccggttattcacgcaaaattaaatcactgcaggatctgccggatggcgctaccgtgaccgtgtctaacgaagcgaccaccttggggcgtagcctgctgctgttgcaggcgcagggcctgctgaaggtgaaacccgaagccggtctgctgccgaccacgctggatattaccgataacccgaaaaagctgaagattgtggaagtggatacgccacagctggcgcgcacgctggacgatccgcaggtttatctgtcgatcattaataataactttgccgcgctggtcaatttatccgcctcgcgtgacgggatgtttatggaaggcaaagcgtcgcc

SEQ ID NO: 83334 - DNA, 100 bp, Glycine max
  Peptide Sequence Number=SeqID_200112
gcacctgaatctgacctccgtgtcaaaagttatgaccattggaaattctcgagagcttccgttgttcaacttcgagcgtctcgatatattatgcgcttga

SEQ ID NO: 83335 - DNA, 346 bp, Glycine max
  Peptide Sequence Number=SeqID_200113
gatcccagcaaggtcatgccatcatgacatagggatcgcgcccgcaagacacccagtggacccggagaagtccaacagggtcttagggtttctagctctgattacgggcctctgtcagttctacagagtgctcgtcgcccccaataaggtcaggcccctattaataaggctttcatcgagaagtactgcgcccccaggcaggcgcagggcaaggcatcacgacagcgggcaacagacgcaccgccaccacctctggagttcacctcagctcatccacaaaaaggttagagtgttgcctacgacacatggccgaccaataggcgaccaagtccaaagccaaaggtag

SEQ ID NO: 83336 - DNA, 531 bp, Glycine max
  Peptide Sequence Number=SeqID_200114
acggtgttgctagcagagttctatgtcatcagtgacaacaccatcatcgtcacccaacgcatcatcaagaagcttccaatagaggccaacttcaggctcacaaattgcaagtccaccctcgcaaaagcctccaccctacaccctcgcaaatctggttgtcgatgtagaggcatccatcggaggaagagacagtggtgcacagtgtcagggttgagccaacagaggaggtggaaggaccgacttgatgaggaggaagtcattgttggagtcctagatttggagggagagagaaagaggggaaggcgaaccacttgtcatcgaggttgtcatggaggtgagaggagggggcaagggcaagaagggttcggagtagaaatagagactgcgaaggttgaagaacaagttccacaaaatcttgaacctaccaagtgtgatggttgggattggtatgagtgggatcatttgccacaccctttggttgggcctcttgagaaaatggtcaaaggagctttcgacccatttccaatttga

SEQ ID NO: 83337 - DNA, 210 bp, Glycine max
  Peptide Sequence Number=SeqID_200115
atggacaggtgcaattacatgagtgtctctaccgatttagccttagccagtaggggcaggtttaggtctgaggtcgcatggctcggagactggcccgatgcccagataggggaggagccttcagaatcccctggtgatgcggatgaatcccatatggacgaggatatgaccgacctgctcggtttcttgggagggagcggagccacatga

SEQ ID NO: 83338 - DNA, 441 bp, Glycine max
  Peptide Sequence Number=SeqID_200116
atggcattggcacatgattttgagaggagtgacccatggaacaagtggggaccaaatcttgttttagggtacaagagaacacaaaagtgggcgctagttggagcttacctttgggccaaaatggtcagccttgggcagcaccatgacgctggctttgcgccccagagtggtacccccctgttgtttggtcttgcttatgagatggcaattatgggagatggctccgaagaagctctccacaacgaggtccaggagggatgcctatggggaaggctccaacaccccgtggagtttgacagtcaccggttccggagtgccgaacaccaggagcgctttgaggccatcaagggatggtcgttccacagggaaaggcgtgtccagctcagggaagacgagtaccctgacttccaggaagagatagctcgcaggcgttgggcatga

SEQ ID NO: 83339 - DNA, 309 bp, Glycine max
  Peptide Sequence Number=SeqID_200117
atgaggtcgaggcactaccgaattgcgaccgtaattgacttctacatcgttcttcattcgttcttcgttcatcattcgctgggtgagcccaccatgaagtctaagcgcaagcatcacactaagcgtaacttcagcgagcttagcatgacagagaatctggcagatcactcatttcaaggtcgtgcgctaagcgcagagggcaccctcaaccaggctgagcgcaagagggtgctaagccctagcccactaactcgtgctaagtgcgagagtgacgctaagtgcaacgtcgcgatttcagggcctatttaa

SEQ ID NO: 83340 - DNA, 549 bp, Glycine max
  Peptide Sequence Number=SeqID_200118
atgctcggaagacttcttgccagttcattggcttttgaaagccgcatcctccattaccttatagttcgcattttgcttcctagatcttcaaaccttgcccaggcacatcttgttagatatcgcatgcataaggcattgcgattgaatgccccattaccttatcctcaccttgttaccctcttccttcaacatttcaacatcccttttgattctgaaccttatgttccaatcaagagaacattccttataggcgcttcagtcatagcatcctttggttatattaaggagcatgatggatcatgggtaaagaagggtgctagaaatattggtgaagaaggacatgagggagaagattcatctcttctttcgaagattttggaaaggtttgatggtcttcaaacctttgttggtgagaggtttgatactttggaactgcaagtggatatgtgcttcaatgaaatggagtcaagaatgactaaggttgaagaagatgtatcttacatccaatcaagctttgatcttccaccaccgccgccaccatcatcttag

SEQ ID NO: 83341 - DNA, 330 bp, Glycine max
  Peptide Sequence Number=SeqID_200119
atggggctgagcggcatgactcgcagtggtcacgtgttcgcaccccctgacctaccgacacaacccgcaaacgttaaagggaaggcgaagatagcgaaagaacaaaataacaacgtgatccccgctccagatgaggatattccaatgaaaggtctttctgagaaaaaggatggcagtggcaagaaaaaagtattgctagaggaggcaggcaagttcctccgcattattcaacaaagcgagttcaaggtcattgagcagctcaacaaaaacccggccaaagtctctcttttggaattgctcatgagctctgagactcatcgggctttgcta

SEQ ID NO: 83342 - DNA, 564 bp, Glycine max
  Peptide Sequence Number=SeqID_200120
atgtcctcgccttcagaggactacacatcgtcgccttcagagggctacacatcctcgcttttagagggcttcacatctgtgccttcagagaactcaagggcgaccaactgtgcaagcacaaccagaggaggagactatcgcatagctactatgcataccggggcaagattttacccagccgctacaaggagacgagtatggatcgtgcgcaccaacatatggatgatgttgctacttagcaaccttcttcccaacgaccaccactctaatccccccttgtcgaagtgtcagctgggatcgtgcccacaagacacccggtggacccgaagaagtccaacagagccctggggttctagctctgattatgagcctctgtcggttctacggagtgaccaccactctgatctctccctgccgaagtgtcagctgggatcgtgcccgcaagacacccagtggacccgaagaagttcaatagggtcctgggattctagctctgattacgggcctctgtcggttcaacggagtgcccgtcacccccaacaaggtcatcaggccccctattaa

SEQ ID NO: 83343 - DNA, 297 bp, Glycine max
  Peptide Sequence Number=SeqID_200121
gtcctgctgatacaagaatttgacatcatcatcaaggacaagaaaggatccgagaatgtggtagccgatcatttatcccaattaaagaataaagaagtcaccaaggaagaaccagagagaataggggggatatctcgaaggaatgagatgcctttgcagaatatcacggaagtaaagatctttgactgttggggcataaacttcatggggcctctgccttcttcatacgggaatgtctacatcctggtggctgtggattacgtctccaaatgggtggaagccatagccacgttttaa

SEQ ID NO: 83344 - DNA, 114 bp, Glycine max
  Peptide Sequence Number=SeqID_200122
atgaatatgcaaggcgcgctcagcgcgacaccccctcgctcagcgcgtgtagatcgcgggcttagcgcgcgtgttgcaggcttagcgcgttcttctgttggatttcaggcttag

SEQ ID NO: 83345 - DNA, 306 bp, Glycine max
  Peptide Sequence Number=SeqID_200123
atgattgatgctgccagtcatggagctcttggtgatatgactcctctatctggagtcaatgagcaacttgaagcccatgttgcaaacatttataatagactccctcagcaacaaaaccaacaacaacagaataattatgatctttcaaacaatagatacaatccaggttggaggaatcatccaaatctgagatgggaaaatcctccacaacaacaacagcagcaacaacaacagtttgtccctcccttccagaatgttgttggtccaagcaggccatatgttcctcctccaatgcagcaacaatag

SEQ ID NO: 83346 - DNA, 285 bp, Glycine max
  Peptide Sequence Number=SeqID_200124
atgacccaagagctggtagcccgcggagacaccttacgattatccgcacctcgtcattcagtgatcccaagtgtgattgatgagcagaggccaatgtggtcatctgtgccctttccggagatgtcagcatcttccggtggagactttttcaagtctcacaagttatctagaactacacataatttcaagtttgtcagacaacctcctctccaaataggaagtctgttgctatctgttttcttcaagatgctcatatccagtgttaacactctccttgtcatctaa

SEQ ID NO: 83347 - DNA, 345 bp, Glycine max
  Peptide Sequence Number=SeqID_200125
atggtgctgttttgtacgtggttttcatggattgtgcatggaaaccgcaagcttcaatggcgagttcgtgagcacaggacacgtggatatagcaacccgctactggtgctggcgatatcaggggaaggcacgtcccgccagcggtgctggcgatttcaaggctgtgctgaaatcgcagcattgactggcgatttccaagggctacgagtagggtgcagagggagaggcacagaagccatttccgaggctctgcacggagctgcagctgcagagcagggagtcgccaacgggaactgcgacttggtgaggaaaccgccagcagtgttggcgatttgcattcgttaa

SEQ ID NO: 83348 - DNA, 372 bp, Glycine max
  Peptide Sequence Number=SeqID_200126
gttgttgcttctggaggaagcaaccctgctcgtctgggcgagctgggtgacaagcttctcccccaattttctataaatagggggagaagtgaagtgaaaaagggttcagcccctaaggcacttctctctctttcgaatttgtttggaaaaattgtttccgtgaagaaaattcaagccgaggcgcttccgaaaagtttccgtaacgtttccgtgaggaatttcgcgaaggtttcgaccgttcttcgacgttcttcattcgttcttcatcgttcttcgatcttcaatggtttgaagaccaacacgggccatgttgggctagcaagaccttctacgaggatttggttgttgattcaacatgcttgtgttcagtaa

SEQ ID NO: 83349 - DNA, 624 bp, Glycine max
  Peptide Sequence Number=SeqID_200127
gccctcaccttcagaggattacatgtcctcgccatcagagggctccacgccctcatctttagaggactacacgtccttgctatcagagggctgcacgccctcacttccagaggactagacatcctcgcctttagtggactacacgtcctagccatcagagggttgcacgccctcacctttagaggactacacgtccttgccagcagaggactgcacaccctcaccttcagaggactacacgtcttcaccatcaaagggttgcacgccctcaccttaagaggattacataggactacacgttctcgccttcaaagggatacacgtcttcacctttggagggctaaacattccaccttaagagcactacacgttgtttccatcggagggctgcatgccttcacctttagaggacaacacgtctttgccatcaaagggttgcatgccctcactttcagaggactacacgtccttgccatcagagggctgcacgtcctcgccatcagagggcagtactccctcacctttagaggactacacgtccttgccatcagagggctccacgccctcatcttcaaaggactacacgtcctcgccatcagagagatgcacgccgtcaccttttga

SEQ ID NO: 83350 - DNA, 291 bp, Glycine max
  Peptide Sequence Number=SeqID_200128
atggataagcttcctaccaatgaaaaacttcagggtgaggattgcaacattgtatctatgtgcagtctttgtgaaatggcctacaagaagaaccttgttccttatgaggtgcttttcacttggatcataaggagtgatcgggtggatgtgtctatgttggaatcgtctgtaggtgtcacacaactaaagggtgtgacctttattaagatggggataacagactacttcccaaaatatactcagaagcatatcaagagaaaggctaagaaaaagcctaaggagaaaccatag

SEQ ID NO: 83351 - DNA, 195 bp, Glycine max
  Peptide Sequence Number=SeqID_200129
atgtcagctcgtttaccccttgttcagacgcatgaactgaggtgcgtcgatccagcgacaatgacactcgcaatcgtgccccaaaaaatacatgaaatggctcccccatcgtcaagcataaggccttcttctctttgcttgtggcggctttctcttctctccttgagtgggatgcaccttctcaagccaaattga

SEQ ID NO: 83352 - DNA, 399 bp, Glycine max
  Peptide Sequence Number=SeqID_200130
atggggacgatgctgaagttggagatgaaaggggttttgagggagataatgaagtttgatgctgactatcgagtcattatcggtgtactcttctatagtggttataagttcttcattagaggcaaggacaacaatgaagagaaacagaggacagtggtgcttacctcgacagtcgacgctgatgatgctccctcaacggtggacggtggcgtagctcttcacggaaacctcctcaatgcaccttgcaacctcttcacagcaagctcctcttcacgacaacaatggtttgtggctgaatacgaaaatggtgaactagagttagtgggagagagagaggggtattacgggcttttcacctcaagtgctggatgcaccagcaaaaatgctgggtgcacctag

SEQ ID NO: 83353 - DNA, 300 bp, Glycine max
  Peptide Sequence Number=SeqID_200131
atgaggattgtcattgaactctgcattcgaaaagtggacaaccacatgcctaccgcatccgcacggaggcagcgagtccttgtgactgcggcacacgatgagctagtggtccctgcgccaaatgtagaggttgacgtatttctggatgacccgatggcaccagctgatgtagaggacactggggcagacattcccacagacacaggcgcccaggctgctgaggatgagcatgaaggattttcgggtggtccgagcgacctatctgtgctgacccaatatgcggatcactttgcttgcagc

SEQ ID NO: 83354 - DNA, 632 bp, Glycine max
  Peptide Sequence Number=SeqID_200132
atctaaagaagctcacttatcataaagagcttttcatcatggtagctcaagctaaacatgtattttatgttcaagacccttgtgatgaaaggtggtcagtgattcttcatggaaaaacaattggtgttaatgttgaagatgatgattcaaccattgatacttgtgtcaatcctttctctacacaaatatcgcctaacatcatgcaagaagaatttgacgacagaccattggttcatgtggatcctgccactaggaaagcagatggtccccacaaaaagaagttaagaatatatttggggattgtcgcttacgataagtttaactcagatttgacctccaaatgggctcttatcgatgacaaggagggcaaggatggtaaagtatgtgaaaagtacgacataagcaaggagaagtggaagcagttttgtcagagccgtagagacccttcgatgttttatgatagaggactgtccaaggaggaagagtttggcttgggtggactcaacatggatggaccaatcatagagcaaggagtaagagattcaaaaagagcttgccaagagactaaattttctcatggaggaaaagaagaagaagcaaagctcatttattttagccaacttttagaataa

SEQ ID NO: 83355 - DNA, 276 bp, Glycine max
  Peptide Sequence Number=SeqID_200133
atgtaccctctcttgtaccacaaaggatgtaccctccaatgtgttcagacaaagaattctcaagcggttagtcctttgaatctttgtaaggggaaacaaaagatatctcaggtggaaattggtaatcgattaccagagagtaaatactctgctttcttctacacatctcccaccaatgttgtaacaaagaaacaaaagaatgtttcatgtacaagtgagatcacatctacaagaattcaaggaggtggcagtaccaatgaaacacaacaatcatga

SEQ ID NO: 83356 - DNA, 282 bp, Glycine max
  Peptide Sequence Number=SeqID_200134
atgcctgatagcacgcagagactaacgtcatcttctgcaccttttgtcatccagggacagcgagtcaggtggtgggcggagataccttatggtcatccgcgcctttcatcgaccgaggggaatgaatttggcagtatcaggatgatgtttttcactctcgtcattcggaaacattcaagtctagcgacgcgcggaattcgtctttgctgggaagagatgattgggtgcaatggcaaagggaagtgtcgtggttgtccaactttgtcgttttcaaaacactaa

SEQ ID NO: 83357 - DNA, 417 bp, Glycine max
  Peptide Sequence Number=SeqID_200135
gtggattgtgacgaagaagaccgtgaagagcatacgtatagtggcgtacagggagcacctggaccgactccggattctggatgtttgttggatcccgtatggggagcatcgaccgagagggtcgtgcggaagtttggatacacacaggccattcctgctctgcttgtcgattcatgggtgtcgtatgatgatatacacgacaggccacgcatcagaccctccgcagccccgagtcgtcccttaggccccacatctgcgaggcccgctgtggaggagcctagacatgcagtggaagttttccatggaattgctgagaggttagagcgccatctgagtctaagggtgatcacgctaggctcatcaacacatgatgatggaagcttgcttgtggggcttctatggaggctggatctttga

SEQ ID NO: 83358 - DNA, 324 bp, Glycine max
  Peptide Sequence Number=SeqID_200136
atggtggttacgcaccgtctttgtttgcgtacttttaaagacggtgcttacggtgaaaatctttcagcatcaggatcagaaacaacacaaaatgataattggaggagctcaaatcccaaatcacatacctttctaactatgactgttgaggttgtggctaaaaaggagacacaagtagctgaggttgttgttgttgttgagacccagaaagaggagaaggttgctgaagaaaatgtggaaccaagagagtcatcagtggaagaatccaaacccaagatggtggacaaaagctcttcttccaaggaaaagcaactacctttctga

SEQ ID NO: 83359 - DNA, 378 bp, Glycine max
  Peptide Sequence Number=SeqID_200137
atggtttatggttttcaagaagagatgcggcttggtttccactttttagaaaaaagaatggagggtggacctgggatgatcacaactattatccaggagaggatgaatggtatagggttttccccggcggcatataagatttggcctttgttttcaccaatggttcttcctcacttcaaacattcaagattcaaagatgaccaacattgcagtcaccgtatagctaaagtgctagatccagatggtaaaattccaccagctcaaatttccaatatgttaaaaaggttaggactagtagttgcacctaggagaaagatgtgtgatgctgatgctgaaggacctttggcaagaaagccaaaagatctgttcatccaatag

SEQ ID NO: 83360 - DNA, 669 bp, Glycine max
  Peptide Sequence Number=SeqID_200138
atgacaaatgttttagcaaatgcacagcatttgaagcaagaggcagcaaacatgatgaagaagattggccttcttgaagctgcaaaacggaagttcttgggggaagggttgggggcttgctccattgaggaattgaaatggatagaacaacagttggagaagagtttgagtaatgttagagccagaaagatccaggttttcaaagaacaaatcaagcaactaaaagaaaaggaaaaagtcctacttgatgaaaatgccaagctcactgaaaatggcaggctctctgagaagatagaagcagtgccaaattatcaaggggacaattacatgggcaaaccagtgaggataaattgtcacaaggcgattctgatgatgaaatgctcagctctgttctcaagacctttgtctactagccctaatcagttagacgatgacaaaataacaggagctaccaatcataaatccgtgaatttggagggaagcctgttggttcagcacctattcaaggaccacagaagatgtagttacatgatagccaatgcactggataaggatggtaaattcactactgcccaagtctctcaaaaacttaagcagcttggtttgtatcttcctctgcccaaggatggtaaattcactactgcccaaggggtgcttctcctgaactaa

SEQ ID NO: 83361 - DNA, 612 bp, Glycine max
  Peptide Sequence Number=SeqID_200139
atgccgttagagggtattacagtggttgctgatcttgatgagacaaagatagttgaatattttgacaggaagattgctcctgtgcccaaggctgaggggactgagtacgtggcttcaaatcaaaagtctccatttggaccaacgttcacaggagcaacatttgtgcaaccaaatggactaggattcaagatcaatggccactctatcagttgggcaaactgggagttccacgtgggatatgatattagagccaggccagtgatttcgctagcatcaatttatgacattcagcagcaaagcggtgaattcgggtttggccaatccatggtgtcacttgagcctttggctgattggccatccaatgctgcatttttggatgcatattttgcaggagaagatggtgtgctggtaaaaaccactaatgcattctgtgtttttcagaagtatgctggggatatcatgtggcgtcacatagaatcagaaatccatgatgaagagataagggaggttaggcctaatgtgagcttagtggtgagaattgtctcaatggtgggtaactatgattgtatcatagattgggagtttaagccaagtggttccataaaaataggg

SEQ ID NO: 83362 - DNA, 219 bp, Glycine max
  Peptide Sequence Number=SeqID_200140
atgggagggtcacctccggtagtggaaggaaaggaaaaactcgatctcatcgaagagggattgagggtcgttgaaggattcggtgattatcctttcgaagacatgaccgacctgtgcctggtgctaaacgtcgtcatcccttcgaagttcaaggtacttgacttcaataggtacaaagggacgacatgtcctaagaatcacttaaaaatgtactgttga

SEQ ID NO: 83363 - DNA, 353 bp, Glycine max
  Peptide Sequence Number=SeqID_200141
atgagtgagatagaggaagtgcaagaacagatgaaggccgatatagaggccatgctaagcatgagacgaatgatggagagcaatgcggccacagttgtcgccaccagcgccgccgctgaggtggacctgactcacccatccgacataaaccaaacaagccgtccagtcctgtacatggtaggtcagggaggacaggtgttaggcagcacgggcggtctgcatatggtgcaaaataagaattctttcccaccgtacggcctacctcccaactatacaccacccaatccagtgcacgtgcccaacgagaacaccaaccactctattcccattccccttgaaggccaacaacccca

SEQ ID NO: 83364 - DNA, 189 bp, Glycine max
  Peptide Sequence Number=SeqID_200142
atggcgggtcacagaagctacacttctgggagatgccacacaggtcacaggcacgggctctctaacgtactcacagcacgagctccactacacataatgggcgttgccgagagagcaagagagagcgaagggcacaacaaagagaggggagagagcaaggttcagctatgttgtggaaagagagagtga

SEQ ID NO: 83365 - DNA, 288 bp, Glycine max
  Peptide Sequence Number=SeqID_200143
atggattttgtttctagaatgttaaaagtgtatcaacaattagttgaaaagacaaaatcaactcatggagctctggttgagaacaacaagttttgtctttcagtccattttcgttgcgttgatgaaaagaaatggagtgaactggcacgccaagtgaaatcagttttaaaggagtacccgaagcttcgacttacccaaggaagaaaggtgctagagatccgtcccactattaaatgggacaaagggaaagccttggaagttttattagagtcactaggtgagttttag

SEQ ID NO: 83366 - DNA, 873 bp, Glycine max
  Peptide Sequence Number=SeqID_200144
atgattaatttgaggaagcttgttcagaggtcactgtctttagaagcacttcgcaacttggtgcctcatattgaagccttagccttatctgccatgaactcttggggtggtgatggccaagtcattaacacatttaaggaaatgaaaatgtgggatagtgatagcaattcaacaacagaacaccacacaggccacattgcagaagctactaacaggccaagaagattttcttttgaagttggaatcctcacagtttttggccatctagagccgcgtttgagagaggagctaaagaagaattaccggattgtggacaatggttacaaatcctttccaatgtgcatcccaagaacacaataccaaaaggcactattggctagaaggagacttagcaagattatatgtgacataatttgtgagaggaaggagaagaagttgtttgaaagggatctcttgagctgcttattgaattggaaaggtgaagggggagaagtgttatctgatgaccaaattgcagataacattattggggtgctttttgctgctcaggacaccacagctagtgccatgacatgggttgtaaagtacctgcatgatgaaccgaaacttctggagtctgtaaaggctgagcagaaggcaattcacaagtctaatgaaggtaacctaccactgagttgggatcagactagaaacatgcgaattactcacaagatgttacaagtctctactgagtctagtggtttaagcaaagtgttagatgtgagtttgttgctagtgacttataatggcaaactgtggacttggtcaggttgtgttagagagtttaagaatggcaagcattatatcattccatttcagagaagcaatagctga

SEQ ID NO: 83367 - DNA, 312 bp, Glycine max
  Peptide Sequence Number=SeqID_200145
atgacatttcccgatgttaagaaacaaggaaaaaatagcacaggaagaaaactacacactactcattcgtgggaattgatggacctggaagagaatgatggggtaattccctcttattcactgtttaggaaggccagatatggtgaagatactattattgcgaattttggcacggaaaaaggtgtaatcactaccacttgtcaaaagcaaaaacaatgggaggtcttatggatagcattgtccttgactatttggaatcacaggtacagcttggtcttcaataaccagctcggcaaaatagtagtattttaa

SEQ ID NO: 83368 - DNA, 620 bp, Glycine max
  Peptide Sequence Number=SeqID_200146
gagacatattgagaggaaagaaggcttattttgcttcttcttccaagagtctacatgttttcttgagcttgaaagagtgttcatcttggactgagcttggacatttcgtgagttcatcaagagggatcacaattggttccccaagaatagtgcgtaggctcgagcctcctctttctttcttgtttgcttgtttgtacgcgtttgttaatgtacatggtgaggttgcattgaggaagtggatgattgataaagatacatgggggcgtagtgggcatagaggtttaaagaacctaggggaattagtgagtggtgactaccctgcatttggtgcactcatttgtttgctacttctgacaggctccaagactatgctttttgagttgggagatgaagggactcgcccctacaaccaacaacttttaggtactgacgatatcgagtacaccgaggcgtctatgggctcagtcgtgcatcaagtacacccagtggaggttataaaggatcgaggtgaccatttgaacatgtcatccaaggagatggaggagtatcaagaattactgaggcaattggaaccgaagtctaaggataagagtgacgattctttcgaggacatgtcttag

SEQ ID NO: 83369 - DNA, 210 bp, Glycine max
  Peptide Sequence Number=SeqID_200147
atgggtgaagtagaggaggtacaagagcaaataaaggccgacatagaggctgtaaaagagcaaatggccataatgatggaggccaagataagcataaagaagatcatggaagtcaatgcagttgcaattgccgctaccagcactattgcaaaggtaaacctgactcccccatctggcctcaaccaaatgaatcatccaacctcagatatg

SEQ ID NO: 83370 - DNA, 261 bp, Glycine max
  Peptide Sequence Number=SeqID_200148
atggctgcaatcactgtggtaggaaaccctcaccacaccgctaaagtgggcacgattgactactttgagtggtgcaatattgttaaaaattgggcaagatatcaaaagtttagaaatgagacatggaaagttgtgagtgacaaacaatccaaagcttttgaggacttttactcagatcttggaacaaagaatgaagaatgtaagacatataagcttgccaagaataaggaaaggaaatcaaaacatttggatcaagtatga

SEQ ID NO: 83371 - DNA, 219 bp, Glycine max
  Peptide Sequence Number=SeqID_200149
atggggattgtgagccacagtggaacttctacgcagtgtggccactatgttgctcacattttaaaagatggtagatgggcaattttcaacgacaacaaggctttcaacaaggtgaatatttcaaccattaagaggcgcaggtcgtttttgaatggccttaacatgccacctacttctgctgatgtgataatattcatgctacctttccttggtggcatg

SEQ ID NO: 83372 - DNA, 240 bp, Glycine max
  Peptide Sequence Number=SeqID_200150
atgctgacatcttcggaaagggtgcagatgaccacattggactttgcttgtcaatcggacttggggtctctgaatgacgaggtgcggataatgcaaagggtgtgtgcgggttaccgttgggtgtctccgcatgcaaccggactcttgggtcatggtaacaaaaggtggggtggtcgacaaaagcaaggcttttgctcctacgtatccttaatttgtgatgagaaactcagacctacgtag

SEQ ID NO: 83373 - DNA, 270 bp, Glycine max
  Peptide Sequence Number=SeqID_200151
atgaaagctgcaaagggtggatatgttcgtgctatgtacaatatctccttgtgcttctcctttggggaaggactgacacgtaaccatcaactagcaagaaaaaggatgaagcgggctgcggattgtggccgtagtaaagctcaatttgagcatggacttgctctcttttctacatctgttctgctaggaaactgggtatatgttgaaatatggggaaaactaaatatgggtgcagacttacaagtgtggggagatgctataatcttctaa

SEQ ID NO: 83374 - DNA, 510 bp, Glycine max
  Peptide Sequence Number=SeqID_200152
tgtaatggatttattctaaatagcattccagtttttgtaactgtgattacatttggagtattcaccttgcttggaggggatctgacacctgcaagagcttttacatcactttctctgttttctgtgcttcgatttcctctcttcatgcttcctaatactataactcaggtggttaatgcaaacgtatcgttgaagcgactagaagatttactcttagcagaagagagagtacttctaccaaatccacctattgagccaggattaccagccatctcgatcaagaatggatacttttcttgggatgcgaaggcagagagggcctcattgtcaaacataaatctggatatacctgttggttgcctagttgcagttgttggcagtacaggagaagggaagacatcactagtatctgcaatgcttggagaacttccaccaatggcagattcatctgttgttttgagaggaacagttgcttatgtaccccaagtttcctggattttaaatgcaact

SEQ ID NO: 83375 - DNA, 399 bp, Glycine max
  Peptide Sequence Number=SeqID_200153
atgaagattgattccatagtgggttgctaccttgatccccttgctgacaagatacccttcatggagtcacctgttagtgaagttggttccttatcaaaggttcaaaattcagtttctgaggtacatgatgatcttttttcatttgggactcccggtccttcgtggcctcccttgagagcatctagaaaccatgtggatggtcatcaaaccaagaccattcaccatgaaaacaatcatgtaattaatctaaagcattcctatcaagagggaaacaatattgatcatggaggtttgccaaaaaagttgtgcagcaagcatcaactacttgatgaatcccagaattgtgagttaagtggtgcattagaatctgacaattggattttaggaccatcaaaatga

SEQ ID NO: 83376 - DNA, 726 bp, Glycine max
  Peptide Sequence Number=SeqID_200154
atgaagattagtgtcatggctgaagcaggcaatacgacaaaagaaatctggagcgagagtaaaaacccaaaacacagtgactcaaagttctcaaaaccaccacgtcatcacacaagtggggaactgtcctccaaaaggcttgtgcatgtttatggtgaagaaagtgattggtgtgaggaaatgttaggtatagagatggaagatgaggtaaaggtagccaaagttggagaaagccaaagagaagattcttcaagaatttttccatgtctattctgttcaagaaagttttacagttctcaagctttagggggacaccaaaatgctcacaagaaagaaagaacagctgcaaggaaggccaagaaggcttctgagcactcatgtgtttccttcccatccccactgccaacacctatggtttttgctccaacccatctagacatcataaaccctgcgatgttcatcactgcccatgcagcaaaactccctcatttgccaagccatcaaatttcagaacaatttgggtcaaatggtgcacctagatttggcaatgcactattttacgggggaagttcaataaatcggttccatgatgatgggaagagctctaacttcagctgggggaacacatctcaacatatacaattgataagtaacaatcaaaatcttggaatttggaataatggtacagagaaggatcaaaagcttgatttatctctccatttgtaa

SEQ ID NO: 83377 - DNA, 123 bp, Glycine max
  Peptide Sequence Number=SeqID_200155
atggtggaccgaaagattgaaaaaaatattgttgacctgcatttatggatgattgtcgatagtagatttcatccacaaattggtcattggttagccgaagggtgttgtgcattcaactcttga

SEQ ID NO: 83378 - DNA, 435 bp, Glycine max
  Peptide Sequence Number=SeqID_200156
atgaaagttgttaacaattctttttccgtgattctaaataagccgatgtatggaaccctgcaaagacacggtgcatgtcattgtgagcgtcaggaatcctacaaagacatcgtgcgcgtcaggaatcttacagacactgtgcccgtcactaaacattgtgcgcgtcaggaatcctatagagacactctgcgtgtcaggaatcctgtcgaatcattgtgcgcatttggaatcctgcagagacactgtgcgtgtcagaaatcctgcaaagacattgtgcctcaagaatcttgtcagatcactgtgcagagacactacacgtgtcaggaatcttgtagagacactgtccaacgacattgtgcgcatcaagagttttgcagaggcactgtgcgcgacaggaatcttgtcggatcactgtgcatgtcaggaatcctgtag

SEQ ID NO: 83379 - DNA, 237 bp, Glycine max
  Peptide Sequence Number=SeqID_200157
atggtggagataatagccttgcaatggctctttgggccttcctcggtggctgcaaaaaagccaattgaagaggatagaaactctattttttgggacctaatgttgaatccaactcagtttcaagccaaagaagagaaggttaaagttgctgatgactcgcttagcgaggcaaatccgctcagcgagaagcatctgcttagcgaggcatccagccgcttagcggatgggaaaccctag

SEQ ID NO: 83380 - DNA, 531 bp, Glycine max
  Peptide Sequence Number=SeqID_200158
atggtgttgatagagcatgaagagagcaagcagagaaacgcgaacccctccaacgccgccaacgacgattccgacggcttcgaaaccgccagcgacaccgatctggccggtgaaggcgacgacagtggggccggcatcccggaagaacagaatcgcaccgaacagagtcataccgagaagcagacggagcaagagccggaacacgatgctcctcggagcagcgaatcatccgagaacaatgccctgatcagtgaagaagaatcgagacagaatattgaatgctattcatttatgagacagaaagcattgaatcaagcaaatgaagcaaaggtagaagggaataagctttttgtagaagggaagtatgaagaggcattattacaatatgaacttgctttacaagcagcaccagacatgccttcatctgtggaaatacggtcaatatgccattcaaaccgtggtgtgtgctttctgaaactgcttggtccttggcctttctttgtttccattcacttcagagttcagaattaa

SEQ ID NO: 83381 - DNA, 366 bp, Glycine max
  Peptide Sequence Number=SeqID_200159
atggcgcctactaggcaccctctggacccagataagtccaacagggccctggggtttcaggcactgatcataggcctctgccagtcctatagaggtgacgcacatcaggccgcaggcacaccgccatcgccttggcaggccgatcctgctgggccactgggcatggagtgttatctacagcatttggttctccagcaagcggccaaccaccagaaatttggggctgaggtcgcatggcctggagactggcccgatgcccaggcaggggaggagcctataggatcccccggtgaggcggatgaatcccatatggatgaagatatgactaacctgctcggtttcttgggagggagcggagccacctga

SEQ ID NO: 83382 - DNA, 2167 bp, Glycine max
  Peptide Sequence Number=SeqID_200160
atggaagcagagactttgaacgcaaatcaccctcccggttttcttcaccggtcgcttcctgctgttgtgcctatgcttttgatttcaataggatatgttgaccctggaaagtgggtggcaattgctgaaggaggtgcacgatttgggttcgatctgatggccttcacacttatctttaatcttgctgccatcttctgtcagtacatagcagcaaaaattggtgttatcacaggaaaagatcttgctcagatttgcagtgatgagtacgataattggacgtgcatgcttcttggagttcaagcagaactttcggtgattatgctagaccttaacatgatattgggcatggcacatggattaaatattctttttgggtgggacttgttcacttgtgtctttttaactgctactggtgctgttttccatctccttctttttgtcatccttgacattgagaaggcaaagatcctgggactgtttgtgtcaggttttgtatttctttcatttgtacttggaacactcattaatcaaccagacattccattatccattaatggaatactaacaaagttgaatggggagagtgcatttgtgctgatgagtctattaggagcaattcttgtgcctcacaacttctaccttcattcctctattgtacagtggcatcagggatcaactaccatttctaaggatgctttgtgtcataaccattttttggccatcatgtgtgtcttcagtggcctttatttggtcaataatgtgctgatgaatgctgcagcaaatgagttctacagtatgggtcttgttttgactacttttcaggacgcattatcgccaatggaacaggtgttgcgtagtccaatagccatgcttgcttttttactcattctgtttttttcaaatcaaaccacagcattaacttggagtttcggtggagaagtagtagtgcgaaatttcttaaaattggatattccgggttggcttcattatgctacaattagagtaattgctgttctgcctgccctttattgcgtttggaattcaggagctgaagggatgtatcaactacttatattcactcagattgtggtagctctgcaacttccttcttctgtgatccccctttttcggatcgcctcatctagatcaataatgggggtacacaagatccctcaatttgtggaatttttggcattgatcatattcattgggatgcttggcttgaatattgtctttgttgtagaaatggtatttggcagtagtgattgggtgggcaatttgagatggaatgtggagactggtgtgtctctctcttatttggtccttctgtgcactgcttttgcatctttctgtctgatgctttggttagctgccacacctttaaaatctgcaagtgttcaattggatgatcaggcatggaactgggacatgccacaagccataccaaagtcacggattgataacgaggaaacagatttaaaagaaacaagatatcatggagatgcatcagttcaggtgaaggaaccatcaccagttctagcaaggaccctggaatactcagatgtaccaattgcaagttttcatcatgatctacctgaaactatcatggagcctgatgttcctgtgactactgtaagggagactcatccatttacatcatttcctttctccccaacttctgttgttaaggaatcagcttccacttcagaatcagaggcagtaccagctgtaagtaatgagacttctgatattatattgggagattccaaaactttgaaaacagaaactactgcccctgttgagaaaactgtagaagttgagggagattcaaatgccgaaagggatgatgattatggagattcatgggaaactgaagaaataccaaaagtggtctcactagccccatcttcagcatcagatggcccagcatcattcaggagccttagtgggaaaagtgatgatggagggaatagcattggaagtctttcaagattagcaggtttagggcgcggtgcaagacgtcaactagctgctattcttgatgaattctggggacaactttttcatttccatggtcaatttacccaggaagctaaggccaagaaacttgatgttttactgggagtagattcaacactcactggttctttgcaaaaaatggattcat

SEQ ID NO: 83383 - DNA, 652 bp, Glycine max
  Peptide Sequence Number=SeqID_200161
atggcaaaagcagaacatcctcggagaaaactcgttataaagattttccctccaggttctaaagtttcttattcttgtggtaccaacactccaaaagattcaatagtgtccaaagtgtgtgagctgaagaataagaagggttattatgcgatgacaatgtgggttaacaccgaaaacccatcagaatcttgtgtcactgattcaagaatttcaagaaccgaaatggcaacatgggttaacactaaaaacccgtccgaagtatgtgagtcgaagaaaaagaaggaggatagtgtgcgtgtggagtgcaagaacagagagaagaagaagcgaaaggtggagcacgtaatgacgatggaccgttgcaagaagatgcaatgctgggcgatgttgaagcgtttgatggtaggaagagatgcatgggctttacagaaggatgttcttcatcctaagattttttacgttcttgataagtctgaagccatgaaaaagccaaagggtttggaggatattgagtcaaagttgaagaattcggattactcagaagcttatgagtttgttgatgatgtgaggcttgtgttgtcttatgcattgcaataccctccaaggagtgaggttcatagaactgcaacaaggatcaccgagggttttggag

SEQ ID NO: 83384 - DNA, 513 bp, Glycine max
  Peptide Sequence Number=SeqID_200162
atgattaaagaagtgagaccccatggagcagtggagatgatggaccctacaacaggcaaccttgaaaagatatggatcgtcaatggacaacatctgaaaatttacagtggcggacaattagaaaggctgacaagcattcagaattcctctctgttcccactcactaccttcattctctcaaagttcattaacgaaaagatggcctcatggaaacgccgagtagtgcccgcacaaggaggggattcgacttgggattcttcttgctttacttttgaaactacttggcaccggtaccaagacaacgttcaccttcagaacattctaccaaagaggaacatggagcttgccctggccctaggcacacctggtggaggttttgttctgaacgttgatggtgccccatggaagctgttgaggaaggatctaactacgctcgcacagacatggagcgtactttcttactttagtcttgctcttacttctcacatctctgaccttgttttagggttctaa

SEQ ID NO: 83385 - DNA, 820 bp, Glycine max
  Peptide Sequence Number=SeqID_200163
atggccgactccactcgctccaaatcagccatggaccgtttggaggaagctttcaccaaattagcctcgcatgttactgagaaaattgatgacttgctccttcgtgttgctgccctggaaacccatgctcaccattcaccatctccgtcatcttcctcagccatacctattccaaacccatacacacttagccattcccaaatgaagttggttgtcccacgatttgatggttcagatccttcaggttgggtattcaagataacccaatttttcgaataccatgctacccctgaacctgaaaggcttaccatcgcctcgttttacatggaggggccgaccttggtgtggtttcagtggatgatgcgaaatcaccaactcaccacttggcctggcttcttccaagccattgaggctcggttgcctccttcctttcttttgagctgctttgtctcgggtcttgatcccgatatccgccgagaagtgcaagcacttcagcccatgtcactagtgcacgccgcgggattggctcgcttgcaggaggaaaagctcttggagggtcatagagctccgcacagtcgagtctctccggtgctcaacccttactcaccctcgcccacccctgttcccttacccaaccctaatctttctctctcaccctctccacctaaatccccacccctcccagtacgccgcctcatcccagaagaacttgcaagccgtcgtgaacgaggcttatgcttctactgtgatgagagatttacacaaggtcatcgctgtgcttcgcgattttctctcctcgtcaccgataaagaacaaccaa

SEQ ID NO: 83386 - DNA, 1548 bp, Glycine max
  Peptide Sequence Number=SeqID_200164
atgacatttagaacacaccatggccactatgaattcttggtgatgccatttggcctttgtaatgcgccattgtccttccaggctactatgaattcgacttttggtccctttttgcgaaagttcatcatcgtcttcttcgacgatattttgatctacaacaagatcttttcggagcatatcaagcacctacaaattgcttttcagactttgcaagaccatagcttcttccttaaattacccatatgttcctctgcaacccaacaggttgaatatttaggacatattgtttcagaacagggggtcgaacctgtcccaaccaaagtaatagcagtgcatcaatggccgccaccaacgtctatcagagttttacgcggctttctaggactctccgggttttatcgctgttttattaaaggctatgctacactcgttgcaccactcactgccctgttggccaaggattcattccattggacgcaagcagcggaccaagctttccgcaagcttaaggaagctctctgcacaacaccagtcttaaggctgccggatttttccttaccctttatacttgaaacagatgcatcagggactggtatgggcgttgtcctctcccaacaacaccatccaattgcattttttagcaaatccttctgcctgaagttgctttgcgcctccacatacgtctgtgagctggcggtaatcacagtggcagtgaagaagtggcgtcaatacttgttgggtcaccatttcaccatcttaacagaccatcgaagccttaaagaacttatggcacaagcaatccaaaccccagagcaacagacttatctcgggcgtttattgggctatgatttcaacatccagtatcgtgccaacacagcgaattcagcagttgatgctctttcccgtcgtccggagcttctctctggcgaacttttaatgctaacaattcctagttgtatttttttgcaggacttgaaggacaagctgagagcaagtcaggagtttttgtatttcaaacagcgcattctagatgatccccaaactcatcctgattgtcttctccggcaggacttgattcttcaaaatgggcgcatttggctaccccgaaatgcaccgtcaatcccaacaatccttgctgaatttcattctacaccaacaggagggcacatggggatgacaaagactttagctagagttcccgacaacttcacctgttccaacatgcaacaagatgtccgcaaagggcactcggttatcctcgtagtggtggaccgtttctccaaaggggttcatctcgaaatgttgtcaactcattacacagttgccaatgtcacaacaacgttcatggagatcgccgacaagcttcacggcatacctcaaagtctacaactcttcaagctaagtggtacaaagcttcgcatgagttcggcttaccatccccaaacagatggtcaaaccgaagtcatgaatcgcgtaactgaacagtacctcagggcattcgttcatcaacgaccatcgacatggggacgtcatctgatttgggcataa

SEQ ID NO: 83387 - DNA, 315 bp, Glycine max
  Peptide Sequence Number=SeqID_200165
atggcggaatcgagattggagaggagatcgaagtacaggagtggaaactctaaatcccaaaccagtgaatttgtgagagacaaagagagcacattttcttcctctataatttcgagcgggttggggtcggggcggatatcagtaatcccatacccgcccctgctcacgttttcagttatcggggaaaacccgaatccgaccccgaacccggtcaacacggtttttatccgtcaaagtcggggcaggttcgatttggttcccacgaggttggattccactgccatgcctactcagactcacgacaccgtaatgtaa

SEQ ID NO: 83388 - DNA, 886 bp, Glycine max
  Peptide Sequence Number=SeqID_200166
gtttgtcgtgcgtgacgccgagcagggtgcagacggtgccgcacaggtcggtttgctgcggctccaggtcgggctgcagcgagaagccgcggccaaaaacaaacagcggcacctgcgtctcttccggcagaataccgccgtgcgagcgatcgtcgttcatgccgtggtcggcggtgaccatcacctgataaccggcggccagccagccgggcatccactgcgacagatagccatccgccattcgtgcccggttacggtactgcggagaagacaggctgtgcttgtgcccggcatcgtcgatgttcattgggtgaatcagcaggaaatcgggatcgtgctgcaggcgcaggctttcggcatcctcgaacagatgcgagtcggggtaaccgtcgtcccagtagaaatggccgtactggatcggcaggtcgggcgcgttagtgtggcgatcgcgcgcagcgttgaacggcgagcggttatacagttcgctcacccagtgataagcggcagcggcggtagtgagtccggcgtcgcgcgcgtagtggaagatgctgcgctgattgctcaggcgattgacgccgttgtgaatgatgccgctgcgcaccggcggaatgccggtcagaatgcattcgtacagcggacgcgacagcgacggcagttcgcagatagcccatggcgtgctgcgccacctgattactcagcccatcgagtaccaccaggattgttttcatccccgctccctcaggtgcgcatgaatgcgcaccctgtaaaaattggtgataggtaccggcgcaatgtattgcgcattgccggaaaacggatgcgcgatacatcgcgccgctacggtatgtgcgactggcagaacgtttgcgttactgcttcatgttaa

SEQ ID NO: 83389 - DNA, 438 bp, Glycine max
  Peptide Sequence Number=SeqID_200167
acttatcaaggtaatccttgtggcgtctaccctgacttatcttccttaatcggaagtggcgtcatccaaacctctgtagcctgtatcaagcgatccgctcctactcagacttatcaaggtaatccttgtggcgtctaccctgacttatcttccttcactggaagtggcgtctacccagacttatcttccttcattggaagtggcgtctaccctgacttatcttccttcaccggaagtggcgtatgcccagacttatcttccttcaccggaagtggcgtctacccagacttatcttccttcatcggaagtggcgtctaccctaacttatcttccttcactggaagtggcgtcatccaaatctctgtaacctgtatcaagcgatccgctcctactcaggttcacatcatgggcctagcctctactcgcgtccgtccctaa

SEQ ID NO: 83390 - DNA, 147 bp, Glycine max
  Peptide Sequence Number=SeqID_200168
atgggagaaagaaaaagagaaaagaaggaaagaaagctcctgatcaaggatcggaaaaacagaagaaatgtgcagaaaggtctttggaccggacaatatctgaacaatacagaattgtcaccaaatgtacaccccaaagaaggaaag

SEQ ID NO: 83391 - DNA, 501 bp, Glycine max
  Peptide Sequence Number=SeqID_200169
atgtgccgtgtcagtagtcttgtttcgcgtaaacctgttctcattcactacactccacttctctcttcgccgtcgatctcacccgccgccgcacatggccgaatcccacagaacccgaccctcccaccagcagcccagccgcctgcagagtcgctccccgttgttgtttcagataaaccgtgccgtcgagtgaaacgtcgctatccccctgttgttcttgctggtctggtcaccccctccgccgctgccgaaggacgagccgccgcagccgcagcaacaacgcccgccgaaaaaagttgtcttcaaaaagtaaggatttcagtcacctactctggttcactcttcattcactgttgtgtttcgctctcactcatctgtgagccatctgcagtgaattggtcatcccatcatgtgctacttcattataccaggttttgggtccaccactccgcgccactatccaagattaactactctgatgctaagttgaatatacaatag

SEQ ID NO: 83392 - DNA, 387 bp, Glycine max
  Peptide Sequence Number=SeqID_200170
atggctaaatttgtggccacaagggaagaaaactttatagaggttgaagctcatgaggaaagtcttgtaaaagagcatgattcaagagaaaaagatgaagaaaaaagtgaggagagaacacaacaacaattagagaagtgctcacaagtagaaattcaacaagaaagtattctccaagtcaatacccctgctcatcaactgattgtcaaggaagaaaggcatggagaacatgataaatctttaagtgtcattctctccttgaccaccagcacttcccttgcaatgatatggaagatgtttccgggatacataggtttcatggagtctctaactaagaggcgaaaatgcaaggaagatgtgttctatatgaccttcatgccaccttga

SEQ ID NO: 83393 - DNA, 552 bp, Glycine max
  Peptide Sequence Number=SeqID_200171
atgcatgggcttttacagaaggatgttcttcatcctaagattttttacgttcttgataagtctgaagccatgaaaaagccaaagggtttggaggatattgagtcaaagttgaagaattcggattactcagaagcttatgagtttgttgatgatgtgaggcttgtgttgtcttatgcattgcaataccctccaaggagtgaggttcatagaactgcaacaaggatcaccgagggttttgaggtcaattggaaaactatgaaggagaagtggatgcgtgaggaagaagagacgaacaagatttgcaagagggaattacatgtgtgtccaaatgaaggaagtcaagtctttcaacttgtattatcttatgcattgcaatacccttcaaggagtgaggcatacagaactgcaacaaggatcaccgagggttttgaggtcaattggaaaactatgaaggagaagtggatgcatgacgaaagagagattaaaaagattttcaagagggaattgcatgtgtgtccaaatgatgatgatggtgaagttcatgggaagtga

SEQ ID NO: 83394 - DNA, 363 bp, Glycine max
  Peptide Sequence Number=SeqID_200172
atgtttgccaccactttcaacactcaaccatctgcatataatctagcaccatcgagttcttgttatcgttcatcattacctactcaaatacgtgacaagagtcacgaagatgaggacgaggatgaggataacgacaataacaacgatgacgataatgatggtgaaggtgatgatgatgatgacaaaggtggtcatcatgtttctcaacaacaatggacaattacatgtgagcatcctagaacaagaggaggtagaggccgtagaccaagaggacaacaaacacagacaaagccagtcaaacaagatgagagacccagacgcatatctagaagaacttgttgtgggacatcgtctcattattag

SEQ ID NO: 83395 - DNA, 306 bp, Glycine max
  Peptide Sequence Number=SeqID_200173
atggataagagggagagtaggattgaaatgtgtgcatccataatggaattgattatgactgcatttatgcagatgggaagcaattattggatttcatgggctacaaagcagaaaggcagggtcaacaacaaacaacttatgggaacatttgctcttctatcttttggtggcaccatcttcatacttggaaggattgttttaatggcagctaatgctatggaaactgctcaacacctttttcttggaatgatcacatcatttttcagggcacctgtttcatattttgacaccacaccttcaagctga

SEQ ID NO: 83396 - DNA, 429 bp, Glycine max
  Peptide Sequence Number=SeqID_200174
atgaggtctttcaccaaactcatttatgaaaggatattggtcaatttgtcgatgatagatccaggcagacacatgaataatttgaggctagattatctccaactagaccctgttgaagaacaaagacttaggagtcagtgttgggttgcaattgcgggaccgaagcgtaagggatgcctttatggtattagagaccttgctcatacttataaatatggagatgagaacttcatgcagcatattcaaggatattccagtcgcgctcaagatgccacagagattaacctattgagggaggaacttcatcaatcaaaggaggagatgaatgtatttcagtcagttgcccttcagttcctacctcctgaaatacgaaacattattcatcaatatcaacaaccttaccagcaacatcaggaccaacaacagtag

SEQ ID NO: 83397 - DNA, 195 bp, Glycine max
  Peptide Sequence Number=SeqID_200175
atgaaaggtgcgggaaacaataataagaatacaagaaaccacaaccattcctcaatggttaagatggaactggcccaacactgctcacaacaagagcgaagatccaacaagctcatcacaaaagctcaatggcaaaagctcaatgtgctgaaattgggtctagcaggttcccagttgaataatcaccagctgtag

SEQ ID NO: 83398 - DNA, 408 bp, Glycine max
  Peptide Sequence Number=SeqID_200176
atgatggtgatgataacaacgacaatcatgttggtggtggcgacagtagtcatggtggtggcggttgacaatcataggggtgattgcggtgttggccatgatagttgtggcagtaacgatcatgatagtgacggagtcatgccaaacctttttcacccactctcagtctattcgttccacaaacccttttcactagagcgctctgtatcaggccctctgtctcgcgtccactctcactcccactcacagccagtctcgctcccactcacagccaatctcactctcggtggccactctcgaaagcaattgtatcctgtgaggtgtgatttgtcagctgctacttctttctacaagatcgatgtggatggaacacttaccatagtttctccctctcatgcaacaatgtag

SEQ ID NO: 83399 - DNA, 303 bp, Glycine max
  Peptide Sequence Number=SeqID_200177
atggctggaacaactattgtcaaccacattcttcaccatgtgcgaaaaccacatcaacacacccagaaacgaatgcaacatataaggagatcgtcctatcatgatgttgtgagggtagtggagattcagaaggttttggatatcagtggagttcagacgtatgtgattaacagtgctagagttcttttcctgaatgagaggcctcagaatcagcctaagaccaatagtgttgttggaaaaggaatctcttggacccttttcgtttctgttctttgggatgcaaggttcgtctctcatcattaa

SEQ ID NO: 83400 - DNA, 1356 bp, Glycine max
  Peptide Sequence Number=SeqID_200178
atgaaggtgctgtctccaaaattgttcactctcagtattctgctcgcggcgctggttttagcttccgccaacgcagtcagcggcaatgagatgcagaaacatgaagccacggaatcaagggatgtggttgaagaagagaagttgcaagtgcagagcttgaagaattcgtcaatggcagaaaggtcagggagtgctttgaatgaacatgcagttgataatccagaggagattgcttccatggttgatgagagcatacgcaactacacggctcgaaggaacctgaacttcttctcatgcgggtccgggaacccaatcgacgactgctggcggtgcgacaagcggtggtacgcccgccgcaagcgcctagccaactgcggcatcggtttcggccgcaacgccatcggcggccgcgacgggcgctactacgtcgtgtcggaccccggcgacgacgacccagtcaacccgaaacccggcaccctccggcacgccgtgatccaggaccgccccctctggatcgtgttcaagcgcgacatggtcataaccttaaagcaagaactcatcatgaacagcttcaagaccatcgacggccgcggcgtgaacgtccacatcgcttatggtgcgtgcatcaccatacagttcgtcaccaacgtgatcatccatgggttgcatattcatgactgcaaggtgactgggaacgccatggttcggagctctccttcgcattatggttggaggacccttgctgatggagatgggatctccatctttggctcgagtcatatttggattgatcataactcgctgtcgaattgcgctgatgggcttgtggatgctgttatggggtccactgctattactatttccaacaattactttacccaccacaacgaggttatgctactgggtcacagtgactcttatgtccgcgacaagcagatgcaagtaaccattgcttacaaccattttggggagggacttatccaaagaatgcccaggtgcaggcatgggtatttccacgtggttaacaacgactatacccactgggtaatgtatgcaattggaggcagtgctaaccccacaattaatagccagggcaacagatacctcgcccctctgaacccttttgctaaagaggtgacaaagagagtggacacggggtcatccgtatggaaaagttggaattggagatctgaaggagaccttttgctcaatggagcctttttcacttcatcaggagcaggagctgcagcaagctatgccagagcctcaagtttgggggcaaaatcgtcttctttggttggtaccatcacctctggagctggtgttcttaactgccgcaggggtgccatgtgttaa

SEQ ID NO: 83401 - DNA, 852 bp, Glycine max
  Peptide Sequence Number=SeqID_200179
atgtcattacagttccgctttgaggttccagatccgttgcacttgtccgagtccatcctttacgcagcaaggggagctgaacaccaccgtcacacgcggtgcgctccaggagatcggaattgccacgtggaactccacatagttcgcgagcaagggggtggaggaagaaaaaggagcatcctagggttgctgtcacagcttgagtcgccgattcaacaccggcaggcggtggctgctagggtcccgatgcggtttggcacgggggagcggaggagaagagcaacgatagacttgaaacttgttttattttttaaaaacaataataaatatagtggcaggccatacattttaatcagcaacaaaatctttcttctactgtcaagagttatttttagagatcattctggtggctggagtactggcttctgcttcaagtcttcaaatctatcaagcttatcgataccgtcgacctcgagggggggcccgagtgagctaactcacattaattgcgttgcgctcactgcccgctttccagtcgggaaacctgtcgtgccaactgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgatcggggcggagatttcctggaagatgccacgaagatacttaacagggaagtga

SEQ ID NO: 83402 - DNA, 336 bp, Glycine max
  Peptide Sequence Number=SeqID_200180
atgtggaaagttgctgaagaagaagacagggtggatgcagacgcctctcaagctgagaagagaaccaaaaagaacatggatgcacctttgtccaaggttgcccctgtaccactgtgttcaccaccttctctggttgctccgaaggcaataagtgcaatgtaccatcttggcgagattgatgatgatgaagatgacttagtgttcagaaaaaggaaagttgcaccaccttcggatgaagccactgtgcctcaaatgaataaggtcaaaccaactccacaggttccacctccttcaactcaaactcgcaccgacaagcgagagaaaagaggtgcttaa

SEQ ID NO: 83403 - DNA, 114 bp, Glycine max
  Peptide Sequence Number=SeqID_200181
atggcctcctatggtgtgttgcctaagtcttgggtgctgcccgaggtggatgtggtggatctcttgtcagaagatgaggtagaggacctagaggaggacacttcgtatgaatag

SEQ ID NO: 83404 - DNA, 387 bp, Glycine max
  Peptide Sequence Number=SeqID_200182
atgagtcacactcaagaaaactgttacttactacatggctttcctgaaaaagtagcacaggtgtctaagtcagaaaaatcggagtccggattctctaatgaagagtatcaggagtatttgaggctcaagtccgagaagtccagcaatcaagcatcatcctcatcggcaccatgtttttcaacaacttgtgtttctcaatccattggaagtcctagtccttggatactcgattcaggtgcctttgatcatatctctggtaacaagtcctccttctcatccatttcttttccaaaagttcctcaccttgttactgtagctaatggttccaaagttgcatctcaaggaagtggaacatgggacgggtcgactgattggagaaggacgtga

SEQ ID NO: 83405 - DNA, 528 bp, Glycine max
  Peptide Sequence Number=SeqID_200183
atgggtgaagcagaggaggtgcaagagaggatgaaggccgacatggaggccatgaaagagcaaatggccacaatgatggaggccatgatgagcatgaagaagataatggaagccaatgcggttatagttgccgctactagcgttgtcgctaaggtgaacccgatgctcccatctggcctcaagcaaatgaatcatccaacctcaaatatggtaggcaaacatgaaattccccaccacgatctagttgacttcgagccttggctcggatatgccactgaagggcaagcagttggtggtatatcctttgaaaacactttggagggccctcagtttcgcccacaaccacacccattgcattttgcggtgggaagagcccctcctgctatggccgaaaagggaatggcggatcatctaaaggaaaggctcagggccattgaaggaggcgaagattatgcctttgctaacctagaaaagttgttcctaatacccaaacatggtcattcccaagttcaaggtgctggactttga

SEQ ID NO: 83406 - DNA, 279 bp, Glycine max
  Peptide Sequence Number=SeqID_200184
ggttgttcatgtgtcctccactttcgagtttggagctgagtttcatgattgcctaagtgcggaccctcaaggcaatcctccatactccacctttgtcggagcaccatgcatgtcattgcctagcgctgttcatgtgtctccattatcaagtgcaaagcttctggtgactaggaagcacaagaaaaaagaaggaatggagacgagagtcatcatcacagaaagggtaggacggacgaaatcagtgtcctatctttgctttcctcttatctccgatgagag

SEQ ID NO: 83407 - DNA, 318 bp, Glycine max
  Peptide Sequence Number=SeqID_200185
atgtctcttgcaactctttttggaaagcttcaaggacacgaaatggaacttatgagactaaaccaacatgaagaaaatgacaagaaaaagaaaggaattgcacttaaagcctcatcttctattcaagaagaaagtgacaaagaggacttgaatgaaataggagaagatgatgatttcagtttcttctgctatgaatgtaatcaacctggacatctgagagttgattgccctagtttcaagaaaagaatggaaaaatctgataggaaaaccttcaaagataagaaagcaaagagaagcttacatcacttgggaagataa

SEQ ID NO: 83408 - DNA, 273 bp, Glycine max
  Peptide Sequence Number=SeqID_200186
aggcgtcaaaatttcaaccatggaaaaagattccaagaagactctccaactcttagatgctacaagtgcaaccaacttggtcacatcaaagcaaattgcccctcaaacgagcaatggcctgagaggaatgagaagaaaagtcatgaagaaagaagatccaagaaggcgtatattgcatgggatgacaatgactcatcagatggtttggagaaggagattaaccttctatccaaggactatgagagcgatgagaacatctctcaagaagactaa

SEQ ID NO: 83409 - DNA, 555 bp, Glycine max
  Peptide Sequence Number=SeqID_200187
atggcagatcaaggagaatgggcctcattcattgatgttttagcgttattggtgtttggagtcgtcctctttccaaatgtggatgggctagtagatctagtagcgatcgatgcttttcttgcttatcaccacaataaggaaagtctgattgttgttgtgttggtcgatgcttatgacacatttggccggagatgcgagaagagcggagcaaggattgtctattgcacacccgctctttatttatggttggtttctcacattttccaccatgaaagtagacccacctgtttcctacaaggtcaccgcatgtgtgccgagaaagggaaagcaaattgggagcaactcttggctggtatggtaggggcatccattaattggttcctgtcgcaacgtgcccttcgtgggcgagcgagggcgaggctcacgggtgcgctttccaaaggaggaaagatgcgcggagtcgccacaaaggtttatttgtggaaaacgtcggaaaaaccgaaggaaaccggtcaaaacaaaaattctaagtttgggagttgcatttacgcttga

SEQ ID NO: 83410 - DNA, 747 bp, Glycine max
  Peptide Sequence Number=SeqID_200188
atggagcaaaacccgccgtctccggcggaagactcggcggcggcggcgccatcctccggcgaagcaaaaccttccctcttccctctatttcctctcacagcctcctcctctctccaaaccaccaccacatcctccactccccaatggctcagcaacaccagcttcaccaccgacatctccgttataaacgacgccgtggcctcgcaactcaaccgcgaaatcacgcagtcgccgccacaagacgacgaggacgaaaatcgcgcccaggcgaatcccctcccttcttctaggtacgagattctggaatcttccgaatcggacggaggcggaagagatagagagaggaagaagagaaagaagaggaaaaagcggaagtgcgattcgtctgtggagagaggcggattccatggtttcggttcgagaaagtcgcgcgttcgagcttgggcggattcggaggccaaagttgccaaggattattacattgattctcacggagatcgcgacaatctcgcgttcggatgtatttacagaatggtggtgcttacttcggtcctgttagcgctgttgatgaatttattgggatctccgcctcgagcggaagccattatcatccacaagtatttcatgatgatcattagagttcacatgctctatatatttgcatcgccactctacccatgggacacgccgcttgaatccaccacaaggaacactttcgctattttactcatccgagtcgatcactaa

SEQ ID NO: 83411 - DNA, 2445 bp, Glycine max
  Peptide Sequence Number=SeqID_200189
atggatattgccctatacaggccttacaatccattgaaactgtctgggctacatgttcgaggtttgtattggtggaatcggagtggttcactattggaaagagatggtgatattgattcattggatgctaaaatgaaatctgctggtcgttactgttctggaaaatacatggctttggaacgacataagagctttaagcgtattcgtcttgttgctccagaatcgtctcctgtctctatgcaagatgagtttatacctttgtcagaaacagatgccggggcatctcatggagctgttgacagtgatttggtctccaaaacttcaacatcactcgaagaatcttgggaagatgaaacgttaaacaaaactagggagttcaacaaactaacacgggaacacccccatgatgaaaaagtttggttagcttttgcagagttccaagataaggtagcagggatgcaacgtcaaaaaggtgctcgcttgcaaactcttgaaaagaagattagcattctggagaaggcagttgaccttaatccagacaatgaagagatattgctttgccttttgaaagcttatcaaatgagagacagctcggatgtgctaattgcaagatgggagaagatacttttgcaacattccggaagttataagttatggagagaattcttgcacactgttcagagaaatttctccagatttaaggtttcagaggttaggaagatgtatgcacatgcaattgaagctctatctgcttcatgcagcaagcactctaggcaggttcttcaagctactgatccttcttcaccagatcctgtatttgttcagttagaacttggtcttgtggatatatttctaagtctttgcagatttgagtggcaggctggttatagagaattggccacatctttatttcaggctgaaatagagtttagtttgttttgtcctcctttgctgctcactgagcagagtaaacacagactatttgagcatttttggaacagtggtggtgctagagttggggaagaaggggctctcggttggtccgcatggttggagaaagaggaggaaactaggcaaaaagttatgaatgatgagctctcgcgtgaaaatgaaggtggtggttggactggttggtcagaaccatggtctaaagataatgagggtattgtcaatgttgaaaatgaaaccatcaatgatgtggttatggaggatattcaagatgaagaggaatacaaagaagttgagccagaagttgatactgaaaatttgctgaagatgctaggaattgatatgaatgatggggatggtagcgaagttaatgacacttcgacttggatcaaatggtcaaaagaagagtcctttagagattgtgatcagtggatgcctgttcgcaggaaatcaggtacaacctctcttgctaacgaaacacacaaaacagatgaggatgaacaactcttgagagttgtattgtatgaagatgtgaatgaatacctgttctccctgagcacaacagaggctcgactatctttgttatcccaattcattgacttctatggtgggaagatgtctcaattgttttgctcaaacagtccaacatgggctgacaatatccttagtttggaggatctgccagattctatgttagagaagttgaaatgcatccatgaagttttgactaaaacacagaacagtcctactggttacagttttgaatatctatcaggaagtttctcgaggaatgctgattttatgaaatttatacagaatgctgtcttactttgtttaaccgtttttccacgtaattacatgttggaagaagctgttcttatttctgaagagctttatgttacaaaaatgaattcttctggtatggttacaccatgtcgatctttagcaaaatctcttctaaaaagtgatcgacaggatgtattgctatgtggtgtatatgcacgaagagaggctacttatggtaacattgatcacgcaagaaaagtgtttgacatggcattgttatctgtagaagcgcttcctgttgaactacagtccagtgctcctcttctatatttctggtatgctgaggtggagcttgcaagtactgctaatgatcgtgaatcttcatctcgtgcaatacatatattatcatgcttaggaagtggcacaaagtacaacccatttaaaagtcaagcatcaagtttgctactgcttagagcacatcaaggatttaaagaaaaattgagaacagtatggtcatcttgggttcgtggcataataaatgaccagtctgtagctctaatatgttctgctgcattgtttgaggagctaaccactggatgggatgtgggcattgaagttttgaatcaagctttttcaatggtgcttccaggttatgtctcttcagtaattgatcttcttttagaaaacatgggacctttaagacaagtgtga

SEQ ID NO: 83412 - DNA, 2446 bp, Glycine max
  Peptide Sequence Number=SeqID_200190
ggcagaaaacagtgatgttagggcatcagtaaaagagcaagtggatgaagtgggaagagctctttacctaggaaagttgcaaggcagttctggcagcttaagttttcctcttgcaccagaaaatcagaaggaagagtttcctaggcttcctcctgtaaagataaagtcagaagataagccttttacttttaattggggggagaagtttgagtgtgatggacttgctgtgaaactcgctggtgctgacaacaccttacttattgggtcatatctggatgtccctattggacaagaaattaaaaatacaggtgtgaggaaggctatagggggcagttggttgtctgtaagtcatgggattacagaggatacatctgatcttgtatcaggttttgcaacaattggggatgggttgtgtgaatctgttgattatccaaatgaatattgggactctgatgaatatgatgatgatgaagatgttgggtacacgagacaacctatcgaggatgaggcctggtttttggcacacgaaatagattaccctagtgacaatgaaaaggggactgggcatggaagtgttccagatcctcaggaaagaggtccagccaaagatgaggaggatgatcaatcttttgctgaggaggattcttacttctctggtgagcaatatattctaccaaaaaatgttgagccggtcactgcttcagatgatcctattggtctaacaattactgaaatgtatggaagaactaatggtaatgatgtaatgcctcaatatgatagacaattgatggatgttgaagaactgaatctgatgcatatggaacctgtcaggcagggctttgtcactcacaaaaatgatctcatcatgatgggagatgggaaggttctgaatcatagtgcgaggtcacgaattgaggacatggaagatgatcaacatggttcagttagatcaattggggtggggatcaacagtgatgctgctgatattggcagtgaagtgcatggaagtttggttggtggtagcagtgaaggggatttagaatatttccgtgatcatgatactactacacacagtttggataagaattctattaacaaatcattcaaaaataataagaaaaatgacaagactgagtcaaataaatatgtcattgacagtgataaagatgcatgctcacagataaaagcacatactgatgggaacttctcatttccccaatctcttagagatagccagatgattcatgctggctccagtaagaccctatggtcgagtaattgtaatgtagaagaagcagatgactgtattaatgcatttgtgggatctgatgacatgcttacttcatggaagaggaagagtagtgattcttcgcctgttaaaagttctagggatgagaataatgctattgcggtaagatccagaaactcttctccaactacagtctcgaattatgggtatactgatggagagcttgtcaaactagaaaaggatgaaaaagttagcattgtaagggaagatgatctaggtgcatcactagaggatgaagaggcagctgctgtgcaagagcaggacaagaatttccatgttgttttaaattctgtactagctgggcgctatcatgtcactgagtatctgggatctgctgcatttagcaaagctatacaagctcatgacctgcacacaggcatggatgtttgtgttaaaattataaagaacaacaaggacttctttgaccaaagccttgatgagatcaagcttcttaagtatgtcaataagcatgatccttcagacaagtaccaccttctaagattgtatgattacttctattatagatcaattaccattcagtgtttggaagcacttcagtttttgcacagtcttggactaatacattgtgacttgaagccggagaatattttggttaagagctatagcagatgtgaggttaaggtcattgatctcggaagtagctgttttgagacagatcacctttgctcgtatgttcagtccaggtcttatcgtgctcctgaggttattttggggcttccatatgacaagaagattgacatctggtcacttggatgcatcttggcagaactttgtactggcaatgttctcttccaaaatgattcccctgcgacattacttgctcgggtgattgggatcattggcccaattgatcaaggtttgcttgctaaaggacgggatacatataagtacttcacaaaaaatcatatgctttatgaacggaatcaggaaagcaacaggttagaatacctgattcctaaaaagacatcattgaggcatagattaccgatgggggaccaaggcttcatcgactttgttgctcatttgcttgaggttaactcgaagaagcggccttctgcatccgaggcgctgaagcacccatggttgtcatacccttatgagccaatatcatcttga

SEQ ID NO: 83413 - DNA, 318 bp, Glycine max
  Peptide Sequence Number=SeqID_200191
atgggtagcactaattttcaccaaacagaaacgaaaaacaaaaaagaaaggtttttgcaaagtggggatttttcacagaggaaaccccaattgccaattgccaattgccaattgccatcaagatctggcatttacgttccagaacgaatttccaggctctgccgggacgagaggaaaaactggggtcccaaaaaaatggcaaaagaaattgaaatttgtttagagggtacgctgcgttctcttgtcccttccttccctgctgcctctgctgatgaattgagggtggtgaatggtgatgatggtggaccaaagctatag

SEQ ID NO: 83414 - DNA, 1806 bp, Glycine max
  Peptide Sequence Number=SeqID_200192
atgtacctcaaatgcgaccgaatccgggatgcccggaaactgtttgatatgatgcctgagagggatgtggttgtctggagtgccatggttgccggctactcgcgcctcggcctcgtggacgaggccaaggagttttttggggagatgcggagtggtgggatggcgcccaatttggtatcgtggaatggcatgcttgctgggtttgggaacaacgggttgtacgatgtggcgctggggatgtttcggatgatgttggtggatgggttttggcctgacgggagtactgtttcgtgtgtgcttccttctgtggggtgcttggaggatgcggtcgtgggggctcaggttcatggttatgtgatcaagcaggggttggggtgtgacaagtttgtggttagtgccatgcttgatatgtatgggaaatgtggctgtgtcaaggagatgagtcgggtgtttgatgaggtggaggaaatggaaattgggtcgttgaatgcttttcttactgggttgtcgcggaatggtatggttgatgccgcgttggaggtgtttaacaagtttaaggaccggaaaatggagttgaatgttgtgacgtggacgtcgataattgctagctgttcgcaaaacgggaaggatttggaggctttggagctttttagagatatgcaggctgatggggtggagcctaatgctgtgacaatcccgagcttgattcctgcttgtgggaatatttcggcgttgatgcacgggaaggaaattcattgcttttctctcagaagggggatttttgatgatgtatatgtaggtagtgcattgatagacatgtatgccaagtgtgggagaattcagttgtcccggtgttgttttgataagatgtcggccccgaatttggtttcatggaatgctgttatgagtgggtatgcaatgcacgggaaggctaaggaaaccatggaaatgtttcatatgatgctgcagagtggccagaagcctaatttggttacattcacatgtgttttatcagcatgcgcgcaaaatggcctgacagaagaagggtggcgctattataatagtatgtccgaagaacatggctttgagcctaaaatggaacattatgcttgcatggtgacacttctcagccgtgttggaaaacttgaagaggcttactctatcattaaggaaatgccatttgaacccgatgcatgtgtacggggagccttgctaagttcttgcagagttcacaataatttgagtttaggcgagattactgcagagaagcttttcctgttagaaccaaccaaccctgggaactatattattctgtccaatatctatgcttcaaagggcttgtgggatgaagaaaatagaatacgtgaagtgatgaaaagtaagggattgaggaaaaacccaggctatagttggattgaagttggacacaaaatacacatgcttcttgctggtgaccaatcacatccacaaatgaaagatattttggagaagttggataaattgaatatggagatgaaaaagtctggttacctccctaagtctaactttgtgtggcaagatgtggaggaacatgataaggagcagatattgtgtgggcacagtgagaagttggcagtagtattaggactactcaacacaagtccaggacaacctcttcaagtgattaagaacctgagaatctgtgatgactgccatgctgtgattaaagtaataagcagattggaaggaagagaaatttatgtaagggacacaaatcgtttacaccatttcaaagacggagtttgttcttgtggagatttttggtaa

SEQ ID NO: 83415 - DNA, 495 bp, Glycine max
  Peptide Sequence Number=SeqID_200193
atggagaaaggaacagtcaatgacatgtttgttatacttgctgatatttggctagacaatgaagaggctttgagaaaactagagactgttctggatgattttgagagtgtggaagtggtaccttcattatttgttttcatgggaaacttctcttctaagccatgtaaccgttcatttcattctaattcgagcctcagtataactactagttctaacaacattgccattaagaagagatattttattattgtgttaaaaggtgaaatgattgcttcccatccacggctaaaagagcacagtaagcttctgattattccaggtcctgatgatgcaggtccttcgacagctcttcctaggtgtgctcttccaaattatttaactgaggagctccaaaagcacatccctcatgccatattttcaagcaaccccttcagggttaaattctatacacaagaaattgtatttttccagcacgatctgctgaatagaatgtga

SEQ ID NO: 83416 - DNA, 423 bp, Glycine max
  Peptide Sequence Number=SeqID_200194
atggagggagtgattaataaaccaaatacaagtgtgaccattttgctagcgcaatcatttgttgctgaattagttagggtttttcagagtgtcgcattttgcgtcgatttctccgcacacgccaccgtcaatcatctcagcacaacgttgcgattcgaacaatcgcaatacggtaagataaccctgttttatcatcaaggcaaagatgttttgaccattgaaagaatgaggatgtcctacataaagcattttcttggtgacggaatacaatttccggtactaattttacaatacaaagcatctttttcaggtctgacccctgtacctcagatagtttcaccggccaagtctttctgtggcatatcaaattttattaggactaaccagactacaaaacaaggcatacttactgactccatttag

SEQ ID NO: 83417 - DNA, 534 bp, Glycine max
  Peptide Sequence Number=SeqID_200195
atgtcagaagaacaaatgtacctaattgtcgatattaaatcaacttcaacaagtccaagaacttcagaaaaaataatcaagacacaagcctttatatataggttcaagaatgcaagaaagcattcgaaaacggaagttaaagttgttcattcctttgctattagcaaccttcaagggagaaaattggcacttccaaaacagcaaggtaaaaccttaaaagttggcaacagccaacaggttgaaaaagaagctgattacattggattgatgttgatggcatcagccggctatgatccccgggtggcagtcgaaatgtgggaggagcatgggaaattgttggaggaggaagacagaatctcagtcatattgtgggagaaaaagcttgacagaatctcagacatattgtgggagaagcttgacaaaatgtttggttggaactatttctctactcatccttctgaaatagaaagagcacaattgttggcccaacctaagataatggaagaaatccttactatatatatagagatgtaa

SEQ ID NO: 83418 - DNA, 1815 bp, Glycine max
  Peptide Sequence Number=SeqID_200196
atggttttccttcgtccccttttcttcgtcgaaacgaagcagcagcatccaccacagtacataataaattctctgaaaaacccttccttttcatcactcacccaccatcattgtcaggtcttcagaaataaagttctgcaacaaattgaaaccacacttcaacatacaaggttttcaccctttcatcaccttgctcattgccaaaggccttcgttatctgataacaaatcttcctgtgtgcacttgattcaatattcgttgcccttgaactattattatattgcttgtcatgtttctaaccgccattattgttcagaaactgtttccatgaacaaagatcttagttgtagtgagagtggtgttgtggagggtaatggttttgaaagtgacgttgataaggtgtatagcattgtgatggataatttagctggatttaacaatatggagaatgctcttggccaattggggatccctttgtccacccctttggttacaggggggttgcataggcttagatatgatgaaaaaattgcacttaggtttttcacttgggctggtcatcaagaggattattcacatgaaccttgtgcttataatgatatgatggacatcttatctagtactaggtacaaggtgaaacagtttcggattgtttgtgatgtgttggaatatatgaagaggaataacaggactatggttccggctgaagttctcttggtgattttgagaaagtatactgagaagtatcttactcatatgcagaagtttgcaaagaagaagaggataagggtgaagacgcaactagaaataaatgcatttaacttgctgctggatgctctgtgcaagtgttgcttggttgaggatgctgaaagtctatataagaaaatgaggaaaacggtcaagcctaatgcggagacgtataatatattggtttttgggtggtgtagggttagaaacccgactagagggatgaaattactggaagaaatgattgaactgggtcataggcctgacaatttcacgtacaacactgccatcgatacctactgcaaaacaggtatgataacagaggctgtagatctttttgagttcatgaggacaaaaggttcaactatatcttcccccactgccaagacttatgcaattataattgtggctcttgcccaacatgatagaatggaagattgttttaagcttatagggcatatgattagcagtggctgtcttcctgatgttacaacatacaaggaaataattgagggaatgtgtatgtgtggaaagatagatgaagcttacaagttcttggaagagatgggaaacaaaagttaccgaccagatattgttacttataattgttttctcaaggtcctttgtgacaataagaagtctgaggatgcccttaaactctatggaagaatgattgaattgaattgcattcctagtgtccagacatacaatatgctgatttcaatgttttttgagatggatgatcctgatggggcatttgaaacttggcaggaaattgacaacaggggttgcagaccggacactgacacatattgtgtgatgatcgaggggctatttaactgcaataaaatggaagatgcttgttttcttttggaagaagtgataaatgagggagtaaaactgccatataaaaagttcgactcctttttgatgcaactgtcagtgattggcgatctccaggccattcataggctctcagaacatatgaagaaattctataatcatggtatggcaaggcgttttgcactaagccagaagcgtaagagcttgagtttaagagggaaataa

SEQ ID NO: 83419 - DNA, 576 bp, Glycine max
  Peptide Sequence Number=SeqID_200197
atggctaattttgagaaagatgaggtgccaattttctcagatattcatcctaaactatcaaatgaacttgttgattctaaattcccaaggcgtgtacctaggactcgaagtgtatcaatttctattcctgcgacactcacagagccatatgaaagagatactaatcttgtgggatacactggtcccctacggagtcagagaaaaactccattcgatcagatgagtggtccattgtatgttaccaataaacctggaaaccttttccggcagaatagagtggcaccagagtaccaaacagcagaaagtaagacagaaaattttccttcatgctgtggcatgggtgaaaatgatttgcagaacaactatgctggcaagaatgaacatttaattaggtccggtccccttggaatgtgtaatgatccgtattgtacaacttgcccaacttacttcaaggctactcaacaaatgacttcaaaagcttcgggtatattcaatcctaagtatcaagcaattaaatgtaatgagatgtggaatactggtgttggacccaaaatagggttacatgtcatcgtgtga

SEQ ID NO: 83420 - DNA, 216 bp, Glycine max
  Peptide Sequence Number=SeqID_200198
atgatggattccatttccaaacatttgaaagtaaagcatggcataaaaggagaggaaactctcactgatataggtaaggattgtaaaggggccatgagtgagaacagagaaaaggtgaataatatggtgactgagtctgagtctttgaggcaactttcacgacaatttcctgaatactgtctgaacaaagcagaaagtaagcagcttgaaccgtga

SEQ ID NO: 83421 - DNA, 273 bp, Glycine max
  Peptide Sequence Number=SeqID_200199
atgacaaaaatgctggttgtacttagaagcatgaatgatttcatacacttcctaaacattgttcttcaggtcttggaattcgaggaccaatacaagcctcctgagagagaaaagaagagagaatttttctggttggcttatgtggctcctgagtcgagggtggttggtgctggggagttagttgaccatcctaagaaaatagcccttcactaccttcggacatcttttgttattgacttatttgttgtacttccacttcctcagcatgcataa

SEQ ID NO: 83422 - DNA, 378 bp, Glycine max
  Peptide Sequence Number=SeqID_200200
atgacttcggaatttctggctctaaaagacagaagtgtgcatgttgtcatgcctcactccttgcctcaattttcaccactaggagagctttatgtcaccaaagttttagtaaaaacacctcataaatatactggtaacataatgagcttgaaggtaataaacacagttactattggaaaaaagaataaggttaacagctttattatagatcccatatggaaaaccatcttcagtaaaacaagaacttgcttcagaattgctcctccaattatgcaaggttgggttattttgattttcttcagcttgaccatgcccacaatcaatgaattttgcgcattcattatgttctttgattactttctggcagacatctcgtag

SEQ ID NO: 83423 - DNA, 486 bp, Glycine max
  Peptide Sequence Number=SeqID_200201
atgctcctggagaatttgccagaagacctccaaagggacatcagacgtcatctctttacatttattaagaaagttcgaattttcgccttgttggatgagcctatcttggatgccatatgtgagaggctaagacaaaaaacatatatcaaagggagcaaaattttttatgatggcggtttggtagagaagatggttttcattgtgcgtggaaaattggagagtgttggcgaagatggaattagtgctcccctttatgaaggaagtgtttgtggtgaagaacttctgacatggtgtcttgagcatcctttagcaagcaaaggttgtggaaaagcaaggattccaaggcaaaagttggttagtaaccggacagtaggctgcttaacgaatgtggaggcattttcccttagagcagcagaccttgaagaagttacaagcctttttgcaagattctttcggagtccccgtgttcaaggagccataaggtag

SEQ ID NO: 83424 - DNA, 1350 bp, Glycine max
  Peptide Sequence Number=SeqID_200202
atgcagaattatcaaggaagcatggctaattttgaaaatgacaagctgctgatgctctcagatacagatgcacaaccatatgatgaacccttggatgctaaatttcgaaggacagtaaccaggacacaaagtgcatcaatttctatttctatgagttccttggagtcatatgataaagaaactagccttgtgggacatactggtccacttcagagcaagagaaaaacaccctttatgcagatgagtggtccattatatgctaccactggaactggaaatcctctgcagaagcatattgtatctggaaacaaagcagaggagagaaagacagataattttgctactctccgtgacacaggttcaaattactggaataatgactatgatagaaaaaatgaacacttactaaggtctgggcaactgggaatgtgcaatgatccttattgtactacttgccctacctacttcaatgcttctcagcaaagaaatccaaaaccttcgactagatgggatccaaaggctattggtagtaggccagtaataaaacatgtctttgttaggaagaagaggatggggccaggaactagcaagaaccaaactaatttccataatgctctttatggggatgccaagagttttgtgagaaaacttctttctttctgctattcgtatgttcctggagttatgaaccctcatgctaaagtcgtacaaaaatggaacaaatttttggccattttttgcttgattgctatttttgtggatccattatttttcttcttactctatgtggagaaggataataaatgtattgttatcaactggcctttgacaacagcacttgttttatttagatgtgtgactgattttgtttatttccttaacattcttctccagtcaagctctgtcattgattccatgtttctattgatctgtgttcttagttttgtgaagtttaggttagcttatgtttctcgtgagtcgagggtggttggtgctggagatttggttgaccatccaaagaggattgctcttcattacctaaagggttatttccttattgacttatttgttgtatttcctcttcctcagataatgatattgtttgtcctaccaaattccttggagggagcaaattatgccaagaatcttctccgtgcagcgatcttagtgcaatatatccccaagttattcaggtttctgccactgctaattggccaatctcccacaggattcatatttgagtcagcctgggcaaatttcattataaaccttctcatttttatgcttgctagtcatgttgttggctcttgctggtacctcttcggtcttcaggtgggggatataatatag

SEQ ID NO: 83425 - DNA, 606 bp, Glycine max
  Peptide Sequence Number=SeqID_200203
atgacaaagctttatgcatattcatcatggaatcaaacagcgacttgtcaaaagccaaagcatatcaacaatcccgttcgaatcttttccctgatggatgagcctatcttagatgccatttgtgagagactaaaacaaaagacgtacatcaaaggaagtaaagttttgagtcagggtggtcttgtagagaagatggtctttgttgtacgtgggaaattggagagctttggagatgatggaactatagttcccttatctgaaggggatgcttgtggtgaagaacttctgacatggtatcttgagcattcttccgtaagcacagatggtaaaaaattaagggttcaagggcagaggtttctgagcaacaggacaataagatgcttaacaaatgtggaggcattttcactgcacgctgcagaccttgaggaactcacaattcttttcacaagattcttgcggaaccctcatgttctaggagcactaaggaatgtatcaccttattggagatcccttgcagcaaaccgtattcaagttgcatggagatacaggaagaagcgtctaagtcgtgctaatacctcgcaatcaaatcaaacattgatgtcatag

SEQ ID NO: 83426 - DNA, 369 bp, Glycine max
  Peptide Sequence Number=SeqID_200204
atggagcaaccccctgaattaactaccactggctctcgccttgtttgtcaattgcgtcattcacattctctccatgatttgttgggaaaagtttacatggagcaaccccctaaatatttcttgagaattgaggtttgcgagagtcatggaaagacacaagggattgttgggtatgcatatatgaggacaaagatcacttgttactctgatgctaactggaccaggtcaccctcagaaaaaagatttacttccgaatattgtgttcttgttggagaaaatcaaatctcatggaggagcaacaagcaagacctagttgttagatccattgcaaaagttgaatatcgtgctatggcaaacaattgtgtgtga

SEQ ID NO: 83427 - DNA, 513 bp, Glycine max
  Peptide Sequence Number=SeqID_200205
atggatgagcctttcttagattccatttgtgaaagattgagacagaagacatacatcaaaggaagtataattttgagtcaaggtagtctagtagagaagatgatctttattgtgcgtggaaaattggagagcattggagaaaatggaattggagttagcttgtctgaaggagatgcttgtggtgaagaacttctgacatggtatcttgaacattcttctgtaagcaaagatggtaaaagagtaaggcttccaggacagaggtggcttagcaacaggacagtaaagtgcttaacaaatgtggaggctttttcaatccgagctgaagatcttgaagaagtcacaacccgattcatgagattcttgcggaatcttcgtgttcaaggatccctaaggtatgaatcaccttactggagatccttggcagcagttcgaatccaggttgcatggagatacaggaagaaacgtaaaaattgtgttgatacctcaaaattagatcaatcatttaactcatag

SEQ ID NO: 83428 - DNA, 507 bp, Glycine max
  Peptide Sequence Number=SeqID_200206
atgcagagtgaggttgaaattggagggagggaaagggggatttatagggggaagggggggggtgagggcgccacgtgtcatttggatgcgtggcggagttggggacgggtgagggggcgacggctacgatggctcgagcgtgtgagagaatggacggtgggatggggattgcgcgtgaagataccagaaagtgcggtgccgaaagatcttcccatggtcgatgaaaaggtgacacgtgacggatgtgactgctcacgtgtcgtgacgggactttcggtaggaaggaaggttcttgtaagattgggacttgacacgtgttgtgccattgctgaatgcaaacaccttaggcactcaagaaatctatttttacacattcgaaaaaatcctctacctcacatgatttttcttttttctggttaccaaatttacaggcacaagctgaccgggagggtggatgacaaagaagaggccaataaagatggagaagaatcagattgtgagagttaa

SEQ ID NO: 83429 - DNA, 1827 bp, Glycine max
  Peptide Sequence Number=SeqID_200207
atgaatcaacaaggaaaagtggctaattttgaaaaacatggggagccagcgccatcagaaacacatgcacaacatgatgaacttgagaattctagatttgggaaagtgatatcaaggacaaaaagtgcatcaatttctattcctatggtctccatggagccatatgagagagaaactagtcttgtgggacatactggtccacttcctagtgtgagaaaatcccccataatgcatgtgaatggttcactatctgctaccaatggaactgaaaatctattgcatcagagtatatttgtgaaaggaaacaaagtagtggagagcaagacagaaaaaatttctactcttgacaggaaagatgaaaatcattggaataacaactatgatagaaagaatgaacacttgctgagatctgggctactgggaatgtgtaatgatccttattgtactacttgccccacttacttcagggcctctctgcaaagattttcaaaagcttccactgtctttgatccccagtttcacttccacaatgctctttatggggatgccaagggtttggggagaaaaattatgtctttcttctcttcatatgttcctggagttataaatcctcactcaaaagttgtacaacaatggaacaaatttttggccattttttgcatggtggcaatttttgtggatccattattttttttcttaatctatgtgcaaaagggtggtaaatgtatatctatcgactgggacatgacaaaagtacttgttgtagtaagaaccatgaatgatgttatatatttcttgaacattcttctccagtttaggctggcctatgtttctcctgagtcaacagtggttggtgctggagatttagttgatcatcccaagaaaattgctcttcattacttgaagggttattttctttttgacttgtttgttgtatttcctcttcctcagataatgatatttttggtcctaccaaaacacttggggacatcaggagcaaactatgctaagaatcttctgcgtgcagtgatccttgtgcagtatattcccaaattattcaggattctgcctctgctaattggacaatctccaacaggatttatatttgagtcagcttgggcaaatttcattataaatcttctcatttacatgcttgctagccatgttgttggatcttgttggtacctctttggtctacagagggttaatcaatgcctgcgagatgcctgcggtaattctgatattgatagatgcatgacagtcattgattgtggaagacatggtcataccagaaacaactattcagaccaaacatcatctctgtggagcaacaattcagatgccattgcttgtttgaatccctcctctagtggtttccgttatgggatctatgtcaatggtgtacctcttactatagaaactagtgtggctaacaaatatatttattcactattttggggattccagcaaatcagtactctggctggtagtttaaccccgagctatttttggggggaagtcctgtttacaatggccatcataggattgggactcttgctttttgcggttcttgttggaaacatacataactttctccaaggtcttggacggagaaggctagaaatgcaacttagaggccgcgatgttgagcaatggatgagccatcgtcgcttaccagaagatataagaaggaaagtacgacaggctgaacggtataattgggctgcaaccaagggagtgaatgaagaaatgctaatggagaatttgccaggagatctccagagagagatacgacgccatctcttcaaatttgtaaagaaagtatga

SEQ ID NO: 83430 - DNA, 618 bp, Glycine max
  Peptide Sequence Number=SeqID_200208
atgacgaccagaagagaaaagagatggaagttaaaggagaagaaaagagaggttacggagacagaaagaggattgactgtgaaatttatgcagatactttttagcaatgaatggaacggcaagaggagcggtggtggcaagaaggaccaaggagaggtggaggacccgagtagattggaaagacaactagataacatctttgtagaaaaaataaagctggacattaacttaccaaggtttgaaaagtctgatccagggtctgcaaagaatacaaaatttgaaaagtatggtagaggggatattggaagaaaaacaacaggacatcaagggagagaagaaacacaatcaaaggggcaggatgtcgggaaaggtaaggaggtggtttatcagaatgctggccagaaaacagggagacacaacaatgcaagatcatatgctcggttagtttctacaagggtaataccagttggccagacatggaggccaaaaaatggaaacaaaggcaggggagaaacagtgttgggaagggaaaccgtgacacctatgcaatatggaatggctaaacaagagtatggtggcgaggatgaaaaacccagaagacgcattcaatcagaatga

SEQ ID NO: 83431 - DNA, 189 bp, Glycine max
  Peptide Sequence Number=SeqID_200209
atggctatgcaagattttgagtccgtccagcataatccacaagctgtgtgggtttggacaacggggttcatgggtttacccgcaaacccacaactactaaccaagactggtccgtctactaccaatgtgaacttacgcgaggcgagtcggcccgcttacccactcctaattttaaccgttgatggttaa

SEQ ID NO: 83432 - DNA, 561 bp, Glycine max
  Peptide Sequence Number=SeqID_200210
atggaatactttcaaacacgttttcaagaaattggagaggaaagaccaatccttgatggagtacattttgagagactaaatgaggaagacaacatctttctatgtcaacctttcaaggatgaggaaatcgaggaggccatatgggattatggtagtgataagagtccgggatcaaatgacatgaattttcatttcattaaaaaatgttgtggcacgatgaaaaatgaatttgtggatatgatgaaggatttttgggcaaatggggtcatttcgaggggtgcaaatgcttccttcattgtgttgctacctaaaaaggattatttgcttgggttggaggagtatagacccatttctttgattggttgtttgtataaagtaatttcaaaggtcctcgctaaaaggttgggaaaggtgttggggaaaataattgacatgagacaaagtgcttttgtgggaggacgatttatgctcgatggtgtgttactatccaatgaagtgatagatgaagacaagaggtgcaagaaggattgtttgatttttaaagttaactttcactactag

SEQ ID NO: 83433 - DNA, 279 bp, Glycine max
  Peptide Sequence Number=SeqID_200211
atggctagtttggagtatgcaagggttatgataagcacttcatcatatgacaatatttgcagtactgagtgggtaaaaatacatggaaatccttactcttttcgtgttgtggaagaactgaaagagagtggaaacctgaagatgatatggtggtcaagatactgccaccacaggttcaaatctggagagagaaaacaccacaacgggtcacaatcaaagggggggattttttggggggacttctggaaaaagggagaagttcaggagagttttctgtaa

SEQ ID NO: 83434 - DNA, 177 bp, Glycine max
  Peptide Sequence Number=SeqID_200212
atgttgagtggggagcgaagaaccagaaccaacaaccaacaaaatcaacaacctccaaaccaaaaccacaaccagatcgaggttgcggtggcctccgaagacaaccgcaaatcggaggttgtcaccgaaatcgttgatttgaaagacaaagtgagcaaatcgaagaggggagtgtag

SEQ ID NO: 83435 - DNA, 225 bp, Glycine max
  Peptide Sequence Number=SeqID_200213
atgcttatgcatggctggttgtggaaagggtggtacatattgagttctggacgttttctagcagatcccaatggtcaaaatcttggagggattgatggggacccggtgttgagaggaatgaggatatgggctacgtgggagtacgtgagctcagttgaaggtgggcaactggggatggtggatttacgtgggatttgtggatgtggagagtcgacttgcacctag

SEQ ID NO: 83436 - DNA, 209 bp, Glycine max
  Peptide Sequence Number=SeqID_200214
caggtcgtcgaccacctggtcgccggtttggcgcagcactgccgcaaggttggcctggtggtgccgctgcaagcccaggtcgacgccttccatatggccgtgccgctggaatgcgcgaccacggtggtgcacgcctcgccctacgaggccgacgcgggacgcgcggtggccagtttcaagcaggccggccaggacctggccgactgtga

SEQ ID NO: 83437 - DNA, 690 bp, Glycine max
  Peptide Sequence Number=SeqID_200215
atggccgcccagcaggtcggtgatgaccggcgccgcgccgcgataggccgcgtgcggcaccttcacgcccagcttgtacagcatggtttcggcgatcaggtgattggagatgcccacgccggcggtgccgttgttggccggcacgtccttgttgacgatgaccacgttgggttgcaccgccgccagcgtgatgggcgtgaagtcggtcggcttgtagctggtgcccttggcgttgagcacgtgggtgatggccatggaaccggccgcagcgatgccgatggtgtagccgtcaggctgcgattgcgacaggcggaaggccatgatgttgccgccggcgcccgccaggttttccaccaccacggtctggcccaggcgctgcgacagcggctcggccagcaggcgcgccagcgtgtcggccgaaccgccgggcgcaaagcccaccagcaagcgcaccggcttggtcggtttccaggcgtcggcggccagggccggcgcggccgccagggtgctggcggcgaacagtgcgcccgcggcgcgttgcaaagtacggctgaacatgaagtcgattcccttattccaatatttgcgcgagcgcctgcgcgaccaggcggttggacaacagcaccgggcgacccgatgcctgtgccaccgcctgccgcatgcgctcggcgtaacccatgcaatgcatga

SEQ ID NO: 83438 - DNA, 347 bp, Glycine max
  Peptide Sequence Number=SeqID_200216
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagtctggagaagcgtcctcagtggcggaccgggtccaagtcccctggaagggggcgccagagagggtgagagccccgtcgtgcccggaccctgtcgcactacgaggcgctgtcggcgagtcgggttgtttgggaatgcagccccaatcgggcgg

SEQ ID NO: 83439 - DNA, 999 bp, Glycine max
  Peptide Sequence Number=SeqID_200217
atggcggtttcctccacaaaacaaaccccctccgttatttcttttgaaacagaccccatcccgtgtcacccacaagacaagaaagcgctgctccaactcaagaaggacctaggcaacccttacatcataacatcgtggaatgcaaaagaggattgctgcgactggtactgctgcgtcgagtgtgacgagaaaacgaatcgcgtcatcagcatcggcatatcgtcatccattccagacgccaatgcgtcgggacaaattcctccttctgtgggcgacctcccttacttggagtccatcaccttccacaagctccccaacctcgtgggcccaatccagcccaccatcgccaaactcaccaaactcaagtctctctttatcacttataccaatatctccggcccaatacccgcttttctgggccaactcaagaacctcgagttgatcaaactttcctttaacaacctctcgggccccattccgagcacactttcccaattgcctaatctcgggtccctacagttggaccgcaacaagctcacgggcccgatcccgagctcatttggagccttcaagaagcccgggccagatctcatcctgtctcacaaccagctttcagggcccatccctgcttccctcggcaacttaaatcccgacagggtagacttgtcaaggaacaagctcgaaggtgacgcttccatgcttttcagcagcaagaaaacgacccagatacttgacctttcaaggaacaagttcgagttcgacctatctcatttgacgtttccgaagcagagcttgatatggctggatctcaatcacaacaacatttatggaaacattcctgtagcattgactacggtgaaatatctgcaacaattcaacgtgagctataatcctaggttaagtggtaagataccgcagggtggagaattacaaagatttgataagtatgcatattttcacactaagttgtgtggctccccacttccaccctgcaaataa

SEQ ID NO: 83440 - DNA, 300 bp, Glycine max
  Peptide Sequence Number=SeqID_200218
atggctcaacccgccattgccagtggcggcaaaggtggagagaagggtgtattgtcactagcagtggcgatatggccacgtaggatggagagaggagggtgtcgccaatgggaacggccattgttagggcagatttttgcttcagaaggatgcagtaatagcaggtctaggcatgtggagagtaaacttccaacgacacttaacactcaaaaatttaacattgaagagagtatcagtgtggaagaggaagaaaaagtttcatttgaagagagtattttgaagtttgctgcttctatatag

SEQ ID NO: 83441 - DNA, 297 bp, Glycine max
  Peptide Sequence Number=SeqID_200219
atgcccttacggacactattcctacttccccatcaggctctgataccagaggtcagcggagtaggatcaaacggacagataggaagtaagaatgcaatatcaaggtcacaccggagaccggcttacaaaacccaggttttcataaacaaagaaaccgaagcggcggcagagccgcacaggatcggtgaagggagaagagagaagaatgaaaaacagaaatttattgaatctagaaagaagcgcttacaaaaatcttgtttcagagcacctctcttccgaaacctgaaaaatgactaa

SEQ ID NO: 83442 - DNA, 456 bp, Glycine max
  Peptide Sequence Number=SeqID_200220
atgtcaataggaaaactgacatccaaacaggaccattcacatgtggatgtggcaaggataattgatcaaacctgttctgaggatggtgatcttgatttgaatgcttcccctcaagcacttgacaaattgttgggtcatgtgttttcttttaaggtcaggattcaatcaaatttcaaaaatgcagttgtacttagatactctaaagacctggatttgatcaatgctgttctcgagatgctgcctgatagtgaggcatgttccaaaatagatccttccaatgttgattgcaatgatgctacgcatgctgaatctaaccatgatccggttgcgggattgcctttaacacccaaaaagcggatgtcatctgatgaaaccgatgatgagttaaggagctctcaaatttcgccagcccaactatcgtctaacaaattaacaagacattctcataagagctaa

SEQ ID NO: 83443 - DNA, 315 bp, Glycine max
  Peptide Sequence Number=SeqID_200221
atgatttgtgaccttggacaagagtcttttcagcaagcacatgcccttatgtataaaggatttcaaagtgattcaaagaagcctttgtatacgaggtgcaagaattccttgtcgctgttgttggcggtgttaagtctggttaatgtcaaggccagatatgggtggagtgagaaaagctttagttcactacttcaagtagtgcacaatctgcttctagaggagaacatgttgcctaaaagttggtatcaggccaagaagatattatgtccgatgggtatggagtatcagaatattcatgcctgcccgaatgattga

SEQ ID NO: 83444 - DNA, 786 bp, Glycine max
  Peptide Sequence Number=SeqID_200222
atgcacgctctctccttcatagggctacactccctcacctttagaggactacacatcctcgccttcagagggctacacgccctcgccttcatagggctacatgccctcaccttcagaggactacacgtccttgccttcagagggctgcgtaccctcgccttcagagggctacacgtcctcgccttcagagggctacacgtcctcgccttcagagggctacacgccctcgccatcagaggactacacgtcctcaccttcagagagctgcacgtcctcaccttcacaggattgcacgtcctcgcctttagaagactacacgtcttcaccttcagagggctacacgccctcgccttcagaggactacacgccctcgccttcagaggagtacacgtcctcaccttcagaggactacacgtcatcaccttcagagggctacatgtcctcgccttcagagggctacacgtcctcgccttcagagggctagacgcctcgccttcagaggactacatgtcctcacctttagagggctgcatgccctcgccttcaatgggtgacacgtcctcgacttcagaggattgcatgccctcgcctttcaagggttttcttgggtcaccccttgatcctggaggagggccaactgtgagagcacaaccagaagaggaggctatcacgcagctactatgcatactggggcaagatttcactcgagccgttgcaaaaagggatcgcgcccacaagacacccagtgaacccgaagaagtccaacagggcccctgggggttctag

SEQ ID NO: 83445 - DNA, 144 bp, Glycine max
  Peptide Sequence Number=SeqID_200223
atgaaggaagaggtgcgaaaagaggtgctcaagcttctagaggttgggcttatctatcccatttctgacattgcttggatattggagaggcttgcgggacatgcttattactgtttcttggatggatactctagatacaattag

SEQ ID NO: 83446 - DNA, 1086 bp, Glycine max
  Peptide Sequence Number=SeqID_200224
atgtcggatgaagatcccaaaaaagaccgtctcctgctcaatggtgatcgcctaagaggtctgtctgacagtgtgaagcagattgcacagttagcggatccagcagaccagctcttattaaaaaaggtgctacccaatggattggaaatagaaaagatcaccgtcccacttggggttgtcggtgtaatctatgaatcgcggcccaacgttactattgacgttgctgctttatgtattcaatcgggtaatgtttgtttattgcgtggcggttccgatgcccaatataccaatgcggctttattaaaagtcatctatggaatcttggacgaacatggtattacgagagatattgtacagttgttacctgtcgatagaaagcacgtatcagaattgctggaggcaacctcctatgtggatatcattatcccgcgggggtcacagtcgttgatcgattttgtcagggaaaacgcgaaggtacctgtgatcgaaactggtgcgggagtatgccatacctatgtagaccgaactgcagatctggatatggcagctaaaattgtggccaatgctaaaatttccagaccttcggtctgcaattccttggatactgttttggtcgataaggatgttgcaccagagtttttagttagattggctccctatctggaggaagctcaagttgaagtctttgctgatcctgttgcctatgagctattgaaaggtgaaaatttttcaaatttaaaagcggcagaagaggcagattttggaagagaatttttagatttgaaatgttcgataaaaactgttgatggacttgatgaagctctggaacatattggaaaatattcttccaaacattcggagtgtattgtctcttctaatgaattttatattgaacagtttctaaacactgtggatgctgcggcggtatatgccaatgcatcaacacgttttacagatggtggtgaatttggacttggggctgaaataggaatttctactcagaaattacatgcacggggaccatttgcattggaaaagttggttacagagaaatggattgtccgtggaagtggacagatccgataa

SEQ ID NO: 83447 - DNA, 600 bp, Glycine max
  Peptide Sequence Number=SeqID_200225
atggtagatgctgccgcacaggacaccggtgcagagactgacgcacaggataccgatgcagagactgacggggatgagcctatgggatttcctggtggacccagggacccatcagtgcttacagagtatgctgaccatgttgcgggcagcgtatggtctggacaggaacgtcctgagttgaagttatgctcccatgggaggaaggtgcataacttgggtaggcctattcctgcaattgaggacatggttgctaggacaggattaagtcctttgattgcatgttcgatagacatcggtgatcggggatttatatcctcttttgtggagaggtggcaccgggaaacttctagtttccatcttcctgagggggaggtgtcgatcacgctggacgatgtcgtgtctcttctccattggcctatcattggcacattccatgacttccagcctctgcgcaccgacgaggcggtggtgctgttggttgagttactgatggtctcagcagaggtgtccatggccgagacaagccaatgtggtggaccatacgtacgcctgcagtggctgcgagacatataccagcacagatgtcagacgcagcactag

SEQ ID NO: 83448 - DNA, 285 bp, Glycine max
  Peptide Sequence Number=SeqID_200226
atgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagacctacgggccgagggacagtctcaggtagacagtttctatggggcgtaggcctcccaaaaggtaacggaggcgtgcaaaggtttcctcgggccagacggagattggcccctcgagtgcaaaggcagaagggagcttga

SEQ ID NO: 83449 - DNA, 612 bp, Glycine max
  Peptide Sequence Number=SeqID_200227
gacctcccctacagtatcgtcaccgcagtagagtttaaccaccaagttcgggatggattgatgctttcagcagttatccgctccgcacttggctacccagcgtttaccgtgggcacgataactggcacaccagaggtgcgtccttcccggtcctctcgtactagggaaaggtcctctcaatgctctaaacgcccacaccggatatggaccgaactgtctcacgacgttctgaaacccagctcacgtaccgctttaatgggcgaacagcccaacccttgggaacatactacagccccaggtggcgaagagcccgacatcgaggtgccaaaccttcccgtcgatgtgagctcttggggaagatcagccttcaagctcccttctgcctttgcactcgaggggccaatctccgtctggcccgaggaaacctttgcacgcctccgttaccttttgggaggcctacgccccatagaaactgtctacctgagactgtccctcggccctggtatctcactgatggctctggcccccccagaaggaggccttctttgccctccacctaagctgcgcaggaaaagcccaaagccaatcccaggaaacagtgaagcttcatag

SEQ ID NO: 83450 - DNA, 639 bp, Glycine max
  Peptide Sequence Number=SeqID_200228
atggcggtggcgatgatcctgctgctgctgcgccaagggcctggggctgggcgtgctgctgctcggcttcgccttcctgtacctgccgatcctgctgttgatgttctattcgttcaacagctcgcggctggcgatggtctgggccgggttctccacccgcgcctacagcgacctgttcgccgaccgcgcgctgatggaggcgatgtggaccagcctggtggtggcgttctggaccgcctgcacggccaccgtgctgggcacgctggcggcgatggtgatgacccgcttcaagcgcttccgcggcaagccgctgtttggcgcgctggtcaccgcaccgctggtgatgccggatgtgatcctcggcttctcgctgatggcgctgctggcttcgatgggtgcgattcccgggttcccggcgcgtggcttgaccaccatctggatcgcgcacgtcaccttcacactgtgcttcgtcaccgtggtggtgtcctcgcgcctgcaggaaatggacctgtcgctggaagaagcggcgatggatctgggcgcaagccgattgaccgtgttcggacgcatcaccctgccgatcatcgcgccggcgctggtggcgggctggctgctggccttcaccctgtcgctggatga

SEQ ID NO: 83451 - DNA, 494 bp, Glycine max
  Peptide Sequence Number=SeqID_200229
ccttcagaggactacgcgtacacgccatcagagggctgcacgccctcaccttcaaaggactacacgtcctcgcctttagagggctgcttgtccttgccttcagaggactacacgtcctcgccatgagagggttgcacgccctcgccatcagaggactacacgtccccaccttcagaggactacacatcctcgccattagagggctgcatgccctcaccttcagaggactacacgtccttgccatcataaggctgcacgccctcgccattggtggactatacgcccacgccttcagagggcagctcgccctcgcctttagagggttacacgccctcgcctttagaggactacacagggctactcgccctcaccttcagaggactacacttccttaccatgaggactacacatcctcaccttcagaggactacacatcctcaccttcagaggactacacgtcttcacctttagaagactacatgtcctcgccttga

SEQ ID NO: 83452 - DNA, 205 bp, Glycine max
  Peptide Sequence Number=SeqID_200230
atggaacgagatgagaaaaggtttgagtaccgtttctgctgttcttcagaagaaaacattgtggaagaggataaggagggtggaattggtgttgtggatgcgttgattttaatcggtgaaatcaaaagaaaattgaaaaagaagaagattgcaagttacgggagtcgatttgatgaagaaatgagtaagataggaaggtttgaag

SEQ ID NO: 83453 - DNA, 483 bp, Glycine max
  Peptide Sequence Number=SeqID_200231
atggcagaatcatcaaagaaacgtaagggttcatccacctctgcttcggcttcaagagctcatcgttccggagccaccaacgcatccacaacaccaattccaccctccttatcctcttccacaatgttttcttctgaagaacagcagaaacggtactcaaaccttttctcatctcgttccattatcgaccctaagttcatagatatggaattcttttctgctgaaagttttgattgcattcaagcatttcagaacttaggtctcatacctttcatgtcatttatcctgaattggttaaagctttttattgtttttgggataaaaatggtcattgaccaatcccttttccatgacttaacccaattgtccagtgacggtgtcccatttgaaggtacactgaatgacgattggaaatttgatttctctgcacatgatgcccgccagttggtgtgcaccaaccatgcggatatgaccggaccatga

SEQ ID NO: 83454 - DNA, 405 bp, Glycine max
  Peptide Sequence Number=SeqID_200232
atggcgccctttacatgtgcatgcgacaaatacaataaggaagttgtgcttaggtataggcttgaggtgatgatcaaccagggaaatgaaagcacaaaattcctgctttgggaccgtgaatgcagtgaattgattggtcaatcagctgatgcatttaataagcttaaaattgaagatggtgatgttgatttgaatgctttaccccaagcacttgataagctcctgggttatgaacttgctttcaagataaaggtgcaacccaagttcaggaattttgctgttttgaagtgttcagctgactcgagcttaataaatgttgtgatggatatgctagctgatgctgagacatcttctaaaatgaatatcccagtttctgattccaatcattctgctcaacatgaatct

SEQ ID NO: 83455 - DNA, 369 bp, Glycine max
  Peptide Sequence Number=SeqID_200233
atgttagctatcatcaccaagtaccaagaggaactaagtctagccacggcccacgagcatagagtggcggatgagtatgcccaagtgtacgcggaaaaggaggctagaggaagggtgatcgactcgttacatcaagaggcaacaatatggatggaccgatttgctcttactttgaacggaagccaagaactttcccgattgctagccaaggccaaagcagtggcgaacacctactctgcccccgaagagatccacgaacttctcagctattgtcagcataggatagacttaatggcccatatgattagaaaccgccaggaagtttgtattgtcgctcaaatcttgactagttataaactttctgaataa

SEQ ID NO: 83456 - DNA, 345 bp, Glycine max
  Peptide Sequence Number=SeqID_200234
atggctgatgcgctcgccaccctagcatccatgtttcagctgaccccacatggagacatgctgtacattgagtttcaatgtcccagcaagcccgcacatgctaaggaagccgagtggatgctcattgaggtgcatgaagggtcctttgggacgcatgctaatgggcatgccttggtcaagaagattctaagggcgggctattactggcttaccatagaaagcgactattgcatctatgtgagaaaatgccacaagtgccagacattcacggacaatgtcaatgctccgcccatgcccttgaacgttttagcagcgccatggcccttctctatgtggggaatagat

SEQ ID NO: 83457 - DNA, 417 bp, Glycine max
  Peptide Sequence Number=SeqID_200235
atgtggcttcgcatgcccccggactcttgggtcaaggtagcaaaaggtggggtggtcgacaaaagcagggcttttgctcctacgtatcctcaatttgtgatgaggaactcagacctacgtagttcttgcaaactcattttgtttctaaacgaccatttggaggaaacactgggtcctacaaaaataggagaaaatcattcaaagtgtatcaatctcacacaggtcaaggtttatgataagttgggattttggctcaaggcttgtagaacagctggtcacgatatatgtcagggtttggccagcggttcagggataaaggggacgttccacattatttctgaaattctgatactggggacagatgtcgtacaggatgtcacgactctagcgtttcaggacatgcagatttatatgacc

SEQ ID NO: 83458 - DNA, 1241 bp, Glycine max
  misc_feature (1237)..(1237): n is a, c, g, or t
  Peptide Sequence Number=SeqID_200236
gattttccggacaactaaaaggatggtgggataattatctcactaatgaagagaaatcaaaaatttacagcgcagttaagacggatctcaatggaaaagtcattactaatgacgatgataaagagattcctgacgctgtgaacacgttaatttttacaatagcccaacatttcattggagacccatccttgtggaaagacaggtccgcagaattattatcaaatcttaagtgtagaaccttagcagattttaggtggtatagagatactttcctaactagggtttacacaagagaagatagtcaacaacctttttggaaagaaaaattcctagccggtcttcccagatccttaggagacaaagtcagagataaaatccgtagtcaatctgccaatggagacattccatatgaaaacttaagctatggtcaattaatttcctatgtccaaaaggtagccttaaaaatctgccaggacgacaagattcagaggcaattagccaaagaaaaagctcaaacaaagagggatttaggttccttctgtgaacaatttggcttgccagcctgtccaaaacaaaagaaaaaacaaacctccaggaaagaagcccaggatcataagccagccaatagaagaagattttcaaaacgaagatactctcaaaaaccctcaaccagtagagaaatggaaaatcctaaacaaaaaataaaattaaaaataacgtgctacaattgtggaaaacaaggccacattagcaaatattgtagactaaaaaagaagttaagaaaccttaacctagaaccctcaattgaagagcaaataaacaatttgctcatagaaacctcaaaggaggaaacagaaacagaaacttcatcctctgtgctttccgatgaaaacctaaatctaatccagcaagatgaccaactatcatcaacaaatgatgatgggcaaatcaatactctaacgagagaacaagatctcttgtttgaagcaatcaattccatacctgacccccaggaaaagaaggttttcctggaaaaactcaagaaaacattagaggtaaaacctagacaaaaggattttatcacgaacaacaaatttgatgtaagtaacatactcaagagattagaaaattcttcaaccaaaccaacgacaatccaagatctccaaacagagataaacaatctaaaaagagagaaacaatggccctatttgacacaggggctgattcaaactgcatnttag

SEQ ID NO: 83459 - DNA, 348 bp, Glycine max
  Peptide Sequence Number=SeqID_200237
atggtgggttacacaccttcaagctttgagaatttagtttccatcagtgaaaggatcaaagtgggtctgaaaagagtcaaaggtgatcatcctgctttgacaaataaaaagcctggggcaaaaagagagaatgagaaggaggaaggaacccatgttgtgactgttgtccccacatggccaaatttcccaccagctcaacaatgtcattactcagccaatatcaacccttctcattacccagcacctaattatccacaaaggccatccctaaatcagccacaaagtttgcccttaacacaagccaaaacaccaaccaaggaaggaattttccagcaaaaaagcctatag

SEQ ID NO: 83460 - DNA, 249 bp, Glycine max
  Peptide Sequence Number=SeqID_200238
atgcacacacgccaaaggattagtgcaacaagcacgctaagcgcacttccaagaatttcaaaaacagtaagggattggcgcttagcgcatcctgcggctaagcccaactatgaaagctcaattccagaatggatatggggcttagctcaggacaacacgcttagtgctgcaataaatttttccaaagaagaagtggcgcttagcgcatcatctccgccaagcccactgcttaaagtttacttccagtga

SEQ ID NO: 83461 - DNA, 852 bp, Glycine max
  Peptide Sequence Number=SeqID_200239
atgaatgcaaagcgacaggcattggtgatcggcgccaatggcgtgattgggcgccgattgattgaggagctgaccggccagggctggcaagtggtgggcgtctcgcgccggggtgggcaaccggcgccgggggtgcgccacctgcaggttgatctgctggatgcggcggcgacgcgcgacgcgctgcggccgctgagcgcgattagccacgttttctatgccgcctatcaggatgcgccggactgggcgggactggtggcgccgaacctgcagatgttgcaacacgttgtcgaggggctggagccggccgcaccggcgttggagcacatcagtctgatgcagggctataaggtgtatggcgcgcatttggggccgtttaaaacgccggcgcgcgaaagcgacgccgggcatatgccgccggagtttaacgtggcgcagcaacagtatctggcgcagcggcaggccggcaagcgctggcgctggagcgccattcgcccgagcgtggtggggggcttctccctcggcaatccgatgaatctggcgttaagcatcgcggtttacgcgtcgatcagcaaagcgctcgggttgccgctgcgcttccccggtaaaccgggcgcttaccacagcctgctggaaatgaccgatgccgggctgttggcgcgcgccacgctgtgggcggcgaccgagccggcggcggccaatcaggcgtttaatatcaacaacggcgatctgtttcgctggagcgagatgtggccgaaaatcgccgcttactttgggctggaatgtgcgccgccgctgccgatgccgctggagagcatgatggcggacaaagcgccgctgtggcgcgagctg

SEQ ID NO: 83462 - DNA, 210 bp, Glycine max
  Peptide Sequence Number=SeqID_200240
atgggagattcagctaaagttgtgatcaaacaagacatgaagggaagaaggcataaatatgggtttaacaacaatgaacgtgagaaggcacagaagaaaagggtggtggatgatgaaactgccgacaaacatcagttggatgaacaccaagagcggctacgcaagaagtttgcacttgaggaggaaaggatatttgcagctaatgaacaa

SEQ ID NO: 83463 - DNA, 990 bp, Glycine max
  Peptide Sequence Number=SeqID_200241
atggcaagacgcatactggtggtggaagacgaagcgccgatccgtgagatggtgtgctttgtgttggaacagaatggttaccaaccgttggaagccgaggattatgacagcgccgtgacgcgcctgtctgagccgttccctgatttggtgttgctcgactggatgttgcccggcggttccggcattcagtttatcaaacatatgaagcgcgaagcgctgacgcgcgatatcccggtgatgatgctgaccgcgcgcggcgaagaggaagaccgggtgcgcggcctggaagtgggggcggatgattacatcaccaagccgttctcgcccaaggagctggtggcgcgcatcaaagcggtcatgcgccgcatttcaccgatggcggtggaagaagtgattgaaatgcaagggctgagcctggatccgtcctcccaccgcgtgatggcgaacgatcaggcgctggacatggggccgaccgagttcaagctgctgcacttctttatgacccacccggagcgggtttatagccgtgagcagttgcttaatcacgtctggggcactaacgtttatgtggaagaccgtaccgttgacgtgcatatccgtcggctccgcaaggcgttagaaaccagtgggcatgataaaatggttcaaaccgttcggggcaccggctaccgaacgtctgtcgtggaagaggctggctctggagctggctcttttctgtctgcccgccttactgctggggctgattttcggttatctgccctggttcctgctggcctccgcgctggcggcgctggtgtggaatttctacaaccagctcaaactctcccattggctgtggatcgaccgcagtatgacaccgccgcccggccgctggagctgggagccgctgttctatggcctgtatcagatgcagcagcgcaatcgccgccgccggcgcgagctggcgttgctgatcaagcgctttcgcagcggggccgaatcgctgcctga

SEQ ID NO: 83464 - DNA, 885 bp, Glycine max
  Peptide Sequence Number=SeqID_200242
atgctggcgggcaacctgtccagcgtcggttccgatactttggcgaatctgatggcgctgtgggcgcaggatttcagccggcattatcccaacgttaacctgcagatccaggccgccggctcgtcgaccgcgccgaccgcgttggcggcgggcgctgcgcagctgggcccgatgagccggccgatgaaggcggccgaggtttcggcgttcgaacaccgttacggctatgcgccgctggcggtgccggtggcggtggatgcgctggtggtgttggtgcatcaggacaacccgctgcgcggcctcaatctgcagcagctcgatcgcattttctccgccacccggcgctgcggtgaaagcaagccgctgacgcgttggggcgagctggggctgagcggcgactgggcgacgcgctcgctgcagcgcttcggccgcaactcggcgtccggcacctacggctatttcaaactgcgcgcgctgtgcggcggcgattttatgccgcgcgtcaatgagctgcccggttcggcctcggtggtgcaggcggtggccggttcgctcaacggcatcggctacgccagcatcggttttcgcgccagcggcgtgcggctgctgccgttggcggaatcgggagaggactatgtcgcgcctaccgccgccaacgtgcgcaacgatcgctacccgctgtcgcgctatctctatatctacatcaacaaagcccccaatcaaccgctggagccgctgaccgccgcgttcctcgatcgcgtgctgtcgaacgcagggcagagcctggtcaatcacgacggctatctgccgctgccgccgggcgccctgcagaggacccgccaggcgctcgggctgcagccgctcgcggcggccacggtgcaataa

SEQ ID NO: 83465 - DNA, 165 bp, Glycine max
  Peptide Sequence Number=SeqID_200243
atgggcggcaagctcctccggggcgtaggtggcttccgtaaaatatccgaaaaccttagaaaaatcgagttgaagtgctttcgtaatgcttccgtaagcgattatgtggaaattcttcatcgttcttcaccgttcttcgttcgttcttcaatcttcaaccggtaa

SEQ ID NO: 83466 - DNA, 198 bp, Glycine max
  Peptide Sequence Number=SeqID_200244
atgactgctagggaaaatgacattttggcaacaaagaaaatattcgagatgctttcttcagccatagaatcaaatgcttttaaattccaggtaattgttcttgagcatgcagatcaaactatttggggcgagattcctcatacctatgaagcagcacaatggaaaactgcaaaagatggcctaattccgaaagaatgg

SEQ ID NO: 83467 - DNA, 561 bp, Glycine max
  Peptide Sequence Number=SeqID_200245
atggttgattatgagtatttgaagatcgttgttgagggtggagtttctagcgggaataattctatatcagtcgatccagatgatactgatgcaacaacttttgagccagaaaatagaactgttgggatagaagaattttcatatgatcctaatagtgatacattcataacaccaaataactatgaaccagcatatcagcctccatcaccaaaccaaccaagtccaccatcccacccccctttagattcagaggttcccatagaaaaacaaaactgtcacaagcgaaggagatccgagtatggagggagttcaagcgctgttgggatcaacaatcaaggcaacgttctggaaaatctttctgttggcattgagactattgctgtgaattttgaaaaaatatccaacatgatggagaaaagagaaaaagatagagatagagatagagagctcgagggtattatttgggatgttataaaagaaattccaaatttggatgacataacgcgtttcaagacagctgaattgttaaatactaaagcaaaaaaggattttttttcttga

SEQ ID NO: 83468 - DNA, 496 bp, Glycine max
  Peptide Sequence Number=SeqID_200246
aggtgctggccttaatagtggaactggagacaacgcggtagtcaaggaaaggttcaagacggcagccatcatagtcgaaaaggaatgcgacgagctgagggatgtcgccccacctacagccccaacattggaacgagaaacaaagagggcccgaaaagaggaatggggccgaaacaagttccgaggggctttatggggcagcaatagcgaactcaagctccaaagggctattatggactattccagagtcgaaggacagaagagaaacttgtgggctatcattgaccagtacaaagaaaagttgagtctagctactggccatgagcaaagattagaggacgagcatgctaaagtatcggtcctgcaagtgaaaagggaagcgagggagagagtgatcaattcattacacaaagaagctataatgtggatggataggttcgctttcactttgaatgggagccaagagcttccaaggctattagccaagtcaaggtga

SEQ ID NO: 83469 - DNA, 189 bp, Glycine max
  Peptide Sequence Number=SeqID_200247
atttcaatcggtgaaatcaaacaaaaaatgaaaaagaagaagattgcaagttacgggagtcgatttgatgaagaaatgagtaaggtaggaaggtttgaaggtttgggaatggagggacgtcgcaaggaggaagaggttgcgcaggggtttctgaaaaacgtgatatttatagaccaggacgcattgtaa

SEQ ID NO: 83470 - DNA, 129 bp, Glycine max
  Peptide Sequence Number=SeqID_200248
atggtcgaccagcaggctaccaagtccaaagccaaaggtaagcgaagtactaggacgcacctagttgctcatgatcctggggatttaaataaaacaagcgcaagctcggaaggtagagagataccttag

SEQ ID NO: 83471 - DNA, 207 bp, Glycine max
  Peptide Sequence Number=SeqID_200249
atgactttcaaatcgttcaaaagcaaaaatatgattcaatatcattcctatgttcattccgcagcacctgatgtgtggaattacaatacttcttcatcggattcagttttgataaagaaaaatcattcaaataagggactttattatctccaaagagctaagtacggaagaggccaacaagaggattcaatcttggagcaccaatga

SEQ ID NO: 83472 - DNA, 305 bp, Glycine max
  Peptide Sequence Number=SeqID_200250
atggaccccaagaagtccaacagggtcttggggtttccaactctgattacgggcctctgtcagttctacggagtgcatgtcgcccccagcaaggtcatcaggccccctactaaccgagctttcatcaagaagtactgcgcccccaggcaggcgcaaggcgagacaccacagcagcctggggatggccggcagcgggcaacagacgcaccgtcgccacctctaaagcccctcaactcatctacaaaagctggagcgttgcctacgacccatggtcgaccagcaggcgacaaagtccaaagccaaag

SEQ ID NO: 83473 - DNA, 531 bp, Glycine max
  Peptide Sequence Number=SeqID_200251
atgtcgtcacctttagagggctacttgccctctacttcagaggactacacgtcctcgccttcagagggctacacgccctcgccttcagaggactacatgtcctttccttcagagggctccacaccctcaccttcagaggactacacgtcctcgccttcagagggctacacaccctcgcctttagaggcctacaggctcttgccttcagaggactacacgtccttgccttcaaagggctacacgtcctcgccttcaaagggctacatgtcctcgccttctgaggactacacgtcctcaccttcagaggactacaaatgggtacatgtcctcgtcttcagaggactgcacgtccttgccttcagtggactgcacgtcctcgcctttagaggactacatgtcctcgcctttagagggctgcacgccctcgcctttagaggactacatgccctcgccttccgagcgcttcacatcctcgctttcagagggctccacatctgcacgtttagagaacttaatgtcctctgcccttaa

SEQ ID NO: 83474 - DNA, 351 bp, Glycine max
  Peptide Sequence Number=SeqID_200252
atgcagctggaaaaatgttctttgaaagataatctgataaaggcattggaagagcaactagcaactgcagagaagaagctgcaggagttaaaagggaacattcgtgtattctgtcgagtgaggcctttattagctgatgaaagttgtagcacagaaggcaagattttcagttatccaacatcaatggaaacttctggacgagccattgacctagcccaaaatggtaaatctgttgtgatcatgccaaaaaattcttttacatttgataaagtttttacaccagaggcatcacaagaagaagtttttgtagaaatttcacagcttgtacaaagtgctcttgatggttacaag

SEQ ID NO: 83475 - DNA, 495 bp, Glycine max
  Peptide Sequence Number=SeqID_200253
atgaccaaacttggtctctgcttgtcatctgctctggatgacaaaagggtgcgaataaccgtaaggtatctccgcgtatcatgggtgcaaaatgaccaaacttggtctctgcttgtcatcggcccgcctctggatgacaaaagggtgcggataaccgtaagaatgaccaaacttggtctctgcgtgtcatcggacccgccgcgtctgaatggcaaaaaggtgcggataaccgtaagggcccgccgccgtaaggatccgcgaacatgggtgcagaatgaccaaacttggtctctgcttgtcatcccgccgcctctggatgacaaaagggtgcggataaccgtaagaatgaccaaccttggtctctgcttgtcatcgggcccgccgcctctggatgacaaaagggtgcggataaccgtaaggtatctccgcgtatcatgggtgcagaatgaccaaacttggtctctgcttgtcatcgggcccgccgcctctggatga

SEQ ID NO: 83476 - DNA, 873 bp, Glycine max
  Peptide Sequence Number=SeqID_200254
cgatatcggcttcagtacgcggtgaatgcaaaatacgggctggtcgacaagcgcgccatcgagcaggctgccgaaaaggcgttggcccggctcggtgtcgagatcgatctcgacaggccgctcaaggaactgcccatcgcccagcgtcagatcgtggcgattgcccgcgcgctggtcggtgaggcacggctcgttttcatggacgaaccgaccgcgtcgctcacgcagtcggaaacggattacctgatcgacatcgtccgcaacctgtcggcctccggtgtcgcggttgtcttcgtctcgcaccgccttgcggaagtgcttgagatttcagaccgcataaccgttttgcgggatgggtctcttgtcggtgtctttcccgttgaaggcatgacccagtcacgggtgaccgagctgatgaccggccgcaattttgacagtgccgtcattgccgccgatcacgatgacaaacccgtcgttctctcggtgcgcgggctgagccgtgccggcgagttcgaggatgtttcgttcgatctgcggcggggcgaaacgcttggcataacgggcctactgggagccggccgcacggaactggctttgacactgttcggcatgcatcggccgcaatcgggtgaagtactgattgacgccgcaatccattgccgacaatctggtcatggcctcgctcgaccggctgctgcgcggcggcctgatctcaccgtcgaaaaaggcggatgtcgtttcccgctggatttctgcgctcggggtgaagatcggcctgcccgaagacccgatccgaacgctttcgggcggcaaccagcagcgtgtggcgatcgccaagtggctcgcgatcgggccgaaaatcctcatccttga

SEQ ID NO: 83477 - DNA, 615 bp, Glycine max
  Peptide Sequence Number=SeqID_200255
atgtgtggggtatcacgatacaaagtgaaggatgatgacgagtgtaacaatgacaaaagcataaagaaaggtccttcatcgaaggtgttatggtatcttctaatcattccaaggtttaaatgtctatttgataatggagatggcagtaaagaccctacatggcatgtagatgggagaaactatgatggaatgctccgccatctggttgattcctcccaatggaagaagattgatcatttgaatctagattttgacaaagaggcaagaaatcttaggcttggacttgccactaatgaaatgaatcactatggcagtttaagcactcaacacagttcgtggcctgttttactaaaaaatagtatacacttaacatcaacgtcttctaaaaccttatcacccttactagcaattgaaaaaacttttaatggaagtcaagagcatgaaagtgcaccaataccattaactagtcaacaggttcttaagcgggttgaggacatcaatactatatttggaaagacccaaaagaagctgacagagaaagatgtgtgtgatagtgtcattgacacgcttcttaaaattcaaggcaagacaaatgatggtttgaatactcgttaa

SEQ ID NO: 83478 - DNA, 561 bp, Glycine max
  Peptide Sequence Number=SeqID_200256
atggcaaacgttatcccacctgaacgtgcaagcggagttcgcagaggggagggccgctttgtgccaggatcggacattgttcaggggtcaggcaggccttctctggaagactataaaggttcagatgcagccagggttcgtgctgcatctgagggcaatacagccctgcaattttacgaaaaacagccgagtggctgttataaaaaagttttagagcgccgggttacagctggtctggctattctcggtattcctgtgtcaggaaataaaaaaatcggaatgccagaatcaagtaacaataagggggctttcataaatgaatttactatcaagccggggcaactgataagtataattcattactggactcagccgggctactaccaaaatacagaacgatctgtctccaccagattcattcctcagccaaatcatgattacgatatcgtcgtcactggctcagaatttggcggggatagcgtatcggtgagagatctggatccaggcgctaagatagttggatgggaaggcaatttctgcccctccggtatatttgattaa

SEQ ID NO: 83479 - DNA, 316 bp, Glycine max
  Peptide Sequence Number=SeqID_200257
cggtttaggaggtcttgtttcggctttgattttagcgaaagaaggtcttaagagtgcttataaatgtgcgaaaggaggaagccagatctccaagttgctcatccgcaaattacgggaatatggtgcagatgttcacaagcattctgaagtctctgaaatgatctttactgaggatgttttggtggccgtttggaatgcttatcagtatgagaatgaaacctggcctgagacgtatatgctaagctccacgccatcgaagcatcatcctgaatttgcagaaagtatgacagcaattacttatatggattttgatgag

SEQ ID NO: 83480 - DNA, 174 bp, Glycine max
  Peptide Sequence Number=SeqID_200258
atgaacaaatctgtgaaggttttccatcgttcttcaccgttcttcatccattcttcgttcttcaaccggtctgatttcctcttcgatggaggatacgtaggagaaaaagtcccacttttgtcgaccctcgtgagatggttagaggtccaacgccttagctttctcaccaagtaa

SEQ ID NO: 83481 - DNA, 345 bp, Glycine max
  Peptide Sequence Number=SeqID_200259
atgtggatggaccgatttgctcttactttgaacaggagtcaagaacttccccgattgctagccaaggccaaagcaatggcggacacctactccgcccccgaggagatccacgggcttctcagctatttgcgaatcaagtcactcccgcattttatctcacacatgcgttgtatgtgggtctcgtcttttgtcgtgggaagtcgaaagatccatatcgtcttcttaactgcacacatggggcactgcgcccccaaatgcacagtaaggagagatgattttctgggccctcgtgtccgtaaatgcattcatatcatgcaccgcataaacatctcttcagcatcataa

SEQ ID NO: 83482 - DNA, 243 bp, Glycine max
  Peptide Sequence Number=SeqID_200260
atgaacgtgctaagcccagttgtcgcgctaagcgtgttcatcttctctgttgagttatctattgaacttgctaagtgcggttgtgcgctaagcgagtactgtgtatggcttctcgtaaaaggaaggcaccaccttcagtgtcctaggctaggtatgatagctcaagatttgtatcccaagatgcctgggaccgctatgcagacaatgtccttagccggaagatcattctggaaaggaatgtga

SEQ ID NO: 83483 - DNA, 507 bp, Glycine max
  Peptide Sequence Number=SeqID_200261
atggttaagtttcttttcttaagctttcttttagcaaatacccttttgagtctaaccaatgcaacaaaccaacctcaaatcattttccaatctttttcagcaccgtcttcaaaccctccttctcagagtccatctagtggccaaagaccacgcacatcagaaccctctattggaaggaaacttggtatgcaccgacataaccaaatcaggtcctctgacaccaaaagtcctaccccatctgaagcaccacaaagtgaaaagaagatgcactctatttctgaagggagcattcctagtcatcagagaacttctattgaaccacatgatggagaagttttgggttctcatcatggccaggtccatttgtcaaagcagcgccaccactcatttgacaagtccagagctggagcaggagttattcttgttgggcttgctaccacatttttggtgtcagttttctgttatataagagccactagaaggaacaagctagaaacaacagcttag

SEQ ID NO: 83484 - DNA, 171 bp, Glycine max
  Peptide Sequence Number=SeqID_200262
atgaggcttcactgttatcaagcgagtcagagacccagcatgaccacaaatcgacttccactccttatggctcatatagacccgggtatagggcctaatatctcaacgtgtgtgcgagaggagaaagtcgttaaggcgttcgaccttgaaacgatctcaagcgatatttga

SEQ ID NO: 83485 - DNA, 369 bp, Glycine max
  Peptide Sequence Number=SeqID_200263
atggaggatgtcataggaaggggtttggaatgcctgaagactatggatgggaaggctagggcttcaatccctgagtctgaggcgaagtgccattctactgttgtttctgggtggttcccagcttctcaaacttgccctaggaaatcaggaaaatttgtttatttcaacaacccaatgtggccagctccatgtagagcttgtaggccttggatcttcttcatcaatggagtcctttgcttcttgaggatcaatggcaatgaaatggagaaggaggaaaggatcaatggcaatgaaatggagaaggaggaaagggagaggaagagaggggaacaaaattttgagagacagaagaggaagaatgaggtctga

SEQ ID NO: 83486 - DNA, 297 bp, Glycine max
  Peptide Sequence Number=SeqID_200264
atgactttgatgcaagttcaattactatttcaaaacttggttacacttgtggatgaagtcatggaggaagctactaaaggaaatgaagatgctgagagtgaagatgaagtggagttcgaagagaatgatgaggagcttggtgaggattatgaggagtctagtgaggaggaggatgatggtagtagcagtgatggttttgaggaagaggaggatctaactacgaagatcgtttcatcgaagagggaaattagatacttggcatcgttactgttggtttcctttttagactttagatga

SEQ ID NO: 83487 - DNA, 882 bp, Glycine max
  Peptide Sequence Number=SeqID_200265
aggatcccactgaactacctcggctactcgtacggcacgttcctcggtgcgacctacgcgaagctgtatccgcagaaggcggggcgtctggtcctggacggtgccatcgacccggcagtccccggactcgaagtgggcgcgacccaggctctcggcttcgaatcggcgctgcgtgcgtacatgcagaactgtctggattccggggagtgcccgttcaacggcaccgtcgatgaggcgatggccgacctcggcgcgctcctggcgagcgtcgaccgtaccccgctgaagaacggcgacggccggatgctgggcgccgactccctcctgaccggcatcatcgccgcgctctacgcgcaggagagctggggagctctcacgcaggccctcgatgaggcgctgcagggcgacccgaacaccgccttcctcctcgccgatttctacaacggacgcgagaacggcgcctacgtcgacaactccagcgaggccttccgcgcctacaactgcatggactacccggtcgaagacgacccggcggccgaggcggccagcgaggccaagatcgccaagggcgccccgaccatcgccccgtactggagcggtccggactccagcgaggtctggccgtacccgccgacgggaacgcgagatgagatcacagccgagggcgcagggcccatcctggtgatcggcaccacgaacgaccccgccacaccctacgagtggtccgagtcgctagccgatcagcaggaggaaggcgtgctcatcacccgtgtcggcgagggacacaccggctacaacaagggcaacgtaagcgtagacgacgcggtggaggccttccttctcgacgatgtggtgccggaggacggcttgcgctgcgagtga

SEQ ID NO: 83488 - DNA, 510 bp, Glycine max
  Peptide Sequence Number=SeqID_200266
gttgctttgtttatgatggcactgagcacgtactccaactttgacactactcttcaaattccccacttagaaacaaacactttccatgaagccatgccagaagtagcagcaccaaacctccaacattttcttccacactcagatgaaagcctcttcctttcaaacgcgctttttgagaactacattgacccaacttgtgattttctctatactcccgagatcaatcccttcacttcactcactcatcatgatgacattttcccaactcatgaagattacaatcttctcccatgccctaaacgccaaaagtgctgctacgagaaaaaccaacaacaagaacacgtgttcttttcactgcaagagcttactacatcaacacttccatccaatttcctagacaggtatgctgtgccttatgataataacttctccttccaagcagaggaactccaacaacaactctacgaggttccacaatatggtagtaacttgtgtggatcttcaatgtga

SEQ ID NO: 83489 - DNA, 132 bp, Glycine max
  Peptide Sequence Number=SeqID_200267
atgagcaagaaggaaacaacaacactccatacgactctcatcaacaaccaaggtgcccatgtcggtggtagagatggtcctcatcggcgaccaagccaatcaaacgctcccttggacatgttcctcacataa

SEQ ID NO: 83490 - DNA, 228 bp, Glycine max
  Peptide Sequence Number=SeqID_200268
atggtggctactggtaatcgagtactgccttatggtgatgaaaggaaggttcctttggctacccttagcttccaagggtataccctctattggtggacttctcttgttagggaaagaaggattcatggggatccttcagtagagtattggaatgacttgaaaggtgccctcaggaagaggcgcatcccctcctactatgaaagggagcttatggacaagggagtatga

SEQ ID NO: 83491 - DNA, 528 bp, Glycine max
  Peptide Sequence Number=SeqID_200269
atgcatgaaaagccggggcatcggtggacacttgcagaactggcggggcgggccgggctttcgaggtctatcttcgcccagcgattcagggaaagggttgggcaaacgcctatcgaatatctgactcagtggcgcatgatgcttgcaaaggagttgctgacaggcggtcgcgagcctcttataacgattgcaaatgctttgggctatgaatcggaaaacgcgttcaacaccgcgttcaaacgcgtgactggctatgcttcgtcctcgccgtcggccgactcgccacaaaacgctcgcgcccctgagctacggcctttttggcgtcgatcagtttttcatgagccaggagatctgctgatggcgggaaagccgtataaaacaggctttcccggagagacctttaccgttaaagacgagtttggtctgaatagtgaacgggacggtcttaatctggccctcggttcttaccgccagttttaccgccagcctgttcagcttgctggcgatagccaccgatcgtcgtcatga

SEQ ID NO: 83492 - DNA, 1232 bp, Glycine max
  Peptide Sequence Number=SeqID_200270
atgatgatatcaggcctaggacaactaggaaatgacatcgatgtttatcttaatcccttgattgaagacttaacaaagttgtgggacaaggcggttgttgtgtttgatggacattgtatcgatgttatgcatgtggagaaaaatgtgagtgatagtgtcatcagcatgcttcttaacattcaaggaaagataaagaatggtttgaatactcgtcaagatctagatgagatggtatacgtgactagttacatccagcgatacatgaagatcttaaaagggtatacaaagaatctacatcatcttgaagcatccattgttgaaaggtacattgcaaaagaagctattgaattttgttcaaagtacattgaaaaggcaaagcctgttgggcttcccaagtctcgacatgacgaaagagtgggagatgatgattcaacccttgatacttgtctcactcctttctccacacaaatatctaacgtcaatggagaagaagaagttgacgacatccatgcaaattataatgatcatgatgaaggagaattaattaacatccacatgactacaccaccgagctcccttcctcctcctgagtcagcaccttcgttgtttatgccgaagaagactagaaaagcaacaaggctcggatcattggctaccagacctatcgagatagagagaccaaaggttcatgtggatcctaccactgggaaagctgatggtccccacataaagaaattaaggacgtatttgggggtcgtcgcacgagacaaggtggatgttacatttgttaactggaaagaagttcctacaactcagaaggatttaatctgggaggacattcaagctgaatttgatattccagaagcgtttgtccaaaggacgaagaagaaaatccttaagatgaaggcaaggaggaggacgatgacactatttgtgagacgtataatatcagcaaagaaaagtggaaccaattttgtcaaagtcgttgggtccctccttgagaggattcctttgaagagcagtcagcacagggaagctttgtcacccattgacgtcaagatggacgagctggagcagtcgatcattgaaaaagtgactcgacaactaatgttgtccttaagcaagatgcagtctcagatgcaaccccagagactcgtactgcctcctaagcttggggttggtccttctgctacccatgtcagcacaaaggaaagttgtgtcgatacctcgag

SEQ ID NO: 83493 - DNA, 273 bp, Glycine max
  Peptide Sequence Number=SeqID_200271
atggtcattgaccaatccctattctatgacttgacccaattatctagtgaaggtgtaccatttaaaggtacactgaatgatgattggaaatttgatttctctgtgcatgatgcccaccggttggtttgcaccaaccaagcagatatgagcggaaggcctcttgccggttcattggcttttgaaatctgcatccttcattatctcattgtgcgtattttgcttctaagatcttcaaaccttgcacaggcagtcaaattgattgggcacacttag

SEQ ID NO: 83494 - DNA, 300 bp, Glycine max
  Peptide Sequence Number=SeqID_200272
aatgttgatacggataaccactcgggtatttctgcccgtcagcgtgactcaaaagtcagtatgacagatcttgtaagtgcggaagatgatgtaaatctccgcgtgtcaacgggcttgtcggccgcgattgacgaagggtgtagaatgaccataatttgtctctgtatgccatcggacacgactgtgtctgaatggcaaaagggtcagtacgacagatcttgtggggcggccgacaaaagcaaggctcttgctcctacgtatcctccaatgaggaactcagacctacgtagttctagataa

SEQ ID NO: 83495 - DNA, 786 bp, Glycine max
  Peptide Sequence Number=SeqID_200273
cctaacgcccttgtttgtggcctcccgaacacgaaagtcgaaacccgaactcacttcctcaccccatcatcgcagcctcgaaaccctgagtcgccagcgcagccccgaaacctagtccacccttctggaaagcttgttcagattgagcatgccttgacagctgttggctctggacagacgtctttgggaataaaagctgcaaatggagttgtcattgccaccgagaagaaattgccatctatattggttgatgaaacatcagtccagaaaattcagttattaacaccaaatataggtgtcgtatatagtggcatgggtcccgattttcgagttttggttcgaaaaagcaggaaacaagctgagcagtatcatcggttatataaagaacccattcctgtcactcaacttgttagggaagttgccgctgtaatgcaggaatttactcagtctggtggtgttaggccttttggagtgtcactgcttgttgctggatttgatgataatggaccacaattatatcaggtggatccatcgggttcatatttttcttggaaagcttctgctatggggaaaaatgtttcgaatgcaaagacgtttcttgagaagaggtacacagatgatatggagcttgatgatgcagtccacacatcaatattgactttgaaggaagggtttgagggacagatctcaggaaaaaacattgaaattggcataatcggtgctgataaaaaattcagggtattgacaccggccgaaattgatgactatttggctgaagtagaataa

SEQ ID NO: 83496 - DNA, 189 bp, Glycine max
  Peptide Sequence Number=SeqID_200274
atggatgatttacaaggacatcgagagtgttgtttgcctagaaaaatcatacatcattgttatgttaaagtgtctcacgatgctaaagaattcaaagtgaccccagtgaggtttgatgtgagaggtaatgtcctgagttggagattcaagtcaggcatgatcttcagtgaaaatgttttgttgatgtag

SEQ ID NO: 83497 - DNA, 315 bp, Glycine max
  Peptide Sequence Number=SeqID_200275
atgccgggaatccaccccagcattatctaccacaagctcgcgatctttcccaaggccaaaccgatatcacaaaagaagaggaagatgggagatgaacgacgcaaaatggccaacgacaaatggcgaatatgcactgactacattgatatgaacaaggcgtgtcccaagtatgcgtaccctctacctagcatcggcaggctagttagtggagcatccaggttccaagtactatgcttcctagatgcctactccagatacaaccaaatctgtatgcacgctataaacgaggagaaaatgacattcatcattgaataa

SEQ ID NO: 83498 - DNA, 663 bp, Glycine max
  Peptide Sequence Number=SeqID_200276
atggagcaactagacattcaaggtccgtctcttgacgatgaggatgagatggtgtttgtgaatgatgttactaaagaggggttgaaccatttgttgtgtttggtggacatgtttctcacaaagaaaaccatacaagtggagggaatcacgaccaataaggctagtaaagttatccgccagaacataggaagcttcttaggtgagtttctgaattatgatgacaaacataattcaagtcctcagatgtccttcatgagaattgaagtccttgtcaacgtaaatgagcctcttaaatgcacaaagagaataaaaaaggtgaacggggaagccaatgttatcagtttcaaatttatgtggaatcttttcaaagtggagaacgacaatgaccaacgttcatggggttcagagcttcgtgcttacatacgccccttagccatgacagagggatcttactatctcagggaagaaggccaaccctcacttgtggcatcccatgatttgggggttacaaattcaatgccaataaatgtgaatttgaaacaaccaaatagtgaggatatgattggtgttgacaggaaacatagtgaactcttaattgttgcattcaagtcacccgaatattctaacatcaaatcacaccaacggtgcattaacggccaataa

SEQ ID NO: 83499 - DNA, 177 bp, Glycine max
  Peptide Sequence Number=SeqID_200277
atgggcagcgagggcgtgccgttgatagtggtggaggtcatgtcggtggccgtcgtcgagctcactgatgcctccagctggtggcacgaaatcgatgactctccagcctgttcagtgtgtagtttttatcttctatcagaacgtgcagaggttgaagctagaggtattggagtatag

SEQ ID NO: 83500 - DNA, 486 bp, Glycine max
  Peptide Sequence Number=SeqID_200278
atgccagatttcatgaagccagctcacgatcagtacgtttaccgccatgccaatggcttgtgtgtgattgggttggctccttcccacattgctttcaaggatgaaggtggaatcacagccgttgatttcaatgttggaaagtctgatcgcagcaggataaaagtcattggaaagcagaagaagaaactagagatgcagcttttaaacccgctcctctggttcagaagccaatttcttcgatcttggagaaaattcggcagaggaaattggagattttacagaatcaaatatttagcatacaccaaaaacatggataaaggtggacactactgcaaaaacgcgattctaagacggtggaaagcaggatacaacgacggtggacgaccgtcgttgtatccaatgtcgtggaaaataaaaccgttcaacgacgggtcaaaattctacgttgtcgaaagggatccactttcaaagacgttgcttacataa

SEQ ID NO: 83501 - DNA, 294 bp, Glycine max
  Peptide Sequence Number=SeqID_200279
atgttgaagaaaagagggaacgtactagggctttcgaacatgaaagtgacaatgtcgctactgtcgtcaaccttgatggtgatgatgacgtcaataccagcccatggagatgtttcgattgtaacaacagtgctcgaagccctcagatcagaggacgagggcgacatggctaaagtccatggcttggagggagaacttggtggaggagcagttgaagttcgcatcattcatgagctccttaatggattccaaaaccttcttcaggagggagccttgcacgagacggagttctaa

SEQ ID NO: 83502 - DNA, 312 bp, Glycine max
  Peptide Sequence Number=SeqID_200280
atgccgctcttgtgggcaagagtggttatgcgcaaatggcttaacaaggcaagtaacgagcctgatgataatgaggatgaccctgaaagtgactcagataatgaagaatttcttccaaggttaaggaggcaaaagtcattaacctctaggtctcagtatataaacaaaggaactaaggtatcaattgatcaaagtgttgtggatcttgacattccttttagacttggtggatttgcttcaactacaatacaacttattggtattgttgatgtaatgactgaagatacatggcaagttttgcttcttttataa

SEQ ID NO: 83503 - DNA, 192 bp, Glycine max
  Peptide Sequence Number=SeqID_200281
atggacggtacgtttgacaatgaagctgagccggtcgttacaatccgcgagtatctggaggaagtggaggagcgggaagtgatgttatccatatctcttttacaaagctactacttcatagcatttttgtcaggcttggcactacacatagtgttatgtattgcttcaattctgaagaatattttgtcttga

SEQ ID NO: 83504 - DNA, 591 bp, Glycine max
  Peptide Sequence Number=SeqID_200282
atggctattgatattcaaacgttaaacaaacttttcaaagtccctcttgccaaaaacactggttccataaccaatttgcccgattttaatccatccatgaatcttgttcacgtggaaggtaacatgtatcacttcaaggagaatgactccacggaggactctcaaatcaccaaggttgataaacctcctggcacgagacacattgtgtttctgcaacatcggaaaagttctgggcattccagtgggatctgggtcctcgtggagaacaatagtaatcttcaaacacacaagaggtcaaagttttttggcaagctcttacctttcgaatcagagctgttggcattagatatacacacttggtacaaacaacaaactgggtcctttttagcaaaaagattggatcgagttttggttgatcaaagctggcaatattgggatttttggaggcctatgtggagaacctatgtagggtttacttcgaccactgcccattgcttctccgatatggagggtgcccctcatcccgttgagatcgtcctttcaggttcgaggctacctgggctatacacaggagcttcaaacatgtggtaa

SEQ ID NO: 83505 - DNA, 225 bp, Glycine max
  Peptide Sequence Number=SeqID_200283
atgaagatgcagcggaagacaaatgagaagagagctagaaacaagctggttttggaatccaaaagaatgggaactgacgacatagctgaatgcacaaaaatgcaagcttggaattggattagatcctgtgaagtagggatatgcagttttcctccatgtatcacggtatcgatcggatacgtgagggatacatatcccacaattatccagtttgacgctgtttga

SEQ ID NO: 83506 - DNA, 192 bp, Glycine max
  Peptide Sequence Number=SeqID_200284
atggaagacgcacctgcgagtcatgcgtcgccctcccgccgaagggtaggttgcgatagaggtgaagaggttagagaatgggaaagcaaagtagagagacggaaaagaaacttatgtcctaatgtcacatcctatcaaagcaatgtgtcccgacatccttcagcacaaggttccttaaagcaattcacctag

SEQ ID NO: 83507 - DNA, 1248 bp, Glycine max
  Peptide Sequence Number=SeqID_200285
atggcctcccttacgccattgtcaccgaaaactgacacccaattcaaaactcaagcttatgaagacttcctgacgaggctaggggtcaagcatctcgtcacctctgtcgaacatcctcggaccaacagtcaggtagaggcagccaacaaaattatcctcaaggtcctacacactagagtcgacaagtctaagggtttatggaaagaggaactcctcagtatactctggacctaccattactcaccccaaacaacgaccaatgaaactctttaccaactcatatataacaaacacatcatgatccccgtcaaagtcagggaatcattgacaaggagattattgttcctgcaacaacaaaatcaagaaaacatgagggtagagctcgagacaacagatgaagttcaagaaatggctagaattagggaagaagctaccaagcttcgagaatcaagaagatacaatacaaaggttcaaccacgagcttttcaacccgacaacctcgaatggcgagtccaaggcgaagccagaaaagatccccaagcaggaaagcttgatcccaattgggaaggcccattaagggtcacaacaagcctagacaatggagcgtatagactacaggaactagatggcaaagcgattccaagaacgtggaaccttacccatttgaagatagacgtcgctggtcgattctccaaagactcgcaaaacccaaggttcgcccttggtgagtcttggttctccaaaggctcacaaaacccaaggtccacccttggtgagtctcacttctccaaaggctcatcaaaccaagtttcacccttggtgagtcttagttctccaaaggctcgcaaaacccaagacccgcccttggtgaaactcgccaaaacccaggacagacacgtctttattcttttctccaaaggcttatcaaacctaaggttcacccttggtgagcctcttttctccaaaggcttgtcaaacccaaggcccgcccttggttcacccttggtgagccactctgttgctaagttccgtctccacaagaactcaaggaaaacaagtctgcaggaacattgcaaacccaaggtccacacttggtacaaaaacccaaggtccacccttggtatgcacttctacaaaacccaaggcacccctttggtcagctcactccttaagaaacatgacgatcacagtcaaaggtctaggttccataagacgaactaccaccagaatggtcgacaagacctttaa

SEQ ID NO: 83508 - DNA, 648 bp, Glycine max
  Peptide Sequence Number=SeqID_200286
atgtgtctttggatcgcatctacaccttccgcgatgctaattcattgtggggtattctaccaaggtcttcttccatggaagtttggtaattttggaggagaatggaaagtggcaccaagaggtcgtgagcaaggtggcgtccttggaggcgaaggtcgccaaatggatggttactgctcacattgcctgggaagtggagtgcccttagctgtgaagtcgaaccatcaatttttgaccaaggttggtggtgtgcttgccatgttgctgtgcaccagattggatggtgatgagttgtttgagcgctgcaaggacttgcagaaggagaaagatgactttgctggcaaggaggagagcacgatggtggggaaggatgagtttgccaagctggttgctgacttagaggcccggttgaaggagttggagtccaggctggaggagtttgagttgctggcatccaaggagagggaggctaacaaggaactcgaagaggagttgataatgcaggctgggttcttcgccaaggaccttaacttgggtctttttgaccctttcaaggacgtgaatgatggtattttgctcgacgagaaagatattgatgttgaggaggagcaggacattgaggagcaaggcgatgatgccaatgcttag

SEQ ID NO: 83509 - DNA, 537 bp, Glycine max
  Peptide Sequence Number=SeqID_200287
cttggcaagggaattttgaagcatgggtacaggatcctttacatgtaagacctatagctcatgcaatttgggatcctcattttggtcaaccggctgtagaagcttttactcgaggaggtgctctaggcccagttaatatagcctattctgggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaagtttatggctgaccgatattgcacaccatcatttagctattgcatttctttttctagttgctggccatatgtatagaaccaacttcgggattggtcacagtataaaagatcttttagaagcacatactcctccggggggtagattggggcgtggacataagg

SEQ ID NO: 83510 - DNA, 471 bp, Glycine max
  Peptide Sequence Number=SeqID_200288
atggatgtagatataagtcgtctcttggccagggcattagcagagcagcttccactcctcccttcgataaggcttccctttttgggcactggacctagttaccgctccatgggaacatctatagattccgctatcgggaaagtcaggcatggaatcacgctaagaatatttgaggatataggagtagggctattcttcgcaccgagaaaatcttttgttaatctcgttatctccacgggcgctgggttaagggcagaatcagaccttggggaaccgggtagagtcacttatttcattccctgggctttccatcctattatggggcttgaatgcgggtctttggctagagacggagactttcccagtgaaagcgctggcgttcagtttggttgcgtgctttccgatctctttcccttcctttctgtggtagcatggttaacggtagcatgtttgctagtcttgtcggactag

SEQ ID NO: 83511 - DNA, 267 bp, Glycine max
  Peptide Sequence Number=SeqID_200289
atgtgtatatttaagttgtggagactttgtgggcagagctgttcatatgtgaataatcatctatacaacataccccatatccaacaacttcaatatctaatgcaaagaagccaaaatcccgttcttacattgtactcgcgaaagaaggttcttccgcaggaaggaaaagcactcccgcggatgctagtggaagatggaagacatgtctcttccgcgggattctgcggaagaaccatcttccgcgagaaggaaatggaacgtctttga

SEQ ID NO: 83512 - DNA, 192 bp, Glycine max
  Peptide Sequence Number=SeqID_200290
atggaatttgaaggagcatgttccaagaagatggatgctaacccagttgctgtagttgaagcttttattcatataaacaaccaattacaccaacatgagcgatgggatcatgccctcaaggcttatacaacaaaggcttctcaagcaacaagtccacatcttgtcttggatgccactttaggtttattctga

SEQ ID NO: 83513 - DNA, 294 bp, Glycine max
  Peptide Sequence Number=SeqID_200291
atggaaatcacagaacttttctctgtcacaactgcccctgactctcaattcccatcattctacctgtgtgcacattctatcacccttccaaacatcagatatcttggacctccatccaattgtcaagcattcaattccagttactggtccaatgcatcgggaggttgccaattgctgccgcacttggcatggaataaagatactcaaaggtggaaggtgtcttcaatgttgccaagtgatttatgcaaccagtacaaaattggacccaaaattactggaatgaagggtgcatga

SEQ ID NO: 83514 - DNA, 1335 bp, Glycine max
  Peptide Sequence Number=SeqID_200292
atggcattgcgttccgctatcaccctaataatcatcttcatactttcttccttccatgtcgttggaattcaaatcatctccaaatcgaagctggagaagtgcgagaagaactccaattccgaggacaatctcaattgtactaccaaaatcgtactcaacatggctgttcccagtggctcgagtggtggagaggcgtcaattgttgcggaattggtggaagtggaggaaaattcaagcaggaaaatgcagacattgcgtattcctcctgtcataacggtcaacaaaacttctgcatatgccttgtatcagttaacatacatacgagatgttccttataaacctgaagagtattatgttaagacacgcaaatgcgagccagatgctggtgcaaatgtcgtgaagatatgtgaaaggcaagccatactgcgggatgaagagggtcatattatcgagtacactcagccaatatgttgtccatgtggaccccagaggcggatgccttcatcatgtggaaacttctgtaagtgctttgatgttgcaacattctttgacaaattgacaaaaggaaaggccaacactgcacattgtgtgcgtttccctggtgattggtttcatgtttttggcattgggcggcgaacattgggatttagtgttcgaatacaggtgaagagtggaactaaagtttcggaagtgtttgtgggtcctgaaaacagaacagtgatctctgatgataaatttttgagggttaatcttattggagattttgttggctatgaagcttttaatcaacaaccaaacttttgctcttctcccttttggacctgcttgcataatcaattatggaattttcgggagagtgctgggagttattctttctccataggaattacagaggttcttagtacaaaccttgtgctagaattaagtgcgaatgatgtagagtatgtttatcaaaggagcccaggaaagataagaagtgttagcgtccctacatttgaagccctaactcaatttggtgttgctacaatcacaactaagaataccggtgaggtggaagcgtcatatagtttgacgtttaattgctccaaggatatcaccctgatggaggagcaatttttaataatgaagccaaatgaggttacaacccaatcatgcaaaatctacccaagcactgatcaggcttcaaaatatttttgtgcgggtaaagttgaagctttggatttatacgttatctattccgaggataaggaacacattaacatttactgtgtcctttttttgggttttttggatgaagccgtattaaaggattctgattataatgaagttgattga

SEQ ID NO: 83515 - DNA, 1872 bp, Glycine max
  Peptide Sequence Number=SeqID_200293
ttcttccgcggaatcccgcggaagtgccatgtcttccgtcttccgctggcatccgcggaagaaacgttcttccgtccgacctcccacgacacattcacacacgtgaaagaagcgaaccttccgcgaaagaaggctcgtcttctacctcgcgcaaccaagcccagcacagaccaaacatgtcttctaccctatggccatcataagcgattaaaggagaaaaatgaggttagaacactaacctataaggcggaacacgaatgcaaggcaggttcaaagcttcaatcggccgacaatggaggacgacgcgcgcgtggagaagaagaagaactcaaacctggacgcggggagaagaagagctactggaagctggaagcgggaagctggaagaagaagagcttttggtcgcggaagaagagtttgaaccgcccaacccacaaacccagttccttccgactgagatctaacctaacccactcacaagaaacaaagacacgaacgaaccacttagagctttctgcggcgccctctatcattgtcgtcgtctcggtttcttcccttctcgtggcagatgaggttggaaggtcagaaaccgaaccgtctaacccacacaaacacaacccagatactataattggttggactagcacttttttgtttattcctaaatacatggacactgatgccactggagatcctgttgacaagctcaaggctatccagaatgatgatgtagaatatcaagacgaagatgatgattttgatgacgaagaagaagaagaagatgaccctattactcttggtttcgttgacaaacccaagaatgaatggtctcttcgccgtcaatatttcccaagcaaaactggtggagtcccggcttggcttgaccctctgaatataccatcagggagatcatctgtgtgtgacatttgtggagatcctttacaactcttgcttcaggtttatgcaccaactgacaaggaaaccacatttcaccgaatgttgtttgtttttatgtgtccctccatgaaatgtcttcttagggatcagcatgagcaatggaaacgccatccagagaagccatctagaagtgtgaaggttttccgttgtcaactaccccgcattaatccattttactcacctgaatgccctcagtataatgagagccacgaacctgctggcagtggagctgctctttgtgattggtgtggcacctggaaaggagacaagctttgtagtagttgcagacaagcacggtattgctctgagaaacaccaggctatgagttggcgcacagggcataaaactgcttgccaacagatgaaagtttcttcacctgtttttggacccaacaaaagtggaaccacctccttggagtctcataaagttggaagcaagaatctgtggcctgaatttgagatcagcattgaagatgaaagtgaatataatagggacatatctgaggaaaatagcttagctaattccttgatctctaggaacaggaatgatgacacaatgaattcacttatggataactttaagggtgatgatgacaaaaagagctgggcctccttccaggaacgcattgccgaggctcctgaacaagtgttgaggtattataggaatactaatgccaagccaatatggcctgtttcaagtggtcgaccatccaatgctgatatccctaaatgcagttactgcagtggaccaatgtcttgtgaatttcagattttgccacaactgctctattacttcggcgttgacaacgaagtggactctctggattgggcttcaattgtggtgtatgcgtgtgaagcctcttgtgaagcaagtttgccttacaaaaatgaatttgcttgggataggcttgattag

SEQ ID NO: 83516 - DNA, 1693 bp, Glycine max
  Peptide Sequence Number=SeqID_200294
accgagtcgtaacaacaacaacatcaacaacgatagggctgcagagaacattccaatggataagaagaagaagaacaatgtggatgaaacgcggaatgcagatacagaaacaacaaaacagcatgatgatcctcggggttcccttgccttcatcagaatgataacaggggaaaagattgtcgttcaagggagaagattgtcgttcaggggagacttgagagtttcaacgtgggacactgtgatggacgtaagacagttccttcttgagtctaaggaggcatgctttcatcacgtgctaggactcgttgcacacgaaggatggccacttgtggaggttactggtattaccggttgtggtgttgtccttggaaatggttcagagcttgatggacctggttatatggaggatatctctggtttgttgagtaatgtgctaccatcctcattgaaggatgttaagtgtgtggagagcatattgttttcttccttcaatcctcccccaagatatagaaggcttgttgaagattcattttatttggatgtgacaacgctggagggtaatgtgttttgtataacgggaagtacaaggatgttttatgttaactcgtgcaccacaaagacttttgacccaaggccaagcaaagctacccttgaagcaacaactcttgctactctcttgcaaaagattagccccaggttcaaaaaagctttccacgaaatttgggagcagaaagctgctgcacattgttttgaaaaggagcagcctgtattgatgcctaatttgtggcttgggtcatacccagttcctgacagggctgagaattcagtaactcttttatatggtagcgagccacttggcatgccaagagagtggaatgaggagttgcaaacatgtcgagaatttctccatacaactccacttgagaggcttatgcgggatagggcactttatagagtgacatcagacttcgttgatgcagcaattagtggtgctgttggagtgattagtggctgcattccttcaataaacccaactgacccagaacatttatacatgttcctgcacaacaatatattttttagtttttctgttgatacggaccttcagaagttgtcaaagaaatctacagatgataattcacaaacatggagtacaggctccccacacagttcttctgaaaaatcttgtgacttccagggccacaacctccagacacaagaagggataaactcagggaaatttcattgctatctgccttattatattgcttctctatttatactgttaattggaataacagaatttgtgattctgctctatcctatcctaacagaattgggattgcacaagcaaatggcaagcattgtcgtagtggtgcgccccctacaggatgcgccagctcagcaaagtaatggtgcctatgtagtgttgctgctatcaatcaatgacatggaagttattcaagatattcctcctgaagctgaactggctgagagtgatgtggccacatatgcttctttaaacaatgatttgaatggcacaaaggctgaccaggaagctgatgtcccaggacttcacaatcttgctgtggctataattgactacaagattttttcattgggtcactatcaccatttgaaggacagctctgctagctctagactagaagattttactattattcctgactga

SEQ ID NO: 83517 - DNA, 234 bp, Glycine max
  Peptide Sequence Number=SeqID_200295
atgtacggagattgttcctgtacgacttatgcaaattcagacatcaggggagaaggtagtgattgcaccatttggtacggtgatctgttagatataagactgattccagaagctggacaagatcggtatattagattggcagtgtctgaaacagagatcatcatcagggttaaaggaaagaacaatgaaagccaacaagaagactttgagctacctttgtttgactttgcctaa

SEQ ID NO: 83518 - DNA, 114 bp, Glycine max
  Peptide Sequence Number=SeqID_200296
atggcgagtggggttcgctttggatccttccagcctgtacttactgaccgcagaaaaactgagatgttagatgtattactacactatccatttcgcatgagaacaatggactaa

SEQ ID NO: 83519 - DNA, 843 bp, Glycine max
  Peptide Sequence Number=SeqID_200297
atgactactattttaacagcagaaagtgatgtcaaaatttatattcaacaagttccagagcttgatggacctggttatatggaggatatctctggtttgttgagtaatgtgctaccatcctcattgaaggatgttaagtgtgtggagagcatattgttttctgccttcaatcctcccccaagctatagaaggaagttgataaggttttctgtgcttttcaggcttgttgaagattcattttatttggatgtgacaacgctggagggtaatgtgttttgtataacgggaagtacaaggatgttttatgttaactcgtgcaccacaaagacttttgacccaaggccaagcaaagctacccttgaagcaacaactcttgctactctcttgcaaaagattagccctaggttcaaaaaagctttccacgaaatttgggagcaaaaagctgctgcacattgttttgaaaaggagcagcctgtattgatgcctaatttgtggcttgggtcatacccagttcctgacagggctgagaattcagtaactcttttatatggtagcgagccacttggcatgccaagagagtggaatgaggagttgcaaacatgtcgagaatttctccatacaactccacttgagaggcttatgcgggatagggcactttatagagtgacatcagacttcgttgatgcagcaattagtggtgttgttggagtgattagtggctgcattcctccaataaacccaactgacccagaacatttatacatgttagtaggaccttccattttaaaacttgtgctatttatccaatatattattgaagcattttcaagccagaatttgtaa

SEQ ID NO: 83520 - DNA, 544 bp, Glycine max
  Peptide Sequence Number=SeqID_200298
atgaaggcaaagatattagagaatgttttaatcatgtctagattattgcgatccttttcccgtatctcttttcgctcaaattcctcctcttcatcttcttcaagaaacaccaatctcttaaatgatcaagataaccagacccaagaggtcgccccaaaacacaatctcttcgatgaggaagtccgattcgaagatattaatcaaaacatggatgactggaacattccagaaatccctcaggatcaactatatgttcctgaaacaattaaagacaaacacaactttgattatataatcaaaaaagtagaaaacaatattcctctaggacaagatataggggaagaatttcatctactttcaaaaaattcaatttatgaacatagccgtaagtataaatatctacacatcggttgtatacaagtagccatcaagcccttaattgatatgggcatagatgcagcagttttaatgtgtctaagagatattaggcataatcaatttgaagactccctaattggaacagtcgaaaccagcctaggacaag

SEQ ID NO: 83521 - DNA, 447 bp, Glycine max
  Peptide Sequence Number=SeqID_200299
atggagaagggtattaatttgctcgagcaaatattgaaattatacaaggattattaccacggtggattgatgaagcttgttattattggtggaggtgaagatttatttcactatcttgtatatggctattctatttgcattcaagaagttactaggaaaacctataatgttgaagaagtaattgctgaccaagaacccatgtttcactttgtgtccttgttcatagagggaaaatggacaaaagagcagcttagttatgttgttgaatgcagcccacgagtaacatatcgtatctctgggttttgtttctgcgttcagtcatctgagtaccacccagttcacttacaaggtagaattgaaaacttgttaaatggcctggaagaattattggtaagtgttcctgattccttcaacctccatgttcttagcgtatttgcttccttgtga

SEQ ID NO: 83522 - DNA, 132 bp, Glycine max
  Peptide Sequence Number=SeqID_200300
atgcatatttatgaggaccagtctcagggcatattatgctatgaagatgagacaggagaaataatttgtgaagggtacgatgaagggcctcgttatcaacgaattcctaggccaacgcatcaccgaaggtag

SEQ ID NO: 83523 - DNA, 393 bp, Glycine max
  Peptide Sequence Number=SeqID_200301
atgaaagcccaagttgatgattcatggttgtggcatcgaaggtttggtcacttcaacactcaagctttgaagctgctatatcaaaagagtatgatgaaaggtttgccatatttgaaagaaaataataaagcttgtgaagtttactttcttaaagaaaaatcaaaagtctttggaatattcaagaagttcaaagcatttgtcgagaaacaaagtgggaagcatataaaagtactcagaagtgatcgaggcaaagaatacaactcacacgagtttgataagttttgtgaagatgagggcattgaatgtcaacttacagtggcatattctccacaacaaaatggtgtgtctgagaggaaggatcaaacaatcatggaatggccagatcaatgttga

SEQ ID NO: 83524 - DNA, 546 bp, Glycine max
  Peptide Sequence Number=SeqID_200302
atgaaagaaggaaaggaggacgcgaggaaaagaagcgggaaattgcgtagatacagacgaagaggaaagcaatccctcttatcacgctcatgccccttagcttcacctagatcgaatagacaggccaaatcaactcggtcttcattagtatgcttactcattgctgtgaaaccaatgctatcattccccggtcaccagtctacgattggcagtaccgcatcgattgggagacatagaaagcgatcgtttacacaaattgatccatcccgaataagatggcaaccgcctgtgctagagcaacagcgtcaagcttggcatgataggcagttacgtcataaacctattttcaaaggctaccagacttggggacttcaacttaagaacaaggataaccaggaatcagagcagaattcacccagcagctctgttctcagtaggaaagtcgcgtgggttcaaagtcctaagctaggaggaagaccggcatctgagaactcctctaatgctgctaaggaaggacttggccggctaggaatccgcctgacctaa

SEQ ID NO: 83525 - DNA, 276 bp, Glycine max
  Peptide Sequence Number=SeqID_200303
atgagaaccagattgagtagagctgtgagtgagagcgagaatgagagggcgggagtgatagcaagaatgagagcacagagcaagaataagatgcgcacgttccgccgtgaggagttgagtctcacagtgagagagcgagaatgcagtgatggcacggtgggcatgtcctaccgcaaggagttgagtcacaatgagagagtaagagtgagagtcacaaggaagaggagaatgagagttgttgcgctgcgaggaagaggaggagaacacaagaactga

SEQ ID NO: 83526 - DNA, 333 bp, Glycine max
  Peptide Sequence Number=SeqID_200304
atgggtgaccttctaggacatttcctggaaagcatgttagtgagaacaaaacacactgaaaaatcttgtgttagtttgtggggtcagtcattaatcctaaaagcaggcagagcagattatcgaggtctcggaaaaggctacctatggaaggagttgagtgaagtgcaacctatgaagtattgtagtgtgaaagccgttgagaagttgacaatcaagaatgttacaagcctaatcaagccaggtaaggtgttaatgatgttggcacagtgcacattataccccgaatgccgatttgaaatgatagagaaaagaattgtagaggtagaaggataa

SEQ ID NO: 83527 - DNA, 1092 bp, Glycine max
  Peptide Sequence Number=SeqID_200305
atgtttgcctttacatctcccggtatcaaatttgacaaatcctataacactggaaaaggacctccaactttccgtatacatggacaaacacatcatcttattggaagcctcctccctatgcctaataacccacctaagtttgcacaactatatatttatgatacagacaatgagatcatcaacagactttcgcaaaacccgttagtattcatacttatgtcacacatgatgcatgatatgcttgatgaacggattatcattgcaatcaaagacatgcttgatcatcacaatcactatgctcaaaactttcgaatggcaagggacaaattgcattttgttgcagttccagacctgaagatgaaactcattagtcaaagacaaacagacggaaggttgtataacttaccaactacctctgaagttgctgccttgattgttggtgatgaacactcagctgataaaagagatattataatagaaaaacagtccggacttctgaagagaatacatgaacttcatcctgcatatttgcctttgcaatatccacttttatacccaaaaggagaagatggttacagactaaatatacctcacaaagatcatgccaatatacatgctgcaaagaggaaacaaactatacttcattccagaagattatttcagcaatggattgttgatggatattgtatgattgagtctcaaaaactaaactatgtcagacagcatcaacaacaactcagggttgacaaatacatcaatttaactggctctaatgatcatcctcaaacaattggtagggacataggaaaaagaatcatactgccaagtagttttgttggtggtcaaagatatatggagcaactgtattttgatggtatggcaatttgtggacatcttggatttccagacttattcttaacaattacatgtaatccaacatggccagaaatacaacgcaaggtcacacaatccaatctgaccccaaataattgccctgatattattacacgagttttcaaaataaaactcaatcaattaatgaatgacttaaaacatggcaatatctttggcaacattattggatgcaagtaa

SEQ ID NO: 83528 - DNA, 186 bp, Glycine max
  Peptide Sequence Number=SeqID_200306
atggttgaactggtgaagaattcaagagtaatgaagaaagcacaagctaagttagttccccaatccagcgatgagacctttaatgttactcgggcacaaaagattcttgatgaagaccattatagattaattgatgtgaaggaaaggatggatttaacactactagaaaacagcgttccacaatga

SEQ ID NO: 83529 - DNA, 297 bp, Glycine max
  Peptide Sequence Number=SeqID_200307
atgtcaaatgaagaattgaagttgcaggatccacgatgtcggatacaatgtcctgacatcctgcccgaaaatactggagttgatgcacaatgcataagtcaagataaaatgtcaaatgaagcattgaagctgcaggatccacgatgtcggatacgatattttcaggaaaatgatagatctcatccagcacaagcagttgcagcccagaaacgcacattgctatataatcatggaggctgcacgagttctgtaccaagtccgggattgaagagttattttgtgagttttgggacttga

SEQ ID NO: 83530 - DNA, 168 bp, Glycine max
  Peptide Sequence Number=SeqID_200308
atgatagatgaaagggcaagtggtgtttgcaagaaatggaaacaaggggtgaaggagtctcttgctcgaagacacaatcttagctttaccggttggaagatggatgatgactccactgctcaccttgtttatcacgcctacaacctcactaaactagacataccctga

SEQ ID NO: 83531 - DNA, 546 bp, Glycine max
  Peptide Sequence Number=SeqID_200309
atggaccgtttaaaaaaattgatccgtaacccgcacggaccatgggccccgcgggccagtccatggacctgggcctatttacccacccctatgcaccagttcggatatgtccagagtattcctccacatcctgtcgattcatgggagtcatttgatgaaatagatgtcaggtggatgcactactcaaaccatcttgcgctagcaggtgagatgtgtgttgtgccaggtcaatgtgtggccgactacatggactggttcttcgtcatttctcatccattcatgaccgcggcacaaccatcaaatccgccgcgagatccacttgcgacgcatgatgcctcatttgtggagccacatatccctcaaatcctgaaaccagcagcagcatcaacacatgcccgttctgaggtggatgagcctagacatgcagtggcttgccatgcgatcgctgaaaggttggagcgtaatctcaacctaaggatagtcacgccaagcacaaagacacatgaggtcatggaacaacgcctcaagattgccagggtgtcatag

SEQ ID NO: 83532 - DNA, 222 bp, Glycine max
  Peptide Sequence Number=SeqID_200310
atgaccatggacgaattaaagcgcctaagcatcccctcagaaatgcttaaattctttaaccactctattttcccccaccagggacatccgacaagggacatccgacaaggtcaatgcaccccccatgaacatacacaacatgcacatgtcaatgcatttccaacatcatcaacattccatttccatatcatactcaacataaacatcatctcatctctatga

SEQ ID NO: 83533 - DNA, 120 bp, Glycine max
  Peptide Sequence Number=SeqID_200311
atgaaagaaagagaacaggaggtcttcataccagataaattttcggcaaggaatcgtgtgcaaaataaagtcatggtgcagttatggtttgggattagggtaaaacacttgcctgtgtga

SEQ ID NO: 83534 - DNA, 399 bp, Glycine max
  Peptide Sequence Number=SeqID_200312
atggaggacaaaccctggaatttcaatggattgattaaacatcaaacgactccattgccatcactccaaaatggtcaaggtggaccattgggtactagtaccctcaccttcagagggctacatgccctcgccttcagaggactacacgtcctcgccttgagaactacacgtccacaccttcagagggctacacgccctcgccttcagaggactgcacgtcctagccttcataggactgcacgtccttgccttcagaggactataagtcctcgccttcagaaggctacatgccctcgctttcagacgactacacgtcctcagcttcagaggactaaacatcctcaccttcagaggactacacgtcctcaccttcaaaggactacatgtcctcgcctttag

SEQ ID NO: 83535 - DNA, 636 bp, Glycine max
  Peptide Sequence Number=SeqID_200313
atgctttcttcacctacactagaaccagattcttcactggtgtctactccaagacgagtaagatctttgatggatatatgtgaaacctgcaacatggccatgcttgagcctgaatgctacgaagaagcaccagagcaagtagtacggcaacctggagtcaactacaatgaaacatttgtcccagtttctcgcctagatacaattagagccttaatagctcttatagcacaaaaatggtggaacatctaccaattggatgtcaaatcagcattgctaaatggtgtgcttgaagaagagatttatatggagcaaccacaagcctttgtaagcaaaggcaatgaagctaaaatgttgaaattgagaaaatctctatatggcttgaaggaagccccccgagcatggtatagtagaattgatcagtacttcactgatcatggatttaggagaagcaagagtgagccaacactatacatcaagactcaagatgatcttatctacacaagcaacaatttgaagatgctgaaagaattcaaagaagacatgatgaagacattcgagatgactgaccttggcttgatgaattacctcctcgacatagacgtaagacaacaaaaagaaggaatatatatctcttag

SEQ ID NO: 83536 - DNA, 189 bp, Glycine max
  Peptide Sequence Number=SeqID_200314
atgacaatgttgagcatgagagaaaaaacaagaatagagccaacactagtgaggaaaatgacaaagattgtgagcttggagagaatcaaaagggttttgacgacagagaaggttcaaccaaggacaaaagatgacatctctgtgggagggtggaccaaacacaaaagtgctttaaaattgagggattaa

SEQ ID NO: 83537 - DNA, 372 bp, Glycine max
  Peptide Sequence Number=SeqID_200315
atggggttatgtcactttaagttgtatccaaatcattatgtatttgatgccattgccaagattgtgctatgggtgacaatttcgttcctgttgaagaaagaatcaattacgttggtggtgacagtgttcttaattatgttcctctttcaataccttcccaaaatgtatcactctgtttgcctcttacgtcgcatgcaagacctctctgactacatttttggaaccgtttggtggggtatcacacttaacctgatcgcatattttgttgcttcccattattttaccgatgctagaccattggaaccagagagattgaaggcgcttcgcattcagtgggcaaagtactatatgaaacttaaacatgaaacttaa

SEQ ID NO: 83538 - DNA, 249 bp, Glycine max
  Peptide Sequence Number=SeqID_200316
atggtgccaacgcaatcatcgatgaccacctcgcgcacctcaccttcacatcctctaactacaatgtcaccttcgccgcctcagctagatccccgtcatccagatgcaaaatcacgaaggttggcaacgagcgacgatgaagatgaggcatcgcgtcctcaacacacgaggaagaagatgaggcttatcgagaaagataacgatgatgacaagaatgccataactgcctcagcttacggaggacgctaa

SEQ ID NO: 83539 - DNA, 339 bp, Glycine max
  Peptide Sequence Number=SeqID_200317
atgaagttgccgtggagcaaaactgcaacccccacgaacgttcataacaacaatagcaatggctggaggttggtcatgtctcttttagcttccgatgatcctttagatcctttcatgataaattgcattcctttcactagcagatgcaacttcagaatggtcaatgaagaagtggcatttcttgttgcaatcaaaataggatggaaggactattattctaggataagacttagatgcaacttcttaggtgttttgtggaggagcagattgaggctaaggacatgctcaacattcagcgttagatgttgtcagttagctgtggtagttgacatttgttag

SEQ ID NO: 83540 - DNA, 459 bp, Glycine max
  Peptide Sequence Number=SeqID_200318
atggccaaaccaaaatgccaggttttcggtttcaacccactaacgtttaggtatttgactagtgggaagttgaattgggccacaaaggttgggtattggaagactactaggaaggatagagcaattaaacacaataatagagttgaggggatgataaaaacactagtagagcctttaagggagatcgaactgattgggttatgcatgaatttagacttgatgacaaggtgttggctgatgaaggtgtatcgcagaaatcaagcatgcggtaaaactatgcccgaatcattaggacgtgaagaacaagttgcaaaaacatttgcttcttgggggattgactacttgaagtatgataactatgagaataacaatataagccccaaagaaaggtaccctccaatgagtgaagctttggccaacactggaaggccaattttcttctctttctgtgaatggtga

SEQ ID NO: 83541 - DNA, 240 bp, Glycine max
  Peptide Sequence Number=SeqID_200319
atggataaagttgtctctagaatatttccattggatttaatgatgaaatatgtgcaatttcagttgagcttagctaatcagtgggctaagcgtgcatccaccgctaagtgcgcttctggcagggtatcagcatcaaggctgcgcgctaagcgcgagatcaatgcgctaagcacagcaggtgtcttcagccaggctcaacgcacgactgacactaagcccgaatccacttaccaacgctaa

SEQ ID NO: 83542 - DNA, 303 bp, Glycine max
  Peptide Sequence Number=SeqID_200320
atggctggacgaaatgatcatgtgatagctaatgctctccaagccttagctcaagctatggggaatcataataaaggagaagagcaaaaggttgcttttggcgtgcatactttgatagaagaagctgggtactggtgggagaacactcgccaatgcctggaagctgaaggtcaagctatgataggaaagtggcatctccaatcacctttcctccttctccattctgctaccattgatcttcaagaagcaaaggactccattggtgaagaagattcaaggcctgcaagctctacatggagctaa

SEQ ID NO: 83543 - DNA, 324 bp, Glycine max
  Peptide Sequence Number=SeqID_200321
atgaagcagtggaagaaaacaaaaagtataaagtatgacttccacccctgcacagaaaacttggactttagacatatacctgccctgctcgaagatacaatttggtgtagccaacatggtaagagagccacttcacattggtttactattgttgatttgatgctacgaattagtacatatgttagaattgaggcagaaataagagtgccaaacaagtatgcattagagcaaagtgaattactgcaagctcaatcagtgaatcccagtcattctccttctattggtgtgggacagaatagtaaaagaaagcagatatttacctga

SEQ ID NO: 83544 - DNA, 552 bp, Glycine max
  Peptide Sequence Number=SeqID_200322
atgtttcaaatgaataaaaacttgtttggtggaacttggattggtcttttgaatggtttagccactagtgctagagacatggtaggtcttgataaatctcgtactcctttttcatcacaagtttttcactcacttggaacccagagaaaaatcactctttgtctttctcccacttccgggattgttcaacttggcaaagtgacacatgaatcccaacctgagtctgaaattttcagatctcttactttaacaggaacctatgcctcaaatttgagagcaatcggacgtgaaatggtgaagatatggcgacttaattttcggcttcaagcgtggctgcaggaatgcagtaaagaatgttacaactctgatcatcgaggaagagatcctcaaggacacaaaacgtgtgttgtggaggctaacaacaacgccaagcataagagcaaaaacaagaacaaaaccaacactagtgagaaaaatgaagatgacaagcatggagagaagtgcaagggtttcaatgtaagagaaggacgaaaagcaccatctctatggtag

SEQ ID NO: 83545 - DNA, 204 bp, Glycine max
  Peptide Sequence Number=SeqID_200323
atgggagcatgtttctcaagtgggaataggtatgatgagtatttggaaggtagtggcaatggaagaaggatatttgcaagtgatgaagacagagcacattgggttgctgagcctggcattgacagaaaagcttctgatttcattgctaaatactatgccacacgagtcaccgactctcagtgccaatatgtgaacaccttataa

SEQ ID NO: 83546 - DNA, 594 bp, Glycine max
  Peptide Sequence Number=SeqID_200324
atggcgtttggagacaatcatggtcatccgcaccctttatgctatctcgagacaatcaagttcggtggcacgtggggagaaatcactgtcatccacaccctttttgctatccaaagaaaatcaagtccgatggcacacggagacaaaacttggtcatccgcaccctttttgctatccagagacaatcaagtgcattggcatgcgaagacaaaacacgatcattcgcaccctttatgctatctagagacaatcatgttcgattgcacgcagagacaaaacatggtcattcatacattcttttccatccagagacaatcaagtccgatggcccgcagagagaatcatggtcatccgcacccttttggctatacagagatagtcatgtccgatgacacgcggagacaaagcatggtcatccgaaccccttttgctatccaaagacaatcaagtccgatggtgcgtggagacaaaacttggtcatccgcaccctttttgctatccagagacaatcaagtccattggcatgcggagacaaaacatgatcatccgcaccctttatgctctctagagacaatcatgttcgattgcacgtag

SEQ ID NO: 83547 - DNA, 336 bp, Glycine max
  Peptide Sequence Number=SeqID_200325
atggcttcggatgaccatattttgtctccgcgtgcattattggatagcaaaaagggtgcggatgatcatgtttgcaaaaagggttcggatgagcatgttttatctctgcgtgccatcggacttgattgtctccagattgcaaaaaggcagatgaccatgttttgtctccacatgccatcggacttgattgtccctggaatgcaaagaagcgaaatgggtgttgatgaccatgctttgtctctgcgtgccaccaaatttcattgtctctggattgaaaaaaggcggatgaccaggttttttcttcgcgtgccatcaggcttgaatgtctctagatag

SEQ ID NO: 83548 - DNA, 690 bp, Glycine max
  Peptide Sequence Number=SeqID_200326
actagattgtctctaggtctcaaaaagggtgcggatgaccatgttttgtcaccacatgccattggactctattgtccatttatagacaaaaagggtgcggatgaccgtgttttgtctctgcaggccatcggccttgattgtttctggatagcaaaaaggcctcgaatgaccttgttttgtatccatgttccattagacttgattgtctctggtagcaaaaatggagcggatgaccatgttttgtcttcgcatagcatcggacttgactatctctgcattgcaaaaatgggtgcggatgaccaagttttgtctccacgtgccattggacttgattgtctttggatagcaaaagggactttattgtctccagattgtaaaaagggtgcagatgaccatgttttatctctgcgtgccatcgaacatgattggctggtgcggatgaccatagtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgtgatctacgaacttttaagtgaaaggttcgggagttgtatttacgcacggggaagggtgtttccctttgctcctacgtattcctcaatttgggatgagaaaatcagacctacgtag

SEQ ID NO: 83549 - DNA, 165 bp, Glycine max
  Peptide Sequence Number=SeqID_200327
atggctacagccaggtgggcactcaagcatcctgtttatggcattgtgatactacggttgggaatttacacagacagacccaacgtttccaagacaacgttcctaaatggaaaactccacacgactccggaatttcaaaaaacgctattgacaacaacgaagtaa

SEQ ID NO: 83550 - DNA, 522 bp, Glycine max
  Peptide Sequence Number=SeqID_200328
atggaaacttcttacaaaggatctgactacactgacccagacataaagtgtcttctcttactccaacttagctcccacatcccacacctcagatttgaacatggacagagacagagtaactcctctaggcttggatttccaaccttgatcactgccctctgtagagctagaggagttatctgtgacagtctgacttatgagagcctgagcctagccattaatttggcctacattaagaaaaactattggaatatggatgatctgacagttaacttcagaggggcaaggaaggcaagggctcgactagctgatgttccttcttcttctactccaccagctcctcccacatatgctactcctacaccagctcctccaggcccatctgcccaggactctcagtgctttgagtccatgcttctgagtctttatcagggacaaatattgttaatgcaaagcctgcaggtagtctggccaggaactcagccttctcttgtgagggaaggtggaggttctggtgctcag

SEQ ID NO: 83551 - DNA, 321 bp, Glycine max
  Peptide Sequence Number=SeqID_200329
atgactgaccatcgactcaaagggtcttctcacctcgtaccgatccgaaccttcgtgttctcccacgaagacgtacctgcgaggcaacaagcgtgcaagctgacattagaaaatcttcccgacaaggtttacgagacggactgggacaggataatgattgatgcgtcgaaggggtattttgcggaggcgccagcgaggatggcggcggtgttctccgccacagtgatggcgaggaacaggaagggatcgggtgtgacgcacgtgtttttgcatgacggggatcggaaggtggaaaaggtgttcgcagaagagtttctttga

SEQ ID NO: 83552 - DNA, 444 bp, Glycine max
  Peptide Sequence Number=SeqID_200330
atgcaaagagaggatggtggcgttggaggggaagtacggtgcgggggagcagatcgagatcacgacagattgggagtcgtgggtgaggttcacagagccgaagttgtcggtggcgcggccagtgttttgaaggagtgtggtgatgagcttgccagaggggtagaggtcggactaggagaggaattggaggaagacatggtagagaaggacgtcgacgagggcggccgaggagaggtggtcgtcaatggtgaggtaggtgttgaggatggcgagaatggagagggaggaacggtccgagagatctgcgaccagggcgtggcgaaggtaaggagggaggtgaattgggagagtttcggcacggtggagaggagggcagtgaggttgttaatgtttggagataaatgtttagaaaaggagacattgaacaaaacgttgtacgattag

SEQ ID NO: 83553 - DNA, 492 bp, Glycine max
  Peptide Sequence Number=SeqID_200331
atgactataatctatttgattggtcataaaagtaacgtggtgggaactgaggcatggaaaagtgctcaggatgctacaggtttgaccccctatgactatgcatccatgcggggctactactcttacattcaacttgtccagagtaaaacaagcaacacatgcaaaagccaacacgtgcttgatatcccaggcacccttgtagatagtaacacaaagcagaagcaatcagataggcacagatcatcaaaagtttcaagtttgcagactgagaagattgaaacaacagcaatgccacgtcgttgtgggctatgccagcaaaagctggcgtacggtggcatgagaagggcactggtttataggccagcaatgctgtcaatggtggccattgcagccgtgtgtgtctgtgtggctttgctcttcaaaagttcacccaaagtttactatgtattccagccattcagctgggaatcattggagtatgggtcaatctaa

SEQ ID NO: 83554 - DNA, 1458 bp, Glycine max
  Peptide Sequence Number=SeqID_200332
atggcttcaatgtccctctcactttcttgttccattcttccatctcccattctccacaccaaacccaaacccaacaccaacctcacaaccctcgtctcagtttcagcgtcgaaaacctctgtctctgcatcttctacccgaaaacccgctccggcaccgaagcccccgaaagtaagagaatttccccaaacattgttttttgagaatctggaaaagacacgaattaagaagaagaaaaagatgaaggaggaaacgaagagtggtaaggcttgggtccactctctccccgaagtcttatcctatcgaattcacaagaggcactggagcatagcccttgagttatttgacatgcttagagagcaaccctattaccaaccaagggaagatacttacatgaaactcattgtgttgcttggaaaatccagtcaaccgcttcgtgcccatgagctgtttaactctatacacgaagatggttgtggaagtactgaactttacacagccttaattgcagcattttgccagaacaacctggttgatgaggcgttgtcaattcttgatgagatgatgaacctccccagttgccagcctgatattttcacttacagtaccttgataaaagctcttgtggattctttaaaatttgaaatggtagagttgctgtttgataaaatggctaaaagatctattgtgccaaacacttacacccagaacctcatcctgagtggttatggtaaggctgggaggtttgatcagatggagaaaatagtgtcaagtatgatggagggcactacttgcaagcctgatgtttggacaatgaacacagtcatcagtgtctttggtgataagggtcagattgatataatggagaaatggtatgacaaattttgtagttttgggatacaacctcaaaggagcacgtttaatattttaattgcagcttatggtagtaaaagaatgtatgacaaaatgtcatcagttatgcagtgtatgcgcagggtaaaatgtccatggacaacctcaacttataacaacgtgattgaggcatttgcggctgttggtgatgctgaaaacatggaacgtgcatttgatcaaatgtatgctgagggtttgaaagcagatactaagactttctgctttcttattaatggctatgctaatgcaggtatcttccataaagtaatcagcagtgttagtttggctgagaagcttcagatacgtgtgaatacatccttttacaatgcaatcatatctgcatgtgcaaaggacgatgctttgacggaaatggaaagatttttcaagcatatgaaagaaaaagaatgtcatccagataacacaacatactctgtcatgattgaagcatacagaaaagaaggtatgaatgacaaaatacactatttggagcaggaaaaacggatgatgatgtctgatgacaaaaaattgaatgagactggggactga

SEQ ID NO: 83555 - DNA, 468 bp, Glycine max
  Peptide Sequence Number=SeqID_200333
atgatagatccaggttcacatctcatgaagcttgggagagatatacagatattatggtgcctaggaaatgtagtagtttattacactgagtttgacgagttcaaggaggaactcgagagaagacactgggatgagaagttgactgattttgctgacaacaacatagacattgctattgtgaaggaattttatgccaacctctatgaccccgaggataaatcacctaagcaggtgacggtgagaggtcatctagtgaaatttgatgaggataccttgaacacatttctgaagaccccgataattttggaggagggggagaatttgtgtacttattccaggtttgcactcctaaggcctgatcctcaggagttggatgctaagctctgtatcccagggaggggattcgagctaaatgctgatgggcagccgttgaagatactatggaagaacatgaccaccttagcttag

SEQ ID NO: 83556 - DNA, 3048 bp, Glycine max
  Peptide Sequence Number=SeqID_200334
atggagtctcaattagaggggaaaaaccagtatttgtatggacctgtggtgcctgagatgaagagtgttgggaagagaagtttggagtgggatttgaatgattggaagtgggatggggatctttttactgctaggcaactgaattcagtgccatcagattgtaggagccgcgagttatttcctactgatcctgaaattcttgcaaccggcggtgcttctaacagtttgtcttctgcatatgatgatgctaacctcggggaaggaaagagagaattggagaagaggaggaggggtgttaatgacgatggaggggtggagatgaatgatggagctggttctcttaatttgaaccttgggggtcaagtataccctatcatggaaggggaggagaaaagtggaaagaagacaaagatgaccgcgagtacttcgagccgggctgtttgtcaggtggaagattgtagggctgatcttagtaatgcgaaggattaccatcgccgccacaaagtttgtgatatgcattctaaggctacccaggcactagttggaaatgttatgcagagattctgtcaacagtgtagcaggtttcatgttcttcaagaatttgatgaagggaagagaagctgtcgtaggcgtctggcaggccacaataaaaggaggaggaaaacacttcctgatgcaactgtagttaatggaggctctctgaatgaagaaaagggcagtagctatctgttaatgagtttgctaaggatactgtccaatatgcattcaaatggctcggataatatgaggaaccaggatgttctatcacatcttttgaggaacctggcaagtctggctggtacaattaatggaagaaatatagtgtctttattagagggatctcaaggtttggtaaaagctgggacatctggagctgcgcagaatgttcctaacacaaattctgatggccctgaaccatccagacctttcgattcttttatcaaaatggatgatggtctaatccatcgggaccctccagagtctatggtacaacgtgagacgactcctgctaatgatatggctaaaaaatgtatagcttcaggcagtgatggagtaggaagtttaaaatctccttcagtaccgcagtcctcaaatgtacttctgtcaagggatggccttccaccccaatcagttgcagcacagactacagttggaagaattgggttaagtaatattgacctgaataatgtatatgatgatgtacaggattatgttgagaacacgaggaattcttgtcctcctctgccttcagggaatgggtctcttgatcatcctttatggatccaatgtgactctctcaagtcaagtccaccacagacaagtagaaactcagattcaacctctacccagtcaccatctagttctagtggagaagctcagagtcgtacagatcgaattgttttcaaactatttggcaaggctccaaatgatttcccccatgctctccgatcacagatccttaactggttatcccacagtcccacagagatagagagctatataaggccaggctgtatcatattgactatatatctccgtctagaaaattccgcttgggaagagctatgctacaatctagaatccagcttgagaaagcttgctgcgcccaatgattatttctggagaacaggatggatatatacaagagtgcagcactctgtagcttttctgtataatggtcaggtggtcttagatgcaccattgcgcctcaaaagtccgcaaaattgtcaaattttatgcgttaaaccacttgctgtttctgcaagttcaagtgctcaatttgttgtgaaaggattcaattttttgctgtctaacacgaggaacaagtacatctttaacaacaaggaatttcgaggggaaacagtcctggataatgcgatgttcgtcatttggtcgtggctgaaggcactggaaaagggttttaatgtcccattccaagtatggagtagtaatgctaggatgaattttgttggtggaggacgggatcgaaaagcactagggggattttttgttgtgggaacattttttgagggtgaagagagggagggagggataggtcgtgggtttgaatcctcccgctcttcgctatgcgaaggtatgggggagggatgttgtacgcagccttacccttgcatatgcaaagaggctgtttccggattcgaacccatgaccaacaagtcaccaaggcacaactttaccgctgcaccagggttcgccctcaaaaacttgctatgcgaagggaagtatctggtacaagatagttgttatgatttgattgacagtgctgatgcagtcaatggacatcaagagcttcagcatctcagtttctcttgtcatgtaccgaatgtgactggaagagggtttattgaggtggtggaagacaatggtcttagcagctgttcctttccattcatagtggcagagcaagaaatttgtttagagatctgtacgctagacaatgtcattgaggcagcagagatggctgatgacaaccagataaaaactaacctaatggaagaaaagactcaagcattgtatttcatacaagaaatgggttggctccttcatagaagtcgtgtgaaagttaggctaggtcccatggcacctgtccaagatcgcttccattttaatcggttcatatggcttgttggcttctctatggaccatgactggtgtgctgtgatgaaaaagctcttgaacattatctttgagggcactgttgatactggagatcatgcctctgttgagttagctttgttagagatgggtcttctacacaaagctgtaaaaagaaattgtcggcctatggtggaaatactattaaaatttgtgccagttaaagcttcagatggtggagacagtaatgagaagcaagtcaacaagtcccctgacagattcatattcagacctgatactgttgggcctgttgggttgactccccttcatgttgcagcaagtatgcatggttcggagaatgtattggatgcattaactgatgatccaggaatg

SEQ ID NO: 83557 - DNA, 228 bp, Glycine max
  Peptide Sequence Number=SeqID_200335
atggatccaaacaacagctacacacccaaaaccagcaaagatgccagaatcaaccctgaaatcatggagaagcaacccatgattgcaaaatccaaacatgcagcatcatttatcatggggggtggaagaagtttgcaatcaaaaagtgaagggaaattgaaaggaagagaagaagaagaagaagagaggcaaaataggaagtggagagagatgggggagaaagaataa

SEQ ID NO: 83558 - DNA, 402 bp, Glycine max
  Peptide Sequence Number=SeqID_200336
atgctagccgacctatatgacaccttcgaccgaagatgtgaaaagagcaatacaaggattgtttgctgtactccaactctttatgtatggttactttcacacctttttcgccaagaggtgaggcatgcttgcccgctagaaagccaccgttcatgcacagagaaaggaggggcaaattgggaccaactcttagcaagcaaagaaggagcatctgtcaactggttccctcgatggaaggaaggaagaaccggagttcttatttcctgcggaggattcccgaatgttcccttgatagggacgaggggttgcatcagttacattcccgttctcgctataaggcaacttggctaccctatgagaggagcaccaatagaggaagagattgcgcctgtcatttcatga

SEQ ID NO: 83559 - DNA, 311 bp, Glycine max
  Peptide Sequence Number=SeqID_200337
ggcgcccgttccccccagcaagttcatgtcgtcgtggcatagttctagggagtgcctgtcgcccccagcaaggtcatcaggtcccccctaccaatcgagctttcatcaagaagttctgcgtctccaggcaggcgcagggtgaaacaccacagcagcctggcgatggccgacagcgggcaacagacgcaccgccatcacctctagagttcacctctgctcatccacaaaaaggtttgagtattgcctacaccacatggccgaccaataggcgaccaagtccaaagccaaaggacgcacctagttgctcatga

SEQ ID NO: 83560 - DNA, 327 bp, Glycine max
  Peptide Sequence Number=SeqID_200338
atgtgggctatcattgaccaatacaaagagaagctaaatctagctgcgacccatgaacaaagactagaggacgagtatgcgaaagtatcggtcctgcaagtggaaagggaagcaagggagagggtgatatattcattgcacagagaagttatgatgtggatggacaggttcgctttcaccttgaatggaagccaagagcttccaagactgttagccaaagccaaggcaatggcggacgtgtactcggctcccgaggaagttcatgggctcctcgattattgtcagcatatgatcaatttgatggcccacataattaggaaccgctaa

SEQ ID NO: 83561 - DNA, 270 bp, Glycine max
  Peptide Sequence Number=SeqID_200339
atgttggtgagctatctcttcttgaaaatccgtgtactcatcgtccctgagctggacgcgtctctctcgatggaacgaccatcctttgatggcctcgaagcgctgctagtgctcggcactcctgaaacggtggctatcaaactcaggggcggcactggtccctttagccacgacgtccctcctagatctcttcgcggaaagctttttcggagccatttcttgcgaggccgatcatttggaaagttagtttacaaggagatgctattttaa

SEQ ID NO: 83562 - DNA, 252 bp, Glycine max
  Peptide Sequence Number=SeqID_200340
atggctaagtttgacccagatatagtcctggagttttatgctaatgcttggtccacagtagagggagtgcgggacatgcggtcatgggtgaggggtcagtggattccatttgacgtagatgccctcagccagttcttgggtgacccgctagtgttggaggaaggccaggagtgcgagttcagtcagtggaggaacagggttgacgggttcgacgaggaggccattgcccagttattgtgcacaccggggtag

SEQ ID NO: 83563 - DNA, 635 bp, Glycine max
  Peptide Sequence Number=SeqID_200341
atgaccaacaattccatggcaatctcaacctctcagaactccgtctccttcgacttagacttgacatcctcttggctcaaccacactagctcctcctcccagtgccctcgttgtccaccatcaccagctacaaaccaaccactagagaatctccctcttacaaacccacccaccaagaagccacatggcaggcccgcaggctccaagaacaagcccaagatcacccccttcctggtggcccaacctgtggaaccctgcatgaaggtcatcattgtcaatgtgaccccgagcagcgatatcattgagtccattcttgatgttgctcatcgaggccatgttagcctcactgtccttagtgcctctggaacgatcaccggagtaaccctcaacaactcttcgcatggtgttgatgccctcacacttcgcgggcccttcaccttgctctccctcaatggctcatacttgtacaacaaccactacgcccttcaccctggagccacccctgcccctcccttatcatttgggatcagcttttccacctctcaagggcaagtctttggcggtgccattggtggtagagtcattgccgataatgatgtcagccttacaatttgcaccttcaagaaccctgtgat

SEQ ID NO: 83564 - DNA, 225 bp, Glycine max
  Peptide Sequence Number=SeqID_200342
atgcccacccaaaccctaacaccttcttctccaccacccacaacttccggttgccaccatgagccgtcgttgcttgccactaaaccaccacaagaagaggaacattttaatcagagcggaatcctcagaatccacctcaaggattcagttaagaacaatccctcaatccattatttcgtagcttctttgagggtctttttacacttccttggaaaacccctttaa

SEQ ID NO: 83565 - DNA, 183 bp, Glycine max
  Peptide Sequence Number=SeqID_200343
atggagatgcctattggtatgtcagctttggtcattctaacttcctttgttaatgttcaagtgcacgagattatgtgtcgtaaacttggtttaatgatgaaacacaatttaaaatggaaaagattacaacaaatcacaaggaatggacataacactttttacaatttaaatataatgaattga

SEQ ID NO: 83566 - DNA, 864 bp, Glycine max
  Peptide Sequence Number=SeqID_200344
atgactatagctcttggtaaatttaccaaagatgaaaatgatttatttgatattatggatgactggttgcggagggaccgtttcgtttttgtaggttggtccggtctattactcttcccttgcgcctatttcgccttggggggttggttcacaggtacgacctttgtaacttcatggtatactcatggattggcaagttcttatttggaaggctgcaacttcttaaccgctgcagtctccactcctgctaatagtttagcacactctttgttgttactgtggggtcctgaagcacagggagattttacccgttggtgtcaattaggtggtctgtggacttttgttgctctccacggcgctttcgcattaataggtttcatgttacgtcaatttgaacttgctcgatctgttcaattgcggccttataatgcaatcgcattctctggtccaattgctgtttttgtttctgtattcattatttatccactgggtcagtctggttggttctttgctactagttttggtgtagcagcaatatttcgattcatcctctttttccaagggtttcataataggacattaaacccatttcatatgatgggagttgttggtgtattgggcgcggcactaatatgcgctattcatggtgccaccgtagaaaatactttatttgaagatggtgatggcgcaaatacattccgtgcttttaacccaacccaagccgaagaaacttattcaatggttactgctaatcgcttttggtcccaaatctttggggttgctttttccaataaacgttgtaactggtttatggatgagtgctcttggggtagtcggtttggccctgaacctacgtgcctatga

SEQ ID NO: 83567 - DNA, 525 bp, Glycine max
  Peptide Sequence Number=SeqID_200345
atggccatcaaagtccaaagagagtatgatgaactaagggacgtcaatatggccaccaccgaagccttggaacgagaaaccaagagggctggaaaggaagaacatggccaaaacaagttccaagggactttatggggcagcaacagtgagctcaagcttcgaagagacgaaaaggatcagtcgcggttaagcgagactgaagggcatatgtgggccatcatcgatgagtacaaagagaagctaaacctagcggcgactcacgagcaaaggctagaagatgagtacaccaagatatcagcggaaagggaagcaagggaaagggtaatcgactcattgcacagagaggcaatgatgtggaaggacagattcgcctttactttgaatggaagtcaagagcttccccgattattagctaaggccaaaggaatggcagacgtgtactcggcccccaaagaaattcacgggctccttaactattgccagcacatgattgatctaatggctcacatagttagaagccgttaa

SEQ ID NO: 83568 - DNA, 434 bp, Glycine max
  Peptide Sequence Number=SeqID_200346
ggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattggaacgggcccttggggcctcttccccgggcgtcgaacagtcaactcagaactg

SEQ ID NO: 83569 - DNA, 270 bp, Glycine max
  Peptide Sequence Number=SeqID_200347
atgcttctagaacagtcatttcgaaagcattttttgcttatgaaaagggagaaggaggaggaagaaaagaaaaaagaagagaaaggtgaaggagacacttaccttcatgaaatgaggaaggggggaggaggagtcgccacgagaggaacgggtgtcgtcgccatgggtgtgctgttgaagaaaggatgtcatcatgagggtgtgctgtcgagggagatgtcttcgcgggttgagagaagggaggaaggaggtgttagggttgggagatag

SEQ ID NO: 83570 - DNA, 249 bp, Glycine max
  Peptide Sequence Number=SeqID_200348
atggcacgcaaaccgaagcaggattttagcatttcaaagccaaagcagaaaaaaattcagacagctctccctcttcctcacgttgcctttctttctccctcattctccattgaagctccaaacaaagcttcaacctttggtgctcatttctgctccaaatcgcgaaaggagggcatttttggagtcgtgaagtgcgtggctacgagtgggacttcgaaatttcagggtttggggagatatgatgggtag

SEQ ID NO: 83571 - DNA, 760 bp, Glycine max
  Peptide Sequence Number=SeqID_200349
tttgacgaacccgcctttaacgtctttttcgacgaggtgaatgactggggcattgccgccttagaacgcgccatcgaagggcttaaatgtgagaccgcagtgcatatttgctacggctacggcatcaaagccaacaccgactggaagaaaacgctgggtaccgagtggcgccagtatgaggagatcttccctaaactgcagagttccggtattgatatcgtttcgctggagtgtcagaactcacgcgtgccgatggatttgattgaactgattcgtgtggctgccacgctgcgtaaagcgctgcagtttgtagatgccgataaactttatccaagcaccaactgtggcatgacgccactgtcgcgtcatgtggcttacgggctaacgcgtaacgccttatttgtctcttactcagtccgcaggcaacgcgaagtgatatatgccgctgcttttcacgctgcgctgacgttaattcaaccagcctgtgtgaacaacagccgcattgactcatcagtacacgctgttttccgtgctttcatcctcaagggacttcctggtatgttgcaatctcaatcctcccgtttgggcagtttactgctgctgctggcggcactcatcggctttgccgtcgcgctgtatgcctggctcacgccactcaccggtgtcaccggcaccattggtgcgctgggcgtcactattgccagcgtcgttctggcggtgctgaccttcctgctgcgcgcggcaaccggccgtaccggtc

SEQ ID NO: 83572 - DNA, 293 bp, Glycine max
  Peptide Sequence Number=SeqID_200350
tctacggagtgcctgtcgcccccagcaagatcatcaggccccctactaatcgagctttcatcaagaagtactgcggccccaggcaggtgcagggcaaaacaccacagcagcctggggatggccggcagcgggcaacaaacgcactgccatcacctctagagttcaccgcagctcatccccaaaaagcgaccaagtccaaagccaaaggtaagcaaagtactaggtccgtgaccgacaagccatcaagcatccagctcaagacgttaaagaagcgctactgggaggcaacctag

SEQ ID NO: 83573 - DNA, 597 bp, Glycine max
  Peptide Sequence Number=SeqID_200351
gcctcacagggttcctttgtcgcccatggacgtcaagatgtaatgactgttgccattgggcgaccagaacaccctggtcgtgtgcgtgctgctcgagtcggtgtgaccatcaagcaatactttggaccgactccaaggacctcctgcacatcttcgtccatggctcccaaagacttggagcagcagatgcaaaaaatcagggaccagctggaggagtcgatcacagaaaaaatgcaatcaaaaggactcgcactgcctcctgagcctgaggttggtccttcagctgctcatgttagcacaaagaagagttgtgttgatccctcagggaacgatccagacacgggtgactcagagaaatacgggttgtacatcgaagaaaatcccccccgcctggttgccctaggaaaactttatgaggggtcgacaaccgttcacaacatgcctttgcgccatgatcaagtcaaggttggtgttgaggaagttagagatgcatatgttcccattcttgtacccattaaagaggttcagttagtagggcagacacttaacacctttgttgtttggccgacatatcttgagaagcgtttatcagaacaa

SEQ ID NO: 83574 - DNA, 105 bp, Glycine max
  Peptide Sequence Number=SeqID_200352
atgtcggctgaaaatatcagtcgaggaaatgttcgatcggcgtcatccgatgatgctcccgttttaaacctcgatcgcataactttcctggccgacgtcggctag

SEQ ID NO: 83575 - DNA, 326 bp, Glycine max
  Peptide Sequence Number=SeqID_200353
cgaagcataaaggttatgtgagtggtagcttgtcggatgaggggaaggttggacttggaggagattctggtaaatcagaaagttctttggagaaaggcttagttgatcgcagtgacgcttcagatgttgatgctaaagtagataacatggcgaggtgtttcagaaccaaccagaggatactggtattgtcagcagccaaagttgccaaaaagatgaagctaaaatttactaaagaatggattgcatatcttagattgcctcttccaattgatgtttacaaagagctgaagcattatattctgaaacatggtgcgaatgtcatgtaa

SEQ ID NO: 83576 - DNA, 318 bp, Glycine max
  Peptide Sequence Number=SeqID_200354
atggaggttgtgctgccatttgaggtggaaatcccatcattaagaatcttggtagagtccggattaaaggagttggagtgggcccaagctcatttcgatcagctcaatctcatagaaggcaagcgtctggccgctatgagccatgggtgtttgtaccagagacgggtgaagaatgctttcgacaagaaagtacgcccacgcaggttcagcgaaggggacctggctttctccgaaagggcccttgtgctcaccaacatgaatgatgaggaactaccttcacccgtaaacgccgacgtcatcaagcgatactacgcttga

SEQ ID NO: 83577 - DNA, 198 bp, Glycine max
  Peptide Sequence Number=SeqID_200355
atgggtgccaagcacctcacgaggaccaaagaatggtcgcacgtcatcgagcaaaggtccccggacgaaattaggttagaggagcttggtcaatttgtatatgtagatgaggtctttcaacaaactcatttacgaaaggatattggtcaatttgtcaatgatagatctaggcggacacatgtgagaccattaccttga

SEQ ID NO: 83578 - DNA, 486 bp, Glycine max
  Peptide Sequence Number=SeqID_200356
atgggtgaaaatgcccttcacttaaaatataaaagttgtacacccaacactccactgttcatgttggttgtccttacgttcctcttggttgtccttacgttcctcttggttgcgccgtttgcttgctttcgcgacgatgttcaagcttcttctcctctcggcagcatttgctttcattggaggttgattatggttaaaactagagagttaggtcgtgccttagccagggttatgggtagagccttggggagagaggatcatcatgatttagatgatgttctccaacggcgaaggcctacgacatctgcacgtaggcaacgggaagctgcccctattgctgaggatgatcctatgcttactgaagacgtacatgcacatgctgaagaagttgttgatgatgttgagggatttccaagtgggctgtgtgacccatcagtgctgactgactatggtgaccatgttgtagtcatcgtatggaatgaagag

SEQ ID NO: 83579 - DNA, 674 bp, Glycine max
  Peptide Sequence Number=SeqID_200357
atgaagatcaacatcgaactggatcctgaagctttcggggcgcatcggcaggaactgttccgcaatgcggatttcgcggtgagcgcgcatcgctgcgcagaacgcgggccgatgctgacgctggcgaactgccgcggcgcgctgacggtcttgccgtatgaggggctggcgatttgggacgccgagtttgacggttattcattgaaatcgggccgccgcagcgcccgcggtctcgggagaaagcgcgctgacgacgcggcgttctgccccgcctggccgagccacgacggcgcgccgctgcagatgcagcgcgtgtggctgcagctgacgggcgatgagctgacgttgcatggcgaaggcgagcggttgggcgggcgttggcgcatcggcccggcgctgcgtttggcagcccagagcgcgcagttcgccatagagatgaaggtcactaacctggccgagcggccgcagccgctgcgctatgtgtgtcgcctcaactatgattgcattcccgacgcggtattccgccagaatctgccgacgccggctttgttaggggatgcgatcgggcaagaactgctgtgctccgacgatctgacgcgctatgtggatcaggccgagttctttatgctgacgccgcaaggccggcgctatgtgacgcgtttcgccaccgggca

SEQ ID NO: 83580 - DNA, 240 bp, Glycine max
  Peptide Sequence Number=SeqID_200358
atggatttcttgtgtcttgttggaacaagtgcgaaaccaaccaaacacagagggcgggcaaggaaagcgtcgattgctgctaggcctaccaaaaccatccacgcccgctatgccgttccgagtctgctttacgcggtccaaacctcttgcggaatccttgaccacagttgcaattctgctcaaggaggggagacatccggaggaaagatatggttttcttcccccgagaggacatcctag

SEQ ID NO: 83581 - DNA, 316 bp, Glycine max
  Peptide Sequence Number=SeqID_200359
atgattgaaagttttgaacaacaacaagaaatgtctgtcatagaattatgtgttgaagttgatgttgtgggtgcttctgcaattaatttcacaaattcattgttatcatgcggaaataatatgtctcacaatgaatcgggtagtgcaagagttggaacaaattcagaagaagattttgatgatgatgatgattatttaatatataattcatacgttgaggactcattagatgaggatgaggatattgatgaaatatctgacacaaatgaagctgcccgtttgatcgaaccacttacagttgtgcaatcaggagaag

SEQ ID NO: 83582 - DNA, 375 bp, Glycine max
  Peptide Sequence Number=SeqID_200360
atgtgggccatcattgagcagtataaaaagaagttaagtctagcggcaacccatgagcaaaggctagaggatgaagaagctatgatgtggatggataggttcgctttcactttgaatgggagcctagagcttccaaggctgctagccaaagccaaggcgatgggggacgtgtacttgactcccaaggaagttcatgggctcctcgataatttaaacaccttaactaaacacgctttaagacacccctatcaaacccattccaaaactggaatcatggttgagatagaagaggtgcaagagaaaacgaatgtcgatatagaggccttgaaggatcaaatggactccatgatggaggccatgttaagcatgaagtga

SEQ ID NO: 83583 - DNA, 234 bp, Glycine max
  Peptide Sequence Number=SeqID_200361
atgaatgctacaaacaatattaagacaaatctccctctgattgaaagtgctaaagagtttatggggttagtgggagagcgctctcaaacaactgacaagtctcttgctaggacattagaagaaatgaggcttaagaatcaaggaagtcacttagtccattatgtaagccaccaagggaatcaaggagttgaaaagaaatttgtgaagaaacatgataaaggcaaagggccatga

SEQ ID NO: 83584 - DNA, 375 bp, Glycine max
  Peptide Sequence Number=SeqID_200362
atgacaactaaagaaaatgacaagaaaaagaaaggaattgcactcaaagcctcatcttcttctattcatgaggaaaatgacaaagaagactcaaacgaaaagaacttagaagaagatgatgattttagtctctttgtgaagaaattcaataaatttctgagaaacaaaggaaacttcaatccaaagaagaaaggagaaaattcctccttagttccaaaatgctatgaatgcaatcaacctggacacttgagatttgattgtcctatctttaaaagaatatggaaaaatctgataagaaaaatttcaatgataagaaagaaaagaaatcatacatcaattgggaagataatgacatggattcatcaagtgatttag

SEQ ID NO: 83585 - DNA, 645 bp, Glycine max
  misc_feature (325)..(325): n is a, c, g, or t
  Peptide Sequence Number=SeqID_200363
atgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgncactgaggacgcttctccagactacaattcggacgccgagggcgaccgattttcatggtgggcttttcccggttcgctcgcccgttactaaagggaatccttgcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 83586 - DNA, 854 bp, Glycine max
  Peptide Sequence Number=SeqID_200364
aactcccactgccccatgttgatcaactcctagaaaatgttgaggccacagtggacattccacagcacattgttccatacctcaagaaggcttatgatggtcttcaggaacctttgactaagtttctggagagatgcaaacctgattggatcatattcgactttgcaccatatgacaccctgaagggttctctagtgtttgctctaagaagttgcatggagattgaaggtgagtctctcaaattgtttgaaagtatatgtgggaaactagttattccagttgggttattgccactttcattacaattcagtgaagacaacaataatgctgacaattggaatactttccttaattggttagataaacaagaaaaaaggtcagtagtttatgtagcatttggaagtgaagtgacactgagtgatgaagaatttactaaggttgctatgggattagaactgtctggatttccatttttttgggctctaaggaagcaaaatacctcagctattgagtcacaagattgggttctgagtgagttcaaaaggggaatggtgtggagaacatgggccccacaattgaggattttagtgcacatgcctcaatggttaaatgctaggcttattgaagagaaaagggtaggagtcaaagtaccaagaaatgagcatgatggaaagttcacaagggacttagtgaccaaggcattgagattagtgatgttagaagaggaaggaaaaacttatagaagtcaagcagagaagatgagtaagatatttggggacaaagaactcccccaaaattatgtagatgagtttgttgattatatggaaatccataggcctgccgttaaggattag

SEQ ID NO: 83587 - DNA, 236 bp, Glycine max
  Peptide Sequence Number=SeqID_200365
acgcaaatcctttgagtggtgtcttctggaagacccgcgaagacttcttccggaacttccggaagaaggtgttctggaaactttccggaagaaggattcttccgaaagtaaccaaaggtcatctagaagaacacttcttccggaaagcttccaaaacaccttattccggcaactttccggaagaagtagttcttccggaaaatttccggaataaggttcttccggatgacctttga

SEQ ID NO: 83588 - DNA, 156 bp, Glycine max
  Peptide Sequence Number=SeqID_200366
atggcaggaatgataatggtgacaataacaatagtgacgatggtggttgataatagtgacagtagtgttcatggcaacgataaaagggatagtggtgcaatggtagtactagcaataatggcaatgaatgttgctaattgtaggaaaggccagtag

SEQ ID NO: 83589 - DNA, 231 bp, Glycine max
  Peptide Sequence Number=SeqID_200367
atgactaggagactccaggaagatttggccagggatgcaggagaaggctctagggttctcatcagccttaggtggaatctccaatcacctttcctccttcttcattttgctgccattgatcttcaagaagcaaaggactccattgatgaagaagatctaaggcctacaagctttacatggagctacgttaagactgaagagggaagagagccttctagtagcaacctttga

SEQ ID NO: 83590 - DNA, 1170 bp, Glycine max
  Peptide Sequence Number=SeqID_200368
atgcagtccttcatagaatctgcgactcaaaaccttgactctcaaaaagaagacataattttctccaacctgtccctaagactagcaactgatgtgattggacatgcagcatttggtgtcaactttggcctttctaggccacattcagtttgtgattccatcaagagtgttaatgttaacaataacaataacaatgcaagtgctagtagtagtagtaatgataatgaagtatcagatttcatcgaccaacacatatactccacaacacagctaaagatggacttgtctggttccttgtccattatcttgggtctgcttttgccaatacttcaggagccatttaggcagattctgaagagaattcctggcaccatggactggaagattgagcgtaccaaccagaaactaagtggccgtcttgatgagattgtggagaagagaatgaaagacaaggcacgaagttcgaaggatttcttgtcactcatacttaatgccagagaaacaaaagctgtttcagagaatgtgttcacacctgactacataagtgctgttacttacgagcacctacttgctggctccgcaaccacttcctttaccttgtcttctgttgtctatttggttgctggacaccctgaagttgagaaaaagttgcttcatgagattgatgggtttggtccagtggatcagatacccacttctcaagatcttcataacaagtttccttatcttgatcaggtgatcaaagaggccatgaggttttacactgtctctcccttagttgcaagagaaacatcaaatgaagtagagattggaggctatctccttccaaaggggacttgggtctggttagcgcttggagttccagcaaaagaccccaaaaactttccagagccagaaaagttcaaaccagataggtttgaccccaactgtgaagaaatgaaacgaaggcatccttatgcttttataccatttggaattggtcctcgggcttgcattggtaaacaattttccctacaagagatcaagatttctctgattcatttatatcgaaaatacttgtttcggcattctcccaatatggaaaaccccttagaactccagtatgggatagtcctcaacttcaagcatggggtcaagctcagagtcataaaaagaacagagacttgctaa

SEQ ID NO: 83591 - DNA, 168 bp, Glycine max
  Peptide Sequence Number=SeqID_200369
atgacaagacagatcacacattgggtcatattatttggcgagaatgctcaaaccatgtgggatcgacacatgcttaaaggagcactcaaaccaggtgtatttatccccaaggcttatactccgaatagtccgtcagtacctctccctcctgattcaggtccaacctag

SEQ ID NO: 83592 - DNA, 162 bp, Glycine max
  Peptide Sequence Number=SeqID_200370
atgtctgagagtcaatgtcgaaaccctaagttgtattgtattcttattaggaacaagttagttgaggacaacaccgaagaggaaatcatgagatccatactcaagaggcaacaagaagtagacaacacagttaggcacataagaagaacaatgatagattag

SEQ ID NO: 83593 - DNA, 270 bp, Glycine max
  Peptide Sequence Number=SeqID_200371
atggtggtgttcatggattatttggaatggttgtttgcaattccaagtgtcccttctgcttcagcaatgttcaccctgcttgctttaattggaggattgttggtttatctgtatgcaccctattgggggttaaggaaggttccagggccaccatctctgccccttgtaggacaccttcccttgctggcaaagtatggtcctgatgtgttctcagtcctcgccaagcaatatggtcctatttacagatgcttgcttgcttccatacaataa

SEQ ID NO: 83594 - DNA, 1037 bp, Glycine max
  Peptide Sequence Number=SeqID_200372
atcccgcaacagtttcgtcgtttgggactctcacaagttctctaccaccatcctgcctcgctacttcaagcacaacaatttctccagcttcgtacgacaactcaacacctacaaaaattgatcctgacaagtgggagtttgcgaacgaagggtttttggcggggcagaggcaattgttgaagacgataaagaggaggaggcacgtgacagtgacacagacacagtcacacgagggaggaagtggggcttgtgttgaattgggggagtttgggttggaaggtgagatggagaggttgaggagagacaggacagtgttgatggctgaaattgtgaggttgagacaacaacagcacaactcgagggagcaattgttgtccatggagactaggttgcaagccactgagaagaaacatcaacagatgatgaattttctggctaaagcactcaacaaccaggcttttattcagcagtttcttcaaaggaatgctcagaacaaagagttgcaaggtgcgagaagaaagaggagactaactgctaccccaagtgtggagaatttgcagcaagatcatttcgctttgtcaattgaagaaggatcggctactattgagtcacagatggagtcttttttctcagctgcgtgtaatgatccgttagaatcaaacagtgaactcaaagacccaatattgagttcagttccagttgcaagtgggagtaatttgggggaggtgagtgattctgtttgggaggacttgctgaaccaagacttggttgctggggaccctgaagaggaagttgtgattggtgatttttcacaagttgatgttcctgtggaggatttgattgcggatgctgatgagtggagtgaggatttgcagaaccttgtggatcacatggcagcgaagatggtaatactagttgaagaagtggtcgacagatattgcctcattatccgtatcctttgtaaagaatatgatgttttggtaggttactcaaaagcagatgttcaatggggtgtgatcgactgggaaaagaagtag

SEQ ID NO: 83595 - DNA, 612 bp, Glycine max
  Peptide Sequence Number=SeqID_200373
atggccataatcacagccttatgcagcgatcggtttcgaagaaaaaaatcaccatcaccgccaccaccatcctctgatccaatagaaatagcccaagaattggatgctaccataccatcaaacaatgaaacagaaaatgagaacaacaacaacaacaacgaggaggaggagcaggtgaaggagctacctcttccacccgcattgcaacaacacccaaaagatccatttatctcggatagaatgaaaagggtgacttctgaacgaaaggcaccgttgagtttaagcatcaaaatgccgaggagtttgtccgtggcgaagaactgggagcaaaaggaggacaaaaataaagggacaaacataggagggaagttgaaagcagaggactctgtttggatgaaaacaattattctaggagaaaaatgcgtccctgatgaagaggatgatcctgtcatctttgaagggaggggaaagagaatctcagcgtaccatagtaaaaggcatagcaccatgtccatttctagacaaacctctttccttgagcctgatgcattgccaaagccattgtctgtaccccaatcccgaacccatgatgaaacaactagtagcgcttga

SEQ ID NO: 83596 - DNA, 804 bp, Glycine max
  Peptide Sequence Number=SeqID_200374
atggaggaagggtaccccagaagcaagttcaagaccgtgtgtgtcttctgtggcagcaacagtggcaaccgacaagtcttcggtgacgctgcgattcaattgggcaatgaactggttaagaggaacatagacttggtgtatggtgggggcagtgttgggctgatgggcttaatatctcagagagtgtatgatggaggctgccatgtcctagggatcattccaaaagctctcatgcctctcgagatatctggtgaaacagtaggtgaagtgaggattgtttcagatatgcacgagcgtaaggctgcaatggcacaagaagctgatgcatttgttgctctccctggaggatatggaaccatggaagagctgttggagatgataacttgggcccaacttggaatccataaaaaaccggttggtctactgaatgttgacggttactataactgtttgcttgcattatttgacaatggtgttaaagaaggtttcattaagccttgtgcacggaatatagttgtctctgctacgtcagccaaagaacttatgatgaaaatggagcactacactccttcgcacgaacatgttgcccctcatcagagctggcagatgaaacaattaggtaatatccagatgcagagtgagactgttattgatggaaggcaaaagtacttggaaatggaaagagatgataagcatttcgtgagcagaatttcagttgtgcgtaatgggttggctccactttgtagtgccttaattagacaagataggttaatcaaggacaacctacaattttggccaacctga

SEQ ID NO: 83597 - DNA, 564 bp, Glycine max
  Peptide Sequence Number=SeqID_200375
atgtgggaatcaattgttttgacggtggttgccaccgccggcaacaacatcggcaaaatccttcagaagaagggcaccgtcattcttccccctctctctttcaagctcaaggcatgtcataagggcatatgctttgaacaaaacctgggtgataggttttctaatggatatatttggggcactgttgatgttaagggcattagctcttgcgcctggtcttctggtcttttgcctagatttttgtcacgtactaacagaatttctaggtttttatacaggtcagaatttgaacctaaacctaaaagagttggtgctggaggtgaggagcaagaggctgctgctctatctattttccacataccatggctggcatttgttgttttcatcttgtttgtagaaacacttgtacagataatgcttaatggatggcttcgtatattcaaacgtaatcgaagagaacaagagatgatggacatatttcacttccttcatttacctcaactccttaatgttgtcataaagattatgacaattaagtgttttacccttaatgttattatctga

SEQ ID NO: 83598 - DNA, 192 bp, Glycine max
  Peptide Sequence Number=SeqID_200376
atgcaggatggcatctgtaatatcaaagatggggtttctgttcttggagcaaggcttccccaagctgttggttcctatttgcatcatcataagtgtctgttcaagtggtacaggcttttactaccagcctatgggacattttcaaatctatggatgctgggaaggggggattttcagtcaaactggctttga

SEQ ID NO: 83599 - DNA, 477 bp, Glycine max
  Peptide Sequence Number=SeqID_200377
atggaggagtttcaaagatcaaggtcttatgcaaatgggcaaatgatgcagatagagagctactatggagctcctaggccttatgatcttagtctcagaacttatagtgcttcttatgcacaaactcaaataggtcctcctagggacttgaagttgaagaaaggaaaaagcatttctgcagggtcttctttctccaagtcttggagctttgctgatcctgagcttcagaggaagaagagggttgctagctataaaatgtattctgtggaaggaaagatcaaagggtccttcaggaagagcttcaggtggctgaagaacaagtactcccatgtgtgtttggtatgttggttgggagaaagcaagtataataatggatgcgatattgatgagccaggcatatttcagtattttacatctttctcttgtgaaatctggttggcagtagggatgaattggtcgggttggagagaatattaa

SEQ ID NO: 83600 - DNA, 141 bp, Glycine max
  Peptide Sequence Number=SeqID_200378
atgacaggggtaaatagatacgacgtcggaacacttgtgggtcaggctgcaattagcagaaaaattcagggtttgctatcatggctgggttggcgccagaaggatcacaatttgatgctcgtcaatatgatgctaagatga

SEQ ID NO: 83601 - DNA, 276 bp, Glycine max
  Peptide Sequence Number=SeqID_200379
atgaggacgcgtagccctctaaaggcgagggcgtgcagccctctgcaggcgaggatgtgcagtcctctgatggcgaggacatacagtcctctaaaggtgataggtactagtacccaagggtccacctttatgagaaagcatgagatcgactcatcgagagggccgattgactgtccttttgaaaaaggtgataattcatgcaaccttatcctatctcttgcaaatttctccgagaactccctcagagtgtatgttctatttgatttagtcacttga

SEQ ID NO: 83602 - DNA, 816 bp, Glycine max
  Peptide Sequence Number=SeqID_200380
atgtcggttgcaggtcctcaagtcaagtgcattcataggattttgacctctttgtttcacaatttcaactcgcccatgacatgtcactgcatggcctatgaggaggaacatcactctagtagtcacaaaagcactaataacaaaatttacaaggtaaatcagcagaagacatctgatattgcagtacatggattgctcctgtgggcttcaaccgggtttttaatgcctcttggcatacttatcatcagaggatccattaaagcagaacctggatccagaaggagtatagttctcttctatctccatgttggttttcagatgctttcagtgcttcttgccacagttggagctgctatgtccctgaagaagtttgagaattcatttgataacagccatcaaaaactaggcctagcactttatggtgctatattggtgcaaggcttgattggatttttcagaccacacaggggaaagaaggagagaagttattggtacttactacattggatactagggacaatagtttctcttgtggggatcatcaatatttacactggattaaaagcctaccataagagaaccttaaaaagcacaacactttggactatccttttcactgtggaagtctctttcattggattagtttacctcttgcaagacaaattggaatatatgaaaaagcaaggagtgattattggaagtgagtcgtcaattgtgtcatctaaccaagatattcctcaaagccaaacccaaaaggagttgttgccagttgcatgtggaagaaagagaaatgcacttgagaatttgtttgattaa

SEQ ID NO: 83603 - DNA, 1119 bp, Glycine max
  Peptide Sequence Number=SeqID_200381
atgcttcagaaaaacctcattcagaaaacagacttctatatcgatggcgcatggcgcgctccggtagaggccaagtccattgaggtcattaatcccgctaacgagaagccttatgccgtaatctctgcaggctctgcgaaagacattgatctggcggtcgcagctgcccgcaaggcattcccgtcctggagcgaaacttctgccgcggaccgcatcggttatattcgacggctcgtggaaatttatgaagctcgtcttgaggaaatggccaaggcgatctcgctggaaatgggagcgccaatcacgcttgcgcgggaatcgcaggctgcggcaggcctttcgcataccaaagccttcatcgcagcattcgagaatttcgagttcgaagagcttctttctccgaaatttccgaaccagacgatagtgcgcgaaccgattggcgtttgcggcctcatcacgccctggaactggccaatgaaccagatcgcgctaaaagttatccctgcgctagctgtcggctgcaccgtcatactgaagccatccgagattgcccccatgtcggccatgctcttcgccgagtttgtggatgaggctggtttcccgcaaggtgtgttcaatctcgtcaatggcgaaggtgctgtcgttggtgaggccctgtcgcagcatccggatgtcgacatgatgtcgtttaccggctcgacgcgcgcaggcacagcggtctctcgagctgcagcagcaacggtgaagcgggtttcgcttgaacttggcggcaagtcgccgaatatcgttttcgccgatgccgacctcgaaaagaccattgcccgcagccttgcccattgtttcgaaaataccggccagtcctgcaatgcgccgacgcgcatgctggtcgaacgttcggtttacgacaaagcggtcgaactcgccaggaaggtggcggaaggcacgaaggttggtgacccggcagaagaaggcgatcatattggcccgctttcctcttcgatccagttcgagaaagtgcagaaactgatccagaagggcatcgacgaaggtgctcggcttgtggctggtggaacggggcgtcccgatggattcaccgaaggggacttcgtcaaaccaacc

SEQ ID NO: 83604 - DNA, 622 bp, Glycine max
  Peptide Sequence Number=SeqID_200382
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtgcgccaggcttggggcggggcacctctggctgggcggggcggccgggccccggcgctctccagaccccggcgggtagctggcgctttgggaacctcagttgcctcggttggaaatggggctccccggcaggaccgaggtggccgcgtgccatctgcgcgagtccctgggtccctcgatgcgcgggggcgactgctgccaccgcggcctcccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgag

SEQ ID NO: 83605 - DNA, 303 bp, Glycine max
  Peptide Sequence Number=SeqID_200383
atgcttccatttgatttccgatgtgtcacggaaacttacggattgtgcatcaacatttttttggtttttcggcatgtcctggaatttcataaattgcctaatgatgggtgccaagcacctcacaaggaccaaagaatggtcgcatgtcatcaagcaaaggataggacgtgtactactctgaatgggagggcatgcacccttctgaaggtgagggcgtgtagtcctctgaatgcaaggacgtgctatcctctgaacgcgagggcgtgtagccctttgaaggcgaggacttgtattcctctaaag

SEQ ID NO: 83606 - DNA, 758 bp, Glycine max
  Peptide Sequence Number=SeqID_200384
ttagagggccgcacgccctcaccttcagaggactgtacgtcctcacctttagagtactgcacgccctcgccttcagaggactacttgtccttgccttcagaggactacttgtcctcgccatcagaggactacacgtcctcaccttcagaggactgcacgtcctcaccttcagaggactagacgccttcaccttcagaggactagaagtcctcgccttcagagggatgcacgccctcggctttagaggactagacgtcctcgccttcagagggctgcacgcctttgccttcagaggactagatgtccttgtctttagaggactagatgtcctcgccttcaaagggctacacgtcttcaccttcagggtgctatacgttctcaccttcagaggactagacgtcctcgccttcagagggctacacgcccttgcctttaaaggactacgcgcccccacctttagagggcttcgcgccctcacctttagaggacttcatgttctcacctttagaggattgcatgtcctcacctttagagggctacatgccctcgccttcagaggactacacgtcctcgccatcagaggacaacacgtcctcgccttcagaggactgcacatcctcaccttcataggactacacgtcctcacctttagagagttgctcgtcctcaccttcagagggctacgcgccctcacctttaaagggctgcacgtgctcgccttaagagggttgcacgccttcaccttcaaagggcgatac

SEQ ID NO: 83607 - DNA, 162 bp, Glycine max
  Peptide Sequence Number=SeqID_200385
atggagaaagatgagcaaatattggaacagaatggaattgacatgaaatccttgagccttaaggcaggagaggaacggtccaagcgaccaaaaaatggagacatatacagagaggtggcagccaatgtgcaaaacatagagaaacggttgaaatatctatga

SEQ ID NO: 83608 - DNA, 405 bp, Glycine max
  Peptide Sequence Number=SeqID_200386
atgaatcaaaaatctacacatgttgcaagagtcggtggtctatgttcttctacagatcaccatatagatctctgtccttctttgcagcaatctggagtcaatgagcaacctgaagcttatgatgcaaacatttataatagacctcctcagcagcaaaaccaacaacaacataataattatgatctttcaagcaacaaatacaatccaggttggaggaatcatccaaatttgagatggacaagtcctccacaacaacaacagcatgtcccttcctttcagaatgttgctggtccgagcaagtcatatgttcctcctccaatgcagcaacaacagcagcagtcacaacaaagacaaccagcaactgaggctcctcctcaacctttcttagaagagttagtgaggtaa

SEQ ID NO: 83609 - DNA, 255 bp, Glycine max
  Peptide Sequence Number=SeqID_200387
atgggattgagagaaggggatccaatggaatcatttcttttcagcattgttgcagagggtttaagtggtatgatgagggaggctattgcaaaaaaattattccacaaatatcccattgggagagatgacattgaggttgatgaattttccttttctatacttgaggatcccagtgggagcaaatccaagggcagaggagacttagttaccaatcttgaaggaaatcgacaagagataagcaaggtggaagcatga

SEQ ID NO: 83610 - DNA, 1107 bp, Glycine max
  Peptide Sequence Number=SeqID_200388
atgatgaaagccctcacaagctcttgttctaaggccatggtcgagactctaggacccttctctcccagagttcccctttgtgtttctgatagacccgaattctgcttcacccttcgttccaaaaatgagaaaaagggatggaatttattgctcctgaaactggttcgaaacaatgatctttaccctgttcatgcagtgccaccaaaggaccaggtggacttggaaactgtggagcctcaggctcaacagagtgaacaaacaattggaggtgatcctgtgcttggttcatgggaccctttagaggcattacccatgacatggtctgaaggacatgtatgggctgtggagctggatatgcctgctggacaaacattccagtataagttcatactgaaaggagaagggggggatattatttggcagccagggtcagatcgattgatccacacttgggaaactatgaatagaatagttgttctcgaagattgggagaatgtagaacttcaggaaattacagaggaagatcaacttgccgagccaaatgaggaaccccaggttgactttgaagtgccaactttagctgaatttcttaataatcctcaagaagaactggattccaaagcattggaaatatcatctgtaggagatacccaaattcatgctgtggaggaaccacttgctgaaacagtccggcaacaaatcactggtaatagtatttcttcctcaatggaaaagccaatgtctattgttgtagaaaacatcagttcttcggaggatctcatcagcagtataagccacaaaagtaataaaaagagtatacttcaaccaagtgaagaatctgcagatagtccaggaaatgatgatataatacatgatcttggtcaaaatggaaatgctgcatcactggagaatcaggaaaagacaattgtggaaagcagcttatttgatcttgaagaaggtcctgttcttgtacctggcttaacaataccaccaactgagccaactgatgaagcagaccaaggtgaagttcaagaaacgactaaaaaggacacttcagttgaagcttttgaaactcaggatcagaacatagctgaggtaaacacttga

SEQ ID NO: 83611 - DNA, 762 bp, Glycine max
  Peptide Sequence Number=SeqID_200389
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatcttttccctcgcgggtacttgttcgctatcggtctctcgcccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttcttttcctccgcttattga

SEQ ID NO: 83612 - DNA, 768 bp, Glycine max
  Peptide Sequence Number=SeqID_200390
atggatatctctgaagatattgacatccttgtaatcttgggaaggccgttcatgttgactgcaagctgcatagttgacatggggaagagaaagctggagttaggttttgaagaccagaaaattgatttcgacttgtttgtggaagacaagcttgctccggaacacaatgtttgcttgcagttgtactctctttgtgcattttcgactttaaagcatcaatcatacaccgtccaaatgtcttccaggaaaagaaagagtggtggttcaaggcccaccactcaatatgatacaagaagattccactcttttgaggcttggaccagatatactgacaatgtgttgggaaaacacatattagctgagaggaaagtggaaatttatcacacagagttggatgaattcaagggcgagctggagaggcgtaactttcacaagcgcctcaccaacttagctgatagtagcattgacctcgcgttggtgaaggagttctacgccaacctttacaatcctaaggggccttcacctaaacaagtcagaattcggggccacttaataaggattgatgcagacaacctcaatgcctttctagaaacacctgtggtgcttgctgagggtgaatctttccccgtctactcaagatactgtaggatgcctactgacactagagaaattgaggcagcactgtgcatacccgaccgagggtttattctaaatgccgaaggtcacccggggaagatcctcagaaaagacctaaccacccttgcttag

SEQ ID NO: 83613 - DNA, 2321 bp, Glycine max
  Peptide Sequence Number=SeqID_200391
ttgcgagtggtagtaattactggtcacagcatcctgaatgtgacttctactttgggtgtggccgtgatttgatagaggaggatgccttgaatgtggaatcctgtgtccgggttttgagaattttgatcaccaaggcagataccgagatcgaggaacttgaaagggacctcttgtttcttcagaatgaattggcctgcgccgagcatgaaaaatggcctgatatatgccgtgctgttctcactgagagaatcaaccggcttgatgtggcggttagcactttgaagaatgatcatactgatgatgcggagatgcagccactgttagatagtgaacctgctgagacacttcatgaaatacttgctcagtctctggatatgaaaatgttgagtccaattgtgaatctagacaaggattctagcacttttgattctaatataatcattaagggggaagaaaaagaactccatggaacctctgaaagctctggaagctcagaacttcttttggagcttcatggaaagagatcagataatcccgaaaagattgaggaattgtctgaaaaatctcttgttagaagtcctgatttgggggctatcatccatgcacctgatcactctgttgagacaaaattatcagaaacatttgataatgacgttactggaaatgaagaagtcagaagaagtcaacacattagtacagatataggtcaagtgttggatttgttttctgccaaagacgatgaaaacattccaaatggagtcaagaaaggaaatgaatttgtcaaagaaaaagatgttagctcagatgattttagacctgcaattggtgtcaaggggaggaaagagtatcctcattccaggttagttacttcacaacaacgaaaaggtgaacctgatcactctgattggatgaaattatcagaaacatctgatagtaaacttgctggaaatgaagaggtcggaagaagccaactcattaatacagatataggtcaaatgttggatttgttttccgccaaagacaatggaaatattccaagtgaagtcaaggaagaaaatgaagttgtcaaacaaaaagatgttagctcagatgattttagacctgcaattggcatcaaggggagggaagagtatcctcattccagattagctacttcacaacaaaaaagtggacctgaatctcctgatcactctgattggatgaaattatcagaaacatctgataataaagttgctggaaatgatgttgaaagaagccaactcaatgatacagatataggtcaaatcttggatgtgttttctgctgaagacaacgaaaatattccaagtgaagcccagaaagaaaatgaatttgtcaaagatgttagctcagatgattccagacctgcaactgacatcaaagtgaggaaaaagtatcctaattccagattagctacttcacctcaacgaaaatgtagaaattctaatttagacaaaaagctatgtgatattgctccaaaaactgcacggaaggcctacaagaaacagtccaaggttgctccagataaagatttgaactccatggatttacctttacaagtattttatcctcaaacattttgtagcgccaatactgaattttgctcctttaaaggaagtaatgggattcaaaccaagagtgccctgtatactgatttacagctgatagatgaagatgaagaggaacaagaagcacaagaccttaaatcccaaattactactaaattcagaaagttgaacatgagtttcccttcaaagctaaaagctcgggaaaagcaggaactggaactagaggcattttcttccagagaaccatatgacagttgtacagaagttattcaaagtacacccataattgtatcaaccaagaggcagcgaagatccaaaccctgtaatgatgttgccattttaactgagccgatgaaccggaagaaaatttctagaagggcagtgcaacctgacaagcatgaaactgaaggtggtgctattgttccttatgatagcaacttctctgaattacaaaagagaagaaaagtttcaaagttgccaatcaccgtggacatggaaacaaattcagatagggtttctatggacagtggaagccagttagttcttcatactagcaagttgcattccttggtggattcccatgatgggacctcatctttgctgcctggtgacttgaatagcttgtcattgactgatttgagggccatggcaaaggaccacaaagtaaaacagtactataagcttcgaaaaggagctttggttgaacaattagctaagcagttcagaagctgctga

SEQ ID NO: 83614 - DNA, 261 bp, Glycine max
  Peptide Sequence Number=SeqID_200392
atgaggaagggaagcacgtttgtattttacttcttcacctggaaaacgacgaaaaaggctgcaactgaaaatgaaagcggcgagactgagggtagtgtggtcatttcctacactgcgacgtgggcccggggttctggtggggccctgtttgactgggctagttcgtgggccgtcgatttttttcaggtgctatttttatcacccaatggggtccacacgtcaactcttttttttgctacacgtctattctattttttttaa

SEQ ID NO: 83615 - DNA, 1152 bp, Glycine max
  Peptide Sequence Number=SeqID_200393
atgggtgggggagaaagtttgagtagaaagtatggaaggttagcttcaaactcagaagaaagaagttgccgagtgcaggaaatgggacatttggagggggattcatgggaaatgattgatgagcttatggatttaatacagctgaaagtaccaaagaaggagataaagcataggaggctatggaaagggatcaagtccaaatcctactctgttaaggaagtttatgagacattgcaacagcaaagtaacaatgaggaatctgatttctttaagaatctatggtctacaccagcgccttcaaaaacaaagacaaaggaagctcttaaaaagagacgtattgtgatggaaaacaacgactacatgtgcatgctttgcaatcaaactgaagagtctattgcacatttattgtttgagagcaatttctggtaccaggagattgagaaagttgcatatgttattaagacactagtgaaatcagagggggaagttgcagtggagctgagcttgcagaagatggagaggacgaggtcgttggggagagagtcaaagaagtcttttgtcttttccagcaagacatggttggagctggaagtggaggataagagagataaaaagggtaaatgcaaagtgggaagtttcatagatatgagagttgagacaagaggaaagggtaatgaatcagaagagggagagttgagacgagaggaaagggtaatgaatcagaagagggtaagtgaggtggcgggagggagtggaatgagaagagaagaagaaggagaggctttaggagagagaaaggggtttccagcgaagaagaggaaagaaggagagaaagagtttttaaccatctatcctttatggaccttgagccctggtgcagcggtaaagttgtgccttggtgacttgttggtcatgggttcgaatccggaaacagcctctttgcatatgcaaggcacattggatgatgagttgcaagatgctctcaaggaatacctgatagccaagggcattggggtaagcctgaccaatttccttctccactacctacacaaaagagagcatgagcagtacatgaactggttgaagaaaggtgaagcagcattcgtggcaaaagaagggtcattgagggaatcatcagagttacattcttga

SEQ ID NO: 83616 - DNA, 402 bp, Glycine max
  Peptide Sequence Number=SeqID_200394
atggtacaatacactgcatattttagttttagaccttttggggacatggaaagacaaaggcccaaagaacaatacatagcagaggtagtggagaaggaaattggtcaggcttaccccaatgcccttggctatcaggtattccttgagagcatcttgcaactcatcatccaatgtgcttcacatggatgtagacaagacaatgaacaagtattacataaaaaaaaacttcgtaccccattgcccggaggctcttcgctatgcgaaggtatgggggagggatgttgtacgcagccttacccttgcatatgcaaagaggctgtttccggattcgaacccatgaccaacaagtcaccaaggcacaactttaccgctgcaccagggctcaaggtccataaaggatag

SEQ ID NO: 83617 - DNA, 3036 bp, Glycine max
  Peptide Sequence Number=SeqID_200395
atgacatggattgagaaaccaaaaataagagaccagccaacaccctgggagtgctgtccgtccagagacaggttggagaagactcattggagctcttcagaggaaaaatttcgaattgctctctacgttcaaaaggcagcattacaatttatcgatgctggtaatcgagtcgagtacaaactatcaagtgaggtaagagatgctggttttggtattcatccagatgagattgcttctattgttcgtggtcatgataacaagaccttaaatgatattggtggagttgaatccattgcaaggaaattgttagtttcggtagatggaggtgtcaacgaagagagtataaatagcagacaacagatttatggattcaatcgttataccgaaaaaccttctaggtcgttcctgatgtttgtgtgggatgcattgcaggacttaactctaatcattctcatggtttgtgctgtagtttctataggtatagggattgccactgaagggtggccaaagggaacttatgatggtgtgggaatcatactcagtatattcttggtcgtcattgttacagctgtcagtgattacaagcagtccctgcagttcagggatttggacaaagagaagaaaaagatatttgttcaggtcaatagagatgggaaaagacaaaagatctcaatttatgatatagtagttggtgatgttgttcatttgtcaactggggatcaagttcccgctgatgggatttttatatcaggatactctttgcttattgatgaatcgagtttgtcaggtgagagcgaaccggtaaatataaatgaagaaaaaccttttcttctctcaggaaccaaagtgcaggatggtcaggggaagatgttggttacaactgttggcatgaggactgaatggggaaaattgatggagactctaaaccagggaggagaggatgaaaccccattgcaggttaaattaaatggagttgctactattattggtcaaattggtttgacatttgccattctgacatttgtggtgttgacagttaggtttgtggtcgaaaaagcgcttcatggtgagtttgccagttggtcttcagatgatgcaaagaagttactggacttctttgctattgctgtaaccataatagttgttgcggttcctgaaggattaccactggctgtgacactcagtcttgcttttgcaatgaaaaaactaatgaatgacaaggcacttgtaagacatctttctgcttgtgagactatgggttcagctagttgcatttgcacagataagacagggacattgaccactaacaaaatggtggttactaaagcatggatatgcgaaaaatccatggagataaaaggtaatgagagtgcagacgaactgaaaacatgtacatctgaaggagttctaaacatccttttgcaggctatatttcaaaatacttctgctgaagtagtcaaggataaaaatggaaaggacactatattgggaaccccaacagaatcagcattattggaatttggctgcctcttgggtgctgattttgatgcgtatgcacagcgtagagagtataagatactccaagttgagccattcaattcagtccgcaagaaaatgtctgtgcttgtgggtcttcctgatggaggagtccgagctttctgcaaaggtgcatcagaaataatattaaaaatgtgtgacaaaattatggattgcaatggggaagttgttgatcttcctgaagaccgggcaaataatgtctctgctgttataaatgcctttgcctctgaagctttgagaactatttgcttggcctttaaagagataaatgaaacccatgaacccaacatttcagatagtggctatactttcatagccttagtaggaatcaaggatcctgtacgccctggggttaaggaagcaattcaaacttgtatagctgctggaataactatccgcatggttactggtgataacataaatacagctaaagctatagctaaagaatgtggtttacttacagagggtggtctagccatagaaggtccagattttcgtgacttgtctcctgagcaaatgaaggatgttataccaagaatccaggtgatggcacgatccttacctctggacaagcacagattagtaaccaatttgaggaaattgtttggtgaggttgttgctgttactggtgatggaactaatgatgctcctgcactgtgcgaggcagacattggacttgcaatgggcatagcaggaactgaggttgccaaagaaaatgccgatgtcattataatggatgataacttcacgactattgtcaatgttgtcaaatggggacgtgcagtatacataaacattcaaaaatttgtgcagtttcaattgacagttaatgttgttgctctggttatcaacttcttttctgcgtgcatcactggatctgctccactcaccgctgttcagttgctttgggtcaacttgatcatggacactcttggtgcattagccctggctactgaacctcctaacgatggacttttgaaaagacccccagttgcaaggggagcaaactttatcaccaaacctatgtggaggaatatcataggtcaaagcatatatcaattaatcatcctagggattctaaattttgacgggaagaggctactcggacttagtggttcagatgcaacgaaagtgctcaacactttgatattcaactcctttgtattttgccaggtgtttaatgagataaacagcagagatattgataagataaacatattcagaggcatgtttgacagccggatatttttggcgataattttcgccaccgtggcatttcaagtggtgatagttgaattccttggaacgtttgccagcactgtgcctctaaactggcaattctggttactaagtgtggtaatcggagcagttagcatgcctatagctgctatcctcaagtgcatcccagttgaaagagatactagtaagcagcaccatgatggttatgaagcactgccatctggtcccgagctggcataa

SEQ ID NO: 83618 - DNA, 810 bp, Glycine max
  Peptide Sequence Number=SeqID_200396
atgagcacacatggttcttacagcatgagatccaaggcctcctttgaaaatgaagctaaggccacagggaaagaaagtggggttgtgataaaaatggaaatccagggaggaggaggaggtagtggtggaggtggcaagagtgggaagacaatgtcccccaacagcaaggagaatctgtttatagtttttctggtgacactttggtactcttcaaacattggtgtgatccttctgaacaagtacctgctttcaaactatggattcaagttcccaatcttcctcacaatgtgccacatgtcagcttgtgctgttctcagctatatctccattgtgttcttcaaggtggtgcctcagcagatgatcaaatcaaggtcccagttcatcaagattgcaactttgagccttgtcttctgtgcctctgtggttggtggcaacatctccctcaagtacctggctgtgtccttcaaccaagcggtgggggcaaccacacccttcttcactgctgtctttgcctatttggccaccctcaaaagagaggcttgggttacctatggtgcccttattcctgttgttgctggagttgtcattgcaagtgggagacatgtcaatgctgcatcatgttccttgtgccactccagatctggagtggtgttggacagattaggtgatggtggtttgtgtgatttagttgatcttgattgtttgaaagggcgagccagggtttcacttatttggattcattatgtgcctaagtgcaactgccgcaagagccttcaagtctgtccttcagagcattttactttcttctga

SEQ ID NO: 83619 - DNA, 240 bp, Glycine max
  Peptide Sequence Number=SeqID_200397
atggagagaactctcctcaagaatttcgagctcgagcacaaaaatccctccgtcgaagccctccgccgatggagatccgccgtcactttcgtcaagaaccaccgccgccgcttccgcatggtcgccgatctcgacaagcgcgtcgaagccgagcagattaagcagggaatcaagaaaagtctacgtaaattgagcctaaaaacagtgaagaataaaatggaattagccacgagagtttaa

SEQ ID NO: 83620 - DNA, 207 bp, Glycine max
  Peptide Sequence Number=SeqID_200398
atggcttgcaatttggcaatttttcatggtttaaaattagccatcagcagacatattgctcaagagatgaatgcacttgaagatgctcttgccaactatggaatgtctttagatagtggtggtcttaggattttagattgtgtcctggacttcttgtacttacatttgctagctgatgattcagcaactttgtttagtaatttgtag

SEQ ID NO: 83621 - DNA, 204 bp, Glycine max
  Peptide Sequence Number=SeqID_200399
atggtgtggacctggcacaccgctaacatccacatggtgttgttccacacctacaatgagatcgaggactgcaaggttatctctggcaaggccaccggcaagtcaatggtcatggatgaggttgatgctatcagattgcccatggtcattaagagccagagtgaaagttcaactctcattaacataaatagtcatttagcatag

SEQ ID NO: 83622 - DNA, 786 bp, Glycine max
  Peptide Sequence Number=SeqID_200400
atgaaatccaaaggctgttggaatgaagagattgggaaatgggagaagtcattgagaagaatggcaaaaatgtgggcatctcaagtctcttggctacataattggctgtcatggtgttgcttggagtttgaagagtatataaaaacttcccataaacctgttgctcttgaagtcaccgaagaaagcaaacaactagaagacacaaatttcaaatcagagctttacatcaataagttatgggtcttgctcactagtgcgcttagagcattggttaagaaactaaaaagagaaagtatttatgtagaaatcataggagagcataaaaaaagtcatagacagcatgattttgcgcattccaataaaagcatttctcattttagtttcttaactaatgcctttagggcactggttagcatatgccataagttatttggaaagttgcagataaatgatttgaggccagattttgatgtttatcttccaaacagcaggtttagaaagtcttctcccggtgatccgagttttctactgtacttatctagaggaattcatgctggcagacatgctacttcattgtgtggcatgtgtggttgggggtggggtcttgtaaggtgctggtgggtggcaatgtggctattttatttctcaaagggtcatccatctagagcagaaattgaagcccttgagagacaatgtggtggcattcctttgaaaatttgcttggccacagagggaagggtcagcttcttttcctttgacaaggtggaacttcctgttctaccctga

SEQ ID NO: 83623 - DNA, 736 bp, Glycine max
  Peptide Sequence Number=SeqID_200401
tccttacttggagttaataaagaggatcattagtagcaagactcattgggccttggggcccttcaaccctttgtccattgagaagggagtctataacacaaagcacttcagtgttgagtggcttgacaagcaagaagcaggatcagttttgtatgtgtcgtttgggacaacaacatgcttctctgaggagcaaatcaaggaggttgcaaatgggttggaaaaaagcaagcaaaagttcatatgggtggtgagggatgctgacaagggagatgtgttcattgaggatggtgtgagaacttctgagcttccaaaggggtttgaagagagagtgaaaggcacggggttggttgtgagagactgggcaccccaattggagattctaagccacagttcaactggtgggtttatgagtcactgtggatggaactcttgcatggagagcatcacaatgggggtgccaatagcagcatggcctatgcactctgaccagccgaggaacagggttttggtgaccgaagtgctcaagattggggtggttgtgaaggactgggaccacagggatgagttggtgacagcatcagatgttgagaatgccgtgaggagattgatagcaacaaaagaaggtccagggatgaagggggtgtttctcgcgtggaactggatgatttcattgcgcacatcactagatagtttggtccaaatccatgtcatttacaaaccaggcgtttgtttttga

SEQ ID NO: 83624 - DNA, 456 bp, Glycine max
  Peptide Sequence Number=SeqID_200402
atgtcaattctcagtgctctctcatcttcatcactactccaccatcttatctgccacgccgctattctcaaagtagaagattcgtatttcgtagcgctcttcacctcctctttccttcattgctatcatggcaccaccaaggtgacagatgagctagtgcagatcatccttggtcaggtctggaacttggagtttcaaaggcctttcttgagtttacttgtgactatacctgaatacattctatcaggtagtcacaaccttcagcgctatttttggtgccgtaaaagatgttggaatccaacatgttcctctaaacccaagagcttgatagctgttggggattggatgaggccttattgggtactattgattccagttcccccgacagtgtcgcttcatcagtggcatccaaggaaacattgtttccaggagaaatcggaggaagaagctcaatga

SEQ ID NO: 83625 - DNA, 291 bp, Glycine max
  Peptide Sequence Number=SeqID_200403
atgtctaacttgacatcaaaactaaaagcacttaagctagagcttgtgagctataatactgagaaggacgaatggtccattaatgagcttatatcttattgtgtgcaagaggaagaaaggctacaaaaagacagatttgaaagtgctcatttaagtttgacatctcacgataagagaaaaactaagggtgctctcaacaaaagaaagatgaagaattcacttgctacttctatagggacatatgaagaaaaactgtataaggtacgctgcatggcgtgtaaagaaaggtaa

SEQ ID NO: 83626 - DNA, 291 bp, Glycine max
  Peptide Sequence Number=SeqID_200404
atgaagtcaggtgacatgcggagatacccaagcagttatccgcagaaacggtttctgtcatccagacccgtgaagtcaggacaacgagtcaagtggcaggcggtgataccttatggtcctccgcacctttcgtcaaccgaggcgaacgagttcgacggtatcaggatgatgttggtttttactctcgtcgtcttgagacattcaagcccgacgacgcacgagattcttctctactgggcggggacgatccagttcgatagcgtgtggaaacgtcgtggttatcccatttaa

SEQ ID NO: 83627 - DNA, 321 bp, Glycine max
  Peptide Sequence Number=SeqID_200405
atgaagttaggtggcaggcggagacacccaagtggttatccgtataaacacactttcgctatccgtcagcctaagagtccggtgatgtacgaagatacccaagcagttatccgtacaaacggtttctgtcatcctgacccgttaagtcaggtgacgtgcagagatacccaagcggttatccatacaaacggtttctgtcatcctgacccatggagtcaggtgacatgcggggtaccatatggttacccgcacctttcgttaaccagcggtaaacgagcccgttggcgcgcagagactaacatcgtcttctgcaccttttga

SEQ ID NO: 83628 - DNA, 357 bp, Glycine max
  Peptide Sequence Number=SeqID_200406
atggacaggatggggtgcaggtttactttccccaagcaattagcaaaacatgtagggagaggggccagcctgatgtgtaatattttacatttatcatctttcctagggaggcgttctttctggtgtgagtgtggcattactagtttcctgatagaagaaagtctaatggcacattcaacaagcttgatctttatgggccgcagttttagtccacttcctaaaaccaaagtcagtgtatctggaaggcttgtctccagatcttcagcaggacttcgcattcaagctgtgcaagagaacggtggaccacgaagactagtggacattattagacttgtgcctgagctctcaaggaattaa

SEQ ID NO: 83629 - DNA, 496 bp, Glycine max
  Peptide Sequence Number=SeqID_200407
atggcatcatcatcatcatcgaagaggcatccattgtaccatggaatccgttgccgcggaggaaaatgggttactgaaatccgcgaaccgcgaaaaacaaaccgcatatggctggggacgttcctgacgccggagatggcggccgccgcctacgatgtggcggcgttggccctgaaaggcaacgaggcggttcttaacttccctgactcggttggcaggtatccggtgccggcatccaattccccttcggacatccgcttcgctgccattgctgctgcagaactcatgaagcctgaagccaacaacaacaacaacgttaatgcatcaacaacaaataatgcagcagttcaatctgatagcaatgatgttttaccttcgtttgaaactgagtttatggacgaggaagccatattctccatgccaagtttgctggttgacatggctgggggaatgttgctatctcctcccagaatgagccctccctccgataacgaaa

SEQ ID NO: 83630 - DNA, 1626 bp, Glycine max
  Peptide Sequence Number=SeqID_200408
atgcgccagttatcaccaacctcaaatttctgtgaaaggaatgagggccacccaaacgcatcaaatcacaaagtacaggatgagcccaacatgttaaccactttgattcccaaatccccaacatgtcaactacaccaaatgcaaaatccccataataacattaacacaacacatttgtccctttctctcgtcgaagccaagtgcatagccaacatatccttctccatgatcctcactggcctcttactctattcccgctccgtgatctccatgctcttcctcggccacctcggagaactcgctctcgcaggtggctccttagccattggcttcgccaacatcacaggatactctgttctctctggcctcgccatgggcatggaacccatctgcggccaagccttcggcgccaaaagattcaaacttctcggcctcaccatgcagagaaccgttctccttctcctcataacctcatgcctcatctcattattcttctggctcaacatgaagaaaatattactcctttgcgcccaagaacaagacatagccaacgaggcagaactctacatattttactccctccctgatcttgtattgcagtcgctgctacaccctttgagaatctaccttcggagtcaatcaataacgctccctctcacgtgctgcgccgccgtttcgatcctcctccacgtgcccgtcaactacctcttcgtgtctatcctcaacctcggaatcaaaggcgttgcactaagcgctgttatcacaaacctcaacctcgtagtgctgttgattatttatatagtgttttcaggcacgcacaagaaaacatggccgggtatttctcgcgagtgcttcaacggatggaaaaagctcttgaatctagcgattccgagttgtgtttccgtttgtctggaatggtggtggtatgaaattatgattttgctctgcgggttattagttaaccctcatgcaagtgttgcatccatgggggttttgattcaaacaacagctttgatatacatttttccgtcttctttgagtttcggagtgtccacgcgcgttggtaacgagttgggagccgggaatcctcggagggcgaaactcgcggcgattgtcggcctctgcttcagttttgtgtttgggctttctgctttggcgttcgctgtttcagtgaggaatgtttgggcttcgatgttcacgctcgatggggaaatcattgctttgacgacggcggtgttgccgattattgggctctgcgagcttgggaactgtccccagacgacggtttgcggcgtcctgagagggacggcgaggccgaaattgggggcgaacataaacttgggttgcttctacctcgtgggcatgcccgttgcggtgtggttggggttctttgcagggtttgacttcaaagggttgtggcttgggatgttggcggcgcaagggtcgtgtattgtgacgatgatgttcgtgttggctaggaccaattgggagggtcaagcgttacgagctaaggaactcactagttctgatcctagggaagagaaaaaactagtggaagaggaacatgaggagaaagggtttttgggatcatgtgccaccaaagaagcttctgatttggttgtttga

SEQ ID NO: 83631 - DNA, 519 bp, Glycine max
  Peptide Sequence Number=SeqID_200409
atgcatcaccgctcatccaatgaggtagccaaatccgaggaagaaggtgaggatgccgcatcgaggacgatagaggagcatggaggcgtagccaaggaacatggggacgaggaagtggaggttggaggagaagccgaaggagaggtaggagagggcgacgccgacgacggaggagtagaggtgcttggggaggccgcgggggaggaagcggcagaggaagctgaggggcacggtggcggcgaagcagaggaggaagcggagcacggggaccgagactccgatggaagtggccatagaatccatggacatggctcgaagaagaagaagaagaagaagaagatttatttatggtgctttcttcaactcaagctctcaattgctcagaatattagtgaaatgacgcgcctaccccctaccaagtaccatgccagcctcctttgcgtgacctcaacttcctacggatctttcttagttcgtactctgtcatgtcttctttggaaactccgtctatttttttaa

SEQ ID NO: 83632 - DNA, 1011 bp, Glycine max
  Peptide Sequence Number=SeqID_200410
atgaagaagaggcttttgattttgggcaagtcaaggttctttcttctttcctcgttttccctccctccaagggaagaacctcttcagatacaccctttttgccctgagaaaacattagaccacaccgcactcttccatttcacccataaagcttggactgcagtcaaagagtcaacgatccacaacatgttttcgaggggcagagggagtgacattggtggccatggcaacacaaacgtggctgaatgggaattaaggccaggaggaatggtcgtgcagaaacgtaactcggatttgaatcaaaattctgcatctaaattcaccatcaaagtcaaagtgaagtatggctcatcctatcaccaaattcaaatcagttctcatgcaagtttcggggaattgaagaaaatgttaacagaacctacaggattgcacgttcaggatcagaagttgatttacaagaaaaaagagagagactcaaagtcatatcttgatgttgagagggtcaaagatggatcaaaattggtgcttgttgtggacattgagagtagagaaagaaggatacttgagacgttaaaaattgctaaggagaagacatcaaaatccttgacagaaataaaggtggaggttgataaacttgccaagaaggttgcagctttggaggctgctgcttccacaggtggggttatagcagagttagatatagagactttgaccgagaatttgatgagaacattgattgcattggatgaaattaatggtgagggtgaactgaaattgcagagaagagagcaggttaggagagttcagaaacacattgagactctagatatgttgaggatggcaagggaaaactcaatttctctgaaaaatgaagagaaaaacttggcacgtgagagcaaggtgcattgtggtgatcacatgcaggggagacagggaaatcctaagaagcagcaaccgttaaaacattctgaatcagttgtagtcacaacaaaatgggaaacttttgattga

SEQ ID NO: 83633 - DNA, 1809 bp, Glycine max
  Peptide Sequence Number=SeqID_200411
atgggttcgaaggggaagaagaaaggttcaccggaagacattctggaaaccctaggagacttcacgagcaaagagaactgggacaagttcttcacccttcgcggtgattccttcgagtggtacgccgaatggcccaacctcagggacccactcctctccctcctcaaaaccgttcctctcccgcttcagctcctcgtccccggctgcggcaactcccgcctctccgagcacctctacgacgccggccacaccgccatcaccaacatcgacttctccaaggtcgtcatctccgacatgctccgccgcaacgtccgcgaccgtcccctcatgcgatggcgcatcatggacatgaccgccatgcagttcgaggatgagagcttcggtgcggttattgacaaaggtggactggatgctttgatggagcccgaacttggccccaaattggggaaccagtacttatcagaggtgaagagagttttaaagcctgggggaaagtttgtgtgccttaccttggctgaatctcacacgttttattttcctttactcttactgaaagattcatggtacaaggtttctggacttcatgaggctcttcaaaatgagaatcaaattcgtgaaaaatactccagcggctccaatttattatattctgtggaagatctgcaagaggagttgacaaagctatctcaaggtcggcgattgcagctaactctgggtggacaagggtactccactttttcttacagagctgtaattcttgatgccgaggaacaggccagcccatttacctatcactgtggggttttcattgtgcctaagactcgtgcacgtgaatggcttttctattctgaagaaggacagtggatggtggtcagaagctctgaagcagctcgtctcataatggtttacttggatgccagccattcggataccagcatggaggagattcagaaggatttgtctccattggttacgcagttggcacctgcagaaaatgagaatggagctaaaataccgtctgtcacatcttcattaactggatcaattattgttgaagatgtaatttatgaaaatgttgatagtgaatctgaagctctgctaaaagatgaacagtcacctactaaattggttagtgagacaggcaggaagaaaaacaatgcatcttccaaatctagaaaaagtggatctcagagacacagtattggagcaagcagccagttgaccgtctatcatggctatgtagctagttcttatcatacagggattatttcagggttcacgctaatatcttcttacatggaaaatgtggcatcaagtgggaaaatggcaagtcttggagctggtttactttccatgtttcttcacgggtgtatcccctttttggaaattgagactgtggagttagaccccatgattgttgatattgcaagggactacttcagttttgttgaggataaacgcctaaaggtgcatgtagctgatgggatccaatttgtccgagagattgacagttctggagcacctcagattcatggaaaaagtaatgatcctagtaatactgagtctgctctaaatgcaagttcaactgtgtctcatgctggtgtaaaagtgacaaaagttgatataattattgttgatgttgactcttcagacccaagctcgggattgacatgccctgctccggattttttggatgagtcttttcttgagaccgtaaaggataaactttcagaggatggtctctttgttgtcaatttggtgtcacggtcccaagccattaaggatatggctctctcaaaaatgaaaaag

SEQ ID NO: 83634 - DNA, 957 bp, Glycine max
  Peptide Sequence Number=SeqID_200412
atgggagagctggccactgagaaacatgttcgatatatattatcagttgaaaagaggaaagataactttgaatctgtcgtaatggagcatctaagaatgaatggggcatattggggattgaccactctggatcttctaggaaagcttcataccgtcgatgttgatgaggttgtttcgtggttgatgagttgtcagcatgactcagggggatttggtggaaatgttgaacatgatccgcacatcctctatacactaagtgctgtgcaggtgttgtctctctttgataagctggatgttattgatgtagataaggtcacaagttgtatccttacacacatattgcctcgctttgaagatattgtcagcctgcaaaatgaagatggatccttttcaggggatatgtggggtgaagttgatacacgaggctcttcgctatgcgaaggtatgggggagggatgttgcacgcagccttacccttgcatatgcaaagaggctgtttccggattcgaacccatgatcaacagttgcaaaaatatggatggtggttttgggtgcactcctggtggggaatctcatgctggtcaaaggtcgctagatcttgttgacaaagacctacttggttggtggttatgcgagcgacaggttaaatctggaggtctgaatgggcgtcctgagaaacttcctgatgtctgctactcatggtgggttctttctagcctgatcatgattgatagggtacattggattagtaaggagaagcttataaagttcatcttagactgccaggacacagaaaatggtggaatttcggacaggccagatgatgccgtggatgtctttcatacattctttggggtggctggactttctcttcttgaatatccagggctgaaaccagtagatccagcttatgctttacctgttgatgttgtaaatagaattatttttactaaataa

SEQ ID NO: 83635 - DNA, 1137 bp, Glycine max
  Peptide Sequence Number=SeqID_200413
atgcggactcgggagaagaagtgcaagccgattgcttgtcacgtgaattcggtgcaccacgtgcgcgatcccgttgcgtacccttggcagtggaattggaaggacgattcgacgaaggtgcagaacatgcggcaccagtataaggatgtgtttcggggtactgttgcacttgctgttggcggtcatggtgggaatgagttgatggggattgaggatggggatcacggggatcgtgatggggataatggggatgggtttcttgctggtggtggggggatggatatggttgagtttgggcagatgggtcattctggggatggggattttggggctgctttggatggggtggacaatgaggtgatggggttgggatttgagattgagggggaggaaggggaggtgaattacaatgggagtggtggtcgggagagggaggatgctgcggagaatggttttctgtttgaggaggaaggggaggtgacagggtcaagtttgaagaagaagaggaaggtggcgaaggggatggagaagaaggcgtggcggattcttgctaaccagctggggcagttgagagagatggagacgcggtttgagcagcgtgaggtggagagggagcgcgagaggcagaggagggagaatttgcgagtggagcttgataagcagtgggaaaggaagcttgaggagagggaaaaggagagagaggagagggagaaggagagggacaagcttaggaggcagaggatggcagagtgggaagccatggaaaaggaaaacgaagagatggaaaggaaaaggagagaggaagagttgatccatgagagggaatgggaggagagaatgaactgcaggaggctggaatggaagaagagggttgacgagatgctgagccagcaccgagcagaaatgggccagatgcagactcgttttcttcacgagcaacaaaatcttactaaccaattgcttggtatattctcgcagtggcctgcccaaccttctggcctatctgatcatactagtgctagcaaccattatctttcacaaatgatgcaaaatttgcatcatgtgaatggaattgttcatggtgacgctagggttgagggagataatcaagaagatcaattcattgttgatggatga

SEQ ID NO: 83636 - DNA, 276 bp, Glycine max
  Peptide Sequence Number=SeqID_200414
atgtttttcctcttcttcttccttctcctcttctcttcctccgcgagcaccaaaaccttttccgatagcgattctggttgcatcgagaacgcgaagatcgtgcagcaattaaccaatcgaatgattctctcggaaactgtaaaaataaggaaaaagaagaaggatggagcatgcttaccttttcagagtgagaggaggagcggagtgattttccgggaaagtgaaattttctcgagaaaagaatatcgaaataataagtcagtggggaacgaatga

SEQ ID NO: 83637 - DNA, 2944 bp, Glycine max
  Peptide Sequence Number=SeqID_200415
atgggtgatcgcggttcgggcgctgcgaagccgatttggatgaagcaggcggaggaggcgaagctgaagagcgaggcggagaaggccgcggcggcgaaggcggcgttcgaggccaccttcaaggctttggagaataaacacgacaagggaggagggagcgttgctgattcggacagcgactccgaggaggagtacgaggacctggcccacaagcccattggccccgtggagcccgccaagtgcaccgctgcggggaccgggatcgccggaggaaccgcgtgcgctccgtcctcgtttgtggtggtgactaaggacgccgatgagaggaaggtttccggcggcggcgcgcaaataaaggtgagggtgactcccgggttgggtgttggagggactgagcaagaggggatggtgaaggatatgggggatggaacttatactgtgacttatgtggtgcctaagagagggaattatatggtcagtgttgagtgtaatgggaggcctatcatggggagcccatttcctgtgtttttcagtgcagcaggtaatagtactggagggctgctgggtttagctcctgcatcttcatttccaaatctcgttaatcaaactatgcccaacatgccgaattactctgggtcagtttcaggggcattccctggattgttgggaatgattccgggggttgttgctggagcttctggtggtgctattttgcctggaattggggcctcacttggggaagtttgtcgtgattaccttaatgggcgttgtgcgaaagttgattgtaagttgaatcacccacctcataatttgttaatgactgccttggctgcgacaacctcaatgggaacacttagccaagctcctatggcaccttctgcagctgcaatggctgccgctcaggcaatagttgctgctcaagcccttcaagcacatgcagctcaggtgcaagctcagtctgcgaaagattccgctggttcacctgaaaaggctagtaaggatgatgcattgaagaaaacccttcaagttagcaatcttagccctcttctcactgtagaacagctaaaacaactctttggattctgtggcactgttgttgaatgtgcaatcacagattcaaagcattttgcctatatagaatactcgaagcctgaagaggcaactgctgctctggcattaaacaacatagatgttggggggcgccctttaaatgttgaaatggcaaaatcacttccacagaaaccatctgttgcgaattcttcacttgcttcatcatctcttcctctgatgatgcagcaagctgttgcaatgcaacagatgcaattccagcaagcactgcttatgcaacaatctatgactgcacagcaggctgctacccgggctgcaaccatgaaatctgccacggagttagcagcagcccgagctgcagaaataagtaagaaattgaatcctgatggagttggaagtgaagagaaagagacaaagcaaaactccagtattggaggtcatttgggtggcgcagcaataatagagtatgaattaacatacttgggagaattccttgttgatcgatcatcctctcctcctcgtggaagatctcggtcaaagtcaagatctcctatcagttaccggagaaggaggaggtctcgctcttattcacctgctcgtcattctaaggatcaccgctctaggtcaccattgaggccccatcattactcaagctatgatagggaaagacggtcctatagagatattagggaacatagtgatagatacagaagacgagattcagatagatcacttgatcatcgttcatctgcttcaagaagaaacagaagtaggagtgtaagtccttatacaaggaaatcacctgtttctccaaaatgtcatagagaaacttcacctcatagaggaaggaaacagtcacgtgttgattctggctctccaagtcatcgcagaggaagtaggccttctccaaagattgatgaaaaaaaactaagaaacagaaggcgctcaaggtcaagatcttcagatgataggcttcactctagcaaaaatgaagaagtcttgcatggaaagtctaagcgcagagagagaaggcgatccaagtcattatctgtggatgagaagcctcacagaaggagccggtcatccccaagaaaagtggatgaaagtagatcccggcacaaaaaacgatcgagttcaaaatctgtggatgataggcatgattctcctgagagattggatgaaaacagaaatagaagattgaggcatagtgataaaaggcactccagatcaagatctacagacaatagggatcaaactgatgtcagagaggatgaaagtaaaaatgaaaagtcaaaacatcgtgatactaaaaggagcaggtcaaaatctgttgaagggaagcgtcgttctaaagataaatcaggggaaaatagagataagaaatcaaagcatcatgatagaaggcgttcaaggtcaatatcattagaagataagcatgacaaaggaggcacttcactccatataaacttggatgagagaaattttgaactgacaaagtcccctgaaggtaagaatcactacagtgataaatatggaaatagaggtgaaaaatcagagcatcaaaagaaaaccccatctaaatcaaaatcaggacaatttgatgggagtgggcccttacgaggaaattacaaggaggatgattcaaaaggaaaatcaccttctgattctggatctgctgaagttaagcatcatttgaatgatggagaaagtgctaccagtgaagaaaattctaaactctttggagatgtgtttcaggaaccaattataaatgcgaaggactcagcaatcctgaatgataatgggacactgacttcagtgaatggtaactacaaatcagaagggtcaagtgaaaatgcaggagctgatgataacccag

SEQ ID NO: 83638 - DNA, 816 bp, Glycine max
  Peptide Sequence Number=SeqID_200416
atgggggcgtcttcggacaacgtaactgggtttgttttggctgtctgttccagcgttttcattggctctagcttcataataaaaaagatgggccttaaaaaggctggtgccacagggaaaagagcaggcgcgggaggacatgcatacctatatgaaccttggtggtggtttggaatgatctctatgattgttggggaagtagccaattttgcagcttatgcatttgctcctgcactacttgtaactcctttgggagctttaagtatcattttcagtgcaatactagctcactttatcttaaaagagaggttgcacatatttggtgtgcttggatgtgctctttgtatggtgggatctacaactattgtattgcatgctccccatgaaagagttattcactctgttaaggaagtgtggcaacttgctacagaaccaggctttctaatctacatgtgtatagttgtggttgtggtttgcatccttattttctattgtgctccacgatatgggacaacctatctggttatatatgttggaatatgctctctcacaggctcaattacggttatgagtgtgaaagcagtgtcaatagctatgaagttaacattggaaggcaacaaccaattcatttactttcagacctggttctttacgattattgtgataggatgttgtcttttgcagattaactacttgaacaaggctttggacacctttaacactgcagttgtatcaccaatttactatgtcatgtttacatcattcaccatctttgccagcataatcatgtttaagggaaaagtaaaactgaaatga

SEQ ID NO: 83639 - DNA, 567 bp, Glycine max
  Peptide Sequence Number=SeqID_200417
atgcgggtgcacaccacaaacgcaggaagtatatccttttcaattcaattatgcatcattctatcattctatgtctatatatacatccatcaggaacaacgtgcagaattaaatgaagagatcctgaaggagaatccgagtgtctgtgcatatatgacaccttcattggatacaaggcaagacatggtgattgtggaggtaccaaagttgggaaaagaggctgcaactaagacaatcaaggaatggggtcaacccaagtccaagattacccatctcatcttttgcaccatcagcggtgtccacatgcctggtgctgatgtaccaacaagactgctttgccggtggctccgtctcgtcgaaaacaacaaaggtgctcgcgtgctattggtttggtctgagatcactgcagtcgcagccttgttcggagatggtgcagctgctggcattgttggatcagaccccttaccaactatccttcccgacagcgaaggggctattaatggccaccttggccttggcgaagttggactcacattccatctcctcaaggtggaccggcaattttag

SEQ ID NO: 83640 - DNA, 579 bp, Glycine max
  Peptide Sequence Number=SeqID_200418
cttcacaagacactccacgacggtagcggaggagctttaagggacttcttgggtctaatccgcagcacgaaacccagcgtcgtcgtcgtggcggaacaagaagcggagcacaaccacacgagattggaggcgagggtgtgcaactcattgaaatactattcagcattgtttgattccatcgaggagagtgggcttccgatagagagtgcggtgagggtgaaaatagaagagatgtacggtaaggagataaggaacattattgcttgcgaaggaagggagagggtggagaggcacgagagtttcgggaattggaggaggatgatggtggagcaaggagggttcagatgcatgagtgttaccgaaagagaattgagccagagccagatgctgttgaagatgtattcttgcgagagttacagtgtgaagaaacaagagaaggaaggagcaacaggagttactcttagttggttggagcaacctttgtacactgtctctgcttggggtcctgttgatgctgctgcggagtatgatatacagacagacacaagaaagggtaggggtcaggggaggagagtataa

SEQ ID NO: 83641 - DNA, 936 bp, Glycine max
  Peptide Sequence Number=SeqID_200419
atgtcaattataacacgcagaggcatccgttacatgccaagactagatgcagcaaaagtatctgctgctttgctagaaaaaggccaaaatcgtgtcatagatgcttcacttacacttattcgagaaagagcaaagcttaaggcatctttgcatgaaagcaatataaatgcagaagttgtttttctccagggagaacttgtgcgtgctttgggaggtgctaaagcaacttcaactcttcttggagttcctttgggacataattcatcgttccttcaagggcctgcatttgcacctcctcgcattagggaggccatttggtgtggtagcaccaactcaacaactgaagaaggcaaggaattacaagatgcacgagtgctaactgatgttggtgatgttcctatccaggaaattcgagattgtggggtagatgatcacagattaatgaatgtaattggtgaatctgtaaagttagtgatggaggaggatccattatgtcccttagttttaggcggtgatcactcaatatcatttccagttatcagagctgtctctgagaagcttggaggaccagttgatgttcttcatcttgatgcgcatcctgataactatgatgcctttgaaggaaacatttattcacatgcttcttcttttgctcgagtcatggagggtgactataaactaggggaaggtgttaaaggtgtatatatctcaatagatgtggattgtctcgatcccgcctttgctccaggagtgtctcacatagagccaggaggtctttctttccgtgatgttctcaacatcctgcacaatcttcaaggcgctgttgttgctggagacgtggtcgaatttaacccgcaacgtgataccgttgatggaatgactgccatggtagctgctaagctggtcagagaactggctgcaaagatttctaaatga

SEQ ID NO: 83642 - DNA, 513 bp, Glycine max
  Peptide Sequence Number=SeqID_200420
atgtccgcgatcaggggaggaggtgaggtgaccgacaatgacaatccaggccttgacgtgagggaagtagccggagcggagcatgaagcagaggaaggaggcagcgtagagcgtgtggttgacctcggtggtggagacagcaaggaggccgaggcaatttgcgttgaggcagtgaagttggcgttcattgtggaggcgcgtgacgatggactgggcgtgcgtgagagaagagagtgtgttctagtaagggagctggaagaccaagcgattgagacaggtggagttagggaggtgcgtggagtgagagtaggcgagccaagcttcttcaattttgcgatcgtgaaggagggagagaagcttatgatcgcagattctgaggaggttggggcggtggcgcgttggaagggagagagtggatgttgtaagagagtgacattcatagtgattgttccttcatctgggataagttcatctaattatctctaccaagtcatcttgttatccaaacaataa

SEQ ID NO: 83643 - DNA, 1049 bp, Glycine max
  Peptide Sequence Number=SeqID_200421
tctcagtgtcatgaatatccgtacaccaaccccccttcgcaacggtcatatttcaccgacatctctcaacggtcatataactccctatctctgcaccgttggatgtgaatccgacggtgtaggagcaaagggaactactacctacggtgatggagacagtgctcgtgtcgatcatggagtggtgaagaagaagaagaagaagaagaagtgtataccacaacatggtgcaaatgcgtgtttaaaaagagaggtggggttgttcaacgtttacccgctgcaaatgaaggacttgttcaacgtttctactgctaatatggctttcactatttctcctcaggactactactactactactacttctgccacaaactccaagtgaagaagaagcaagcggcgttacaaaaaccaaaacctcagacgatgttggctgggtgttctagttcgacattgttgtcaccaaggcacagattgaggagcgaagcaccagcacagtttcaagcctgccacttccagctaccttcttccatgagcacgcagagattggacctgccatcatgcaccaccgccaccttcactcgcaacaacaaagaccatcatcatcatcagcccctaagaccagtgggcctctccgtggatcagaaacacatcgaagccaagaccagcacctgttctctcaagcaacacattcgactcccacctcttgccatcactgcatcagcaacaccattggtggaagagtcatccatcatcaacgacaacaacaacaagagtttgaagaagaggctcgcggcggaacaccacgacgattccttcgccaagaggaaaaagagtagcagtactactgagtgtgattggtttcagcctgatgttgttgagactactactttaggagggtttaacaacaacaacacttcacttgtttctttctcctcagaggaacaagagagggtttgttttcttccttctgaagtggtgtctcattctgcacctttccctttgaacccctggctggaatcatgcgtaacaaagatcacaaatttcggcgagg

SEQ ID NO: 83644 - DNA, 1961 bp, Glycine max
  Peptide Sequence Number=SeqID_200422
atggcgaggcctaatcaggaggcagtcgagacgttcgtcagcatcactggcttgacagaagcagtagcgctgcaaaaattagaggagcatggcggtaatctcaatgaagcagtcaatgcacattttagtgaaggagacagaaatctaacgaccggctctcgcaacagctctgccgtatttcctcaagatgatttcatggatatagatgatcagcatgatgcaggaattcccagaattccatcactacttccagctttagcagcaaatgttaatccattttctcttcttgatccaacaattgggagaggtatatttggtacacgttttgattcaacaatcgaggcaccatttgttacccatccaagagaggtaagggagattcctatagaggttaaggatggcagtcaatccactcctcaagctggccatgttccatccattgaagatgtcactggaactgtcgatgcccatggtccagatatccatgggactgtcataattgatgatgaagatgatgacgatattccacctgcacagattgcacatcaagatgagcaaacacaaaagatcttggctgatacttcactcaatagcagtgttagacctagtgctcctgaatctgagaatttgccagattacagcaatgacatagaagaagaaatgattcgtgcagccattgaggcttctaaacaggaggctgaggaaaattatagaaatcacaaacttgacaggcaaattgacttaagtgaatcaggatcacagccaaggcaatcatatttggaggatcctgagcttgcccatgcagtttcattgtccctgaagacagcagagcaagaaaaagcattgcgagtacacgggggagattctggatcaccaacagcagggccatctaagtcatcagaggctggactaggggaagtgacatcaaatggaagagagaagaatactgatgcggcatggggagtcgaggggaactgggacacgacagccgacgactgctcccctgactggaaggtgcaattctacgtgtctccctacgttcgcacccgatcgatgctccgcgagctcagacgatacttcttgaagaaaaggatcatcggtgtgagaaaagagtcccgagcaggaagcttgtcatttcatgatgaagctgaagatgttgaggagcagccactggttaggaatagatctagacatatgtcttcgggatccacaggattgggcaaagatgttgaacttgctgaggctagcacactaccaagcacagcaacagtgactgcaacacaggatagcagtaatcctcatcataatggaaattccttcccagatgagtggggtggcatttcttcagaggagcatgatgaagcagtaatgcttgaagcggcaatgtttggtggaattccagaagggactgggtatcactatggttatgcaccacatgagtttatgcaaaataggggtttcaatccccggccccaatatcgtcctccttcaccatcactggcagctcaacgcttgataagggaacagcaggatgatgaatatcttgcatcgttacaagcagacagagaaaaagaattgaaggccatggaggaagctgaggctgctcgtgaagaggaaagacagagagcagaagactctcgcaggaaattacaggaagaacaggaattggaaacaaaattagcagccaaagaagtctcactaccaccagaaccatcctcagatgatgataatgctgtaaacttgatggtaaaaatgccagatggcaatcgtcgtggacgtcgattcctaagatctgataggctacagtctctgtttgactacatagatattggtagggtggtgaaaccaggcagttacagactggtgagaccatatcctaggcgtgcttttagtgatggagaaagcgccgcgacattggatgaacttggcctaaccaacaagcaagaagctttgtttttaga

SEQ ID NO: 83645 - DNA, 264 bp, Glycine max
  Peptide Sequence Number=SeqID_200423
atgtaccatggttcccctttgttattgacgcttctcggcccgctcacagttagaagccacatgctgattttgaaattcctatgctataatgactttgaatatgttgttgatgctacagaattgaaggacaacccgatcatcttttatgcagatgtggtcagtgcaatgcttatttgtgctgctggtgaaaaactcaaggtggcatacatttcaagtttgcaatcccttggccttcataatttgacagagaattcaggttgttag

SEQ ID NO: 83646 - DNA, 321 bp, Glycine max
  Peptide Sequence Number=SeqID_200424
atgggtaaggcgtcgaagtggtttcgcgggcttcttggtctcaaaaaaacagagtatgccacctcacccgccaagcctcccaaagagaaacgccggtggagcttcgttaaatcatcatacacagaaaaagacaacaccactgccgccacgtgtccaccactaagaaacaacaacaaccacgcaatggcagtagcagcagccaccgctgcggtggccgaagcggcggtggctgccgccgaagcagccgccgtcgtggtgagactaactagtaacagcggcagtacccgcattaaagggaacagaatcggtcttcaggagtag

SEQ ID NO: 83647 - DNA, 498 bp, Glycine max
  Peptide Sequence Number=SeqID_200425
atggggtttttccatctgcaagctctggggtccaacgtggaccctgtccctgcctcttgtttggccatcttaatcgcaaggagagcactgcgagcattaaagggattggtgaagttgcaagcattggtgagaggccacattgagagaaaacggacggcagagtggctgaaaagattgcaagcactcttacatgcacagacccaagtttctgcagggttgaccctgcatgcctcaccttcgagttcaaagttatcaagccacctccaaggtccagaaacacccgaaaaatttgaaagccccattagatctaagagcatgaaacatgagcactcacctatactcaaggtactttcttgccataagttacccaacgatggtgaatttgtgcattatcgaattcaagttgtctatattcatggaagcatttatgtcattgtagagaaatggctccaaatcctgtgccctgatcaatggctatcaagagatatgtgggagtag

SEQ ID NO: 83648 - DNA, 861 bp, Glycine max
  Peptide Sequence Number=SeqID_200426
atggccacgacgacaacaaggtccccgaaccgttcctccgaggatgccgccgccgatcccacgccgttcctcgccacttcctccgacgaatccacctccggccgcctcctcctccgccgccccagcctccgcgaggccgcgcgcttcctgcgccaggccagcggccgccgcctcatgcgtgagccgtccatggtggtgcgggaggcggcggcggagcaactcgaggagaggcagagcgattgggcctattccaagcccgtcgtcgtcttggacattctctggaactgcgccttcgtcgccgccgccgccaccgtcttggttctcagccgcaacgagaatcccaacatgcctctcaggctgtggattgtaggctacgctctgcagtccgttctccacgtcgcgtgcgtctgcgtcgagtaccggcgccgcctgcgccaccgcgaacactccaacgcggccgccgtctcgggtgacggcagcggggatttgagttcgccttcgatggacggctctggacactacgtgtcgttcgacgacgatgggataagtatggcaaagcatttggaatcagccaacacaatgttttcgtttatttggtgggttgttggattctattgggtatcagctgatagtgaagctttggtccaagattctcctctgctttactggttatgtatagccttcctgggttttgatgttttctttgtcgttttctgtattgcactagcatgcatcattggtattgctgtttgctgttgtcttccatgtatcattgcactcctgtatgcagttgcagaccagttgactctacttacactatgttcggcaaaactagctgaaaaactcgtagctgaaagttga

SEQ ID NO: 83649 - DNA, 534 bp, Glycine max
  Peptide Sequence Number=SeqID_200427
aaaccaaatgtggtgattcctcctcagatcatagcagaagccatatcaatgatccacgatattgacattagagccttcagaaccctatcagatgatgggaagaagtcaccaagagggaccttaagagaacctttatttggcaataatctccctgaaatggattggactcagttggagacatcaacactacttgatattctcaacaaaaagtcctcctttccaggaagtttcatctcaataccagaaatccaagcccaaaacaaggttttgaagcattgtgggttgcctgatgatgaatacctggttctcttaaagcattgggtctcagaggctcacaggaactactggcgtgttctgcttgatgcttctgcattggtgctgggaaagggcaggctgtatcttggccttcacaggcctgacttcttagtctgttgtcttgataacactcactccaatccttcaagaatcacttgcctcttagtgagaacgaaatcttttgacacctccactgcttcttctcaggtcaatggatga

SEQ ID NO: 83650 - DNA, 201 bp, Glycine max
  Peptide Sequence Number=SeqID_200428
atgattgagcctctcaatgggtttattccttgtaaaagcaatgctactcttgattatgtagtctttctatttcagcttcatcaattgccaatggcatcattgattgagtctctcgatgggtttactcctttttcttgtaaaagcaatgttatagagcaactagaatacaatgctataaggttgcttcttattgaagactga

SEQ ID NO: 83651 - DNA, 120 bp, Glycine max
  Peptide Sequence Number=SeqID_200429
atggcgactcagcggacttggagaagacggaaaaagcggctgggggggtcacttctggacgtggataccgccattgacactggcgggaagcttgaaccgccagtgacaatgacgggatag

SEQ ID NO: 83652 - DNA, 486 bp, Glycine max
  Peptide Sequence Number=SeqID_200430
atgagagttccacagattgttagttggctggaaatgcagttgagagctttgggtcagatgactgcaaaggatgtgaaccaagtagaaaccacagaatggtgtgccagagttccacaggttgtgggttggctggaaactccacagaatgctacggtttggctggcaatgcagttgagagctctgccaccaaatgacatcgttcaagggggcaaaaaagggggtttcgtctttgatgcaatcacagccgcaattcatgacactccaggcacaacggtgagttgcgacatgacaggcttccttggagcaggccatagacatgacactccacaacacctctatagagtgactgactactacgctttgcaggctattttgagttggaatttgggaatcaagcatttccctttgttcagagatcatggatctactcataatggacacatttaccagtcaagatccaagttatgcaacagaaaaaattcatga

SEQ ID NO: 83653 - DNA, 195 bp, Glycine max
  Peptide Sequence Number=SeqID_200431
atgtcctccccctcaactacaaactacggcgatgccactccatttgcgttcaccatcgacggagcgatgtgcagcaagatctcaaccccgaccacaaccaccgccaaatctcacgatttttatgtggttgtgggtcgcgcaaggtggtttgcggttgtgggacaagttcagattctagtgaagggtggtggttag

SEQ ID NO: 83654 - DNA, 363 bp, Glycine max
  Peptide Sequence Number=SeqID_200432
atggaaccaagccagattctatcattgcggaccaccacaactgatcctgatcatgtgaaggtcattcagtgggacgacttccagcacgatcttgcaaggttggccagtctctcttccgcgctccacgaagccaacgagaagaagcggaatcttcagtacaagctcgagcccctaattcagggaaagcgcgtttggtctcgtggagaatgcgagcttgagtggggaatggaatcgcgttctgtgtttgattacgaaaattcttggcggaaggaaatagaattggggaagggagacgaatcaagagacttcaaatctcgatcactgtttagtggggttgaagtttattatggttggactggatga

SEQ ID NO: 83655 - DNA, 297 bp, Glycine max
  Peptide Sequence Number=SeqID_200433
atggctaccaatggtccacttaagagaaaatctccaccagatgatgagtctgtcaacttaaaaatcaaacttcaggatgggcgtaatttgttcttcaaggtgaaccgggatatgaagttaattaatgtattcaaagagttctgtgatcgacagaagttggattacgagaccctgaagttcatttatgacggttttaacattaaggggaaacatacagcaaaaatgcttaatatggaagatgatgctgagatcgtggccataagaccccaaattggaggtggtgctgcggcactttga

SEQ ID NO: 83656 - DNA, 1458 bp, Glycine max
  Peptide Sequence Number=SeqID_200434
atggtgaagaagaaggtccccgattggctcaacagctctctctggtcctcatcatcgccgtcgtcccctccctcatccgctgtcgccagccccttcgaacagccacctccacctccaccgcgtcctccatcccccgccgtcgtcaccccctccgagccgccgccgcgtcctccgtcgcctcccgcagtccacgatcctctgccgacgcagagaatcgatgattcgccgagggaagatcacggcgacggctttcgttccgcgcacgacgtgtctcgccaggctcaattgctggccgaggttccctctctccgccttcgcctgcttctgtataacgacattgaagtttcgttgattattgtcaaagaaggtggtggatatgagcgagttgcggagcctcgcgtgtcaaggaaaaatggagcaaggatttctgcactagggatgtgcattccaaatcatctaaccaaatatgcaagtggcttattcccattccattccaaccaaacaggttgtgtgttcataagtctaagtaaggatatggtttggttgctattgcttttgcttggatatcttccaccagatcgagggctttggtcagctgaattagccaagaagcggtcacagtacaaacaattcaaagaggagattttcatgaatccttcagaaatcacaaggaagatgttcaactcgacaaattgtgatactggtgatgccaactgtgcgagggcgttgctctctagatccgaaatcactcatggggagcatcctttgagtcttgggaagaccagcgtatggaatcagttcttccaggatacagagatcatcgaccaaattgaccgagatgtaaagcgcactcatcctgatatgcactttttctctggtgattcccaatttgcaaaatctaatcagttaaacccaggcgtacaatatgtgcaaggaatgaatgagatattggctcctctattctatgtgttaaaaaatgacccagatgaggaaaatgcagcctctgctgaagcagatgcattcttttgttttgttgagctattgagtgggtttcgagataactttgttcaacaactcgacaatagtgttgtgggaatccgttcaaccattacgaggttgtcccagcttttgagagaacatgatgaagagctgtggcgtcatcttgaggttacttctaaggtcaatcctcaattctatgcatttaggtggattactctcctgctgactcaggaattcaattttgccgacagccttcacatttgggatactcttttaagcgatccagatggtccacaggaaactcttcttcgggtatgctgtgcaatgcttgttctcgttcgtaagcgcctccttgcgggtgatttcacttctaatctcaagttgctgcaaaattatcccaccacaaacattagtcatttgctctatgttgccaacaagtttcgtgtacagtcagtctaa

SEQ ID NO: 83657 - DNA, 306 bp, Glycine max
  Peptide Sequence Number=SeqID_200435
atgatgagttatgcaaagttgcaaatgagtgttataggggtgaagcaggctgatgaacttgaaaacatactgaccaaaaaatttctaagatttctgtccatgagagccgaggctttccaagtcctgaggagaaagcctgttcagggatatgacattagcttccttataacaaattaccactgtgaggagatgcagaagcacaaacttattgactttattgtgcaatttatggaggcaagaattttgttgaccctattacttggatttgcattttattttgcggcttgtagtaattatctaaattaa

SEQ ID NO: 83658 - DNA, 207 bp, Glycine max
  Peptide Sequence Number=SeqID_200436
atgaaacaagctcagatgatcacggaacaaagcaggatattcaagtggctgaaaaattattttccaaatttcacgggggatgccacccagcttactgtgtatgatgaggctcaagcacgatcgcaagatacacaattacgttatactgcttactgtttaggatggagggtgaaaaatattttctcttttgcaaagtctcacccttaa

SEQ ID NO: 83659 - DNA, 243 bp, Glycine max
  Peptide Sequence Number=SeqID_200437
atgtctttatcaaaatatttttgcttctcatttcaggcaattagcaataatttttctgtggacttccgggaatctgtttcatcgggttggttacacttgcaaccaaaatggaaaccaagcgtttcgtggtttaaaaatgccgaatcccgcctcaatcatcatttgtcaggattattcggagtcagttccttggcttggacaaggcatttaatccatgtcgctacaagtgttagcaacagtcaa

SEQ ID NO: 83660 - DNA, 609 bp, Glycine max
  Peptide Sequence Number=SeqID_200438
atggaagacgaaatcaacagagaactcgaccttctcccatcctcgcgctccgaatcctccctcctccgcctccgctcggcggtctcctcctcctccaccacagactgcggcggcggcggaggcggaggcgccaccccctctctcgacctgcagctctccatcagcgtgaggccgcccgcggccgtgctcatgtgcgacggcgtggacgcgctcaagtggcaggccgcggagcaaatccgcctcgctgcgatggagaaagcctacgcggagcgggtgagggagctcacccgccgcgagatggagatggcgcagtcggagttcgcacgtgcgcgccaaatgtgggagcgtgcgagagaagaggttgagcgcgccgagaggatcaaggaacgagccaccagaaaggtagattccacgtgcatggagatcacttgccattccttagtgagactgatcgtgaataacggaatgatgataaacttggtgagacaagaccccaagttgagaacttcgatgacgatagaacaaatgaatcggaacaaaaagcatagtagcaccaatcaccacaaagacgagatatatagctgtatccacttgtattcaacttcttaa

SEQ ID NO: 83661 - DNA, 144 bp, Glycine max
  Peptide Sequence Number=SeqID_200439
atgttggtggcgactccgcgcgtattcctttcgtggaacacgcatcccgcgagtcacgcatcgccctcccgccgaatgccggaaggtccatatcaccttcttaactgcacacatggggcactgcgcccccgaatgcccaagtaa

SEQ ID NO: 83662 - DNA, 453 bp, Glycine max
  Peptide Sequence Number=SeqID_200440
atgagaattggtgacacccttgttcataacccagaacaagttcagtctcaaagtggcaaggactttgttttcaaaccctttggggaagatggcatggatgcagaatacatgagccagcaggacctcttaggtcctccaagattcttgttcaccatagtagaagaatcaaaggaagatttagaatctgatgatggcaaattcaaatgtgacaagagtggaaaaggttcaaggggtagaagcttgggtgatttgctagttgtggagacaccatatatgacacctactacttctccacctttctttactcctcctttcactactcctatcagtccctataaccagcgtggattcaatcctctatttgaaacagcaactgatgctgagttcaacagattaaagtcctcacctcctccaaaattcaagttcttacaggaagcagaaagagaagcttag

SEQ ID NO: 83663 - DNA, 546 bp, Glycine max
  Peptide Sequence Number=SeqID_200441
atgaatttaagtgcaaatgagactctattcttgtctgttgataaaatcaaatttttcacctataatgtgtgcactgttgctccacccaatattgtttcagatggcttatggggtggccaacttaatggacggactccattcaaatcttcactcccattgtttgagttgcaggtgcttgtaatttttgctatcacccaaatctgccaattcctcttacagagctttgacttccctcaatttattccacaaatgatagtgaggtcacccagaatatttgtcacgtgtagcatgcaatgttggcctgattctaggccctgctgttcaggtagagatgctggacaaatacaaaaggaagttgtttccatttccaagtcaggacacacttgcaacaatatcatcaattggttatgcacttttcatctttacaagtggtgtgcaaatggatttgagcatgataaccaggacaggacacagggcatgggccattgctattattggattggctgtgccgatacttatttgtattccaaccataatcagcattga

SEQ ID NO: 83664 - DNA, 855 bp, Glycine max
  Peptide Sequence Number=SeqID_200442
atgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaactggacagttccaataagatttcattcttgaacaaaaatccattttggggtttatttcatctattccatgaccggaacagtgggagatacacgttacaccacgattttgaatcagaagagatatttcaagaaatggcagatctattcactctatcaataaccgagccggatctg

SEQ ID NO: 83665 - DNA, 165 bp, Glycine max
  Peptide Sequence Number=SeqID_200443
atgaaacgacttccggaagaacaggtcttccggaaagctctcggaacacctcttccgcttccggaaacattccggaagagggttctttcggatgacctttcagtggttccggaagcactttccgaaagacccttctttcggaatgtttccggaagaattgactaa

SEQ ID NO: 83666 - DNA, 276 bp, Glycine max
  Peptide Sequence Number=SeqID_200444
atggcgaaaccatcaaagaagcgaaagggtgcactgattgatgattggaagtttgatttttctgtgcatgatgcccgtcaattggtttgcaccaaccaagcggatatgaccggaaggcttcttgtcggttcattggcttttgaaagccgcatccttcattatctaattgttcgcatcttgcttccgagatcttcaaaccttgcacaggtttctgaagaagatctcattgttatgtgggcctttcataaaggtctacaaattgattgggcacatctt

SEQ ID NO: 83667 - DNA, 579 bp, Glycine max
  Peptide Sequence Number=SeqID_200445
atggctgctagatatttgaaggaaattgctgagttgtatgagtctgaacagaatatcgagcaggccgttgtttactatgaaaaatcagctgatttttatgaaaatgaagaagtgaacacttctgcaaaccagtgcaagcaaaaagttgctcaattctctgcccagctagaacaatatcagaggtcaattgagatttatgaagatattgctcgccagtctctcagcaataatttgctgaagtatggggttaaaggacatcttcttaatgctggcatttgccaactttgtaaagatgatgttattgctattaccaatgcattggagcgatatcaggtccaatatttttcaagaatttacatcttgagaccggacttggatccaacattttctggaacacgtgaatatagacttctggcagatattgctgctgcaattgatgaagaagatgttggaaagtttactgaagttatcaaggaatttgatagcatgacccctttggattcttggaagacaacacttcttttgagggtgaaggaaaaactgaaagccaaagaacttgaggaggatgatcttacttga

SEQ ID NO: 83668 - DNA, 111 bp, Glycine max
  Peptide Sequence Number=SeqID_200446
tctctaccaaaagatgctgacatctccagaaagggtgcagatgaccacattggtctttgtgtgtcggttaccgtcgggtgtctctgcatgccaccagactcttgggtcacg

SEQ ID NO: 83669 - DNA, 159 bp, Glycine max
  Peptide Sequence Number=SeqID_200447
atgaccaggccttgcttaaagggaatagaagagaagactgccaagctgaaaggaagtgagaacgctctagttgcacggcatgaagctagtcatgctgtagtaggtactgcagtaccaaaccttcttgctggacagccacatgttgagatatgtggatga

SEQ ID NO: 83670 - DNA, 207 bp, Glycine max
  Peptide Sequence Number=SeqID_200448
atgtgggtgcaagcaattggtttgtttgctcaagcgacctgcgctcctgagttggactaccaagatcgttcaatcagaaattactcgtgctacacatttggttgtgaaaacaacacaactatggatacctcagagccctacactggggcaatgaaaggaatcatgcataaacctcaagcgaacctaggggtagatcagaaattctaa

SEQ ID NO: 83671 - DNA, 282 bp, Glycine max
  Peptide Sequence Number=SeqID_200449
atggtggggtacgcaccttcaagctttgcggatttggtcttcgccggcaaaaggatcgaagcgggtctgaaaagaggcaaatttgatcatcctactttgataagtgagaaagctagggcaaatgaagagggtgagaatgaaggagaaacccatgatgcgactaggactacacgtcctcgccatcagaggactacacgtcctcgccatcagagggctgcatgtcctcaccttcagaggactgcacgtcctcatcttcagaggactgcacatcctcacctttag

SEQ ID NO: 83672 - DNA, 423 bp, Glycine max
  Peptide Sequence Number=SeqID_200450
atggcggcccatccagttgtcgccaccctcggtttcgaacgggtacatcagcgtgcgatgggcaaagatatgcacgaacaacgcaccgtctggcttcagccactgcgcgatgcgcgccagcaggcgctcgtagttgcgcacgtgttcgaacatctcgaccgacacgcagcggtcgaagcgtgccgtgggcagctcaagctggttgacatcgcgggtgatcacctcgacgttgcgcagccccctggcttcacactgcgccatgatgtgctggcgttggctcgttctgccatccacagggtcagtgagccccagccgcatcccagttcgagaatctgctggccatcggccaggcctgcgcgctggccgtacagttccagcatcgcgtcctccgcctggtccagcgtttcgcgcccggtggggtag

SEQ ID NO: 83673 - DNA, 815 bp, Glycine max
  Peptide Sequence Number=SeqID_200451
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcagggcctgacggtgaccaaggccaccaaaaacttcctgatggtgctcggcttcatttccgaagacggcagcatgaaacaggttgacctgagtgactatgtggcggccaccattgccgacccgctgagccgggtcgaaggcgtcggcgacatccagatcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 83674 - DNA, 558 bp, Glycine max
  Peptide Sequence Number=SeqID_200452
atgcatgatattaacggggggatcactgcaaatactagcttggctcattattgccgagataatggtctacttcttcatatacaccgtgcaatgcatgcagttatcgacagacaaaagaatcatggtatgcactttcgtgtactagctaaagcattacgtttgtctggtggagatcatgttcacgccggtaccgtagtagatcgaagtcgcggtatttatttcactcaggattgggtttctctaccaggtgttttgcctgtagcttcgggaggtattcacgtttggcatatgcctgctctgaccgagatctttggggatgattctgtactccaatttggcggaggaactttaggacacccttggggaaatgcaccaggtgctgtagctaatcgagtagctcttgaagcatgtgtgcaggctcgaaatgaaggacgcgatcttgctcgtgaaggtaatgaaattatccgtgaggctagcaaatggagtcctgaattagctgctgcttgtgaagtatggaaggagatcaaatttgaattcgaagcaatggatactttgtaa

SEQ ID NO: 83675 - DNA, 811 bp, Glycine max
  Peptide Sequence Number=SeqID_200453
tcgtcctctttccaaatgtggaagggttagtagacctagcagctattgatgctttccttgcttatcaccatagcaaggaaagcccgaccatcactattttggccaatctctatgacacgtccgcctgtccactacaaggtcaccgtttatgcatcgagaaaggaaaggcgaactgggaccaactcttggctagtatggagggggcatccattaattggttccctcgctggaaggaaggaagaactgggcttggctaccccatgagaggagcgccatcggaggaaagtgtcacacctttcatcacacggggtttcagtgaccccaacgcgaggctacttcaaggagttcgcaaggcatgggaagcggcgcaaaggaaggacaaagagcttaggggaagtagtaatggggtcatcgacgtctatcataagtgtctaagagtccggacacaagggttggattggctcccaaagctaaaggctgcaagagaggaagaggctaaagctctggaagaaagtgaagaggtacaagccctaaaggcggagctcgaaaaagcccgagcaatcaaagagaagttcaagtcaacggttatcaaagtccgaaaagaatacaatgaactaaaggatatcaatatggccgctgccaaagccttggaacgagaaaccaagagggcccgaaaagaagaacacggccgaaacaattttcgaggagctttgtggggtaggaacaatgagcttaagctccaaagagatgaaatggatcagtcgcgggtcaaaggcatgatcatgaaagacgagttaaaggcttgccttag

SEQ ID NO: 83676 - DNA, 423 bp, Glycine max
  Peptide Sequence Number=SeqID_200454
atggaaaagttggatcatctagaggaaaggctcggggccattgaaggaggagaagattatgcctttgctaacctaggagagttgttcctagtacccaatatcatcacccctcccaagttcaaggttctggactttgacaagtacaaggggactacttgccccaagaaccatctaaagatgtattgtcgaaagatgggggcatacgtaaaagatgaggaattgctgatacattccttccaagaaagtcttactggggtagctgttacctggatgcaactacagaacatgtgcaaaaagggggcacagatctttcaaagaatacgcccaaaggtggagggatctggcagcccaagtggtacccccaatgatggaaatggagacgataatcatgatggtagacacattatcggtattctactatga

SEQ ID NO: 83677 - DNA, 227 bp, Glycine max
  Peptide Sequence Number=SeqID_200455
atggccccgaggaaacttgcctcaaagagatccaggaaggataaagcggccgaaggaattagttctgctcccgagtatgataggcaccgctttaggagcattgaacaccagcagcgcttcgaggccatcaagggatgggcatttctccgagagcgacgcgtccagctcagggacgacgagtataccgatttccaggaagagatagtcgctggcggtgggcatcactg

SEQ ID NO: 83678 - DNA, 390 bp, Glycine max
  Peptide Sequence Number=SeqID_200456
atgtcttccacaaataaacgttggtggcgactctgcacattttcctcctttggaagacgcacccgtgagcctcgcctcgctcgcctgcaaaagggtaggttgcgacaacaagtcctccacaacaacaatagcctgtccctcctttccagaatgttgttggtccaagaaagccatatgttcctcctccaatacagcagcaacaacaatagcagtcacaacaaagagttagtgaggcaaatgaccatccagaatattcaatttcagcaagagacaagagcctccattcagagtctgacaaatcagatagggcatatggctactcagatgaaccaagctcagtcccaaaattctgacaaattgccttcgcaaactgtgcagaatccgaaaaat

SEQ ID NO: 83679 - DNA, 319 bp, Glycine max
  Peptide Sequence Number=SeqID_200457
atgaagagcgcgttcgacaagaaagtacgcttacgcaggttccatgagggagaccttgtgctaaagaaaatgtcccatgctgtcaaggaccatcgagggaaatgggccccgaactacgaagggccttttgttgtgaagagggctttttccggaggagctttggtgcttaccaacatggatggcgaagagctaccttcacccgggcaggatcaccttgggctaccttctggagtagagacaaaacatgaacggcagaaaccaatcaaggacgaacgcaagcgtggatggggtcacgaccgaccgatcgttgcctttctct

SEQ ID NO: 83680 - DNA, 423 bp, Glycine max
  Peptide Sequence Number=SeqID_200458
atgccgatctccccctatggaagtatcagttggtctgtgtcgttcagacatagggatcgtgcctacaagacacccagtggacctggagaagtccaacagggccctggggtttccagctctagttacgggcctatggatcacgcccgcaagacaccctgtggacccggagaagtccaacagggtcctggggtttccagctctggttacgggcctctgtcagtcctacaagggatcgcgcccgcaagacacccagtggacccgaagaagtccaacagggtcctaaggtttccagctccgattacgggcctctgtcagttctacggagtgcccgtcgcccccaacaagttcatcaggccccctattaatcgggcttttatcaagaagtactgcacccccaggcaagcgcagggcgagacaccatag

SEQ ID NO: 83681 - DNA, 382 bp, Glycine max
  Peptide Sequence Number=SeqID_200459
ggagtccggagacgtcggcgggggccccggaaagagttatcttttctgtttaacagcctgcccaccctggaaacggctcagccggaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaag

SEQ ID NO: 83682 - DNA, 348 bp, Glycine max
  Peptide Sequence Number=SeqID_200460
atgaggctactacttcaccttcctctagtgaaagtgaagaagcaaaaagaatctagtgaagaaatatacccccaagaagaaggacaacctttaatggttaaggagaagtgtaaggaggtaagtatctcctccaagaggaataatcaacatgaaaatacagaaaaaggtacgctttattgcattactttccttaattttttaaatagtgatcaaggggttcccacagaccctaagagaataaaggccattcctgattggcccactcaaccaagtataagggaaatctggggctgccatgacttaacaaacttttacaaaaggtgtcaagggaaggagcccagagtatga

SEQ ID NO: 83683 - DNA, 231 bp, Glycine max
  Peptide Sequence Number=SeqID_200461
atgaaggagttttatgccaacctctatgaccccgatgataaatcacctaagcagacccctgtagtgctggaagagggggagaacttgtgtacatattccagatttgcactcctgaggcatgatcctccagagttggctactaagctctgtctcccagggaggggattcgagcttaatgctgatgggcagcctttgaagattctgcagaagaacatgactactctagcttag

SEQ ID NO: 83684 - DNA, 373 bp, Glycine max
  Peptide Sequence Number=SeqID_200462
atgagaggagtgccatcggaggaaagcatcacacctttcatcgcatggggtttcagtgaccccaacgcgagggtacttcaaggagtttgcaaggaatgggatgacgtgcgaaggaaggacaaagagcttaggggaagtagtaatgggatcatcgacggttatcgtaagaggctgagattccacacacaaggtttggattggctcccaaagcaaagggctgcgagaggggaagaagccaaagctccggaagaaagtgaggaggtacaagccctaaaggcggaacttgagaaagcccatgcagtcaaggagaagttcaagtcaacagccatcaaagttcgaagggagtatgatgaactgaaggatgttggatcaa

SEQ ID NO: 83685 - DNA, 603 bp, Glycine max
  Peptide Sequence Number=SeqID_200463
atgctgatcctgcgactgtctgccatcttcgtcgcccgtgctccgcgacgcgtggtgcgtcgtactctggagaagacgtcagaaaggcaggtgaagcgacagcgcgaatgccgctctgtgcgctgggtggtgcttcatcggcaacgtcatcgcagcgtcatccgcctgcaggcttcgcgctgcaggcgcggtgcgtcacccccgcagcggcgggccagtaccgcaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 83686 - DNA, 912 bp, Glycine max
  Peptide Sequence Number=SeqID_200464
atgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaaaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagtagatccggctctaatagctccgaataaattaaatacatgcattaagatacgaaggcttcttatttcacaacaacgaaaacactttttcactctttcatatactaggggatttcacttggaaaagaaaatgtcccatactaatggattcgggtccacaacgatgggttcaaat

SEQ ID NO: 83687 - DNA, 330 bp, Glycine max
  Peptide Sequence Number=SeqID_200465
atgaggaaaagaagagataaccttacgaaaaatgggatgttacagtatgaattagcggcaacttttactccaacacatctccccttcaagtgtgagtctcttccacatggtagccttcctctggagctcacgagtatagccattttgaccacctgcagtacttgcactaccgctacatctgcggggtaccctgcgccgccatcttactcctctgagccggtcacgagtatagccattctggccacctatggtacttacaccgccactgcacgctgcgccgtgccatcttacttatttgagtcggtcaccaagttgaaccttcatctctga

SEQ ID NO: 83688 - DNA, 411 bp, Glycine max
  Peptide Sequence Number=SeqID_200466
atgcaatcacagggactcgcactgcctcctgaacctgatgttggtccttcagctgctcgtgtcagcacaaaggagagttgtgttgatccctcagggaacgatctagacaccggtgactcatacaaatgtgggttgtatattgaagaatatccttctcgcctggttgccctgggaagagtttatgagggatctacaacaattcacaacattcctttgctgcatgatcaagttaaggttagtgttgaggagattagagatgtagatgctcccattcctgtacccactaaagaggttaaggtcgtgggacaggctcttaacacattccttgcttggccgacacatctagtcaagcgtttatcagaacagggagctgtgagacccgcgaaacctgcagataggccggatgatgag

SEQ ID NO: 83689 - DNA, 231 bp, Glycine max
  Peptide Sequence Number=SeqID_200467
atgggtgccaagtacctcaaagcggtcaagcaatggttgcatgccattaaacagtggtccccggacgaaattagggcaatcggttcgtggggctccgaactcgatggcggaggatgcatgaatgacaatcaattcatggggctccgaataagatttgatggtggaggatgcacgaacagcgctaggaaatcaattcgtggggctccggaatcgatggtggaggatgcatga

SEQ ID NO: 83690 - DNA, 657 bp, Glycine max
  Peptide Sequence Number=SeqID_200468
atgggcaagatcattggtatcgacctcggcaccaccaactcgtgcgtggcgatcatggacggcggcaaggcccgcgtcatcgagaattcggaaggcgatcgcaccaccccgtcgatcgtcgcctacaccaaggacggcgaagtcctggtcggcgcctcggccaagcgccaggccgtgaccaacccgaagaacaccttctacgcggtgaagcgcctgatcggccgcaagttcaccgacgccgaagtgcagaaggacatcgcgcacgtcccctacagcatcctcgcccatgacaatggcgatgcctgggtggccaccagcgacggcaagaagatggcgccgcaggaaatctcggccaaggtgctggaaaagatgaagaagaccgccgaggacttcctcggtgagaaggtcaccgaagcggtcatcaccgtgccggcctacttcaacgacagccagcgccaggcgaccaaggacgccggccgcatcgccggcctggacgtcaagcgcatcatcaacgagccgaccgcggccgcgctggcctatggcctggacaagggcgacaacaaggatcgcaagatcgtggtgtacgacctgggcggcggcaccttcgacgtctcggtgatcgagatcgccaacgtcgacggcgaaaagcagttcgaa

SEQ ID NO: 83691 - DNA, 228 bp, Glycine max
  Peptide Sequence Number=SeqID_200469
atggctaagcccagcactcgtgcgcttagtgagcttagcgcgagattggcgctaagctcaaattcacttactcgcgctaagtgggagaatggcggcctgaagactgtgaatttcagagagcatagagcagagcaaggggccaagttttcatcttttagggagattagtgagtttttgagagattgtgagattccaagaggtggaggagtcatccccactcctttgtaa

SEQ ID NO: 83692 - DNA, 588 bp, Glycine max
  Peptide Sequence Number=SeqID_200470
atggggaagaaggagacaaacacacaagactttttatactggttcggcaacaacccgtgcctacatccagtccccaagcgacctgcggtccttgaaatttcttttcaaccttgtaaaaatccttttacaagcaaagatccacaagggatgtaccctcccttgttctctttgaacaacctagtggatgtaccctccactagaactgatccacaagagatgcaccctctcttgttctcagtcaaatccaaggagaagggagacacaaaagaattcaggcggttagtcctttgttcttttggaaaagggagaagagagacacaaaaagaattcaagaggttagtccttggcgattctttttggcaaagggagaagggaatgaaaaagatgaatagcacaagttttcaaggtttggaaaaccagaaaacttcagaaagcttttggtacaaagaagaagaagacgttcaaagagattcaaggcttgtaaaggattgtatgaataagtgttcaagatgcttgaaatgcaaaacaaagccttgcttttatagactcttcatgtttggtcaagacaaccatttagaagagttataa

SEQ ID NO: 83693 - DNA, 195 bp, Glycine max
  Peptide Sequence Number=SeqID_200471
atggagcaagttagcataggaaaccagaattgggatgaattctacaggctttttgctgcaaaattccttccttggttggtgttttggttcgtgctaaaggtggtgtttagcattggttgtgtggaaggtaaggagaagggttgttattggctaagtaatgacattgttgggttggtgggaaacttggccgtatag

SEQ ID NO: 83694 - DNA, 810 bp, Glycine max
  Peptide Sequence Number=SeqID_200472
atgaggtgtaagaaacacttaccggacctcaccagcaccatcggcgtgtgcgcttcgtgcctccgcgaacgcctccagcctctcctcgcagcccaggcccaagcccaggcccaatcagaacgttccaccaccaattccaacgtggattataatcatcgtcgaagaaagcccaagcccaagcccgaagaaaaccctccgccgctcaatttcccgcgctcggtgtctccctacgtgactcaccggaaatccgactacgaccgcctccgggataggcctcggaggcacggcggaaggttctggatcctctcgaacttattccgagccagatcgaacaagaccgaatcttcgcacgaaccgcgtgaggatccgacgggtcctcatccgccacagtcatggttttcgacaatcctctatgcgcgccggcaccacgacgtgcggtccccgcgcgcggatcgaggattatcgccatcaacagcggaaaatttcacccaattctccgctgactcagcgcaagaccgatcggactcgggaaattcgtcggaaacttcgccggcgaaacagaatccgacgccggtgacggggcaccggcgatcgcggatgggacccacaggaaaaggattcacgagcatggcgttttgtctgaatccgttggttcgggcgggtccgaaccggcattggagccatcataataaagggttggcgcaggaacagggcgggggtggggcccaccacatatccaatgcggcgtcgttttgcgcgaaccggtcgcggaagcttgcggatttcggaaggggcgcgcacaaccgttga

SEQ ID NO: 83695 - DNA, 393 bp, Glycine max
  Peptide Sequence Number=SeqID_200473
atgtatatccttgggtggaagacttcaaaagaaaaagtaatggagaagctgaaaattcttaatctcagtcattctcattatttaacacagactccagacttttcaaatttgcctaatcttgaaaagctattactcatagattgtccaaggttgtccgagatttcctataccattggacatctcaataaagttattctaataaattttcaagattgtattagccttcgtaagcttccaagaagtatctataagttgaaatctcttaaagcactcattctttcaggatgtttaaagattgacaagttagaagaggatttggaacaaatggagtctttgacaacccttattgcggataagactgcaataacaagagtgcccattttcaatagttag

SEQ ID NO: 83696 - DNA, 163 bp, Glycine max
  Peptide Sequence Number=SeqID_200474
atgcttactacctcaaaagattggaaggttgtttctaatgactcctccgtggcttccacatatggcatagaggtcgggcaacttaccaagatgtcttcctcccccgacacaataaccaaatgccctccatcaagtggatccacgggcgtcccaaaagacagct

SEQ ID NO: 83697 - DNA, 171 bp, Glycine max
  Peptide Sequence Number=SeqID_200475
atggccggtgtcggtcgttatatggccccgactgatatctttcagccgacattgcgcaatttcttttacaaacgctggccgataatgacggctaggtttctccgtgcgagctcaaccgagggttcgttccgaccgacagtggcatgttgttcttctcatttaggaggataa

SEQ ID NO: 83698 - DNA, 243 bp, Glycine max
  Peptide Sequence Number=SeqID_200476
atggagatgttttttcttttccaggtttgcatctttgcctatggtcagatagggtcagggaaaacctatacaatgatgggaaggcctggacatctagaggagaagggcttgatacctcgttcattagagcaaatatttcaaacaaagcagtctcaacaacctcaaggctggaaatatgaaataattgctgataaggttttccttgcaaaatttacaggtgtcaatgttggaaatatacaatga

SEQ ID NO: 83699 - DNA, 410 bp, Glycine max
  Peptide Sequence Number=SeqID_200477
atgcccttgcggggtaggattgcattagaaacactttgtgcatattccagatttcgactcctaaggcctgaccctcaggagttagctgctaagctcagtatcccagggaggggatttgagcttaatgatgatggatatctattgaagatattgtggaagaacatgaccaccctagctcagatatggagtgttatttccttctctaacctgattcctacctcccatacttctgatgtcaccctagacagagccaaactcatttatggcatcattatgaagatggacatgaatgtggggtacctcgtctcccaccagatctccctcactactcaacatgacacatccagacttggattcccggccttgattacagctctatgtaaggctaggggagttcagtctgactcgag

SEQ ID NO: 83700 - DNA, 1398 bp, Glycine max
  Peptide Sequence Number=SeqID_200478
atgcgttacgtgtggagcatctgtctggtggcagcctgcggcggtttgctgtttggctatgactgggtggtgattggcggggccaaacccttctatgaggcctggttcaacgtcaccgatccggcggcatccggctgggcgatgagttcggcgctggtgggctgcgtgtttggcgcgctggtgtccggctggtcagcggacaagctggggcggcggctgccgctgattgtcgccgcactgctgtttgtggtgtcggcgatcggcaccgcgctggccagcagctttacgctgtttgtctggtggcgcattctcggcggcgtcggcattggtatcgcctcggcgctcagcccgatgtatatcgcggagatcatcccggcagacaagcgcggcaagtttgtcgcggttaaccagctgacaatcgttattggcgtgctggcggcgcagctgatcaacctgatgattgccgatccggtcgtcggcgcatcaacccatgcggcgctgcgtgaaacctggaacggtcaggttggctggcgctggatgttcgcctcggccgccgtgccgtcgctggcgtttctgctgctgatgatgtgggtgccggaatcaccgcgctggctgatgctggcgggccagccgcagcgcgcgctggcgatgctgaataaaattggttcgcctgcttatgcgcagcagacgcagcgagagattgcccgcgcgctggaacaggatcgccagcaaacgcgcgcccgctccggttcgctgctggcgccgcgcacgctgccgattgtcatcaccggcatcgtgctcgcgattttccagcagtggtgtggtatcaacgtgattttcaactatgcgcaggagatttttgcttcggccggtttcgatattaacggcacgctgaagtcgatcgtggccaccggcctgatcaatttgctggcaacagtgctggcgctgcctctggtggatcggctcggccgccgcaaactgatgctgatcggcgccggaggactgacgctgtgttatgcactgattgccggtgcctacacgctgggcatcaccggctggccggtgctgattctggtactggcggcgattgcggtttatgcgctgacgcttgcgccggtcacctgggtgctgctggcggaaattttccccaaccggattcgcggtctggcgatgtcggtcgccacgctggcgctgtggattgcctgttttgtgctgacttatacctttcccatcctcaatgccggacttggtgcagcgggcagctttatgctgtatggcgtgatttgtgcggcgggctttgtctttgtgctgcgtcgcgtgccggagaccaaaggcatttcgctggagcagctggagcagcagctcaccgcaggcgagccggctgcggtggccaggtga

SEQ ID NO: 83701 - DNA, 222 bp, Glycine max
  Peptide Sequence Number=SeqID_200479
atggagagtcatgagctacagtttggactacaacaagatatctctattgaccccatgaatcttgatctacttcaccaaattgacatgcgaggcaatcattacattgattggatggaataccatgcagagtggattaatatctggaaaaacaaacacagtgatgttttagctgggcaatggattgaaggaatagtgacacatacactagcgtacatggaatga

SEQ ID NO: 83702 - DNA, 270 bp, Glycine max
  Peptide Sequence Number=SeqID_200480
atgcatgaaaatgcgacccatgcaatcgcctgtgctttctgtcttgtccatcgatgtagtattggtggatattctacatcgattattatccaaaaccgatgtagcatgcttaacgatggtagcaatctagacgtttggcagctacaaacgatgttgaacatcagacattctatatcggtgataaggaaagccgatgtagaactccggacattctacatcgattgtcctgataaccgatgtagaatggtcagaattctaagacgagtgtga

SEQ ID NO: 83703 - DNA, 408 bp, Glycine max
  Peptide Sequence Number=SeqID_200481
atggctcctcatggtccacatgccagccacgagacagccagttgtgtggcggcacaaggcgaaaaaggaaaaaagcaaaatcacttcgcaatcgattacggttttaacgccatcgttgccgccgcgaacgggtcgaagctcacgattctgaagtccccgacgggccgcgagatcgaggcccactatgagttgggccgcgaactggaccacagcgagttcgggataacctacctctgtacgaacaaggagttggggatttcatatggtctcagacccttgagagaaaggactgggtcttggaatgatgaggtttgtttaggaacttgtcttaaatttcagttttttgatgaccgtgatgggattgcactagctgctattgctttgtgcagttgtgatttgtggaagtag

SEQ ID NO: 83704 - DNA, 438 bp, Glycine max
  Peptide Sequence Number=SeqID_200482
atgtctcaacaaagattgaacggattggcgttattgtctattgaaaaaaaaatgcctctcaagtccttgagtcgcacttatcctgcttcaggtggaagtgaccaatgctgctattcttgccctaatagaaaactaatgccgagcaatagggaacggcagatagcgctacaactcatggggcaaggggaaatgattgatgctattgtggaaccaataaaagaaaatgtagactctgatgaattaggtcaaaataaaattcaaactaagaactccgagttggtggagggtagtgatcctgaaaaagagggtgaaacctctgataaagatgacaaggtgcaaatagatctatcatctaatgaatctcaatgtctcgaggttaaagagaaaaccatagccgcaagaaggagtgaagttaagacttatattcccttcagctaa

SEQ ID NO: 83705 - DNA, 282 bp, Glycine max
  Peptide Sequence Number=SeqID_200483
atggccaagttcaaccctgagatagtcctagagttctacgctaatgcctggcccatggaggagggagttcgggacatgcgctcgtgggtaaggggtcagtggattcctttcaatgcaaatgccctcaaccagttcttgagctgcccgctgatcttggagaaggaccagcgttgcgagttcagccagaagagggaccaagcctccggctttgacaaggaggccatcgcccagctgttgtgcataccggggcaggactttccctggaccgctgcggggaggcgg

SEQ ID NO: 83706 - DNA, 684 bp, Glycine max
  Peptide Sequence Number=SeqID_200484
atgaccaaaaaagtcaatttagtgacctttgccggtgcagatgtcaacacggttaatgaagccgtatctctgcggattaagcagtttcgtaaacaaagaaaaatttctctcgatgagttatcccgcaaagccagtgtcagtaaggggatgctggttgagatagaagggtgcaaggctaatcccagcattgcactgctatgccggcttgctgctgccatgggcgtgtccgtggcggattttgttgatgtcagcgccaggcctgatgtgcacatcatcgctgatacggacatccccgaactctggacaggagacaaagggggaagtgccaggctgctggccggctcaggtggacccgatatgcttgagctgtggctgtgggaaatgcggccaggcgaaaagtttgaatcacccgggcatacctcaggcacgctggagctactgcacgtaaaatccggaaccctcacgcttggcgtgaaagagagcgtatttcaggtaacggcgggatcctccgttacagccaaaaccgatgttccacatttctacgcaaaccagggagaaaacacgctgaactttatcatgacggcggactgtgtattcgccatgagcgaggagcggatattagcgacaaagagccggggaatatcacatagcggccaggtcgatatcgcacatggcttgatctaa

SEQ ID NO: 83707 - DNA, 1337 bp, Glycine max
  Peptide Sequence Number=SeqID_200485
atgtgtttcagaaatttggtgccaaacccaaacgcacgccctgttctgctgaggcgctacgcaacgcgtgcttcgcgatggcaccctgcccgcgctcgatccgggggagaaaatattgctgcgtaccagggcgcacctcgcctgacggtggcaacaggcacggaaccctttgataccatgaaagaaggggttatggcggtggaatatcctgcgcctggcgaagtcgtctggtgtgatgatgccggcgtaacctgccgtcgctggaactggcggcagggaatcaggactcgcttaagcgttgaagcgcaacacatgtggtttattctggaaagtctgccgcagatgccgcccgatcagctgcatgaagctggaaagatgctgaccgacggcctggaagaaatgatgcccggacggcagtgtaacgtcacgctcatcggcgaactctgcatgttcaccggcttgtctgctttcccgttaacgcctgtcaccgcgcgtggtgtcgatgaacagggattcacgaagatcctggctcgcctgacggcagcccgtgtcgattcgttgggggttctgggttcaaccggcagctatgcttacctgagcagggaacagcgcaaacgcagcgcaacgctggcgtgtcaggttgccggggagattcccgtgatggtttgcgtgggtgctatcagcaccgatgccgtactgcatctggctgaagatgcgcagtccgcaggcgctgctgcgctgctgctgccggcgatgagttaccagccgctgcgtgatgaagaagtgtatgccctctttgagacggttacccgccatgcttcagtaccggtttgtgtttatgacaaccccggtaccacgcatttccgttttaccgatgaactgctcgggcagctgtcgtcactgaaagggattcgctcaattaaaattccgggagtaccggatacccccatcgctgcagctgaacgcgtcgctgcactacgacaacatcttcgtcctggcgtgaccctcggcattagcggtgacgccagtgccgggctggggctgaatgccggttgcgaagtctggtattccgtttgcggcggtatcttcccggaaaccgccaaacaaattacgcaggccgcagccattaacgatgctgaacgcgttactgccctaactcaccgccttaaacctttatgggatctgttccgtaagcatggcggaagtctccgcgtgatcgcagcggcagtaggcatactggggctgaccgatgccgactgtctgcctcgtccccttttacccttatcggccacagaggtggcagaagtagcagcggtgatggccgctctggacctgaa

SEQ ID NO: 83708 - DNA, 867 bp, Glycine max
  Peptide Sequence Number=SeqID_200486
atgacgacttcgcgctcagcaagggtggcgatattgccagcattactgattatggtactgccacatcaacagaccggagattctccaatgccatgtgatctcgatttccacggtaaacgcatattggtcactgcgggtaccaaaggtgtgggtaaagcggtagttgggctattcaaacagctgggtgcaacagtattaacaaccgcacgccacgcatccgcagaatgtagggcagacgccttcgtaacggcagacctgaccacggttacagggtgtaactcagtcgcggaagccgttcagacacatctgggaggcgtcgacatcattgttcatgtggccggcggttctaccgcacccggtggtggctttgcagcattgggtgaagaggagtggcaacaggagctcaatcttaatctgttgcccgcggtacgtttagatcgtgcgctgttgcctgccatgctgcagcaggagggcggagtgatcatccatgtcacttctatccagcgagaactgcccttaccagaatcaaccacgggttatgcagcagcgaaagcggcgctgtcagcctacagtaaaagcctgtcgaaagaggttgcgtcgcagggggttcgggtggttcgcgtggcacccggctggatcgaaaccgaagcttccgtggccatggcggaacggctggcgcagcaggcaggaacagattacgaaggcggtaagcagatcatcatgaaggcacttggcggtattccgctgggacgcccttctcaacccattgaggtagcaaatctcattgtcttcctcgcatcatcttatgctgccgcgatcaccggtactgaatttgtcatcgatggcggcactattccaacggtgtag

SEQ ID NO: 83709 - DNA, 175 bp, Glycine max
  Peptide Sequence Number=SeqID_200487
atggctcaactgatttttgatgccatccactatttgcatggatcgcgcccacaagacacccagtggactcggatgagcccaatagggccctggggtttccagctctggttactggcttctgtcagtcctacaaggtgcccgtcccccctagcaaggtcatgccatcgtgacatag

SEQ ID NO: 83710 - DNA, 237 bp, Glycine max
  Peptide Sequence Number=SeqID_200488
atgggtgaggttgtctctagaatatttccattggatttaatgatgaaatctgtgcaatttcaggtgaaaaagaggctaagtcatgaagtgctaaaagtgacagttgagctcagctcagcagttgggctaagcacacatccatcgctaagtgcagtctcagcacacttagcacgacagaagaatctggcagagcatcaatatcaaggccgcgcactaagcgcgagatcagtgcactaa

SEQ ID NO: 83711 - DNA, 702 bp, Glycine max
  Peptide Sequence Number=SeqID_200489
atgcctgagaaaagttcgagtctttggaccactatggtttgtgggtacgctcagaatttctgctccaacgaggctttggatctgtttgaggatatggttggggagggctttgagcccagtggctccaccttggcgtcggtgttgtccgcatgtgcccggtcgggttgtctcgagctcggggaaaggattcatgagtttatgatggtgaaaggggttggacttggagatggagtgattctcgggaccgcgttggtttacttgtatgcgaagaatggggcgattgcgatggcgcgaaggttgttcgatgaaatgtcggagagaaatgttgttacttggaatgctatgatttgtgggttgggtgcttatgggtacgtggatgatgtgcttgatttgagggagtgggttgttgttcccaatggtgtcacctttgttggagttttgtcggcttgttgtcatgctggcttgattgatgttggttgtgagatttttcggtcgatgaagtcggtgtatggaattgagctgaagattcagcattatgggtgcttggttgatcttcatgggcgaggggctagcacgaatagtgggaatactgaggttgctgaaagagtggtgaaggaaattcttgctctggaacctcagaataatgttgttctttctgctttctctaatatgcagaggctggacactggcaggaagttttga

SEQ ID NO: 83712 - DNA, 1015 bp, Glycine max
  Peptide Sequence Number=SeqID_200490
atggcttccacgcccttctccactttctgccacttccacaaacccaccctccttttcttagcttccgacgggttcaggctcggtggcgctccggcgatcgccttcggaaaggttcggaagaaccgcaaaatgggaatattccccgtttgcagagctggttctgccgtcgtcttccgcgacctcgacgccgacgactttcgccaccctcttgatcaacaggttggttgggcgattaagaatgaagagaaaggtcgcggggtggatcccctgaatacgctgctactgagagcaattccgggattgaacgaactgggaaaagctcttctagtgtttattgagaagtttagtcaaacagggccttacataagtgctttcaatcttcctgatctttaccacctaatggtcgaagctgccgaaatattaaatgtagatgcccctgatctatatgttcgtcaaagtcctgtgccaaatgcatatacattagctataagtggtaaacgacctttcgttgtcattcatactagccttgtggagctcctgacaaaagcagagttgcaggctgttttggctcatgagctgggtcacctaaaatgtgatcatggtgtgtggcttacatatgcaaatattctaacccttggagcctattctgtacctggtattggcggtatgatagctcagactttggaagagcagctgttccgctggcttcgagcagctgagttgacttgtgatcgtgcagctcttcttgttgctcaagaccctaaggttgtcatctctgtcctcatgaaattagctgggggatgtccatctatggctgatcaactaaatgtggatgcattcctggagcaagctcgctcttatgaaaaagctgcttccagcccaattgggtggtatataaggaatgcacaaacaaggcaactgtcacatcctctgcctgttctacgtgctagcgaaattgatgaatgtgcatgcatggaatttgttgaaagtgcacagcagctcaaggttcttcaag

SEQ ID NO: 83713 - DNA, 540 bp, Glycine max
  Peptide Sequence Number=SeqID_200491
atggttgaaggggaaattctagttgaaggtggtgcttgcatcaatattttacctgtaacaaagttgaaacatttcaagaaaaaggttgaggatctattgccacacacattatgtcatcgacgactgattattttcatggccatttcatctcaagccaatttcaatatgcttttagggcacgagtggatgcagtttcgtctacaattatttttctggaacaaggaaagacatttaacattatcaagctattttgctcaaatgttgacgtatattgccgagaagatggttgtgactaatgtggctgagaaaatggaaaattctcgatcaacactcaccaacctagctctaaataaagtgagttatgttgctcaatttgcttcttctagtaggtcaatccaccctaccctgcttaaggtacaccatcgtggggttgtgggaggggaaagttggttggatgctaaaaaggatctagcaattgagatggtggcacctgcatatactttgatgttcaagtgtaagtcaaggaattacttggcctga

SEQ ID NO: 83714 - DNA, 693 bp, Glycine max
  Peptide Sequence Number=SeqID_200492
atgcaaacgttttgcgtttgtggagataagctatggcattacgacgccgtttctttcttcggctctcgcgtgtcgttttgcccacccagaagaagaagccgagtagtgtccatggttgctaagcgcagccccaagcgcctcaaatacaccagcgcttctcgcttcaccaaggaggatggtttggtgcacattgaagcagacccttctgcttctgattcttggaaattggaaccaattgtcaatcttttgaagcaaggtgctgttggagtcattcctactgacactatgtattcaatagtatgtgacctcagaagccactcggccattgaacgtcttcgtagaatcaagaatatagaagcttcaaagcctcttagcatcttgtgccactcatttcgggacatagacaagtacacagctggatttccacgcggtgatggccaaggccatgcaaatttgttcaaagctgtgaagcaatacctacctggtccttatgcatcgagaaaaaatgtgggtgtccgtatgcctgatgatgccatttgtcaagcaatactaaaggagatggatgcaccgttaatatgtacaagtaataggagtgcactgtgcacatctaacccaatgcaaatgggacataatggcaaatatctgagaataaagggaggtagtgggaaaatctgttgcttcagtctggattag

SEQ ID NO: 83715 - DNA, 231 bp, Glycine max
  Peptide Sequence Number=SeqID_200493
atggagacacctagaaatcaacaaggaagactcgaccgaattccgacgggcaaaagttttgactcagatgtccgattgaggcccataatatatcatggagcttgtcacaacctacccttttgcgggcgagcgtggcgaggctcacgggtcgacaaaagcggggctcttgctcctatgtaccctccatcgaagaggaaatcagacctacgtagttctttcaaaaggcagtga

SEQ ID NO: 83716 - DNA, 123 bp, Glycine max
  Peptide Sequence Number=SeqID_200494
atgcctcccaaagtactacgacaaggaaaggtatttgttcagggtcctattttacattggatggaattggaagatgatcagaaaactgatgttgataaggatctcatccctgctggcatttga

SEQ ID NO: 83717 - DNA, 1191 bp, Glycine max
  Peptide Sequence Number=SeqID_200495
atggtggacttttggacatctgttccttcttatgaattgaaaattaatggcatcccaagaacagttgtttcaacaagcaaaccagaggacctgatcatcttcttggactttagcattcctacaagaaactcaactgagcaagttctaaatgcactacatgttaactctggcatcttaactcctctccatggcagaagtaatggaacccgtggatttagttttaaactcaagaacatatcaagaactgagattatcacaattgaattacaagctacatccatacttggaaggacaggcactcctgtctctcctgttgctcctatcacattcctttatgatcccatgaaacccaatgtggtactaaggaccagctccctcactgaaacaagggatttcaacatcaacataattgctgagttcacaaagccagtatttggctttgtgacatcaatagtagacgtctcgggaggaagattgataaggcagggtaaaggaattatcaagagctttctacttgttgactgtcaaagcagtgacaaaggaggtgtcagttaccattcctgcagggaagattccaccccagcaatatccattgcactgcactcatttatcagtgccggaacaattgcaacatcactagtagctgctatggtttcactttcctcagcaaatttagaagcattaagcatacttgctttggaaggtgcaagcagtcctgcttccaatccatcaattaatctacatggaatgattggacacctacaagtctttgccctcacaagttggttttcaactaatcaatttatcaaatactctgagacaacaagaggtcttaggtggctaatacctcatcacaagcttccctggaaaaaaattgacacttggtcttcaatcttggaaagagagaaacttgcagggagaagtaatggcctgtctgcaggagaacattcttataacagagatcaacaacaaaatgacttaatgaacttgtcttatattgatcacaaactatcatttcaaaccaaaaataccactaaatttggtcggtttcacaatcagcatgatttaagtaagacaagtacattatatggtctacctctcaattccatcgaatatttcacttatttcttgagaggagaaccattgtctgctagcaatgtcatcaaaggaatggagagttataaagggtag

SEQ ID NO: 83718 - DNA, 705 bp, Glycine max
  Peptide Sequence Number=SeqID_200496
atgggtggtacaactgggggaattattactggggtgttgctactagcaatccctgtggcattcatcttatcatcattgctatttcttgttattgcaatctacactggaagctttgcgcaatacaaagaattcaacaaaataaccaatgaagaaaaatggtacaccaaattatggttctttttcattgggaggcctatgaatgggaagtggtttaacaaggaaggactaccttcctctttcctctcgcgctttggaattctctttgataattggaagggtcctccagtgctgattttaggtgatcaaaatgaacagaataataccataaccaagtggagcgaaagcgacaaaagtgggatccgaagaaccaaaacagcaagttcagaggacagcaatgaggaaaccaaaatctccacattcaagagggtatttggctgcataagagcatcctatatcatccttgacttactaagaaaagttggtttgggaataatatctgcagcttacccatcagaaaactcaaacaaaagcctttttgcattgataatcacattaatgcagttcatttttctgttcaccaccaaaccatacatcagtagaggtgtccatgttgtggaaagtgtttctctcttgtgtgaggcagattaccaatcaatggtatgctatggtaaattccctattgaatctctcacaatctcagaataa

SEQ ID NO: 83719 - DNA, 149 bp, Glycine max
  Peptide Sequence Number=SeqID_200497
atggtgaagggagcagaagctgttcatgcagcaaatccagatgttctagtcattctatctgggctaaattttgacacaagcttgtcattcattcaggatagaccagtgagcctcacgttcaaagggaagctagtatttgaggtgaacag

SEQ ID NO: 83720 - DNA, 540 bp, Glycine max
  Peptide Sequence Number=SeqID_200498
atgtgggactcgttcaatccacgtggcaccacgctgtttctcgaggaggatcctaagtggaccctctctgcactccagcgttttcccatcctacgcgcccacattgtgcgttactccacgcgcctcgccgaggccaaggaactcctctcctcttataaagattattgtcccggtgtcagcaagaacaccactgaccacccactgaaaggtgatcggtggtgtaagctggcacttggcacgctgcccaatgaggtgtacaaccgtgattgggatgtgatcatgattgatggaccgcggggatattttgcggccgcgcctgggaggatggcggtgatatactccgccgcaatgatggcgcgtgggagaaagggatcgggtgtgacgcacgtgtttcttcatgacgtggacaggggtgttgagaaacagtatgcgaaggagttcttgtgcatgaaatatagggttgggggtattgggaagctttggcactttgttattccacctgttgttaatcctagtgatattgctcatggattttgctga

SEQ ID NO: 83721 - DNA, 384 bp, Glycine max
  Peptide Sequence Number=SeqID_200499
atgaattttggcagagaagaggtggcttgtgatgaggcagagcttggagaagaagaatttgcagaaaaaatgctcaatcaacagaagttacaggaacagcaactagagatgctgaagtacatgcgcaagtttcacttggaagatcaatctgccatccttgagaagttacaccagcagatcgaaaatggaacttatgaaagtgggacatctatgttgtcagctgagcagatcgacgagattgttccaagaaaggcatcccctcaatatacgccaagctgctgtaaggttaaagtttcttgtgcaatggttggcacttgttgctttttaccagcaggttttcctacctcagtgatcagcacagaacgaccaataagaaaaacttaa

SEQ ID NO: 83722 - DNA, 981 bp, Glycine max
  Peptide Sequence Number=SeqID_200500
atggagaaaagcatgaggatggtattaatggctttgttggctttcacgatgcttttatctaagggtgaaggccaattagtagagaatttctacagtttatcttgtccaaacgtggaatccatcgtgaaacaagcagtgactaacaagtttacacagaccattacaactggacaagcaactctgcgtctctttttccatgattgctttgttgagggttgtgatgcctcagtgataatctcgtcgccaaatggggacgcagagaaggatgcagaggagaatatttcactaccaggagatgggtttgacactgtcatcaaggcaaagcaagcagtggaatcttcatgtcctggagtggtttcatgtgcagacattttggcacttgctaccagagacgttataggcttgcttggaggtccttcattcaacgtagagcttggacgcaaagacgggcttatttccaaggcatcaagtgtagaaggaaaccttccgaaagcaaacttcaatttggaccaactcaacgcgcttttctcaaagcacggcctcagccaaacggacatgatagcgttatctggggcccacacagtgggcttctcgcactgtgaccagttcgcgaaccgtttatattccttctcgtcctccaacacggtggaccccactctggaccccagttacgcccaggacctaatggcggggtgccctaggaaccccgaccccactgtagcggttgccctggacccacaatcccctgcggccttcgacaacttgtattaccaaaacctgctgtcggggaaagggttgctaacctcagaccaggttctgttcgaggatgccacgtcacaaccaactgttgttaggttcgccaacaacgttgcggattttaacgatgcctttgtcgcagccatcaggaagcttgcaagggttggggtcaagactgggaatgatggagagattcggagagattgcaccacattcaattcttga

SEQ ID NO: 83723 - DNA, 354 bp, Glycine max
  Peptide Sequence Number=SeqID_200501
atggcgatggaagtggagcagaatcagaatcatcaattagggtttcccttctggaaaccgctccgtcgcaggttcggacccgaatctcctttcttcgctcatggcaacctcgaacgggaacttctcgccaaacagcttgctttggaattaacagaagagaaacaacagcttgagaaatggatgcaagaggaagaaggaaggctcataggtttagtttgtcccttcctcctcattcctgagacttggccgttggcaagtctatttgttgggaacctcctcctactgtccaactcaagctcaattgcgaggcagcagtcaatagaaatggcacggcaagctgtggtggggttatga

SEQ ID NO: 83724 - DNA, 126 bp, Glycine max
  Peptide Sequence Number=SeqID_200502
atggagttattatgtatggtcatatgggccagcccatgggctcaaggctttattggtaagcggcctcaaaagcctaacctcgggccttttcttcctgcaccatctaatagctcaattatgttataa

SEQ ID NO: 83725 - DNA, 327 bp, Glycine max
  Peptide Sequence Number=SeqID_200503
atggccaatcgcccaatcgtgtcacacctccttggacaaacatgtcacacctccaaggccaagcatgttgtgcctccacgaccaagcgtatcgcaccttcgcagtgaacaacaatggtcttacaccgtcgtggctagtcggaaccctctcgcacctcggtccttaaccctttcgcacctcccaggtcaacattgtcgcaccttcacgaccaacaacaacaaccctttcatactctgtactcctccacgaacatcgtcagccttgatctcatattttttcccatttcatgttcacaacttagtttctccttctctctttcactgttaa

SEQ ID NO: 83726 - DNA, 444 bp, Glycine max
  Peptide Sequence Number=SeqID_200504
atggttcacaatttaccgaaatggatattcgagaattgggtcaaccaaaatgatgttccatatgttgcatctcaggccattcaaaaaacaaatgctccaccgtgtaggctcaatccaacaatggagaagctctcgtcgttctacaagagccgctggctggttttcgtggccgcaatgtggctgcagtcgtgggcgggcatcgggtacttgttcgggagcatttcgcccgtcataaagagctctctgggctacaaccagaagcagctcgccatgctcggcgtcgccaaggaccttggcgacgccgtcggcttcatgacgggcctgctctgcgagattttgcccatctggggcgcgcttctcgtcggcgctgctttgaacgtcgtgggatatggctgggtctggcttgttgtcacttctcaagtccccgtcttgcctgtttgggct

SEQ ID NO: 83727 - DNA, 405 bp, Glycine max
  Peptide Sequence Number=SeqID_200505
atggtaataaaaaaacaagataatccaaagaagggagaagagagaggcactcacagcccaaacaggcaagacggggacttgagaagtgacaacaagccagacccagccatatcccacgacgttcaaagcagcgccgacgagaagcgcgccccagatgggcaaaatctcgcagagcaggcccgtcatgaagccgacggcgtcgccaagcccagagagctctttatgacgggcgaaatgctcccgaacaagtacccgatgcccgcccacgactgcagccacattgcggccacgaaaaccagccagcggctcttggatcaatcattcaccgaagaagacgaaagagctttgcttgtgtttgatcggtacgaagaggaggaggatcctgatatggtgcaagaggcatag

SEQ ID NO: 83728 - DNA, 1899 bp, Glycine max
  Peptide Sequence Number=SeqID_200506
atgagtttagaagaattgcaaagttcactagaagctagagaacatagattgctagagagaaataagaagaaaattgctgaacaagccttattggctcaatctagtaacaagaatcctggcgacagtaacagaggaagaagtggttttagaggaagaggtcatggtaggaacaataaaggaagaagtggctatgtttctagtagtggaagaggccagaataatgttgaaaataaacctgatcagtcgcagagaggcaggggcagaggctactatcgaggtggtagcaatggcagaggaagaggtggtaggaaaatgtttgataaacagaacatccaatgttataattgtgataggtggggacactttgcagatgagtgttatgcgaagaaggattccctaggtgacccccgcaaatcttgccaaaggacatttggagccaatctagaagcactttgccataaatgcctagctgcagtagtgagtgaagatgattgggtgtggcatcacagatatggtcacttgaattttagagacttgcatgacttgaatacttacaacatgtgtgaatctcttggtgagagtagatactttgtatcattcctagatgatttcactaggaagatgtgggtgtatatcttgaaaagaaagagtgaagtgctaggagtattcaagaagttcaagagaatggtggagagacaaactggttgcttgataaaaactatagtcactgatggaggaagagagtatactagcaatgaatttgatgaattctatgaactggaaggtattgtgcatgatgtgacacctccctacactccccaacataacggtgcagcagaaagaagaaatcgaacagtgatgaatatggtcagatgcatgcttaatggaaagaagctaccaaaatttctttgggcagaggctgtctccactgcagtgtatgtgctaaaccgaaacccaaaaaaaaggctcaataaaatcacacctgaagaagcatggtctggatgcaaaccagtggttagtcattttaaaatttttggctctatttgttataaacatgtgcctgatcagttgagaaggaagttagatagcaaaagtgaaataatgatactgctgggttatcatgccactggtggttacaaattgtttaatccagtaaccaaagaagtgcttgtgagtagagatgtggtagttgatgaatccaaggactggaattgggataaagagatggtagaggagcctacaaaagttgtgattgaagcttctattgatgagccaagtgattcttctgctgcagtaattgatgacagtgaccaaggaggagtaaggaaatcacagagagctagacaaccctctagcaggttacaggattatgaattgatacatgattcagcaataggggaggaaggtgagctagtacacttagctctatttgctgaatctgaatcagtgagcttggaggaagcaatgaatgacacaaagtggactgatgctatgaaagaagagctgaaagctattgaaaagaataatacatggcaacttgtgcctctgcctgctaagaaaaaacctattgcagtaaaatgggtttataaggtaaaaaagaatccgaaaggagagatttccaagtataaggccaggctagtggcaaagggattcttgcaaaaggctggcattgattttaaggaggtgtttgcacctgttgcaagaatggagacagtgagaattattactgctatagcaagtcaaaaagggtggcatatgcaccatatggatgtgaaatcagccttcttgaatggtcctctagaggaggaggtttatgtgagtcaaccacctgggtttgaaataaaaggaagtgaagagaaggtgtacagattgaacaaggctttgtatggcttaaagtag

SEQ ID NO: 83729 - DNA, 1572 bp, Glycine max
  Peptide Sequence Number=SeqID_200507
atgacttgtggtgctcatcactgtcctttattcgctaatcagctaatctacacatatgcctacccttcactcctccaccacttccattttggcctccaagttcacaccgccacactcaaaatggtgcacttcgactccctcctcatctttccatgtccttcatctctgccacaatcttcgccggcatcctcctctgatcctctctaccgccatcgagatccgcgacacgcagtgattttggcagcgctccaaaacccccttacagtggctcctctgcttcccccttggcatgcgccccgaggggagcgtgttcttctggtcctatgtctactacctctcccacttcctccacatgttccgcactctcttcacaatcgcacgaagtatatggagtttgggttggtcaatttggccttgaaggtgttcaatgaaatgccagagaataattctgtgtcttataacacgggattagagcaacatgagcagagacggttcgagttccatgaggagccgaatgatttatgtcaattttcagatttaaagtcaaatgattctagagtggagttgtctgcggaagctgcgctacaggcaaagccaaaaaggtatatgaaacaaacttcaaaatttgttggagaagagggtgcttcccataatattggaggtcacacaaacaatgatgatttggggaaaattgttgatatgccagatttccaggaaagcgaagatgctgattggaccaggacacaagatttgattaagactggagatagagaagacgtggaactagtaagctgcaataccaaagggttcattgtttcttttggttcattggtaggatttctgccataccataatctagcttccaagtggaagttcttagcttttgagtcatggttaaaacagaagggcatagatccatcaatatacaagcaaaactcaggcactattacaagttttgatgctgaaattaagaacttgtcttctgattctcctccatctctggagattgatggtaaagttgaagatagaatttcaccagatatgaaattggaagatctgctaaggatttatgatcaagagaaacttaagttcttatcttcatttgttggcatggagcttgtgttgttgattgaatgcaacaaagtgctcttcagatttgatttctgtttctcgccacaggctagacttcaaattggggatatagtgaaatgttgtgcccagaaaattgcttactttgggatttttgttgagggggcaggagaactatttggagctgcaattatgagtgttcaaagagcagggacaactgcttctttaatactaatgttattccttctcacaggtggctactatgtccagaggaagccgcggtggggaaccttcgacgctgctgatgacgtcgaggaggcggtgaaaacccttggggatgaaggcgtcgacgtagataaagagctcgctctgggcggcgaagagcatgacgtcagcggggaacaactgggggagtgcgatgagaaggaggcaaaggagggcgaagagttgggagagcaaggcggagacggagaggcattctaa

SEQ ID NO: 83730 - DNA, 150 bp, Glycine max
  Peptide Sequence Number=SeqID_200508
atgactctattttgcacacgacttcctatcgaatcaaagatcaaacgtggggtgggatatcgccagtcgagaacgaccttgaatggcaatctgaagggaagagacaccaaaaatgggttttcctttgccggcagtcccttaccttgctga

SEQ ID NO: 83731 - DNA, 306 bp, Glycine max
  Peptide Sequence Number=SeqID_200509
atggcttgcacccacattccagtgcaagcaaagatctttcaaaattgccccatgtgtggtgtcgcttgtcaatgtcgagactcatacgtgattctcctcaaatttcagccagcccgcatcaattggactttgcaccttatgcttcagggtcatacagtgctcaatggaatgccccagggctcctccatgatatgcacatgttgcgttcaagccgtatcctcggaaaatggaggtggaggaaacctagcagaggttatggctaccattgaattatcgagtagatatgagagcaagtttagcatatga

SEQ ID NO: 83732 - DNA, 204 bp, Glycine max
  Peptide Sequence Number=SeqID_200510
atggtgaaaccaataaacatcttgttaacgttgaaggaacacaatgtcaacagttgcaccacgatcaagtttcatatcgataagaatgtgaaggcgaagtgcaaatctttaatcagtcaaaaaaatgcctgggactatgtaatggataactggggtactttggttgattgtccgtccgaacacaagtttgctgagtccttttag

SEQ ID NO: 83733 - DNA, 861 bp, Glycine max
  Peptide Sequence Number=SeqID_200511
atggaaacttcgagtaagctagcgacgtcgtcactgtggtctccttcgagaggagttagtccgtcacgagcgcaaaacggcgtcttaagtggcttgagtagtaggttcggtggtggtagtgaaccttctattttgagcttcgctgttgatgtttcgagggggaaggtagcggagaaccggatctttgatgcctatttattgagactcttccataacaaactccttcagtggcgttttgttaacgccagagctaatgctgctctctctgcgcagacattgaatgcggagaatctacgagaatccgttagagctaaaagagtagagtttcagttgctgaagcaacaatttaagttaatatccatcctaaaggatcaattttatcgtttctccagtagtttgattgccatgtcattctgtccttcattgtgcaactgccatttcatggcatctggattcatcgaattctatattggtcaaagtagtcatcagactcacagtacatttgaggcatcaaaaaccaacatgcttcgtggcactctttttttgcttggaagctgcttgtcatacacagcttggttcattgtgcaaggggcagtttttaacgtgaagtgcatgccatgcaggacccaaaccgccattgccaatggcgagtttggtcacaaaagcgtagggaaccgccaatcaaactggcgagttccaatagctgagggtgcagaacgcagggctagtcctgccatggcagtgcagcagtgcgtcagtcaaggccaaatcgccattaccattggcgatttgccttgcccacggatcgccagcacggctggcgggttgcctttgttgaaaattttggttcttccattataa

SEQ ID NO: 83734 - DNA, 241 bp, Glycine max
  Peptide Sequence Number=SeqID_200512
agcgtacatctacttggggattgttataatgagaataagagagggtacatctcttgtggatcagttcaaccctctcgctaagcgcaagcctcgcgctaagcgcatctttggtcatgcgttgagcagagagtctctagcacttagcactcaacccttgcatctcaagctgatttggtccgctaagttgtccaaggctgagctaagcccatttcaatttgatctaaatctggctaagcgatag

SEQ ID NO: 83735 - DNA, 375 bp, Glycine max
  Peptide Sequence Number=SeqID_200513
atggcgagtttggtctcagtgaaggactcaccactacgagtggcgatatgtccatgcaaggcacaaatcaccagtacgaatggcgatacacaaggcaagggaaccgccagtcaaactggcagttgtgcttttcagtggctaggttgcaggagcttttttagagaaaggggagttgcaactgccattggcgagttgcctgcaagttgcaactcccattggcgatttaggccagaaaaaatagccatcaggattggcaattttgtgcttataaatacaaagcctcttctttcagttgtgtgctcacgttttcagcttcaaatcagaaataagtattttagttgtgtgctcacgttttcagcttcaaatcagaaatag

SEQ ID NO: 83736 - DNA, 152 bp, Glycine max
  Peptide Sequence Number=SeqID_200514
cgacaaacgaggtatgtatttctgcatctctgttgggtgttcgtgagtgggctgatccgtacagcatacagatcaagttgattcgtaagactggtacgaatcaagttgatctgtatgttgatattaaccatatggatcaacttgatccgtaa

SEQ ID NO: 83737 - DNA, 207 bp, Glycine max
  Peptide Sequence Number=SeqID_200515
atgacaccgtataaagcacgatctctcctcaatgatcagcttcttcgagccaccaagtgtaggggaggaggtagaaaggctcgagggcgacaaaatcgcggtggtggtcgtggtcgtggtcgtggtcgcggcggtggggacggtaggggtaggaatcgaggttgtcagagaagtaatcggagaagaggttgctattgtccatggtga

SEQ ID NO: 83738 - DNA, 264 bp, Glycine max
  Peptide Sequence Number=SeqID_200516
atgggtattgatccaaaaactcacaagccaaggacagacttgaatgacctcatgaatctttctcagtttcttggcatgtcaaacttgagcagtgccattaacactgcttggggcaataagcctctaggtttacagccaaatatcactcgaaccacacaaaagtcattttggttcacagataacaatgggcctctaacacgtgtaagagaagcttacctcgacactgatagtgacagtgacagtgagattggtcgcgagtggtag

SEQ ID NO: 83739 - DNA, 357 bp, Glycine max
  Peptide Sequence Number=SeqID_200517
atgccttatacagattacatgaagcctgataccgagacatacaattgggttattcaagcttatactagagttgaatcttatgccagcttgtgtgtgattgggttgactccttcccacattgctttcaaggatgaaggtggaatcacagccgttgatttcaatgttggaaagtctgattgcagcgggataaaagtcattggaaagcggaagaagggaaaatctgccgtgaaacccagaactagtcttgtttcaccatctagaatgagaactccaggtccatctttagtccccaaggaagttaggttaactcaacagggttctcttgcacaacgtagctgggaaggattgcttgtgtag

SEQ ID NO: 83740 - DNA, 126 bp, Glycine max
  Peptide Sequence Number=SeqID_200518
atgtatatgatgtcgtttgatttgagggcggcgcaagatgtcggggcactactcaaagtcggagaagcacgacgtcgacgacagcagtgtgttgatgcttttgactgtgctgaagaacaaagatag

SEQ ID NO: 83741 - DNA, 384 bp, Glycine max
  Peptide Sequence Number=SeqID_200519
atggccccaaggaagcttgcctcaaagagatccaggaaagacaaggcggttgaaggaaccagttccactcccgaatatgatagccatcgttttaggagtgctgagcaccagcagcgcttcgaggccatcaaaggatggtcattcttccgggagagacgcgtccagctcaaggacgacgagtataccgacttccaggaagagatagttcgttggcggtgggcatcgctggttacccccatggctaagttcgacccagacatagtcctcgagttttatgccaatgcttggcctacagaagagggtgtgagagatatgcgatcttgggtgaggggaggaccaggagtgcgagtatggccagaggaggaaccaggccgatgggtttga

SEQ ID NO: 83742 - DNA, 281 bp, Glycine max
  Peptide Sequence Number=SeqID_200520
gtgttgagaggaacgaagataagggctacgtgggagtacgtgagctcagtgaaggtgggcaactggggatggtgggtttatgtgtgatctgtggatgtggagagttgaattgcaccatcgcccgaccgccacctagtaccacatgtgatggagtggtacctggagatatgtcgcgggggtcaggagaccttggggacgtcaggcaagctcctggcagtcaaccgataaaagaacaaagaccacaaagcaaggaggcttgtgtggtggctggccagctgtga

SEQ ID NO: 83743 - DNA, 243 bp, Glycine max
  Peptide Sequence Number=SeqID_200521
atggcagctagtgatcatgcgattttgcgtgataggactcatgtacccacaaagagaagcctactggagctttcttcacaagatgcactattggcgcagaacaagctattagctaaacagctaaagacattgacagagacacttagaagtgaattatatgggcaattagcacagaccaagtctttttacttgcttggaggtcctcattactacagattcagtactatgcctctattcacatga

SEQ ID NO: 83744 - DNA, 642 bp, Glycine max
  Peptide Sequence Number=SeqID_200522
atgtgttcgataaacatgttaattggaagcagatatgttggaggatcctttgacgttgagtccctcgtggagaatttacttggtcaacttgctggtcaccaagcaattttggtgaatgtatatgatatcataaaatctactgaccacttaatcatgtatggaaaccaaaacgaagaaggtgatatgtctcttatccatgaaatgggttatattttatatggtgctggaaatcacattgtcaaagtagacgatgatttccatcaaatggaggaattaaaagttgatgctgccattaaactccatgtttctgtaggaatgcttggtcttcttctaaagatagaattgagttcaactcaacgtgattatgcccagactgctcaagcatgtgggaaggctctaatagcattaataaatgaggtacttgatcgggctaaaattgaagctggcaagttagagctagaagctgttccatttgacattcattccatacttgatgatgtcctttctcttttttctgtgaagtctcggaacgtaggtttagagcctctttgcatatgcaagggtaaggctgcgtacaacatccctcccccataccttcgcatagcaaagagcctccgggcaatggggtacgaagttttttaa

SEQ ID NO: 83745 - DNA, 279 bp, Glycine max
  Peptide Sequence Number=SeqID_200523
atggaagtgaatgaggcagagagaaacagagttcacatacacgtgagtgttgcgagggacggagttgagatcgttgggtttggagagagcagaggaggagttgacatggggagtggagagaatgcggagagcaagtggaatgagaatgagaaacgagcacgtcagaagcagcagcagcccacacctgagactgcttcgctttcaccatttgtgttggtgatcgtgaaacaattgtgcaatgcgagaggaagagaacaatgttcaactggtgagacttga

SEQ ID NO: 83746 - DNA, 588 bp, Glycine max
  Peptide Sequence Number=SeqID_200524
atgatggctcatggagtagctacctttcttttttcatatgcaaatacagatgaacagaagcatatctttgatactatcattaatgttgtcaatagaggcactggtggaatgtttttcctgtatggctatgaaggtactgggaagacctttatgtggaagacagcactacattcaaaaggtatagaacaggctgaattgttaaaggcaacaaaattgattatacgggatgaggctcatatgactcataggtattattttgaggcattagataagacattgaatgacatcatgtgtatgtctaattctgacaatgttccatttggaggaaaagttgtagtatttcgaggtgatttcaggaaaattcttcctgtcattcctagaggaagtagattagacatatcgaacctcacattgacaaatgcacaagaaatcaagagcttttcccagtggctgatagatgttggtgatgggaaactaggcaaaggtgatgatggttgttatgagatagaaattccacctgatcttttaataacaagcttcaccaatcctattgaagaaattgtaaaccatacctacctagatatctag

SEQ ID NO: 83747 - DNA, 474 bp, Glycine max
  Peptide Sequence Number=SeqID_200525
atgctaaagtcactagttattgataatgaatctggagagggtatagaaaccagctatcggacaagcaccgaatatgttgtggaaagaggaaaagataaaattgtgaggaatattgagaagagaatagctgatgttacttttatacccatagagcatggtgaaccacttcatgttatccgttatgcagtaggacaatattatgaacctcatgtcgactactttgaggaagaatttagccttgtgaatgggggtcaacggatagcaacaatgttgatgtacctttcaaatgttgaaggagggggtgagacagtgttcccaattgcgaatgcaaattttagctctgtgccttggtggaatgagctttctgaatgtggacaaacaggactttcaattaagccaaaaatgggtgatgctttacttttctggagcatgaagcctgatgcaactttagacccattgactcttcatcgttag

SEQ ID NO: 83748 - DNA, 321 bp, Glycine max
  Peptide Sequence Number=SeqID_200526
atggccaagatcatgctgaaggtcacggttgcatcagaggatattttaaacactgttaatgccaagggtcagacttaccgtgaagttaataggtcatttgttgtgaggtggaaagacgtgcttgaccgttactggcatttgcttgacaaggatgaaattttgcatatcgttctctacaatcaagatttagacaacccaaccattgtagtagggtggacagcaccgatggatttctatcacctgactggagatcatcaaatgtcgttaacccattatggatggtcagagtgtattctttctgaccatattcaagagcaatag

SEQ ID NO: 83749 - DNA, 1191 bp, Glycine max
  Peptide Sequence Number=SeqID_200527
atgacgaacgaagaacaccgaatgaagaatgatgtagaagtcgattacggttgcaattcgcaaaaagggagacttggtggacttgcagcttgcccaagcgagttgatgcttcactctgaagtgattacaagtattgttggtgttgcaaatcaacctataaatcgagacataatacttgaaaagcaaagtggacgatcacaaagaatcaatgagcttcatccaggttatcttggattgcaatatcctctattgtttccttatggtgaagatgggtaccgtaatgatatcaatcatagagatatggatgattcttatgaaaggaagagaaacagactaactatcaaagagttcttgtgttttaggttgcattctaaaaaagatgaagcacaaactttactgaggtctagaagattgtttcagcaattcattgttgatggtttgccatatgctcatatcttgttgtttctggatgctggcagtaagtatccatctcctgtagatattgatcgtatcatatcagttgagataccagattctattgaacaaccacaactctatgagtgtgtcaagaaacatatgatgcatggtccatgtgacgactatcctatttataaaaggcgtaatgatggtaaatatattgacagaaatggtgtagcactagacaatagatacgtgtacattaataaaggttatgatcgcataaccgcagctcttgtgcctgttgaaaatgaagatggaacaactgaacaatctgttaatgaaattaagcattatcttgatggtagatatatttctccttgtgaagcttgctggagaatattttcattccagattcacaagagatcacctgttgttgaaaggttgtacttttatttgcctggtgagaattcagtcatatttgaagatagtgatgacattgatgccttgctatccaagccaattgttaaaaagtccatgcttaaatgggtgcctccaagtactggaggattgtattatcttaggataatgttgactatggttaaaggaccaataacttatgaacaaatttgtacaatcaatggtcaattgtattctacatttagagaagcttgctttgctatgggtttcttggttgatgataaggattatattgaggctttaagagaagcattccattgggattttggccaattccttgaagactctttgtaa

SEQ ID NO: 83750 - DNA, 825 bp, Glycine max
  Peptide Sequence Number=SeqID_200528
atggtgtatgattttacactatttgatgatgttcttactggcagtgccaatcctgactacttaatagatgttataagggagttagttgatgtattgcaatggagcctggatggaaaacccaaaaaggtggtcttcactatgaaggataagtgtggtatcattgtcaattgtactttatgggaggattttgcgttcctgctgaaagattatttggacaaacatgaaaatgtaccggttatacttttgcttcatttggaaaaaattaaggaaacacaaggggcttatggagtgtccattcaaaattcaatgtatggttctaggctgtttaccaatgaagatttgaaggacattgaagattataaaaatggtgtactcattaaagaacgtgcaagtgatattaaacaacagatgattgatgaggaaggtgaatttgattcgaaggacattccggaggctattgataggatacttggcaaaaagttagcttttagatttaaggctataccaaacaatacccggtattctatgtcacaaatttcagaggatgaagatctaattatgttattattgaagagacttcctacatatgagcttgctagaattgagcttgaaatgtcagattcgtctgtgaaacatggagatgatatagcctacattcaatccttattagctattggagattttgatcatgaatcatctaagtcagtaactcctgcaaagagaggatttatgatctctgaatctcaattggaatcagtaccatttgaagacctgtcattgattcagttatcctgttccaagttatccaagcatatcaagtcttag

SEQ ID NO: 83751 - DNA, 795 bp, Glycine max
  Peptide Sequence Number=SeqID_200529
atggctgattctccccttgcaaggaattcaaggtccccttccccgtggaaagctcagtcgagatctaggtctaggtcaagatctaggtcgaggtctaggcctagacaaaggccaagatcccgttctagaagtcatggcaggtcaagatcaccaattcatggaaggtcaaggtcacccattcatggaaggtccgagccttcaaatcctggtgacacactttatgtaaccggtctatcttcaagggtcactgaaagagacctagaggagcatttctccaaggaaggaaaggtttcttcatgttttcttgtggtggagccccgtacacggatttctcgtggttttgcttttgttacaatggaatctgctgaggatgcggagcgctgtatcaagtatctcaatcaatcagttttagagggtcgttacatcacaattgagcgggttttctggttatattcagaatgcattgcatcagctatgttggcagcgatcaaagatgatcagtacatccattcacgaagaaaacgtgcaagaactccaaccccagggcactatcttggactgaaaaacactagggagtatggctttcgtggtgagcggggaaggtatcgcgatggtcctgaccgtgacaattattcacgccgtaggtctccaaggcgttcaccgtacagaggtggccaagattattcaccccggcgctcaccctatgggggaaggtctaggagggatagctctaggtcgcttccttattctccacatggtagcccagacaggaagtatgctcgtggatctaggtga

SEQ ID NO: 83752 - DNA, 213 bp, Glycine max
  Peptide Sequence Number=SeqID_200530
atgcgcaaaggagaatctggtagagcatcagcatcaaagtcgcgcactaagcatgagatcagtgcgctaagcgcaacaggtacaatgcccagggcacagaatcacacaatagccatagtgcctatttccggacaagagccctggaagcagcaaagaggaatagcttgtgcattgaagccttggttttgtcatttgagagagattattgagtag

SEQ ID NO: 83753 - DNA, 938 bp, Glycine max
  Peptide Sequence Number=SeqID_200531
gacaacatgtcctcaccatcgaaggactacacctcctcgccattagagggctgcatgccctcgccttcatagggctacatatcctcaccatcagaaggctgcacgtcctcgccttcagaggactacacgtcctcgccaagagagggctgcacgccctcaccttcagaggactacacgtcctcaccttcagaggactgcacgtcctcaccttcagagggttgcacgccctcaccaacagaggattgcacggcccagccttcagagggctacacgtcctcaccttcattggactagacgtccttgcctacataggactacacttcctcgccatcaaaggactacacgtccttgccatcagacgaggaaaagacgtcctcgccttcaaaggggtgcacgccctcgcctttagagggctgcacgtcctccccttcagagggatgcacgccctcgccatcagagggctgcacgccctcgccttcataggacaacacgtcctcacctttagagggcgacacgccttcgccttcagaggactacacgtcttcgccatcagagtactaaacgtcctcgccatcagagggctgcacgccctcgccttcagaggactgcgtgtcctcaccatcagaggactacacctcctcgccattagagggctgcatgccctcgccttcaaagggctacaaatcctcaccatcagaaggctacacgtcctcgccttcagaggactacacgtcctcgccttcagaggactacacgtcctcgccaacagagggccacacgccctcaccttcataggactacacgtcctcgcattcataggattgcacgtcctcgccttcagaggactacacgtcctcgccatcagaggactacacgtcctcgccttcagagggctacacgtcctcaccttcataggactacaagtcctcgaactttga

SEQ ID NO: 83754 - DNA, 240 bp, Glycine max
  Peptide Sequence Number=SeqID_200532
atggccattcgagagaaacattacattctcaaatccactttggtttctggaatttcgaaaaggctgcaggaaaaacaagttgcacggatgctaaggataagtgacaaagatgaaaaagcagtaaatgagtttcaaggtctttatccacaagcaaaacaagacgagtttggtagaatatttcgctctccctctctttttgaggatgtcgtcaagtctatactcctttgcaaatgcacgtaa

SEQ ID NO: 83755 - DNA, 530 bp, Glycine max
  Peptide Sequence Number=SeqID_200533
ttggcactttgttgggtgctatgactggtgccttgataggccaagagacagagagtggtttcattcgaggggctgctataggtgccatatcaggagctgttttttccattgaagtttttgaatcttcccttgttctttggaaatctgacgaatctggaattgggtgtgtcttatacttgattgatgttcttggtagcctattgagtggaagactagtgcgtgaaaggataggtccagccatgttgagtgctgtccaaagtcagatgggtgctgttgaaataagctttgatgaggtacaaaacctctttgacattggtggcgccaaaggtttatcgagagattcagttgaaaagatcccaaagatcacaattactagtgacaacaatgttgatgcttctggggagaaagattcatgttcagtttgccttcaggtacagatacagagggggtgggcggggacatctgttattattactgcaatgtttaaggctagtgtaaaatctttggtgttaacgggaaaaagaaattag

SEQ ID NO: 83756 - DNA, 429 bp, Glycine max
  Peptide Sequence Number=SeqID_200534
atgggtataatcatagggcaatcactagggaagggttgttcctcttccacgtgtgaatcatgtccattggcagacaagttctcaacattatctctagaggataatggaaaatcctattgtgatgttggggatggtgtggttgtactagttagggatggtatggctgtaccagttggggatggtgtggctgcaacaactgacgatggtgaccgtgtgggcgcaataactagagatggtgtggcagcaacaattgagattggtgatggtgtggctacaacaactgaggataatgatggtgtggttgcaacaactgaggatggtgatagtgtgtgtgcaactactaaggatggtgatgtggatggtgcaacaaatggggcttgggcagatgatcttagtgtatctctttgtgataatactttaattacataa

SEQ ID NO: 83757 - DNA, 1298 bp, Glycine max
  Peptide Sequence Number=SeqID_200535
atgtcttggcttatatgccgtcccaaggcttcaccacctgcaatagcacaaccacctatgaaaagtaggagtggatctgctcataagatgttgctggaatttattgctggcattttaacaacaatggtaggggccttactctattgcctcttcaggagaaaggtcattccatttcttaagcaacgaaagactttgaaaggaaaggaacataaaagctttgaatatgataaaatatcattaaggtattttgattttaaggaactagagagagcaaccaaaaattttagccaagattgcttgctgggttctggtgcatttggaaatgtctacaaaggaacctttgacttagaaggaacactagccattaagagagctcattctgaatcattctcaagtgtggaagaattcagaaatgaagttaggctcctttcagctgtaaggcacaggaatcttattggtctgattggatattgtgaagaaccaggacgacatggagccaaaatactaatctatgaatatgttccaaatggttcactgcttgagtacatcaagggaaacgaaacgagcttaacttggaagcaaagactaaacatagcaataggagcagcaagaggcatagcttatttgcatgaaggggtgaaaccaagcataattcaccgtgacatcaaaccaagtaacatcctattaggggaaggttttgaggctaaggtttcagattttggtctagtaagattagggccaactggtgatcaatcacatgtcagcagccagattaaagggacaccagggtaccttgaccctgcctattgtttaagctttcatttgaccaaattcagcgacgtttatagctttggtatcatacttttgcaacttgtttcagctagacctgtggtggattccgctgcaaggccaagcttagagaagggtagtgttgaagaaatcatagatgcaaatctactatgtcaaagtgagccgtgcaacatggaagttatgctaaagatgggacaacttggtttaagatgtgtggttgaagaaccaaaacatcgcccaacaatgacacaggtgtgtcaagaactagagcaagccctccattcagctgatgatagcttcaataacaagcagtctccaaagcggttccatacaccaattggctcatcccagcaatcaacaaagtcagagactcagcgatcagttgaatcatacgattgttcacaaagctttgttagtattgacagtgttggattacagaaatttcatgttgatatggatagtttctcctttaagagcacagacttaag

SEQ ID NO: 83758 - DNA, 1069 bp, Glycine max
  Peptide Sequence Number=SeqID_200536
atggctgttgtccaggccaacaacctgctcgaggaccagagccagattgagtctggtcctctcagcctgcttgacactggcccttatgggacctttgttggtgtatatgatggacacggtggacccgagacgtcgcgctacgtctgtgatcatctcttccaacatctaaaacgtgctgttctccaaacagaattggagattcaccttgataatttgcataataaaggatttgcatctgagcagaagtccatgtctgaggaggttattcggaaggcataccaagccacagaagaaggttttttgtcagtggttaccaaacagtggcccatgaatccccaaattgctgctgtgggatcttgttgtttggttggtgtgatttgtggtggtatcctctacattgctaaccttggcgattcccgtgctgtgcttggccgggttgtcagagcaaccggggaggttttggcgatccagctttcgtcagagcataatgtggccagagaatctgtgagacaagagatgcattctttgcatccggatgactcaaaaattgtggttctaaagcacaatgtatggcgggtgaagggtctgatacagggacccctgactaatccggagttcgaccaggagatttctagatccattggcgatgtttacctaaaaaaggctgaattcaacaaggaaccattgtatgctaagttccgtgtgcgggaaggttttaagaggcccattttgagctctgacccatcaatttccgttcatgaaattcaacagcatgatcaatttctcatatttgcttctgatggtctttgggaacaccttagcaatcaggatgctgttgatatagttcaaaacaacccacacaatggaattgctcggaggctcatcaaagctgctttgcaagaagcagcaaaaaagagagagatgaggtactctgatttgaagaaaattgaccgtggtgtccgccggcatttccacgatgacatcacagttgtagttgtatttcttgactccaatcttgtcagcagagccagctcggtaagaggtcctcctttatcggtgagaggaggtg

SEQ ID NO: 83759 - DNA, 237 bp, Glycine max
  Peptide Sequence Number=SeqID_200537
atggagaagaaagaaagcacggaggaaacctcatgtagcaaacagaaaatggaaaacctcagtaaggggaaaactcaacggcaagtgaagctggaagaaacggaccacaaaattgaagaaaaaaagcaaacgggagaaggtggggaaatgacgaaacacagttcagaggaaacaacgggagaaggctggagaaggaggcatgtggagcaaccaaagcttgaagcggaaataaaatga

SEQ ID NO: 83760 - DNA, 177 bp, Glycine max
  Peptide Sequence Number=SeqID_200538
atggatggcgaggaattgccttcgcctgtgaactccgatggacggatgcaagtgggactagggtcacgaccgattgaccgttgcccctccccggcgctaaacaagcagagaacgtcgctgcaaggcagcccagtatcctttgtgttcgcagtttcttttactatttgtttgttttaa

SEQ ID NO: 83761 - DNA, 237 bp, Glycine max
  Peptide Sequence Number=SeqID_200539
atggggctccggataagattcgttggtggaggatgcacgaacagcgctaggcaatcaattcgtggggctccagactcgatggcaatcaattcgtggggctccagactcgatggtggaggatgcatgaatgacaatcaattcatggggctccgaataagattcattggtggaggatgcacgaacagcgctaggcaatcaattcgtggggctccggactcgatggtgaaggatgcatga

SEQ ID NO: 83762 - DNA, 606 bp, Glycine max
  Peptide Sequence Number=SeqID_200540
atgaaggccggcatggaggccatgaaagagcaaatggccacaatgatggaggccatgatgagcatgaagaagataatgaaagccaatgcggttgcaattgccgctaccagcgctgttgctaaggtgaacccgatgcccccatctggcctcaaccaaatgaatcattcaacctcaaatatggtatgcaaagatatgggaagtacgggcggcccccattatgcgcaaattcaaaacaagcacgccttcccgccatatggcttacctcccaactatacactacccaatgtggcgtacactcctagtgagaatgtcaataactccattcccatactcattgagagccgacaaccccaaactagtcatgcacatgtctctcaaaccgtgggggagacacatgaaattccccaccacaatctagccgacttcaagccttgcctcggatatgccactgaagggcaagtagttagtggtattctcctgcaaaacactttggagggcccccaatttcgccaccaaccacaacccttgcattccacaacatgtaaaatccctcctattatggaaggaatgggaaaagttggatcatctagaggaaagagattatga

SEQ ID NO: 83763 - DNA, 168 bp, Glycine max
  Peptide Sequence Number=SeqID_200541
atgtgggacttgttagccattacctacaaagggtcctctgaggtaaaacgtaacaagttgagccttttgacactttttcagcaaggtcgttttggtagagctctagagacccataatcagcagaaagttctggaaggagaaattgtggaaattgaggataaaagctag

SEQ ID NO: 83764 - DNA, 351 bp, Glycine max
  Peptide Sequence Number=SeqID_200542
atgatttttttgaaaatcatcgtcaataccaaccattttcactctgctgagggttctagagagtatagaggaaaagccatcaagaacctccaatgcctagccgagatctccgtcatggccctcaaacaaacacccctcagtgatggccaggttcaccggtgcgccaccagcagtgacacctctacctccttgtaccttccttgtagctcccgacagatctgcagtagctcatgtgccatggcggtgcaaggatgctccaccgtcctccacaggctcgccagtgctagccttcacttccactccaccttaaacaacaacttgggaattgagccacacatgggaaccacgtga

SEQ ID NO: 83765 - DNA, 285 bp, Glycine max
  Peptide Sequence Number=SeqID_200543
atggaagaaccatcaaagaagcgcaaaggttcttcgagtagaagccaacgacactctaaggctcaggatactccaattccttcctccatttcctcctcctcattgttctcattggaagaacaacgtacacgatacactaacctcttctcctctcgttctatcattgaccctaagttcatagatatggatttcttttctgatgagagtttcaaatgcattcaagcatttcataactcaaatctcattccctttatgtctttaaaactgcctgtgtattctgaattg

SEQ ID NO: 83766 - DNA, 180 bp, Glycine max
  Peptide Sequence Number=SeqID_200544
atggcgtgcagccctctgcaggcgaggatgtgtagtcctctgatggcgaggacatatagtcctctaaagattgactgtccttttgaaaaaggtgataattcatgcaaccttatcctatcttttgcaaatctctccgggaactccctcagagtgtatattctgtttgatttagtcacttga

SEQ ID NO: 83767 - DNA, 492 bp, Glycine max
  Peptide Sequence Number=SeqID_200545
atgaccactctcacgtggatgacgttgctatttagcaatattctgcccagcgaccacaatgccaatctccccctgcagatggatcagttgggatcatgcccacaaagacacgcagtggaccgggagaagtccaacagggccctggggtttccaactttggttacgggcctctgtagtcctacagggtgcccgttcccccctgcagatggatcgggatcgcgcccgcaagacacccagtggacccgaagaagtccaacagggtcttggagttgccaagctctaattgcgggtctctgtcagttctacggagtgcctgtcacctccagcaagggcattaggccccctactaatcgagctttcatcaagaagtactgcgtcccaaggcaggcacagggcaaaacaccacagcagcctggggatggccgacagcgggcaacagacgcaccaccatcacctctagaggtgacctcagctcatccacaaaaaggttag

SEQ ID NO: 83768 - DNA, 708 bp, Glycine max
  Peptide Sequence Number=SeqID_200546
atgggttgttgcttcagcacccctaactctaagccacctcaaaatggcgacaaacaccaacaaccccacctcggatcccatgaacaaaactgcagaatcagaatctcacaaccccttgaagaggaatctgtgaaagaggttctctcggagactcccatctcaaaacctcaacaagttccaattttgatgccacaaacgaagacccaattgcccgaaattcaacatccaaaggtgcccataaaaaaagcgttggaattagaggaagggtccctcgtgtcggaaacatgcagcaacggcgagagcctctccaccaccgccaccaccacgacggaaaaccgagaagacgaagccacgagcaagagaagcaacggaactcgcaaccggaagcgttcttacgccgtcgacggcaatagaatcggtggcagagaccggaggcccaaatctccggggagaaagccggaaattccggcgcggtcacggtcagttcgccggagagagaccgaccatgcccgccgtcattccggcgaggggactacccatcggtcgaggtcgccgtcgcgtggcggccggagtaagcttcggttgcctggaggggtcagtcggcgagttcctccggctaagggtgttgtggaggaaaaggacaccgtttcagtgaaggagtcactagagaatccacacgtgtcgttggagtgctttatttttctgtag

SEQ ID NO: 83769 - DNA, 898 bp, Glycine max
  Peptide Sequence Number=SeqID_200547
tggcatgtattttcatggtgctcgtttttccaattatgaggcatggttaagtgatcctactcacattaggcctagtgctcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatggtaagagattatgatccgactattcgatacaacgatctattagatcgtgtccttagacatcgcgatgcaatcatatcacatcttaactgg

SEQ ID NO: 83770 - DNA, 159 bp, Glycine max
  Peptide Sequence Number=SeqID_200548
ggggatccctcctcctcttctcagcatgcgcttagcgcactgatctcatgcttagcgcggggcctagatattgatgctctaccaaattcttctgtcgcgctaagcatgcttagcccaactgatgagctgagctcaactgtcacttttagcacttcatga

SEQ ID NO: 83771 - DNA, 1662 bp, Glycine max
  Peptide Sequence Number=SeqID_200549
atgggtgtcgaggagcaaggcgaggaaattaatgtacagtctatgatagagcagctctctcaggcatttcttgaattggaagctcagaagggggagactgagaataagattcagtgggttgaaattaagcaacatttccatgaccttgagacggagttgaataagaaacttgaagagctggaagctaaggagagggagtacgaagcgaaacaagtagaagtggatacactactcgcagaaaggaagactgtgattgcttctaaagagcaagacctcttagatcggttgcaggagcttaaagatgctgctgtagcttccattgtagaggctcatgcaaatcaccggaatgccactctggagtctgtgtatgatggggagaacaaagataacaaggtaagcaactctcttggcgatacaaattcctcagaggacgattttcctcataagtcagatgaaaagtctaaaggtgtggctgttgagggtaggccacgtccagagctgacacaattttgtgagcaaatggatgcaaaaggtcttctgaattatattgtggagaataaaaaaaaaaaatctgttaatcgtgaagaaatttctgttgcattacaaagtgcaactgatccagcatgtttggtgctggatttactggaggggttttaccccaccaatgaaacttcccaactaaaagataaatctggtgcttccctacagggcatgcgcaaatcctgtattataattttggaagccatggccaccttattggcaagggctgatccaggtgcagatcaccttctgaaccctcaaaccaagcagcatgccaaagcaattgctgatgagtggaggcccaacttagctagagcagatactgatgctgccaatggaaattcattggaagcaaaggcattcttccagcttatttcaacttttaagattgcttcagagtttgatgaagaagaactctgcaagcttgtacttgcagttgctcagcttaggcaggcacctgagctctgctgctctattgggttaattcacaaaatgccagctgttgtagaatcattaatcaatactgggaaacaaatagcagctgtacattttattcatgccttccagctccaagaaagcttccccccagtgccccttctgaaggcatacctcaagaatcgaaggagaaattcacaagttaagactggaaatgtgcgtgacatcactagtgcaaagaatgatgccaatgcacaagagcttgcagcactgagagctgtaattaagtgtattgaagaatacaagcttgaatctgactaccctcctgatacacttcggaaaagggttcttcaactagagaaatcaaagggagatagaaagagaagtggagaatttattaaacgccctcaatcaaagaggccaaggccgaatgagagacgtttttcactccattcatctggtggtagcgttgcttcaactgttgttttgggtaggcaggttccccctgttagggcaccatatgcagcaaatcctgataggtatccccatgatggcacaatcacatatgattatcaagttcctggtcaatctatatacactgcagcatctaatgctcctccttctaactatggtcgttatatgggtactagtactagtttgcaatcctcacaccaaccatacttgtga

SEQ ID NO: 83772 - DNA, 1578 bp, Glycine max
  Peptide Sequence Number=SeqID_200550
atgtcatcaactttccttcacagagacgctgacttgacttccctcctttctccaccatcctttccttttctctctttcttccgatccgttaccgcaggaacaaccataactcggatcccgactcgttcttcgagcccgagtcaccaactcatggcgcgggaactcactcaccacctttcactaatcctattcctcatcgccaccgtcgctggcgacaccgcgctcctccgcaaccgccaccacggttctcgcccttccatgctccttcccctgtacctctccgcaccgaattcctccacgtcagcgctcgatccccgtcgccagctcaccggatccgagtccaaacgccaccctaacgcacgcatgagactccacgacgatctcctcctcaacgggtattacacgacgcggctttggatcggtactcctccgcagatgtttgctctcattgttgatacggggagcactgttacgtatgttccgtgctccacttgcgaacaatgtggcaggcaccaggatccaaagtttcagccagaatcttcaagcacctatcaacctgtcaaatgtacaattgattgcaactgtgacggcgacaggatgcagtgtgtgtatgagagacaatatgcggaaatgagtacaagcagcggtgttcttggtgaggatgtcatatcctttggaaatcagagtgagcttgctccgcagcgtgctgtttttggctgtgaaaatgttgagactggcgatctttatagtcagcatgccgacggcatcatgggtttgggccgtggtgatcttagtatcatggatcaacttgttgacaaaaaagtaataagtgattcattctcactatgctatggtggaatggatgttggtgggggtgcaatggttctcggtggcatatctcctccatcagacatgacttttgcatattcagatcctgatcgcagtccatattacaatattgatttgaaggagatgcacgttgctgggaagcgactgcctctaaacgcaaatgtttttgatggaaaacatgggactgtcttggatagtggtacaacttatgcttacctaccagaagcagcatttcttgcatttaaagatgcaattgtgaaggaacttcaatctctcaagcaaatcagtggtccagatccaaattataatgatatatgtttttctggtgctggaaatgatgtctctcaactctctaaaagttttccagtggttgacatggtatttggaaatggtcacaagtactcactgtcacctgaaaactacatgtttcggcattcaaaagtgcgaggtgcatactgtctgggaattttccaaaatggaaatgaccaaactactctgttaggaggtatcattgtccgaaacactcttgtaatgtatgatcgtgagcagacaaaaattggtttctggaaaacaaactgtgctgagttatgggaaagattgcagacatccattgccccaccaccattgcctccaaattctggagtgagaaattcaagtgaagcattagagccatctgttgctccatctgtgtcacagcataatgcttcgccaggtattatgagctgctag

SEQ ID NO: 83773 - DNA, 600 bp, Glycine max
  Peptide Sequence Number=SeqID_200551
atggtggaatgcatgccttcgagttttgcagatttggtgtttgcaggcgaaaggatcgaggtaggcctaagaaggggcaaatttgattatactgcttcgataagttattgcaataggaggcctggggtaggtgaagcaaagaaaaaggaaggagatgtccacgccgtgaccacaacaccaacatggccaagatcctcacatacccttcacaaccccatgtatcaatgtcccccgcaccaatataattacttggccaatattggctctcccccttgctcaatgcccttccgaccgagaattaccaatcaaccacaaagacctccccaacatcacccacaaaatccattccctacacaacccaggccgagtgcaaatcccaaccccaatgcaaacaccaacccaaggaggaacttcctagcgagaaaagtcgcggagttcaccccaatcctaatgtcgtacgtcggtctgctaccatccttactcagaaaccaaatggtcgtagtgagctcgagaaagatctatcaacctccatttccccgatggtacaatcctaatgccataggcgcctatcatggtggcgtcccggggcacttcatctag

SEQ ID NO: 83774 - DNA, 339 bp, Glycine max
  Peptide Sequence Number=SeqID_200552
atgacaaaacttgaactggaggcacctaccagggtggcacctcctaaatcctaccaggcaaaaatcacccatgcatttccatgcacacccatttacatatttactttgcttaaatcacccattttggtcagaaagtctcaaaacattctaaacagtactcagaagaattggtggcagcaacacttcttcttggtcgtgagtttagctattttgatcacattgcttctaggattgtcaatattaggaacgttcttaatttggaaaaaaagacagcaaagctcgcattcatacaagccagttgatgcggctgttccagagcaagaacttcagccattatga

SEQ ID NO: 83775 - DNA, 336 bp, Glycine max
  Peptide Sequence Number=SeqID_200553
atgaccacagatcgacctccactccctatggctcacacagacccgggtataaggcctaacatctcaacatgtgtgcaaaagtgtaagtgccatgtgtgcatagagcaatctaagaatcacctcaccctacttgccaagcaaacaaacaactcccaggcagatgcaacaaggttcgagagttgtttacgcatagggaaggtattagcacctcacgtgtgtagacaaaggatcaagctgaatgttttgatgatgccaaaggatcacatgcttctcaaagctttattcaagacaaagaaattaaagatattcaagatggatgatcaagacagtctctag

SEQ ID NO: 83776 - DNA, 772 bp, Glycine max
  Peptide Sequence Number=SeqID_200554
aaaagaacatgctttacgccgcccttaccgaactcgtgctagagctagagtaatgggggaagcagaggaggtgcaagagaaaatgaaggccgacatggaggccatgaaagagcaaatggccacaatggtggaggccatgatgagcatgaagaagataatggaagccaatgcggttacagttgccgctaccagcactgttgctaaggtgaacctgatgcccccatctgacctcaaccaaatgaatcatccaacctcagatatggtaggcaaagatttgggaagtacggacggccccatgatgtgcaaattcaaaacgagcacgccttcccgccatatggcttgcctcccaactatacaccacccaatgtggcgtacactcccaacacatgaaattccccaccacaatctagtcgacttcgagccttgcctcggatatgccactgaagggcaagcagttggtgaaatgggagagttggatcagctagaggaaaggctcagggacattaaaagaggcgaagattatgcctttgcaaacctagaagagttgttcctatacaaggggattacttgccccaagaaccatctaaagatgtattgtcggaagatgggggcatacgcaaaagatgaggaattgttgatacattccttccaagaaagtcttactggggtagttgttacctggtacactaacttggaaccttcacgagtccattcctgggaggacctaatggttgccttcgttaggcagtgtcggtataatggcttcggatag

SEQ ID NO: 83777 - DNA, 345 bp, Glycine max
  Peptide Sequence Number=SeqID_200555
atggcttcctatggtggtgagcctgttcttgactcatcttctccttgtagtggcatctccaatcatctttcttccttctccattctgctgccattgatcttcaagaagcaaaggactccattgatgaagaagatccaaggcctacaagctccacatggagctaaatcactagtgagtgcaatgccttccaagattattttgatgatgccaaagaatcaagagttaagcaagtcccaaagaatcaggagtcaaaaagcttcaagaatcaagtttcaaagaatcaaattcaagaataatcaggtttcaagattcaatgaagtttcaagaatcaagattcaagaataa

SEQ ID NO: 83778 - DNA, 228 bp, Glycine max
  Peptide Sequence Number=SeqID_200556
atgtttccattgtttagtaaaggagtgcggaaaagaaaaattgatgcagatcagacgtgtttggttatggtgagaacgtgtagcgaagcagaagaaggtgcagggccaagtggtcgcgtgcataaatctaaagtcggaagtgatgcacgacactgttgcagtgccattaaggttgttgggttcaaatttggacaaaggtggtggcgcgtggtattggtgcggtggtga

SEQ ID NO: 83779 - DNA, 210 bp, Glycine max
  Peptide Sequence Number=SeqID_200557
atgaccctagtcgctcccaaacacagaacagaaccaaactcactcctctcaaagctgccgtcgccggtcgtcgccgacactgttgcttcactctgttcctcttcgtgcgaagatcagatggctttgcgaggggtttggcaacttaacaagctgattgtcagttattgcaactggggcggaagtagcagaggtttaatctttgttctttga

SEQ ID NO: 83780 - DNA, 723 bp, Glycine max
  Peptide Sequence Number=SeqID_200558
atgaggatcatacctgaatcacaaatagcgctgttcacggagcaggaccaaaacacgcaggccagcgtagtgctgtgtctcgcctctacgatcgacagagcttcggatcttgacctgaccaggctgtcaaagctcctgtcgaggttcaagaagcttttgaagcgcgacgatttcaaggtgaagccagtgctgttgacgctcgtcgaaagtattgtcgctgcgggcggcgcgtccgaccccgcgcagttaaagagtttgattccctgcttggtggaggcgttgagcagcgaagattgggccacgcggaaggccgcggcggagatgctcatggtggttgccgacgtggagagggatttcttatcggagtttaagggtgaagttagttcggggcgttatgaatcagatgttggaagcgtggaagctgtgtttgatcagagaatttgggatgtggaaacaaacatgctattatttgggttgtcatttggcaatttgccgatgccttatgctagtgcagttggaagtcttatgtatgccatggtatgcacaaggctagatctagcaaaagcagctagtgtagtgaatttggatgcaaggcgatctgtgataggttatgctttcacaattggcaattctcttgttagttggaaagctacacctcaacccattgttgctttgttgacagcaaaggcagaatatatggctctggtagaagcaacaaagtaa

SEQ ID NO: 83781 - DNA, 470 bp, Glycine max
  Peptide Sequence Number=SeqID_200559
gacttccatttgctcacaagttgattgatctttttaaggatgtagttgcaaatggagatttccaatgggctcccttgtctgggatattgcctactagtgttaaggttaatatgaatgatgggtatcgtccaagtcttaagggcattggcctagatttagaagaaggctcaagtgttggtgcaacatatgcttttgagggaattcatttgaataattcacaaggaattgttagccaaggaattggtagccaaaagagtagggaaaagagaaagagaatcaatcacactgaaaagttaagcaaaatgaaggcaactacctcttcaagaataactgatgcaattagtgtgattgttgaagcatggacaattgatggtactcatgttccatgtgtggttactcctagtgagcaggctagatttattggaacaaagggtatgccaacacaaaatataacggttgcatgcgattga

SEQ ID NO: 83782 - DNA, 363 bp, Glycine max
  Peptide Sequence Number=SeqID_200560
atgttccaaaaccttcatcgcatcactgcaaagaaaatctgtcatttccctaatccaattgagctcttaatcgacaacgtcgatgctgacgaggtcatacttgtcgtagaggctgaggatcttgaagtggagctgggcggccatggcgagatcgactttttcggggtcgatggcaaccatgaggtcgtaaagcttcttggagaggcaaagggcgtggatggagtgctagaggagctcgggggtgcgatggaggttggagagttgggcgattttggtggtgacagagcggtgagggtcggagagctcagagcagaggcagcgaacagaagactggagcgaggaaagtgcagatctaagggatga

SEQ ID NO: 83783 - DNA, 1945 bp, Glycine max
  Peptide Sequence Number=SeqID_200561
gtggcaggcggagatacccaagtggttatccgcacactctcatttgctatctatccgactcagagtccgagactaatgtcgtcttctgcacctttgtcatccagagacggcgagtccgatgacatgcggagatacccgagtggttatccgtacaaacgatttctgttaatcctgacccgtgaagcggagatacccaagtggttatccgcacacactcatttgcaattcgtgagagttagagtccagggaaacgagccagttgacacacaaagactaacgtcgtcttctgcacctatgtcatccagagacagcgagtctgatgacatgcggagatacccaaagactaacgtcgtcatctgcaccttttgtcaacatgaggcaagcgagcccgctgacacgcagagcctaacgtcgtcttctgcacctttttcatccagagacggcgagtccgatgacatgcggagatacccaagtgagtctaacgtcgtcagctgcaccatttgtcaactaggggcaaacgagcccgttgacacgcagagactaaggtcgtcttctgcaccttcgtcatccagagacggcgagttcgatcacatgcggagatacccgagtgacttagagtccgatagcatgcagagtctagcgtcgtcatcttcaccttttgtcaaccagtggcaagcgagccctcaggttgcaagcggagatactggagtgggtatctgtacaaagacgatttctgttaatcctacccctcgaagaggagatacccatgtggttatctgtatacacttatttgctgttcatcagactcagagtccggcaagcgagcccattgacacgcagagactaacgtcgtcttctgcacctttgtcatccagagacggcagatatacccaagtggttatccgtacaccgtcatatgctatctgtcacactgagagtctggctagcgagcccgttggcacgcagagactaacctcatcttctgcacctttgtcatccagagacggcgagtccgatgacatgcggcaatacccgagtggcaagcgaccccttgacacacagagcctaacgtcgtcttctgcacctttgtcatccagatacggcgagttcgattacatgtggagatactcgagtgacactaacatcgtcatcttcaccttttgtaaaccagaggccagcgagcccgttgacacgcacagcctaacatcttcttctgcgcctttgtcatccagagtcgatgagtccgacgacatgcagagatacccgagtgagactaacgtcatcatctgcaccttttgtcaaccagaggcaagcgggcccattgacacgcagagactaacatcgtgttctgcacctttgtcatccagagatggcaagtccgatgacatgcggagacacccgagtgccgttaagtcaggtagcaggcggagatacccaaaggaaattgggcccgttgacacgcagtgcctaacatcgtcatctgtgcctttgtcatccatagacggcgagtccgatgacatgcggagatacccaagtgagactaacgtcgtcatctgcaccatttgtcaactagaggcaagcgagcccgttgacacgcagagactaacgtcgtcttctgcaccattatcatcaagagacggcgagtccgatgacatgcggagatacccgagtggttatccgcggagatacccaagtggttatcttcacacactcatttgctatctgtcaggcatagagtccggtagcatgcagagactaacatcgtcatttgcacctcttgtcaaccagaggcaagcgagaccgttgaaacagtctaacgaagtcatctgcatcttttgtcaaccagaggcaagcgaaccctttgaaacgcagagcctaacgtcgtcttctgcacctttgtcatctagagacgacgagtccgatgacatgcagagatacccgagag

SEQ ID NO: 83784 - DNA, 1866 bp, Glycine max
  Peptide Sequence Number=SeqID_200562
atgaaatcccgaatcccagaaatttcaaccagcaagactactcacaatttgaactgttcctgtttcttctgcatcttgtctgaaaccgtcccttcagtgagaagagccaaaatatccaattacttgaaacaaatgcctctcagagacgaccaagaacatgtcttgatcttaagtgggctttggaaaatcgccatgactaaaccaaacgacccagaattcccttcccttggcatcttcgcatgcatggccaaacttattagcaaaggtgtcactaatagaagttggcttcttagacaccagaacatatacataccctattatgcagcacatatcattggttcctataccataaagaaagccaagtttgccaaaaaagctgttaagtccttagtggttcagcctttacttgaacttcttaagggtaagataagttgggttgaacaaagggttgcacttagagcactggctcatatagctagccaggaagcaacttttgaagctcttaaagcgcatgaagtagaaatcatagaagcagccatgaacatagcttccacgtgcctaaacaaggtatatgatgactttgttgggttgaaaaagtcagagagattgaagtaccacaggaaccttctaacaagagggcttggagggtttgaattggaaaacagaaaggcagaagaatgggctagccaacttcaatgtaggtctctctatctcctacactgttttgcatgcagagaaagatctctcaggttaatatgcaagaagaaattcttgaaggatttgtgtggaatgtgggggggactaaaaaacccatcttcaccttgtggaataggacttttgaaaactctttgtcacacccaaatgggaagagaaagcatagcaggtttgcaagaagtgttagagagtttgtgtaatgtttcaagatcctcagatgaaaggcaacacatggctattgaaagtctcatgcagcttctcatggacccagttacaaggtataaagtgatagacaaggttgctcctgtgcttgctgatttggttgaactaagagacatcaaagggaaacacaaaattggaaaaacaatcatgaaggttctcttacatgactaccacaaaatcaagctttgcaaggtgagtttgtatagtgaaagaaccaggagcaggttagaagaattatgggatttgaaggtggagagaatcaacagagagaaactgatgagtgtgcaagaaatgagagaaaaagaagccttatcatgtgttctgaaaaaggaaggaagtaagagtttttttgctggggaaattgaaaaggcagtggtgaagtactcagaggctttaaatttttgccctttaaaacaaagaaaagagaggattgtgcttcatagcaatagagctcagtgttatttgcttcttcaacattcagaaggtgccatcagtgatgccacaagagcactgtgcctatcgggtgcggcgcgtcctcacggtaagagcttgtggagaagatcacaggcttatgacatggaaggcttcgccaaggagagcttgatggattgtttagcgttcattgacacaaaggggttgaagataccatactatgtagcacggtttttcaacaagcaaattaattcctcgtggctcttcgcttcagctcagtcaaagtggtatagcaaacacgaagaaatgaatggatttgtgagtttgagtcagaaagcgatgagaaaaatgaaaggtatgagttacattgtagaagaacctttcactgggagaagagcaagggagagaagaaagtgtgtaaggatgagccaggggagaaaattagtgagtgcaaatgttagaagaagctggcactgtatcgaaaaggatgaggcatga

SEQ ID NO: 83785 - DNA, 1209 bp, Glycine max
  Peptide Sequence Number=SeqID_200563
atgtcttgtataaatttcaatgcaggaattgtcaatttcaaatttaaagagtttgatgcagctgttgaagacctttcagcttgcgtgaagctagataaggataatacatctgcctacacatatttgatctcttatatggaaggtctcttcagtatttcaccgaacaaattgactgtacagggtttagcattatcttcaattggtgaatataagaaagctgaggaagctcatctcaaatcacttcaacttgacaaaaatttccttgaagcatgggcacatctgactcagttctatcaagatttagctaagccaacaaaggctcaggaatgtataaataagatgctacaaattgatgggaggtttgcaagagctaatcatttgcgtggccttctgttccatgcaatgggtgagcacaggaaggctatcaaggatttgacaatggggttgagcattgatggcagcaacattgaatgcttgtatttacgtgcttcctgctaccatgctgttggacaatacaaagaagcggtcaaggattatgatgctgcattggatttggagctggattcaatggacaaattcgtgctccagtgccttgctttttatcagaaagagattgctctgtacacagcttcaaaatttaatggtgatttttgctggtttgatattgatggggatattgatgctctttttaaggaatactggtgcaagaaattgcatccaaagaatgtatgcgaaaaggttttcaggcaacctcctttacgcgagtctttaagaaagggaaagcttaaaaagcaagagtttactattaccaagcagaaggcttctcttctacaggcttcagattccattggcatgaaaatccagtatgattgtccaggattcctacctaatagacgtcagcatcgtatggctggacttgctgccattgaaattgcacaaaaagtctctaaggcttggcgttccctgcatgctgaatggaaatattcgaataaaggaaactcaaagaatgggagaagggccaggagaagggaaagaattaatatgcccagtcaaaatagaggaggagctggttgtagtacaagcagtacctcagtaacatcttcaaatggaactgtagatgatagattatccagccgtacattgtcgtggcacaatgtttactcattagctgttagatggagacaaatttctgagccttgtgaccctgtt

SEQ ID NO: 83786 - DNA, 198 bp, Glycine max
  Peptide Sequence Number=SeqID_200564
atgtacatagctagaggaaggtggcagcggctgaccagcaaaagcaaaggtcacagatgctgcccagcgatggcacgggtcccagagactgcgccgaaacacctggagcagctgcgttttgccacaagaggcatgatgttgaaatcatggctacttttcctgcttcttcaaacctgcagcccttacccttttgcgtag

SEQ ID NO: 83787 - DNA, 1263 bp, Glycine max
  Peptide Sequence Number=SeqID_200565
atggctcctcctcctcctcctcctgctgctgctgctacctccgagcgggtggacttggccaggctctgcgcctccaaggactggtccaaagccattcgagtcctcgattccctcatttctcattccaacgcaattcaagacctatgcaaccgcgccttctgttacagcaaattagagctccacaagcacgtgattagggattgcgaccgagcgcttcagcttgaccctacgcgtcttcaagcttatattctcaaaggttctgcactgtctgtgttgggaaggcaagaaaatgctctattggtatgggagcagggctatgaacatgctctgcatcagtctgctgacttgaaacagctgctagaacttgaagagcttatagagacagcaaaacaaggcaaaaatacactgtgtgaaagtgaaaaccataggccaccgccacaaaccaaatcagattctctgagtaatgggagctctagtgaaactcttaagatccaagatacattgggcactccggctgaattatgtggtgatgctactggtgataaatctgagacatgcctaaattctgctgataattccgacttaaagcatgaatcacatgatgaagatagagactctaataaatctgatggccaagtgaatggaagccctgatgttcttgatatacttagttacaattctgaatcatgtaatgactccagtgatgcctcagaatcaagcgaaaaagtatctaccaatagtggtgactcatctaatatccctgaaatttttagaaaccctattagtaagtttatattttctgatgaaagaaaaggtgaagcaaggaaaaataagaagttctgcattgctcagatttcaaatactaattccattagtgtagattttcgactctcgaggggtatagcagaggttaatgaaggaaaatatgctcatgccatatccatttttgaccagatactgaaaaaggacccagcttatcctgaagcactaataggaagaggtacagcatatgcattccagagggaacttgatgctgctatagctgattttacaaaggctatacaatttaatccattggctggtgaggcatggaaacggagaggtcaggccagggcagccttgggagagtttgttgaggctattgaagacttgaccaaggcattagagtttgaacctgacacagcagatattttacatgagagaggtagcttgcctttaactaatttgttatttgtgcaactgatttttgctggacttgaataa

SEQ ID NO: 83788 - DNA, 492 bp, Glycine max
  Peptide Sequence Number=SeqID_200566
atggacaggaacccggatgatctcacaatcacttttccggggacccgcaagaccaaggctcggggaccctctaatgcttccacttttgctctcattactgctcctcctacttctacaccaactccaccaccagttcctgctcctgccccttatacttcagcaccctccgacacctctgctcagagctcaaacattctggtggcctggccaggagtccagccttctcctgcggggggaggtgaggctcctacaaccttggaaccgacgccagacgccacaccggaggagatgcctcaggacactcctgccgccacaccgaccgaggctactgaggagggagatagcactacagacacaaattatgttgcagacatggcagcagcacagagcacttgggatccctggcctactccagcacaggacacgtctttgccagcccaggatgctccttcctcacctcaggacgaccctacactggcacaggaggactga

SEQ ID NO: 83789 - DNA, 270 bp, Glycine max
  Peptide Sequence Number=SeqID_200567
atgggggtgcaaatagcatccaggcccacttgggccctctggaatattcctccagaaggcggttgcttttggaggaagcaaccctgctcgcctgggcaagctaagctcgcctgggcaagctgggcggcaaccacctccctcttttctcctataaataggggaaagagggcagagcaaaaatgttcagcccttctggtattgaggattctctcgaaattagtgaaaaaaattgttttcgtgaagaaaatccaagtagaggtgcttccgtaa

SEQ ID NO: 83790 - DNA, 273 bp, Glycine max
  Peptide Sequence Number=SeqID_200568
atgtcatggctctggaaaccaaagattgttgttgatggggaagaggaggatactggagctatggtgaagtcaacaactccccgtatgttctgcaagactcttagagcttcagacaccatcactcatggtggattctcagttcctcatcgagcagctgaagattgttttccttccctgattgtgagacatactaagacggttcttggaataaccgttgtagtatgtctcatgtcaactggactttttaagatgggtattagaaggaccgtctaa

SEQ ID NO: 83791 - DNA, 492 bp, Glycine max
  Peptide Sequence Number=SeqID_200569
atgacaccggcaagaaagaaaatcgtgaagttcaatgcaacagaactaatcatctcaatatatgcactgaaaagtggaatgacatgcgttgtccagctctctttgttgggttcaatattgtccaatatgttactggtgcttgggtgtgcattcttatgtggtgggattgttaatcacgagaaggagcaagtgtttaacaaggcagctacttccgtgaactcaagattattgctaatggcagtcatgggcatactttttcctgctgttctacactacactcacagtgaggtccatgttgggaagtcagagttgtcactttcaagattcagcagctgcattatgcttgtggcttatgttgcatacctattttttcagttaaaaagtcaaagaaatctctacgtctctgtgaacgaggttggcagtcttatatccagtttcctttttgtttcctcagtcattcttttgtttgtggatatgtggtatgccatgtga

SEQ ID NO: 83792 - DNA, 1860 bp, Glycine max
  Peptide Sequence Number=SeqID_200570
atgagaggaagatcgggtcgggtgtatgagagagatagagtaaaacttgggatccttgatgttgttatctcaatagtgaaaggaccaagcaagattctatttgtacacagagatctttgtaactcttgcaccattgtagatcattcacatccttctcgtggacgtaggtttagaaccataatggcgtcatctgtgggaaacaaaaaaaaaagaagatcaaccacgggttcaaccaagttcgatattgaaaagttctctaggtccaatgattttggcttgtggagaatcaagatgcaagcaatcttggtacaccaaggattggacgatggtttgaaaggtgagtcttctctccttgcaacaatgtcagataaagaaaagaaagatttaattgaaaaggcaaagagcacaataatcttgtgtcttggagacaaagctttgagggaagtagcaagggaaccaatagctacaacaatatggttgaagctggaatcactctacacgacaaagttagtggcaaatcgacttttcttgaaacaacaactctattttttcaagatgacagaggaaagaatgttgtcagatcaaattgatgacattaacaagattctcgatgatattgagaatcttgatgtaaagatggaggatgaagacaaagctctaatgttgctccatggacttccaagtagctatgagcattttaaggatgctatattgtttggaagggatcaaaccattacccttgaagaagattgccctgaaagaagaggcaaagattcaaagaaatctcaagaaccaagagatgtagacattgctcaagcaggttatgaaactgttaatgttctggttgtctcaaattctaagattgagaaggattgggttatggattctagttgtaccttccatttgtgtccaaggtgtgactactctgaatccatgattttgaatgaaggtggagtagtgatgctaggaaacaacaaaccatgtcttcaaacccctatagaactttggagtggaaaaccagcaaattactcaaatttgagagtgtttggggcttttgcttttgcacatatcaagcaagacaagcttggggctagagctatcaaatatgcctttataggatatccacttggaatcaaggggtacaagctttggaggatggaaccggttaatgattacaacttggctaaagacaaagttagaagaaacattgtgcctcctaggagatatgaacaagctaatctaatctaccttgctttgacaattgctgaagagattcaagctactgaacctagaaacttcaaagaagccttgaacaacaaggaaagggttgatttcaaagaaattttctcacctgttgtgaagtattgttccattagaataatgttggccatagtgactcagtttgaccttgaattggagcagttagatgtcaaaactgctttcctccatggagaccttgaagaagctgcctacatgcaacaacctaaagactttgctaaagagaatgggaagcaaggctatatgaagaaattcgttgaaaagttcagaatgcatgagtccaaacctatctcaactcctttgggacaacatgacaagctgtcaaccaaggatgcacccaactcagatgaagaaagggaaaggattgcattaattccttactctaacgaagtgggaagcattatgtgcagcatggtttgcaacaatccaaatttagcttatgtcgtcaacatggttagcaggaagatggaaagtgaagaacctatcaaaggttacatagactctgatgtcattggaaacattgataccaggaaatctttatctatatatgtcttcaccttttttggtactgctgttagctag

SEQ ID NO: 83793 - DNA, 387 bp, Glycine max
  Peptide Sequence Number=SeqID_200571
atgaggttccattcatttaatcacaataagaggaagattggggtgtatgagagagatagagtgaaactcgggatccttgatgttgttatctcaatagcgaaaggaccaagcaaaattctatttgtactcaaagatctttgtaactcttgtaccatagtagatctatttgtggaagcaatgccttccaaggttattttgatgatgccaaagaatcaagagttaagcaaagttttcaagcaaagattcaagaatcaagtttcaagtttcaagattcaagattcaagaatcaagtttcaagaatcaagaatcaagaatcaagaatcaagatcaagattcaagactcaagattcaagaatcaagagaagactcaatcaagataagtattaa

SEQ ID NO: 83794 - DNA, 354 bp, Glycine max
  Peptide Sequence Number=SeqID_200572
atggataacatgcaactttggggaagcgctgaaaacccaaatgttgtcaaagaggacaataacatgtttacggagcagcggtcggaaaatatagttcatggtggcctggaacatggcaagtacgttacaaagaccaaacgacatgacctggtactcattagtgtggaaagtcatcttatgcacatcctaaggttaaaggtgaatctggcgaaatctggaataatctacacaattctccaagaatcgtatttcttcttaaggaggggaactggagaggaaaagaggcttgtgctaggtggaatccaacctctggcaagcaatttggccacctatgactcaatttcgagcttctag

SEQ ID NO: 83795 - DNA, 1275 bp, Glycine max
  Peptide Sequence Number=SeqID_200573
atgaagaagacttatatgttctacagtggtggtgtacccaaaaggaacatgaccattcgggttatgaatgagtatgaccttactttgaaggagcttggtggtaccaatcctaggcaggttttgataatgtcaaaacgaatatacttgataatgattgtcatcatcaaaaagggggagaatgtgaatcttcttcgattcatcgcggcactgcgggagatgaggaagcccaaaagtccaccatctccttcaagcaactctaccacacccgccactgctgggagccagactcggttcgggttcagaatcatggttggggtcgatggtgagattctcccggagacactacaaagaatgctctcgatctgcgaccacatgttcgtcgacatccaggctctggtttgcaggttcgacaacatcaacggtcgcgtgagccacgtggtgctgagaggcagcgggttcttctacctcttgccgcgcgtcacgtttctgaaggcttccacggatgaacccgtttttattgacgtggaggtgaggaagtggtgttgcatggtcgtcatgcacgtgaaggatggctgcgaggttgatcccaccggtgccgaggattgctttctcggcgggtttttggcggggattgccaagggtttggccatgcccgatgctgctctattggggaacttctttgggtccattgttgtggcgcaattgggaccaccgaagcatgacttcaacttgattcaatacgagagcctggagttctattgtggcatggttttacactgcagcaatttgttcatcagtgctttggaaacacacctgattttggaaaaggcaggtgatggtattgtagttaaaggtaaagcttatggcatctgtagcattagagtagatggaaatgatgctcttgctgtttatagtgcagtacacactgctagagaaatcgctataagagaaaaaacagggaaaaaaggggcaaaacagatttggagggaaaaaaagagaagaggagatgctggtggcgaggcaagagacgtgcgatggaagagtgaatgctcatgtagacatggattgcttctacgttcaagtggaacagagaaagcaaccaaatttaagaggcttgccctctgcaatcatacagtacaactcctacaaatgttcgggctaaacacaaggaagtctgcctacacaaagatagttggtaggaacattttcaggcagaggcttgaggctggggatcatgaagcggatattgagcaatgtcggaagttaactatttaa

SEQ ID NO: 83796 - DNA, 132 bp, Glycine max
  Peptide Sequence Number=SeqID_200574
atggatgccacctccactcttccaacaccggcatcaccgacattgctttgctctcctccaggatcaagtcagaaaaagatttgtttgtttgtttgctatgcgtcttcctttcaattcccatctcatccttaa

SEQ ID NO: 83797 - DNA, 204 bp, Glycine max
  Peptide Sequence Number=SeqID_200575
atgggtgagccttttgctcaaggagcttttgggaaactttaccgaggtacttacaatggtgaagatgttgctatcaaaatcttggagaggcctgaaaatgatccagcaaaggctcaattaatggaacaacagttccaacagttattgtcaatatcagagttcttgtcaaatataaatcatgatttgtatttcagcagttgttag

SEQ ID NO: 83798 - DNA, 498 bp, Glycine max
  Peptide Sequence Number=SeqID_200576
atgggacccacatacagtgatatggggtgcaaactagcccttgaagacaaaacaagagtcgcatttaggaggaggcagaggcatgaacatgttgatgcatcaaggcatgccaaaccttgcaattgttcaagtttggcctctcagcaacaaaaagcctgtgtctgttgtttcatcaagctaccatgcagaatctgtcatcaagcactgaggtgtgcccgaaaatgggcatgttatggatcaaagaataatagggttgggtttgtgaattccttggcttttgcaaaatcaggagaattcttagttgctggagttggacatgtgaaaattttctcaaactgtgtcctgcttaccgttgtcctcaaagttggtatgtcatgtcaagggtgtgctggagcagtaaacaggattttgggaaaaatggaaggtatttttattcctgcaagctatctctactatcagatccaaaatgaaaatgatctagtaattgtagcaacgtaa

SEQ ID NO: 83799 - DNA, 414 bp, Glycine max
  Peptide Sequence Number=SeqID_200577
atggatgccacctccactcttccgacaccggcatcaccgacattgctttgcactcctccgggatcaagtcagaaaaaggaatatacaccagacatatctggactttgtgcaatgtcgcgttgctttccatttccaccactaggatatacaaacaagggatatgaaaaagaaggctacaacagaggatgtggaattactgacaaagcattggcggagaaagttagattggtgctcaatgagtatccacaactcaggctaacccaagggagaaaagtgctagagatctgtctaaccattaaatgggacaatggcaaggctcttgaatttttgttagaatcattggggtacaagaattcgaatgatgtatttccaatctatattggtgatgatcgaactgatgaggatgcttttagg

SEQ ID NO: 83800 - DNA, 468 bp, Glycine max
  Peptide Sequence Number=SeqID_200578
atgtttgcacattcgattaaaggctgccgtcccttgggacgggcgtgtggggtgctaataccttccccatcacgtcttttccggtttttccgacgttttcctcaaataaacgttggtggcgactccgcgcgtattcctttcgtggaacacgcatcccgcgagtctcgcgtcgccctcccgccgaagggtaggttgcgacattatggatcaaagaataatagggttgggtttgtgaattccttggcttttgcaaaatcaggagaattcttagttgctggagttggacatgtgaaaattttctcaaactgtgtcctgcttaccgttgtcctcaaagttggtatgtcatgtcaagggtgtgctggagcagtaaacaggattttggaaaaaatggaaggtatttttattcctgcaagctatatctactatcagatccaaaatgaaaatgatctagtaattgtagcaatgtag

SEQ ID NO: 83801 - DNA, 231 bp, Glycine max
  Peptide Sequence Number=SeqID_200579
atggttgtggaggaagccaagagcactatggggacaaatgcagaagaagaaaagatggtgatagtaaggtttggggacttgcaaacaatgagaagagtgaggattgggaagagattattaatgaagaagaagcaaatggttgcggctgcagaggctgagaagtctcttccggtgtctccggcgggtggtcctcagcctctctacccttgttatgagtacacacttttttaa

SEQ ID NO: 83802 - DNA, 627 bp, Glycine max
  Peptide Sequence Number=SeqID_200580
atgggcacacaagaagacaaaaagaagattatgggtatcgtggaagaggctcacaacatgacaatagtagggaaggggaatgaaatcgtgatactgactcatgggttcggcacggaccaatcggtttggaagcacctcgtaccgcatctggtggatgattaccgtgtagtcttgtacgacaacataggtgctggtaccacgaacccagactacttcgacaacataggtgctggtacctactcgccatcttgcaagagcttcaggtgtaatcttgcatcttcgttggtcactctctctcctctatggtgggcctcctcgcttccatctctcaccctcatctcttcaccaaactcatcctcgtctctgcttctcaaagcaagaagatctgacccaactctacgacggaatccgatcgaactacaaaacatggtgttcggggttcgctccgcaggtgatcggcgcgacatggactcggtagcggtgcaggaattcagccgaaccctcttcaacatgaggccagacatagccctgagtttggcgcagaccatattccagttggacatgaggccaatcctatcccacctgaccgtgccgtgccacatcattcagaacaccaagtgtgtttga

SEQ ID NO: 83803 - DNA, 231 bp, Glycine max
  Peptide Sequence Number=SeqID_200581
atgctaacaacccactatggatgcacatccatagtagactttaccagttcgataactattgctattataaacaagacatcatcggaaaggtttgaggatgcagtgatagcatctcagcaagcatctaagttagatccaagtagctttgaggtgaatgtagtggtaaggagggccagagcagtggcatcagccagaatgagtggtatcttactcttcaatgtaggagcatag

SEQ ID NO: 83804 - DNA, 396 bp, Glycine max
  Peptide Sequence Number=SeqID_200582
atgccgatctccccctatggaagtatcagttgggatcgcgcccacaagacacctagtggatccggaggagtccaacagggccatggggtttccagctttggttatgggcctctgttagtcctacagggtgcccgtcccccccagcaaggtcatgccatcggatcgcgcctgcaagacacccagtggacccggagaagtccaaacagggtcctggggtttccagctctgattacgagcctctgtcagttttacggagtgcctgtcatccccagcggagtcgccaactgtcgcaacctacccttcagcgggagggcgacgcgagaactacgtaggtctgatttcctcttcgatggaggatacgtaggagcaaaagccccgcttttgtcgacctcgtga

SEQ ID NO: 83805 - DNA, 504 bp, Glycine max
  Peptide Sequence Number=SeqID_200583
ggaacaaaagctggtaccgggccccccctcgaggtcgacggtatcgataagcttgatttttcgttaactttggagcttggactttattccatacccacattcatgcattgtcctttggcttttcagtgtatggttacacgtggtgttggactaggtgcattgcacgttagtgaccttcgtgactccccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 83806 - DNA, 270 bp, Glycine max
  Peptide Sequence Number=SeqID_200584
atgaggggtcaagacatttatagtagtcaagaggagactacttccttcccttcctttagtggaagtgaagatgaagtaaggggtgaagagtttagtgaggaagtctacccccccggaagaaggaagatcatttacaatggcctaactaatgagattaccctcacccatcttggcactaaatttgtgttgcatcctcaaataccttcacaggtggccaaagatcaactatctatgaaagataagagggatgaggaagaaaaagaaggatag

SEQ ID NO: 83807 - DNA, 411 bp, Glycine max
  Peptide Sequence Number=SeqID_200585
atgaccttgttcgaggaggaagtagaggataaagatagggataaatggattgtgtggttcgacggcgtgtccaatgcactaggccacaaagtagggacagttttggttacccccgacgatcaatgcatacccttcacaactaggttgggcttccactgcacgaatgacatggttgagtatgaggcgtacatcagaaaactgatagggtacttcgatgatatctcctttcatcacattcccagagaggagaatcaaatggtcaatgtgctcgccactctagcatccatgttccagctgaccccacatggagactttccgtacattgaattcagatgtcatggcaagcccacacattgctgcctgatagaagatgagcaagatggtaaaccttggtacttcgacatcaagtga

SEQ ID NO: 83808 - DNA, 451 bp, Glycine max
  Peptide Sequence Number=SeqID_200586
atgccacttgcactctgggcgctgaccatcagcgccttcgctatcggaaccaccgagtttgttatcgtcgggctgattccgaccatcgctgaacagctcagcattacgttaccttctgccgggatgctggtatccatctacgcgcttggcgtagccgtcggtgcgccagtgctcaccgccttaaccggcaagctgccgcgcaagcagttgctgatggggctgatggcgctgtttaccgtcggtaatctggtggcctggctggcacccaactatgaaacgctggtgatggcgcgtctgctgaccggactggcgcacggtgttttcttctccgtcggctcaaccattgcgaccagcctggtaagcaaagagaaggccgccagtgcgatagctatcatgtttggcggcttaaccgtggcgctggttaccggcgtaccgcttggcacactgattg

SEQ ID NO: 83809 - DNA, 783 bp, Glycine max
  Peptide Sequence Number=SeqID_200587
atgaaggcatcttcagaggagttaaaagtctttatcgctgtggtggaaagcggcagttttagccgtgcagcggagcagttacagatggccaattcggcggtgagccgcacggtgaagaagctggaaaacaagcttggcgtgtcgctgctgacgcgtaccacccgtcagctggcgctcacttatgaaggcgaactctatttccggcgcgtgcagaagctgatccttgagattgcgacagcagagaatgagctgattgagcgccagcaggcgccacagggcgtgctgcgcatcgacgcggcaacaccagtgatccttaacctgctgatgccgatgattaaaccctttcgcgagcgctatccggcggtcacgctatcgctaatctcctctgaaagctttatcaacctgatcgatcgtaaagtggatgtcgctattcgtgccggggatttaaccgattccacgctgcgtgcccggctgctgttcaccagctatcgtaaaatggtcgctacgccagcttatctggcgaaatatggtacgccggcgtctgtggaggcgctggcacagcatcattgcctcggctttgtcgagacgcctcgtctcaatcgctggcccgtgtcggctaatggcagcgatctgtatgaaattgacgcggcgatgtcatcaaacagcggagagacgatcaagcagctgtgccttaacgatcagggtatcgcctgcctgtcggactttatggtgaatgcggaaattgcggcgggcacttttgttgaggtgctggcgcaccagtcg

SEQ ID NO: 83810 - DNA, 404 bp, Glycine max
  Peptide Sequence Number=SeqID_200588
atggcttcctgtaagagaaaagctgcaactttagtgtctcaggccggttatgatagatcaagatttgtatcacaggaggcctgggaccattactcagataatatgcttgccaggaacattctgccagaaagaaatgtcaaaatgtatatcaatgagtttgatgatttcagaagagaattgattagaagaaactggcataaacagctgaccaacttgactgagggaagcattgatgtggcaattgtaaaggaattctatgcaaatctatatgtccctaaggacaagtctcccaagcaagttagggttcgacggcacctaataaaatttgatgttgattctctcaacacctttttggagactccagtggtcatggagcaaggggagagcttgccctcttactccag

SEQ ID NO: 83811 - DNA, 408 bp, Glycine max
  Peptide Sequence Number=SeqID_200589
aactacgtaggtctgagttcctcattggaggatacacaggagcaagagccttgcttttgtcggccgccccacaagctctgtcatactgaccctgagagacaaaatttggtcattctgcaccctttgtcatccagaggcagcgggcccgatgacacgcggagacaaaatttggtcattccgcacccctttgccattcagacacagtcgtgtccgatggcaagcagagacaaaatttggtcattctgcacccttgtgtcatccagaggcggcgggcccgatgatacgcggagataccttacggttatccgcacccttttgtcatccagaggcggcgggcccgatgacaagcagagacaaaatttggtcattctgcacccttgtgtcatccagaggcggctagcccgatga

SEQ ID NO: 83812 - DNA, 990 bp, Glycine max
  Peptide Sequence Number=SeqID_200590
atgaatatcttctcctatcaccaggcatctgatgctgggtcggcgatcgcgctcaaacaggccgggccggcggcgaaatatctgggcggcggcaccaatcttgtcgatctcatgcgcgagacggtcgaaagaccggaaacgctgatcgatgtcacgcggctatcgagcagcatcgaacagcgcaccgatggcagcctgctgatcggagcgggggtgaagaacacggcgctcgcggcccatggcgcggtgcggacccaattcccggttctctcccgggccatcctggcaggagcaagcgcgcagattcgaaacgtcgcgacggtcggaggcaatatcctccaacgcacccggtgtcggtatttctatgacaatgccgcccattgcaacaagcgtgaaccgagttcgggctgcgacgcgctggaaggtttcaaccgctaccacgcaatccttggggcatctcaaagctgcatcgcgacccatccttccgacatgtgcgttgcgctcgtcgcactggatgcaatggtgcaccttgaggggccatccggcacgcgcagcctgccgctgcgcgatcttcaccgtctgccgggcgacacaccccagatagaaacggcacttcatccggacgagctcatcacggccgtcgaaatcccagcgctgccttttgcaaaaagatccgcttaccgaaaggtcagggaccgtgcgagttacgccttcgctctcgtttccgtcgccgcggcgcttgatgtcgatagcgcaggtaacgtgaacgacgtgaggctggcgctcggcggcgtcgcgcacaagccgtggcgcgctctcactgctgaatcgcatcttaaaggtcagccggcaaacgcgaagactttccgcgctgcggcggaggccgaactcgcggacgctgtcggtctgcgagacaatgctttcaagatcgaactggcaaaacgcactattgtcgccgttctggaagaactgaagggagaaaacgcatga

SEQ ID NO: 83813 - DNA, 234 bp, Glycine max
  Peptide Sequence Number=SeqID_200591
atggcctcctacggtggtgagcttcctctagactcatcttctcctcgaagtggcttctcctctctctcttccttctctattctgcttcccattcatctttcaagaagcaaaggaatcccattgatgaagaagatcctaggcctacaagctccaatggagcttacatcatgtggtatcaagagcatcttcatcttggtgatgttcttttgcttcctctatctttttgttcggtga

SEQ ID NO: 83814 - DNA, 354 bp, Glycine max
  misc_feature (269)..(269): n is a, c, g, or t
  misc_feature (346)..(346): n is a, c, g, or t
  Peptide Sequence Number=SeqID_200592
atggaggttgcatctttgagcttcaatgaggtctttcagtggagaagaggtgagaggaggcgccatccattagagaataagccatggaagaagaagtttcaccaccaagagagcgccttggatacgaagcttagagaggaagcttcaatggaggaagagaatgagagggagagagagagaaagagagagaaagtggcatggaaaattgaaggaagaaagggagagaagttgaaccttgaagtgtgtctcataagtttctcattcatcanagttgccataagtgttacacatactgctatttatagcctaggtagcttccttgagaagcaagtgttacacccctccnatagctaa

SEQ ID NO: 83815 - DNA, 1241 bp, Glycine max
  Peptide Sequence Number=SeqID_200593
ttgccgtgcctcctctaccggaacaagaagctatcgccgaagcgctctcggatgcggacactctgatcgaatccttgtctttcctgctggcaaagaagcgcaagataaagcaaggtgcgatgcaagagttgcttaccggcaagacgcggctgcctgggtttcaggctccgtgggcacggactcagcttgggaagcttctttcagtgcggcatgggcgcaaccaacggttggttcaatatgacgatggcccatatccgatcttggctacgggaggccaaatcggttgggcaaaccgatttctgcatgacaagccctccgtactgattgggcgaaagggtacgatagacgagcctcagttcatggatacgcctttctggacggtggatacactcttctacactgacattcatccgccgaatgtcgcaaagttcttgttctacaggctttgtttggtgcattggatgcgtcacaacgaggcgtcaggcgtgcccagcttaagcgccaaggtcatcgagtcgatcgaaattgagcatcctgatgcggacgaacagcaggcgatcgctgatgtgctttcaactatggatgcggagatcgaaagtgcggaagctaggcttcagaaggctcgccggctgaagcaaggtatgatgcaagcgctgctgaccggtcgcattcgcctggctcagcctgcgtttgatgctgttccgcttctcaccgatctagctgtccactcaccctccattcactcccgaccccaactagacaatcaacaaggagcggctacatggggcgctgaaaacaccgacagctgcgaaagcttcgtggccggcgacaagatcgatcaggcgcagcgctacttcgaagaatgtatgatcgtcgtgcatccggaatggctgctcaagccgtcgcgcgagttgttcacggatagacgcgtcgcagccgctatcgccgagtgcaagacatttctcggcgggatcggacaaccagaacgcgccacgcaagaccgcgtaatcgcactatttcgcgacgagctgggctggcgctacgcgggtgactggtcggatcgcgacgcgaacgcgaacatcgaagagagtattctcacctcttggctcgcgaggcgaggctgcacgcccgctcagatcagtgcggtcctgctgcgcctacgcagcgaggctagcaacaatcatcgcacgctctacgcgaacaataaggccgtgtacggcctgctgcgctacggcgtacag

SEQ ID NO: 83816 - DNA, 207 bp, Glycine max
  Peptide Sequence Number=SeqID_200594
atgcctcgtattcatgacacgatcctgtattacaacgggaaatggaacatgccaccgcagaacaaatttgttggatgcgcgttcacaggaaaaaatcctaagaaatttcaaattccttcaacatgtaccatctatgaactgaagaatttaatcaagcaagttgcacctaaaaggattccccctcttggaattcacgaatcacaaacg

SEQ ID NO: 83817 - DNA, 135 bp, Glycine max
  Peptide Sequence Number=SeqID_200595
atgacccatgtgtcaggtggcaggcggaaatacccaagtggttatccgtacaaagacaacatctgttatcatgacctgcaaaaatacccaaatggttacccgtacaaagacaacatctgttatcatgacctgtga

SEQ ID NO: 83818 - DNA, 339 bp, Glycine max
  Peptide Sequence Number=SeqID_200596
atggcgacggaagccacttgcggccgtaaccgagccaatactttattcatgctattggacgatattgagatgaaaacgcatcgcgtaaacgagttgatcgagctgttgcacccggcctggcaggaagatcccgatctcaatttgatgcagtttttgcaaaagctggcacaggaagcgggcttccagggcgagttgtccgaactgagcgacgacattcttatttaccatctgaaaatgcgcggcagcgccggcacggatcagatcccgggcctgaagaaagattacgaagaagattttaaaacggcgctgttgcgcgctcgcggcgttatcaaggactga

SEQ ID NO: 83819 - DNA, 939 bp, Glycine max
  Peptide Sequence Number=SeqID_200597
atggacgcgctagaaggggttggcctgcgcgtcgattccggcctgacggcgctgaacagctatgagaaccgcgtctatcagtttatggacgaagatcgccggcgctacgtagtgaagttttaccgcccggagcgctggagcgccgcacaaatcggtgaggaacatcagttcgctctggatctggccagcgcggaaattcctgcggtggcgccgctggcgctgcaaggcgctacgctgcatacgcacggtggattcttctttaccctgtttcccagcgtgggcgggcgccaatatgagatagacaacctggatcagttggaatgggtgggtcgttttctgggccgtatccatcaggtcggcggcgagcgtttgttcgccgaacggccgacgatgggggttgaagaatatctcaccgccccgcgtcaggtgttggccgattgcgggctgttgccggcagcacagcgtgacgcgttcctgctggcaacggacaacctgattgcggcgatcaaggcgcactggcatctggactggcagccgcgccgtttgcacggtgattgccatccgggcaatattctgtggcgcgacggcccgctgttcgtcgatcttgatgacgcacgtaatggcccggcggtgcaggacttgtggatgctgctgcacggcgaacgccgcgatcaactgatgcagctggacgtcttgctggaggcgtacggtgaatttgccgagttcgatcagcgcgagttggcgttgatcgagccgctgcgggccatgcgcatggtgtattacctggcctgggtcgcccgccgttggcaggatccggccttccctaagagttttccgtggatggcggagtctgatttctggttgtctcagactgcggccttcaccgaacaggttaagctgttgcaggagccccctctgcagctgacgccaatgtattga

SEQ ID NO: 83820 - DNA, 237 bp, Glycine max
  Peptide Sequence Number=SeqID_200598
atgtccacagaagaacataagaagaaagtggctgaggaggcaaatttgaaggtgttgactttgtctactaaggaagtgcaaaggaaagcagttgaagaggctaccatatttgtttttgatgggctagaacaaaggaaagtgatgcaagccactacagaacctattagaccattaactctcttagaaaatattgatcaatgtctaaaaagaaaggatcaacaacaagctactgagtga

SEQ ID NO: 83821 - DNA, 735 bp, Glycine max
  Peptide Sequence Number=SeqID_200599
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatgatggcgacctactatccagagtatccacagatggatccgcttgtgaagtcgagtttatctgaacgaacattggagttgaccaaaaagactagtttgttcggcaatttaaacgagattgctcaggtcaccgaaagtctttacccacagaccatggaagaaatcgaccacccattaggctatctgctctatgagacagaagtggaaatggatgcggaagaagagcgcttgcgtatcatcgatgcgcgtgatcgagtacaggtttatgccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 83822 - DNA, 544 bp, Glycine max
  Peptide Sequence Number=SeqID_200600
atggccggcggcgccacggcggaggcgttcacctttggcgaccccgtgccggttctggaccgccgcgagctgctggactacgtggagtgcgtggtaaccgatcgctggtatgaaccgccggtgagctttgacgggctggcgcgcacgttccgcgccgccgtacatcacagctcaccgctcaacgtgaaacgcaacatcctgacgagcacgtttatcccgcacccgctgttaagcgggcaggcgttcagccggtttattcaggactatctggtgttcggtaatgcctacctggagaagcgcaccaaccgcctcggcggcgttctttcacttgagccgtcactggcaaaattcacccgccgtggcaccgatctggacacctactggttcgcccagtacggcctgaacacacagccttaccagttcgcacccggcagcgtctttcacctgatggagccggacctgaatcaggaaatctacggcctgccggaatacctgtccgccattccgtccacgctgctgaacgagtcggcgacgctgtttcgcc

SEQ ID NO: 83823 - DNA, 342 bp, Glycine max
  Peptide Sequence Number=SeqID_200601
atggggagcctcaaggcgcctaagcctgatgggtatcgggcaattttcttccagaaagtgattagagatgacttccagtctcctcagaaaatagaagatgttaatcaaacctttatctcttttatccccaaaaagggagttgatatctatgatggtggatcaaggagtttggaaactatctggttgagtagacatggccccttattcccccacttggcgtttatggatgtccttattttatttgttgaggcttcagtagagttccagtcagaaaatcagtttggagaagtcaaggatgttcttctcaacccatgtagtgatcaatatgaggcacaagcttag

SEQ ID NO: 83824 - DNA, 658 bp, Glycine max
  Peptide Sequence Number=SeqID_200602
atgacccctactctcttagatgtagccgccctcacaggccttaggcctagcggagaaacttatgaccccactacttctagcgacaatatcaagctagtatataaggagaataccttttccaaatatatagctgaacacaaaggacccgtcgaagaggaggtttctgatgaagagcacgtagccttcttaaccctgtcagaactttggatttggacgcctcttgtagcagtactatacgaatcgcttggtgaggcatgcgatgatctgaagaagtcgaaggatgggtcttccttcttagtatctgggcctatgtggcttctccagttgtggcttaatgccaccttcgagcaagaaatgggattaataatcccacaagattatgctgaagaagttgcaaatcgctcgatcgaaggccagagagcacttcgattaacccccaagcccttaattcaaaactcacaaaagctgttcctaaagtacatgaggatttttctgagctttgacaagtttcttccccaacatgctccattcattagtcgagaggttggcccggcctggttcactgactattttcctgctgtcgatccggacaatgaagaagaagtgaacgaaatatggtcattttacttgaatccacagatcctgtcttgtcgtacag

SEQ ID NO: 83825 - DNA, 153 bp, Glycine max
  Peptide Sequence Number=SeqID_200603
atgtcagctagcaggaagctgaacacaggagaaaaaactgtgctttcgtggatgattgaaactggaaccatactacaacatgagaaggtattgtgctctctcttgactcggtgcacatgcaaggaggattatgaagatggagatgaattgtga

SEQ ID NO: 83826 - DNA, 1035 bp, Glycine max
  Peptide Sequence Number=SeqID_200604
atgggtgtcaattttgtggctaattgcagtgctatagtaatttactttttcctgtctcattcttccctttccttcctttacagtagagttgtggatgcacagtcgcctatggcagtagttatccctaccaaaggatctgaatttagcatgaaactgcgtaacggtgacctctcttggcatgattttttggagaaaatcaatagtctcaagacgagccctggtgcagcggtaaagttgtgccttggtgacttgttggtcatggattcgaatccggaaacagtgaagagcctctgggcaatgggaggcaaggaattcatagctacagaacaaccaataggaacatttacaaacattctcttttcttctggaacaacaggcaattccatggaccaatattactctctaaaagctgctgcagatgcatggtgccacatggacgttcgtaaaggtgatgtagtgtgctggcccactaatcttggacggatgatggggccatggctagtatacgcatccttgctaaatggagcttcaatggctctgtacattggatcccctcttgggtctggctttgccaagtttgtacagccacaaaatgttccaggaataggtgagttggctcttggtccgctcatgcttggggcttcaaatacactgcttaatgctgaccattacggtgtctatttcaaaggaatgcctctcttgaatggaaaggtgagttcgattgagattgaacgcatatgcaacggagtagatagcaatattctggaaacagctgcaataggggtaccaccttctggtggtgggcctgagttgttgactatagctgttgtattcaaggattcaaatagcacaaagcaagatttacaccaattgaggatgtcttttaattcagctctccaaaagaaactaaatccactgttcagggtttctcaagtagtcacactgccatctcttccaaggacagcatccaacaaggttatgagaagggttttgcggcagcaacttagcgaaactaaccaaaattctaaaatataa

SEQ ID NO: 83827 - DNA, 606 bp, Glycine max
  Peptide Sequence Number=SeqID_200605
atggcttattacaaaccactgagttctatcactatgtcggatattgaattccatggaattggaagagaagacgttgccactctccaccaacgtcttgcacaaatcattgaaattcatggtgatggcaccctgccacatggcagcacggaaagtgctgctttgaccaatgtttggcagttgctagagaggaagggtgaagagtttctgggttcggcatataaggatccaattacaagctttgatgatttccaaaaattttcagtctcaaaccctgagatatattggaaatgtgtgttggatgaaatgagcatatcattttccaaaccacctgaatgcatcttacatgatcgccccccaggggaaggcccattatcacatccaagtggtaaatggcttcctagagcatttattaatccagcacataattgcttaaatgtaaatagtgaaagatgtttgaatgatatagtgataatatggcatgaagaacaacatgatgatctccctctaaagaggatgatacttgaggaattgcgtgaaaatgtttggtatgctgcaaatagccttttgttattagctttgactttgatgttcttttacttgctgtaa

SEQ ID NO: 83828 - DNA, 2163 bp, Glycine max
  Peptide Sequence Number=SeqID_200606
atgagtgagagagattcacaaacacctggtgtggatagctttcttttcttgcatccaagcgaaaatccaacggtatcacttgtttcaccagttcttgattctttgaactatcattcatggagtagatcaatgatgattgctctgagtgcaaagaataagcttgaattcattgatggaggtgcgccagaaccactaaaggctgatcgaacttatggagcatggaggcgctgcaacaacatgagtgatcttcttaggatctctgatctccagcaagaggcatcttcaattaggcaaggattgaatgaacaatatgggaatgtgcgatcacatgtcctcctcatggatccactacctgaaatatcaaggatattttcctatgttgcacaacaggaaaggcaaattggaagcaatttgatagctgctaataacatagacatgaaaggtagtttaattaatgcaatgaaattggcctgtaattactgtgggaagactggacatactgagaatgtttgctataagaaacatggagttccttcaaataacagtgaaaggaacaagtccagcagccataggaatgggaaagtatgtacttgttatggaaaaatgggtcacactattgatgtatgctacaaaaagcatggattcccaccaggttacaggttttctaacccaaggagcagtgctaacagcttggtggcaggagatgatgcagtcaccaatgatcaaacacagcttttagagtctaaggagattcatttttcacccgagcaatacaaagcattgcttgctttaatccaacaaccaactgatgggaactcagctaacatgtcatccaatcttaaacaggtagcctcctgttccgttgacacaacaccagctcatgatagaagacctcttacataccttcacgactatcatgcatttctcacttcaactgctaataccaattcagcttcagtgagccatcctctcgattattcagctttagtgtgtcatcctctcgattctgtactatcttattcgcgtctatcatcatcccacagacattttgttctttccatttctacatctactgagcctaagacatatgctaaagcatctcaacatggttgttggcttaaagcgatgaaagccgagttacaagctttacaaacgaataacacttggacccttacagacttaccagctaataagaaagctattgggtgtcgttgggtttataagattaagtatcatgctgatggctccgttgaacgatataaggctcgacttgtagccaaggggtatactcaaatggaaggattggatttccttgatactttttctccagttgcgaagctcacaacagtcggattattgttagcattggctgctattcatggttggcaccttcgtcagctcgatgttaacaatgcattccttcgtggagaattaaatgaagaagtctatatgcagctgcctccaagaatgcaagtctcacaccctaatcaagtttgtcaattacaacgatcactttatggtttgaaacaggctagtcgacagtggtttcatcgtttgtcctcatttcttcttactcatggtttcactcaagcttcagctgatcattccctctttctctgtttcaatgaaaactcatttactgcacttttggtgtatgttgatgatatagttctaacagggaatgatataatggctatcaatcgtattaccatatttctggaccaaaccttcaagattaaagatcttggcactttaaaatttttccttggcattcaggttgctcgttcccatcaaggcatccatctatgtcaaaggaaatatgttctagatattctctctgattctagaatgcttgcttgtcgtccagtttcaacacctatggattgtactagtcatcatcaagcaggcataggagatcctttatctgctgaagactcctcttcatatcatcgacttgttggtaggctcatctatcttactaacactagaccagatatttcttacgttgtgcagcaattaagccaattcatggctaacccaactaccgatcactcaaaagccgcctctcgggttcttcgcaatctcaagagttcaccgggatgtggcattttctttcctacaactggttcaactcgtcttcaagcttttagtgattcagactag

SEQ ID NO: 83829 - DNA, 429 bp, Glycine max
  Peptide Sequence Number=SeqID_200607
atgacaaagtcatttgttgggcatccgtatgcaggtcgaatgactaaagatgagaagattgttgttgctgatatgacaaagtccatggtgaagacaaaaattattattttgacattgaaggaacacaatgccaatagttatacaacaattaaacaaatttacaatgtcagacatgcttattgttctttcataagagggagtaacaccgaaatgcaacaactgatgatgctgcttgaccgagatcaatatattcactggcataggatgaaggatgtaaatgttgtatgtgacttgttctggagtaatcctgatgcaggaatgacattctttgctgcttttgcttatttggaaggagaacgtcttaataatgttgtttgggccctacggcggtttcggggtcttttcatgaaagttgatgcactccctaag

SEQ ID NO: 83830 - DNA, 687 bp, Glycine max
  Peptide Sequence Number=SeqID_200608
atggatcggaggagaaacaagagtctgatctacgcccggcagtggagcggcggttccaacagcaccggttcctcgtcgccgacgatgttgccggctcatcctcaatcgcgcctcggtacaattttcgtcatcggtctctccaccgtcaagcgcacgcaaaacgtgacagccaaagccgccgcactgcgacttgctcacgtgatggcgtctcagaataccaccgccaacgacggagaggacgcggcggtttcagttcaatatcagctggaagaccagcgatttcagttcgcttgcttgcagataaaaaggagattaaaagaaaggaatgccatttcagatgatacagagctctttggtgcttcttgttatgctgcaaaggtcaccttaactgccttagaggatatgtttcaaggtgcacgaggtatcatgagctggcttggtgactgtgcaaaagaccaaaaactggactggtgcaagatgtttgctcttggaattgaacctcaatatgttaggaacccaaatctatggccaaagaatccagaaaaattcagatttggggaagttttaaaagtgattatagttactgatgcagcaaaaggggcagcttatattgagttcatgcgaaaagaagcagcagataatgcattatatctggataacacttcattcatgtcaacaattctcaag

SEQ ID NO: 83831 - DNA, 153 bp, Glycine max
  Peptide Sequence Number=SeqID_200609
atgaggttagtgggtgactcaaagagtcagagaggaagtggagagagtggagtgagaaatgaagggaatttcaaagaggaatggaaggactttcattgtgagagcagaaagaaaggcattggtgagagtacaaaacaattgagcttcctttga

SEQ ID NO: 83832 - DNA, 973 bp, Glycine max
  Peptide Sequence Number=SeqID_200610
atgtcgcagaacttcacggattgcctaacgatgggtgttaagtacctcgaagcggtcaagcgagggtcgcatgctatcaaacaatggtccccagatgaaattgggaacgtcattcggccggtcaatatccctaccagcggaacctcggccattgcactcgatcatccctggatgacaaaagaaattgactgtgcggagaaattacttgtgtatctccgcacgccacctgacttcagggtcaagaaattacttgtgtatctccgcacgaaacctgacctcagggtcagtgtgacagaaattgactgtgcggagaaatttcttgtgtgtctctacacgccacctgacttcagggtcagtttgacagaaattgactgtgcggaaaaattgcttgtgtatctccgcacgtcacctgactttagggtcagtttgacagaaattgactgtgcggaaaaattacttgtgtatctctgcgcgtcatctgacttcagggtcagcttgacagaaattggctgtgcggagaaattactcgtgtatctctgcacgccacctgacttcaggttcagtgtgacagaaattgactgtgcggagaaattactcgtgtatctccgcacgtcacctgacttcagggtcagtgtgacagaaattgactgtgcggagaaattacttgtgtatctccgcacgtcacctgacttcagggtcagtgtgacagaaattgactgtgcggagaaattacttgtgtatcttcgcacgtcatcagacttcagggtcagtttgacagaaattgactgtgcggaaaaattacttgtgtatctccgcacgtcagctgacttcagggtcagtttgacagaaattgactgtgcggagaaattacttgtgtatctccgcacgtcacctgacttcatggacagtgtgatagaaattgactgcgcggagaaattatttgggtatcttcgcacgtcacctgacttcacgg

SEQ ID NO: 83833 - DNA, 162 bp, Glycine max
  Peptide Sequence Number=SeqID_200611
atggaatcccaagcctatgttaagcttcataatatgctccaatattggagtacgagatgccgtatcggcctagcaggagtcgtcaaatgtgaaggtccaaatgacaaaggttttgctgacattggtgtgagaaaaggggaagagaaatggagggttttctaa

SEQ ID NO: 83834 - DNA, 729 bp, Glycine max
  Peptide Sequence Number=SeqID_200612
atggttttctcttcacttcgcgggtactttagtatgaggcaacaaagctccaaggttcaggctttgtatgaccattgcaaaaccatcttatcaccctctggctctggaacagcccctccttcgtcccaagctctgatgaagctttcttcgattctggacactattcaaccggctgatgttggccttaaggaagaaactgcagatgatgatcgagggcttggattttttggtgctaatgcacttagtagagtaactcgttgggctcaaccaataacatatgtggacattcatgaatgtgacagttttacgactgcctctgcactgcactgcactgctgcagggtttcatgtctatgtcagtatgtgtatattttgtttccctacttcttcagttattcctctccatgatcatcctgggatgactgtatttagcaaacttctctatggctctttgcatgtgaaaggttatgactgggttgagcctccctgcatcatagaaagcaaaggacctggatatggtcaagtacgactagcaaagttagcagttgataaggtcttgaatgcactgtgtgatacatcagttttatatcccaaacacggaaatctgcactgttttgcagcagtgacaccttgtgccatgctagacattctcacacctccttacagagaagaggaaggaaggagttgtacttattatcatgattatccttattcagcattctgtaagtaa

SEQ ID NO: 83835 - DNA, 204 bp, Glycine max
  Peptide Sequence Number=SeqID_200613
atggaataccggatatccgatgaatacgaaaatggggtaataaagtttaacccgacggatatcggggataaatatgatatatggctgtatgaagctggaaataagatggtctttgctagtagtaatacggatttcaaagtggttcaagcacaaagagtgctggaaacacattattttcagaaaggtcaccggatgcttccataa

SEQ ID NO: 83836 - DNA, 540 bp, Glycine max
  Peptide Sequence Number=SeqID_200614
atgatgaccctgaacagcagcgtgaagctctcctccaaacagccggacgtcggcaccaccatttttagcgtgatcggccagctgtccgcacagcaccaggccgttaatctctctcagggcgcacccaatttcccgtgtgacccgcagctggttgagctggtcagccaggcgatgcgcgacggccataatcagtacgccgccatgaccggtttaccggcgctgcgcgaagcgctggcggagaaagtgcaccgcctgtatggccagcagtacgatgccgccagcgaagtcctgatcaccggcagtgccagtcagggcatctacatggcgatttcggcgctggtgcacccgggagatgaagtgatcttctttgagccggcctttgacagctacgcgccggtggtgcggttacagggcgcgacgccgatcggcctcaagctgcaggtgccggattttgcgattgactgggacgaactgcgtgccgcgatcacgccgcgtacgcgcatgatcatcatcaatacgccacataacccgagcggacag

SEQ ID NO: 83837 - DNA, 303 bp, Glycine max
  Peptide Sequence Number=SeqID_200615
atgaacagcgctaggcaatcaactcatgggtctccgaacaaaaggggagaatggagaattgcactaggcaatcacttcgcgtggctccatactcattggtggaggatgcatgaacgacaatcaattcatggggctccgaataaaagtggagaatggataattgcactaggcaatcactacgtgtggctccagactcattggtggaggatgcatgaacaacaatcaattcatagggctccaaataaaagtagagaatggagaattgcactagtcaatcactacgcgtggctccagactcattga

SEQ ID NO: 83838 - DNA, 435 bp, Glycine max
  Peptide Sequence Number=SeqID_200616
atgaacggagtcgtggaagcagccaacaagaatattaagaaaattattcagaagatgacagtgtcgtacaaagattggcatgagatgttgccttttgccctgcatggataccgaacttcggtacaaacttctactggggcaacaccgtactccttgatttatggaatggaagcggtactcccatttgaggtagagatcccttcccagaggatactagcagaattaggtttagaagaatcagagtgggctcaaacacactacaaccaactcaaccttattgaaggtaagcgcttgacggccatgagccatgggtgcctgtatcaacaaagaatgaagaatgcatttgacaagaaggtgtgcttgcgcaagttccatgagggggaccttgtgctgaaaaagatgtcccacgctgttaaagataatcgagggaagtag

SEQ ID NO: 83839 - DNA, 285 bp, Glycine max
  Peptide Sequence Number=SeqID_200617
atggaatcaaccagatcttcacttacatatgatgttttctttcacaaggtagcgcatctagatagcatagctgaaagcggccttcaaaagcctagcaacggaattgccgatacctatctctatctcttcctatcggcaggagtcttacccgcggatactcttattcgagagatggaattgggaatctgtttcgagacttcgtcattgagagctactaactgccattattccgaggcttatggagacccggttccccgtaaagcattgttccctgggcaagactaa

SEQ ID NO: 83840 - DNA, 380 bp, Glycine max
  Peptide Sequence Number=SeqID_200618
accacgatgaagaggaaggttccagagacggtgaggagagggaggcagtggtcgtgttggagggaggagagtttgcggaaggtggaggggacaagaggagtggagttgaggaggagagtgtcgtgggaggggaaggtgcaggcggagaggatgtcgaggagggtggattttctggcgccgctggggcccaccgcgaccaggatttgaaaggggagggcgaagagagaagtaaattagggtttggtggtggatttggtgggtcttccatggagggttggagtgagagtgaagagctatggacggaggttagaaggacggagggtttgggacttttggttttccctaagaagcgcaatggacggaggaaggccaaaaattaa

SEQ ID NO: 83841 - DNA, 465 bp, Glycine max
  Peptide Sequence Number=SeqID_200619
atgaggatgttgcggtggatgtgtggtaagactcgacaggataaaattagaaacggagctattagagagagggttggagtagcgcctattgtagagaagatggtggaaaatagacttaggtggtttgggcatgtagagagaagaccggtagactctgtagtgaggagagtagaccagatggagagaaggcaaacaattcgaggcagaggaagacccaaaaagactataagagaggttatcaagaaggatctcgaacttaatgatttggatagaatggctaatccttctatcatattcatggatgagccaacttctgggctagatgcaagagttgctgctgttgttatgagggctatcgggaaaatagtggacactggaagaacagttgtctgcaccatccatcagccaagcattgatatatttgaatcttttgatgaggtaaatatgcagagtaaaaaattgtga

SEQ ID NO: 83842 - DNA, 640 bp, Glycine max
  Peptide Sequence Number=SeqID_200620
gacgccttccagcacaagtacgcggtgctggcgatcaactgcttcaacctcgaaaccgcccgcgcggcgattcaggcggcggaacagcagcgcgcgccactgatcctcaatgtgtatcagggtcacagcgcgcattttccgccagcggtggcggcgccgctggtacaggcgctggccgctcaggccgcggtgccggtggcgctggcgctcgaccacggcaaagcttttccgctgattggtcaggcgtttcgcgccggctttaccgggctgatgattgacgcatcggccgaaccgctggcggacaatattcgtcagaccgcagcggtagtaaagatggcgcataccgctggcgtgtgcgttgaaggcgagctggggcatatcgccgatgcgcccacatatgaactggccgatgccgccgtgaagatgacgcgggtagaagacgtgctgccgtttattgagcagaccggcatcgatctgctggcgatttcggtcggtaccgcgcacggactttatgcgccgggcgtaaagccgaagatcgacttcgagcgactgcagcagctggacgcggtgacgacgcggccgctggcactgcacggcggctcgggcaccccggcggaggatatacgccgcgtcagcgcct

SEQ ID NO: 83843 - DNA, 555 bp, Glycine max
  Peptide Sequence Number=SeqID_200621
atgggtgcggggacagtggatccccttcgatgcagatgcccttatccagttcttgggccacccgctgatcttggagaaaggaacggggcctacgaggcaccctatggacccagaaaagtccaacagggcattaggatttacagcaccgatcacgggcctctgccaattttacggagtgccagtcgcccccagcaaggctggtgtagggtgaggcaccacagcagcctggggatgaacagcagtagggcgcagatgccccaccgccacctccgaagtctacctctgatcacctgcggagattggagcggtatatacgacatgtggctgaccagtaggcagccaaccacaaggatcaggtgcggctgcatgagactttctaccagtacgcgcaccgccgacttggctaggattccagcccatacatgtggcctactatggagcattttgagactgcaatatcatggctgggggattggcccgaggatcagacaggacctgccggtactcctagaggtgaggacgaggctgaggacaatcagaacatggcagacctga

SEQ ID NO: 83844 - DNA, 696 bp, Glycine max
  Peptide Sequence Number=SeqID_200622
atgaatgggtcagatatattatggcgaatgcgtcagattccattgtgtcttccacaatggaatctgataagtgagatatggaatctgataagtgagattccgggtaattgtttacataatcttcttctgtccgaagaaattattcatcgaaataatgagttactattaatatcgacacatctgagatcgctaaatgttcaggagttcttctattcaatccttttccttctccttgttgctggatatctcgttcgtacacatcttctctttgtttctcgagtctatagtgagttacagacagagttcgaaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaagtaaaacaatctattccttgataagaaaaataaaaaacgtgaatggtgattggattgatgataaaatagaatcctgggtcttgaacagtaattcgattgatgataacggaaagagaattcttggttcagttttctaccttaacgacagaaaaaaggattga

SEQ ID NO: 83845 - DNA, 194 bp, Glycine max
  Peptide Sequence Number=SeqID_200623
gaagagaaaaacttgatctcatcaaagagagattaagggctgttgaagggtttggtgattaccccttcgcggatatggtggatttatgcttggtacccgatgttgtcatccctccaaaattcatggtgtcataccctaatttcgtccggggacctttgcttgatgacatgcgacctttctttggtgcttgtgag

SEQ ID NO: 83846 - DNA, 306 bp, Glycine max
  Peptide Sequence Number=SeqID_200624
atgtcattacgtcggctcggcggctcctcaccagaatcttactccctacactctgccactatcattctgttcccacgaacaaggttcgtgatcatcacagctagtgccaaagaccctggaaggtcagtgcacagtgccccccacgatcatacacaacatccaacgtatgaacgtggccaaaagctagtgccaaagaccctgaaaggtcagtgcacagtgccccccacgaacatacacaacatgcacatgctaatgcatttccaacatcaatcaacaaatcgtatttccatgtcattcacaacataa

SEQ ID NO: 83847 - DNA, 108 bp, Glycine max
  Peptide Sequence Number=SeqID_200625
atgtttgcttacagtcctctcgctaagcgcaagcctcgagctaagcgcatctttgctcatgcgctaagcggagagtctctagcgctcaacccttgcatctcaggctga

SEQ ID NO: 83848 - DNA, 156 bp, Glycine max
  Peptide Sequence Number=SeqID_200626
atggcaggggttgtaagggaaggccctaagcctacgttgcattttgaaacaatggggcatgccacattgcccccattctcttgctatccatgcctaaaatgcgcccaacaagtgttctgtgaaatgcctcaatggcatttgcgcatgattttgtga

SEQ ID NO: 83849 - DNA, 210 bp, Glycine max
  Peptide Sequence Number=SeqID_200627
atgtcttttgctaaagcaggaatcgaaactcagtctccagaaaaatcaggggaaaaacacattctggttgccactgcattagagtttgaacagccttatccttgtgtcagcccggtttgtaacctcagttctaaaggcattaatatggtgttaacaaatcatgtcaataattatttattcagtaagaatgctaatccaatccaaccataa

SEQ ID NO: 83850 - DNA, 1746 bp, Glycine max
  Peptide Sequence Number=SeqID_200628
atgccgaagcacagtgacttgcaaatccacatcaatgatgaggaagtattccttttggacaagaagttcatatcaaaatactgtggaagaataaagaaaatcttgagccatgaaaagagaatgtgcattgaaatcaatgatttccctggagggccacaagggtttgagctggtttcaagattctgctacaacaacggcaaaatccctatcaatgtgtccaatgtgcttatcctccattgctgtggcctttatcttggaatgactgaggaggtcttcaccaacaatctcttgcaacaaatagaaacatttcttgaaggaatccactactggacatggaatgaaatacttgtaagtctcaagaattgtgagttattttacgcacatgctgatagctatggtctattagagaagattattggtgcactcttggcaaaaatggatcaaaatcctgaggcgaacctcttcacctcctcatcttcatcatccccatcatctcctgaaagcaattctgccaagagattttcttactcaacacaagctactcccaagactgtaaagtcaactttgcctaaaaaagcatggtggtttgaggatttggctactttacccccaaagatcattgagaagattctccaaagtattggagcttacaagacagataacaaaaactcaactctcacaatatttctgcttcattatctgaaaattgtgactccaacaagagaggttaattgcaacaacagtgttgagtatgctggtctagcagaaacagctgtttatggggtcatatttgttggcaacaagagtttttcttgtagaggccttttttgggtattaaggattgtgtcaagatttggtatgagtagagattacagaattgaaattgagaaattgattgggggggtgcttgagcaggcaactttggatgatctattagtctctgggcatcatatgggactatattatgatgtaacatttgtgataagactgattaaacaatttgttgatataaatggctctgatggggtgtccgtacaaaagttgaaaaaagttggtagattagttgacaagtatttgattgagatatcccctgatcagaacctcaaggtcactaaatttcttgcagttgctgaatgtttgcctgattgtgctagggatcgctttgacggggtgtacagagccattgacatctatcttcaggtgtgtcccatccaagctagtactatacaggaaaatctcttgaccttagcagaaaaagaaattacatccaaaacattgctaaagtccttgatagaattttacatagcaaggttttgttacatttccatactgccaagtttttacttccacaatcgtataaaattctctcattttagaacaaattatgaattgcagtcgcatccaatgctggcatttgaggagaggtcaagattgtgtagatgtcttaattacaataaactaagctttgaggtgtgtaaggatcttgcaaagaaccccagaatacctccaatgatagcaatgcaggctcttatttctcaacaaaccaagattccatcaagtgacttaatcattgaggaaagtgaaatcataaacccttcccaaatcattttgcactatgacaagacagatagcttcttggaagagaaagaagatatgcgacaaaaccttgagagaatggaatggagagtgaaggaattggagatattgtgcaaggaaatgaaggttcagatgtcaaggtttcactag

SEQ ID NO: 83851 - DNA, 345 bp, Glycine max
  Peptide Sequence Number=SeqID_200629
atggtagtggtggggtggaatagtgacaatgacaacgaccatgacgatgaaggcgacaaaatggtgatggcaataacagtggcagcaacgctgacgatgataataacgataatagtggtggtggcggcgatgacaatggtggcaaagacaaggtgtgatggtggtgacggtgacaatggttgtgttaatggaatgattgataatggtggtagtgatggtgacgacaaaggagagacgatagaactgggagaggagggcaacgttgatggtgttggagacgatactgggcaaggaactcacgagacacttcaccttccaaattggtgtgaggaagatgaaaactga

SEQ ID NO: 83852 - DNA, 276 bp, Glycine max
  Peptide Sequence Number=SeqID_200630
atggcgagggcaaggtgcaagacaagtcctgaagcctcaacaaacgaaacccaaatcagtgtctacgtggagagagaaaaggagatagaaggaaacttaattgaggaaatgtgtgcagacactgttgaagttgttgtggctgcagtggtggcagtgccactacaaaaccaggttggcatttgctatgttacaacagattctgacttgctctctctaggaagcagagagagagatgagtttgagctccaaccaacaaggaagcagagaaaggcatga

SEQ ID NO: 83853 - DNA, 354 bp, Glycine max
  Peptide Sequence Number=SeqID_200631
atggctgcagggtcaaacactggttttcactgtgatgatatgagttctgctttgaactggcattgggtatcttttcagtctggtgctgttagtagcctacctgagatggttccaatggggaattattttgggttgaatagtaacacctctgggatgatgatgtattctgggaattcaagcatcattaacaatgtctatgaacctgtcacaagtctacctagcaatgcatttggttcttctctgcttcttgattcagtccctggactgaggcatgaagaaaggttggctgctgagtggtctgttgatgaacagtgcaaattggaggagggccttgccaaaagctctctcatatag

SEQ ID NO: 83854 - DNA, 174 bp, Glycine max
  Peptide Sequence Number=SeqID_200632
atgacgaagaacggcatccaccactactgggagagcgatgatcaacatggacctagcacaggaacgctatccttcaaccaaaggagggagaaaatggtggtggcacttaacgtgccacataggagactactaacggcagggactaaacgtggcaaacgggaaggatcattttga

SEQ ID NO: 83855 - DNA, 246 bp, Glycine max
  Peptide Sequence Number=SeqID_200633
atggtggttccaaagtcagaagagatgcaaagacaagctgaaactaaaaagaaacagcatagaaccatgggttcctctcggtgtggggtctcaacggagaacaacggcattttgtggtggctaatggtggctgtgggtgatggagacagtgcttgggacgttagaaatggctttggaagaaagaaaggagaagaaatggcatttttcctaagctacacgaaagcaaaggctgaaacgctcaaatga

SEQ ID NO: 83856 - DNA, 493 bp, Glycine max
  Peptide Sequence Number=SeqID_200634
aggactacacgttctcaccttcaaaggactgcacgtcctcactttcagtgggctacacgccctcgccttcaaaggtagtttccttttatcagtttctgggccaccccctgatattggagggcgaccaactgtgcaagcacaaccagagagggaggctatcacgcaactactatacataccagggcatgatttcacccgtgctgctacaaagaaacgagtgcggatcatgcgcaccaacatgaccactattacacagatatgtatgacattgctacttagcaacattctgcccaacgatcgtaatgtcgatctccccctgcggaagtatcagggtcccgcccacaagacacccagtggacccagagaagtccaacagggccctggggtttccagctctggttacgggcctctgtcagtcctacagggtgcccgttccccccagcaagggatcgtgccggcaagacacccagtggacccggagaagtccaacagg

SEQ ID NO: 83857 - DNA, 523 bp, Glycine max
  Peptide Sequence Number=SeqID_200635
atgggtggcccaagcccggggctgtttgatatgctcgtggagacgtcatcatcgcgattgtggatggcagcgcgcgcccttggcgtgcctcggcacctgcgcgctcctgggcgtcgggcttgtgggctccccattcggcccgtcttgaaaacacggaccaaggagtctgacatgtgtgcgagtcaacgggcgagtaaacccgtaaggcgcaaggaagctgattggtgggatccccctgtggcggggcgaagccagaggaaactctggtggaggcccgcagcgatactgacgatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaagga

SEQ ID NO: 83858 - DNA, 294 bp, Glycine max
  Peptide Sequence Number=SeqID_200636
atggggatattaattgttctgcttattttacttatcattcatatacacgggaatggtcatcacaaagaggcaagaggaaatattaatccaaagaggggctgtgatttgtttcaagaatgtccctttattctcaaggaatttgattgccaaaagaatggtcgtcctgataaactctatgtcaagtacagatggcaacctaaagactgcaacttaccaagctgcatcctagacttagagacagagactgccaaactgggtcggggagcagtgcccgttgagatacatgcttgttga

SEQ ID NO: 83859 - DNA, 713 bp, Glycine max
  Peptide Sequence Number=SeqID_200637
atgggttccgaagaagtagtagaagaaccaactccaaaaactccaaaccaaacaacaacaccggaaacgacgtcgtcgagttccccccgaaaaattaaaaccaacactcccaccgaaaacggtcacgtgtccgttactcccaccacgctctcaatcgtgcagccacattcacttctcccaaagccagtgcctccaagaacgacttacactcaaaacgacgtcgtcgtttcctccaccacattcggaaaattcctccgcaagcgcagcaacgacctgtcgtccgcgatcagcaaggggatctccacgctgaagcactccatcaacgaccaaaacgacaacaacggcgtgacggagttcaacctgtcggggctaaaggtcttcgtgacggtgaaaaacaaaaacgacgcgtcgtctaattcgcttgcgcgaatgaaaatcagcttcttctcgcgctcgaactgcagagagtgttgtgcggtgagaaggttcttcagagagagagcgctgaggttcgttgagataaacgtcgacgttttcgcggagcgggagaaggagctgagagagagaacggggagcgcgacggtgccgaagatcttcttcggcgagaggctgatcggaggcttggtggagctgaacgcgctgaggaaggacggcggcgaggagttggagaggcggctgaaggaagcgggtggccaagggccggcggcgccggc

SEQ ID NO: 83860 - DNA, 600 bp, Glycine max
  Peptide Sequence Number=SeqID_200638
atggcacaggttgttgttaagcgacatgaacctaagacacagtcatttacccttttgagtggtcataccatacctgctgttggattgggcacatggaaggctggttcacaagccgtcaattctgtgttcactgccattgttgaggccggttatagacacatagacactgcttcgcagtatggagttcaagagggagttggacaagcactccaagctgccatgcaagcaagagtggaaaggaaggatctatttgtcacctccaaactatggtgcacagacttgatccctgaaagggttagacctgctatcaacaatacccttcaagaactccaacttgattaccttgatctttacttgattcattggccatttagattgaaagatggtgccagcagaccccccaaagaaggagaagtattagagtttgacatggaaggggtgtggagagaaatggagaagcttgtcaaggaaaaccttgtcagagacattggaatatgcaatttcactcttacaaagctcgaaaagctgatgagcattgctcaaataatgccttctgtctgccaggtgaaatttatatatctaaaaatatttttggcttaa

SEQ ID NO: 83861 - DNA, 582 bp, Glycine max
  Peptide Sequence Number=SeqID_200639
atgacccaagatcttcagcgggtgaatctcttggaactatcagaaaatgagacgcttgctttcttcataaatttgtacaatgccatgatcgtccatgctatcattagagtagggtgtcaagaagggcatccttattctcttggtgcaattaaaaatggtatcctcagaagcaatcgtaggtcaccatattccttaatcaagccctttggcacaggagataggcgcttagagcatgctcttgtcaaaatgaatccgttagttcactttggactttgtaatggcacaaaatcgagcccaaaggtgaggtttttctcaccctatagagttgctgaagaattgagaagtgctgctagagagttttttgagaatgatggaattgaagtggacttggagaagaggaccattcatctcactccgattttcaagtggtactctgcggatttcggacaagagagaaacatactgaagtggataataaatttcttggatgcaaataaagcaggtcttttgacacatctcttaggtgatggtggtcatgttaatatctcttacatgagttatgactggtcaataaattcctga

SEQ ID NO: 83862 - DNA, 1305 bp, Glycine max
  Peptide Sequence Number=SeqID_200640
atgggaggctgttgcagccacgatgtttcggttcgagggaaggtggagagcgagatggatgatagagaatatgagtatgattatgaaaatgatgtgtcttatcaacaaggtggagcattggtcaggttaagaggttcctctaggtttgcatcaatgtactcccaacaaggccagaaaggtgtgaaccaagatgcaatgacagtttgggaggactatactggagaaaaagatgtgatcttttgtggtgtgttcgatggtcatggtcctctaggccacaaggtttcacaatttattcgagacaatctaccctcaaaactgtctgcagcaatagaaatttcacaacagaagacaatcaaatactatgatgccaatgatgcagaaactggtagctttgatgatgcctacgatgacaataaccacaacatgtcccttgcttcatgggagggatgcttgctgaaatcctttgatgagatggatgagtaccttgctcaggaaattaacactgacagctattgcagtggttgcacagctgtgacattaattaaacagggtgaccagttgatagttggcaatttgggtgattctcgtgcagtactttgcacaagggatagggaccaactcattcctgttcaactcactgttgacttgaaaccggatattccaagtgaaacctcaagaatagttaactgtgaaggaagagtttttgcagcagaagaagaaccagatgtgtacagaatatggatgcctgatgatgactgccctggactagccatgtcaagagcctttggggacttttgcctcaaagattatggcctcatctcagttcctgatgtgttctacagaaaaattacccctcaagatgaatttgtggttttagcaactgatggggtgtgggatgtgctcactaacagtgaagtgataaacatagtagcttcagcaccaaggaggtccattgcagccaagttgttagtgaagcgtgctgttagagcctggagatacaagtatcctggttccaaggttgatgactgtgctgtcatatgcttgtttctggatgcacaatctgctctatcacactcacaatcctacagtaatagaaagagtagacagcgcagcaagcacttgaatcgcactaagtccactagaaatgaagacaatgaaactgtgtatggcaaggttggggtggagctagatgaagaatggaaggcccttggagggtttgcaagagccaactctttatcaaaacttccacgccttgctaggggtatgagtaaacggcaatcatctaaatactatataccaagttga

SEQ ID NO: 83863 - DNA, 447 bp, Glycine max
  Peptide Sequence Number=SeqID_200641
atgatgataagaatgacaataacaatgagtgaagatgtgaaaccctgtcacactgacctaatccccaatggcgtcctagggaacatgatagcagcgtggtgttgtgagcaaagaatctccttcaaagcagaaagggttatagggaaacacaacaagagagttaccaacaaagccgcattagaaggcatgcgaatgacgatatcgtttttggtcaacaagctcaagggaaatggaaagaaaaataatgataaggttaatgttcctttgagtgttgaagacacaaacgatgttctttacaagcttcgggtgttggcgaagggtcggccagaggttgatggaagggggtgtcgtgggggtggcggcaatgttggaggagggggtgatgattttggaaggagtggtgaagaggggtgggttggtggtggtgctggcggcggcctaggctga

SEQ ID NO: 83864 - DNA, 1402 bp, Glycine max
  Peptide Sequence Number=SeqID_200642
atgaagacagatttgcatgccaaccaactcaatttaatttttctaccatatctatctcctggccatttgaaccccatggtagatacagcaaggctttttgccaggcatggtgctagtgttaccattatcactacccctgctaatgctttgacattccaaaaagccatagacagtgacttcaattgtggataccacattagaactcaagtggttccattcccttcagcccagcttggcctccctgatggggctgaaaacctcaaagatggcacttccctagaaatacttggtaaaatcatgtatggaatatccatgctccaaggtcaaattgagcctctatttcaggatcttcaaccagattgccttgtaaccgatgtgctttatccttggacagtggagtcagctgcaaaactaggcatcccaaggctttacttttacagcgcaagctacttcgcaagctgcgccacatattttatccgaaagcataagcctcatgagaggttagtttctgatacgcagaagttttcaattcctggccttccacataatattgagatgaccaccctgcagctcgaagaatgggaaaggactaagaatgaattctcagatttgatgaatgcagtatatgaatcggagagcagaagctatggaacactgtgcaacagttttcatgaatttgaaggtgagtatgagcttctttatcagagcaccaagggggtcaagtcttggagtgtaggaccagtttgtgcctcggctaacacaagtggtgaagaaaaggtctataggggacaaaaggaggagcatgcacaagagtcagagtggctaaagtggcttaactccaagcagaatgagtcagtactttatgtaaattttggaagcctcaccaggctctctcttgctcagattgttgaaattgctcacggactagaaaattctggtcatagtttcatctgggttgtacgaataaaggatgaaaatgagaatggagacaattttcttcaagaatttgagcagaagattaaagaaagcaagaagggttatatcatatggaactgggcaccacaacttctcatattggaccaccctgccatagggggaattgtcactcactgtggttggaattccattcttgaaagtgtcagtgctggattgccaatgatcacatggccaatgtttgcagaacaattctacaatgagaagttgctagttgatgtattgaagattggagtcccagtgggatcgaaagaaaacaagttctggacaactctgggcgaggttccagtggtcggaagggaagagattgcaaaggctgtggtacagttgatgggaaaagaagagagcacagaaatgaggaggagagcaagaaaacttggagatgcttccaagaagactatagaggagg

SEQ ID NO: 83865 - DNA, 1017 bp, Glycine max
  Peptide Sequence Number=SeqID_200643
atgttggacaaaatcagtcttgtactatcgattctcaaagatcaaatagagcttctgtttcaagatatgcaaccagaatgtatcataactgccatgctttatccttggacagtggagtttgctgcaaaactaggcattccaaggctttacttttacagctcaagctacttcaatagttgtgctggtcattttatgcggaagcataagcctcatgaaaggatggattctaataaccagaggttttcaattcctggccttccacataacattgagattaccactctgcaggtggaagaatgggtaaggactaagaattacttcacagatcatttgaatgctatatacgaatcagagaggagaagctatggaacactgtacaacagttttcatgaacttgaaggtgattatgaacaactttatcagagcacaaagggggtcaagtgttggagtgtaggaccggtccgaatcaggctccctcatgctcagcttgttgaaatcgctcacgggcttgaaaattctggtcatgatttcatctgggttattcggaaaaggtatggagatggagatgaggatggagagagtttcctgcaagattttgggcaaaggatgaaagaaagcaagaagggttatatcatatggaactgggcgccccagttgctgatattggaccaccctgcctcaggagggattgtgactcactgtggttggaactccgttcttgaaagcttgagtgttggtttgccaatggtcacatggcctgtatttgcagaccaattttacaatgagaagtttgtagtcaatgtcttgaaaattggagtcccagtgggatcaaaagagaacaagttctggacgcatattggtgtggatccagcagtgagaagagaagagatcgcgaaggctgtcattctgttgatgggaaaagaagagggcggagaaatgagtagagcaagaaaacttggtgatgctgccaagaagactataggggagggtggatcctcttacaacaacttgatgtag

SEQ ID NO: 83866 - DNA, 1626 bp, Glycine max
  Peptide Sequence Number=SeqID_200644
atgggagatcataataactgggaaacttctgaacttagtcttaataatcaatatcaaaatcataatcaagttggacttgatgttcctaaattcaagtctgttcaacctccctcactactcttctctccctcatcaatctccccttcttcttacttcaacttttcatctgctttcagcccttctgagttcttgaactcacctttgttttttccttctccaaatatttttgcttctcctactactgaggctttggttggccagagcttcaactggaggaacggttcgggcgaagaacaacagcgtggcaaggaggatgagaaaaactactccgacttctctttccaaacccaaattcaatcttcctcaaacatgtttcaagtggaaccgcttaagaaacaagacatgtggaaattcaatgaacctacaaaacaaactgatttttcacctgagcggacagcaacaaaatctgaattcccttcaattcagagcttttcctcagagatggcagaaggaaaaccagaaatacaaagtagctcagttcccgggtctggttattttgactacacaagtgcatctcagtctgtaagagaacaaaagagaacagaagatgggttcaactggataaaatatggacagaaacaagtgaaagggagtgaaaatcctcgtagttattacaagtgcacacatccaaattgctcagtgaagaagaaagtggagaagtctttggatggacatatcactgaaatagtatataagggccaacatagccacccaaaaccgcagtctactagaagaacaaactctcaatcaattcatcaaccttcttcgtcttgcacaaactcagggataactgatcattcagtggtgactctaggaaatccacaaatggatcatttctccatacaagaagattcttcagcttctgttggagaggaagagtttgagcaaacaccgcaaaccagttattccggaggagacggagataatcttggacctgatgccaaaagatggaagggagataacgaaaacgatggctattcagtctcagcaagcagatctgttagagagcctagagttgttgttgaaaccacaagcgaaattgatatacttgatgatggctttaggtggaggaaatatggacagaaagtagtcaaaggaaactcaaatgcaaggagctattacaaatgcaccgcccctggttgttcagtgagaaaacacgttgagcgagccgcacatgacatcaaagctgtgatcacaacttatgaagggaagcacaaccatgatgtgcctgctgcacgtggtagcggaaaatataactcgaacagaaattctcagaacagcaacatatcagcgcctataagaccctcggcagtgaattgttattctaactcatcaagtttcacaaattctctctataataatactaggcttccagcaactggaaatcaagaatcattttcactggacaagttcaagaatcctggaagttttggctattcagatcttaacagaccaatgggttcacataccaatcatgcacaatacacagatgctgcatactcaagggccaaggatgagaggaaggatgattcattccttcagtcatttctctcaaaggacttctaa

SEQ ID NO: 83867 - DNA, 1623 bp, Glycine max
  Peptide Sequence Number=SeqID_200645
atggttaccacagaaggggtactaatcactagtctcacagacagatactggaaagctcagaatctgtcaggtagtctctcaccagagttttccaagcttcattatctccaaaaattagaccttagtcgtaacatcatcactggttctatacctccacaatggggtaccatgcgcttggttgagctctctttaatgggaaacaaattgtcagggccattccccaaagttctcaccaatatcacaaccctcagaaacttgagtattgaaggaaatcaattttctggccacattccaacagagattgggaagttgaccaatttagaaaaactcgttctgtcatccaatggattcacaggagcattgccacccgtgctttccaagttaaccaagttgattgatttgaggataagtgacaataatttccttgggaagattcctgatttcattagtaattggacattgattgaaaagctgcatatgcacggttgctctcttgagggtcccataccttctagcatttctgccttgacaagattaagtgatttgaggataactgacctaaaaggtagtaaaagctcagctttcccaccactaaataacttgaaatccatgaagacactggtattgagaaaatgcatgattaaaggagaaatcccagaatatattgggagaatggaaaaactgaaaatcttagatttgagttacaatggcttgagtggagagatacccgaatcttttgcccaacttgacaaagtagacttcatgtatcttaccgggaacaaattatcagggataatacctcgatgggtcctcgcaaataacgaaaatattgatatctctgacaataacttctcctgggacagctcaagcccaactgaatgtcaacgcgggagcgtaaaccttgttgagagctactcttcatctgtaaatacacaaactaagattaattcatgcttaaaaaagaactttctatgcactgcttcacctagccaatatcggtactccctgaacattaattgtggtggaaacgaagcaaatgttagtggtaatatttatgaagctgacagagaacaaaagggtgctgcaatgttatattacactagccaggattgggctcttagtagcactggaaatttcatggacaatgatattgactctgatccatatattgtggccaatacttctagacttaatgtctctgcactcaattcaaaactatacacaacagcacgtgtttctccccttgctctcacatactatggtctctgcctaataaatggaaattacacagttaagcttcactttgcagagattattttcatcaatgataggtcccttaacagtcttggaaggcgagtatttgacgtctatatccaggggaatttagtgctgaaagactttgatatccgaagagaagctggtggtactggcaaatcaattgagaagacatttaatgcttctgtcacccaacatactttgaagattcacttctattgggctggaaaaggaaccactggcatacccacaagaggagtttatggacctctagtatctgctatttcagtaaaccctataaaagggaaagattaccatttatgtctacctctacaagacctccactag

SEQ ID NO: 83868 - DNA, 359 bp, Glycine max
  Peptide Sequence Number=SeqID_200646
gacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggacgtggcggctga

SEQ ID NO: 83869 - DNA, 714 bp, Glycine max
  Peptide Sequence Number=SeqID_200647
atggtggcggctacgtttgatggattctccataagggactacacatccaagatgagatccatcgacgttttcaagtgctggccgtttgcatctacctcctcacgtgacgtatcagatgaggaggttcagtcgtggcttccgccgatgaacccgtgccctagatccgacgattctaccgaccaccgcgctcaaaatctggagattccgccttctgctgcggaaaccgatgaagacgacggcgatgtagattgcagcgaagaggaatctgcagaatctatggaatctgagaaatccgcgcctccttccgactcctccccggcgaacaacaacaacaacaatgaagacgagaaactggagatggtttgtccggtgtgccgcgaattcaacgccgcgacactcacggcggtgaacgcgcacatcgacggatgcctcgcgcagacgatgagagaggagcgtcgccacatgaggattatgaatttgaaatcttcgtcgtcaaagtcgaagccgtcgaagccgctgaagaaacgttccatagccgagattttcatggtggaggagcagccacatctgccacagccacagccgcagcctcagttgccgccgcaaatcgagagcgtgttgaagttctggccgttccgcgagggccaaggtggacgatgtatctattaccgttacgaagttcgagtggctttctcggcgactgggaggcgctga

SEQ ID NO: 83870 - DNA, 369 bp, Glycine max
  Peptide Sequence Number=SeqID_200648
atggagaaatgttacgagaatggagcatggcacttggaacatcttggcaatgctctcgttgtccatggttgcgagcatggtgacaaggcaggtgttgttaacgctctggaggacgatgttgagggccatgtagatctcagtatacttacaactaagcttttttggtgtgacattgatgtcgcgataggtcatcatgacgatgcagatgacctagttgcactcaaagacattgacaaagttgtcgtggtttatgacaatgatgtcgataacgtactattcttgggaactgaaaagacatggaatggaagtatcgtgaagcgcgtgaaagggacgagttgtgtgcgtggtgtcgtgtgtggcgatgcttag

SEQ ID NO: 83871 - DNA, 1479 bp, Glycine max
  Peptide Sequence Number=SeqID_200649
atggaaaccaagaagctccaccctcgcttctcgctcggccgccaatcctccctcgcgccggagcgcgccggcgccggcgactcgtcggaggccctggacccggcggtccggttgatgtatctggccaacgaaggtgactcggacgggattaaggagcttttggacgccgggagtaacgtcaatttcaccgacatcgacggccgcacctcgctccacgtcgccgcttgccagggccgcaccgacgtcgttgacttgctgctccgacgaggcgcccacgtcgatccacaagaccgctggggcagcacccctctagttgatgcaatgtactacaagaatcaccaagttgtcaagcttttggagaaacacggtgcaagaccccctatggctcccatgcatgtgcagaatgctcgtgaagtacctgagtatgagattgatccttctgaacttgattttactaatagtgtttgcataacaaagggaactttcaggattgcattatggcgtggaattcaggttgctgtcaagacacttggggaggaattgttcactgatgatgacaaagtgtgggttggtctacttatgcaatctgttgtttcattcatgtcaattactcaattggatattcagttctcaatttttattctcatcgtggattttgtttcttggtgtatgtttatcagaaaggcatttcattatgagcttacattacttgagaaaataaggcatccaaatgtagtccagtttttgggtgctgtaacacaaagcacaccaatgatgattgtcacagaatatctaccccagggggatctcggtgcctacttgaagcggaaaggtgcattaaaaccagtaaccgccgtaaagtttgcacttgatattgctaggggtatgaactatttgcatgaacataaaccagaagccattatacacagagatcttgagccttcaaatatactgcgggatgattctgggcatctgaaagttgcagactttggagttagcaagttgcttaaagttgctaaaatggtcaaagaagacaaacccgtggcaagcctggatacatcatggcgttatgttgctccagaggtatatagaaatgaggaatacgacacaaatgtggatgtattttcatttgctctgatattacaggagatgattgaaggttgtccaccgttttttgcaaagccagaaaatgaagttcctaaagcatatgttgaaaatgagcgtccaccatttagagcttcaccaaagctttatgcttatgggctaaaacagttaattgaggaatgctgggatgaaaaaccatacagaaggccaacatttaggcaaataattgggagattggaagacatatactaccatcttgctcaaaagaggggctggaaggttaggactcctggatgcttccagaacctggaagccatatttaggggtaatcgcacaaatccaagtagccgatcatctcgctctacggccagataa

SEQ ID NO: 83872 - DNA, 972 bp, Glycine max
  Peptide Sequence Number=SeqID_200650
atgagggtggcggaggaggagaaagcagtgttggaacaagtgttcgggtcgtcatcatcagaagaatgtgattctgatggatacagcgagagcgagagcgagtgggagcccatctcagaagtgaatggcctatggctgtgccctcacttcctctctccacgccgccagtctcacatactctcctccatccaagccgacaattggttcccctccccttccatcaaccaggccatgcgcttcggcctacaacacctcccttcttgggccacccctctggcccactccattcgccgctccgtccaagcccaggcccaagcccaaacccacccaccgcccttccccctccacctcctccacagagaacctctcttcgaccagatgatcgccaacgtctaccagcccggcgaaggaatctgcgcccacgtcgacctcctccgcttcgacgacggcatcgccatcctctctttagaatcttcctgcgtcatgcacttcactcccctctctggttccctttccgttcccgttttgctcacccctgctggtgttttagtggttgttcttctggtgctggttctcatgaggaggatgggatggttaggaggcaaagatccagtgtataaagagctcaggggcgtagatctgcagacgggattatttacactaagacaaatcaaagcagcaaccaaaaactttgatgcagtgaataaaattggcgaaggtggctttggttgtgtatacaagggcctacaatcagatggtacaatgatagcagtaaagcagctttcttcaaaatctaaacaaggaaatcgtgagtttgtgaatgagatgggactgatatctggacatgaacatcccaatcttgctaagctttatggatgttgtgtggagggcaaccagctaatactgatatatgagtacctggaaaacaattgtctatctcgcattctttttggtaagcttcatgatgaataa

SEQ ID NO: 83873 - DNA, 204 bp, Glycine max
  Peptide Sequence Number=SeqID_200651
atgagcaaagcaggtgtcaggttgttgaaacagaatctacagtccaagcaccctccaagagaattgaaggttcccaagtcactgttaattgaaacctccacaaccgagtccgaggatcaaacaactgcaacacaatatatacagcaagaaggtaacaagaaattccaactagacctccatcatgagtatggaatattttactga

SEQ ID NO: 83874 - DNA, 1293 bp, Glycine max
  Peptide Sequence Number=SeqID_200652
atgtcaagcaattcagatgcagcagcagcgacggtgcatgctcgtggccgtttggccatgctcgctgctcacctcctcccctttgaactcactgatcacgacgccctccgccctatccctctctccgctcagttgccgccgacgaacctcgccggaagtttgaccgtcgtcgacgacagaaccggcaagaagtaccagcttcaggtctccaaagaaggcactgtcaaagcttctgacctcaagaagatatcgactgggaagaatgacaagggactcaagctttatgatcctggctatttgaacacggctcctgttcgatcagcaattagttatattgatggtgatgaggggattcttagatatagaggctaccctattgaggagttggcagagaaaagcactttcacggaagtgtcctatctcataatgtatggaagtttgccttctgaaagtcagttagcagaatgggagtttgctatatctcagcattcggctgttccacaaggaattttggatatcatacagtctatgccccatgatgcacatcccatgggtgtgcttgttaatgccatgagtgctctttctgtttttcaccctgatgcaaatcctgctctcagaggtcttgatatttatgactcaaagcaaataagagacaaacagataacacgggttattggaaagataacaacaattgctgctgcagtttatcttagaatggcaggaaggccacctgtgcttccatccaaccacctttcttacacagagaacttcctatatatgctagattctttgtatgtatgtggtaatcggtcatataaacccaatcctcggctaactcgtgtgctagacattatcttcatcctgcatgcagaacatgaaatgaattgttctacatctgctgtccgacaccttgcatcaagtggcgttgatgtatacactgctattgccggggctgttggagctctatatggaccacttcatggtggagctaatgaggctgtcctcaaaatgctgagtgaaattggaactgttcagaacatcccagagttcattgaaggtgtcaaagccaggaaacgcaagctctctggttttggacatcgagtgtacaaaaactatgatcccagggcaaaggtcttaagaaaactggcagaggaagtgttttccattgtgggcagggatcctcttattgaggtggcagttgccttggagaaggttgcactatctgatgaatatttcatcaagaggaagctatatccaaatgttgacttctactctggattaatttataggtaa

SEQ ID NO: 83875 - DNA, 850 bp, Glycine max
  Peptide Sequence Number=SeqID_200653
gcacaagctgtcagggaggaaccgacggccagatgagaaagtcgacccggtaattgcaagcccatacctaagacgccgaagaagcgcctcgcgctcgatcgcagagattcttacagtggcgccaccgatcgaagctggcaaaaggaaagcgattcaggttgaggaagaagatgaggagaaatccgattatggctattcaggtggagattcaactagggccgccactcctgctccttctgccgctgttgctactcccgttgcttcggtaattaagaacaagaagagtacgatgaagaataggaacaagaaaaagttgatgaaggtgaagaagaagaaaagcaaggtggagaagcacggcgatagtggtgtgtggttcgtgaacaatgagaagaagacggttgcgagcaagaagaagaagaagaaaaagaagaatgtcttcaacaacagaccaactgggaacaagcgaaatacgcggcaagtaaaagttgggaaaggagagttacaagaaaggaaaactaagacaagtgccttcgtgcgcggaagggattcagaaggtagtgaagcctgtaagaatgttgctccagctgtagtgtgtgctgtgtgtataatcagtacaagtaccctagctagaaggggccactcatgggttacgagtttttcggacgtagagaggttttatacgcagcttacagctggatgtattttggctagtgggagatctgtaagtggagataatttcgagtgtctattagaacccaacctaggaggtctatatagaaccaatggaaatcggaaaacaatgtcagtttgtggttacgctggccgaaatttgaaagtggaagtaaattag

SEQ ID NO: 83876 - DNA, 201 bp, Glycine max
  Peptide Sequence Number=SeqID_200654
atgtgcattccagcattgaaagggaagaaaggggcaaggggaaggtgtgatggaagtgaggtcaagtttgatgagaatgctgtggtgcttgtggacaagcaacgccaacccattgggacaagagtttttgggacagtaccccatgaattcaggcagaagaagcatgtcaagattcttactttggctggtcatattgcttaa

SEQ ID NO: 83877 - DNA, 2829 bp, Glycine max
  Peptide Sequence Number=SeqID_200655
atggtgcaaagtgcagtaaatagttccagaaaactaaaaggtacaatcgataataaaatgcttccacttcacgaggttgatccttctatcgatagaaagatatcaggtataaattgcttatcggtagaaaagaagcaacaagttaaaaactgcgactcagttggaaagcaagaaaaagcagtatctcctaatcatggcattcttaagaaccgcttcaaacatgtttctgaaaagacgtcaagtggcagtagtattggagatggtactcaagaaagctattatagtgatcaagaggaaacctcggacagacatgtgaaattctctggcaaagatgatatacctggtcctaaaaagacaaattcatttgatgaaaccttgttcaagatatcttcagatgcggtggcatcttcagcagtaaaggagaagtcctctggaagtgatgaagaaactgcaagtttggagccaaacagaaattatgaccatattgacagaggcaagagagaggtttgccctatagttgaaagtaaacagttttctaacactctggaccaagataccatacaaagcttcttgaagccatgtatcaatcaagagaagtcaaagctgttagaagagaagtcagaattgttgaccaaggtggcagtttgtgacaataatgattcacagtttttttacggagggaacagaactaccctgcattgttctccatatgctgacatttctagacctctttcagctgtccaagtagagaagatgtctggtataaatacaaaggtgtgtgaatctggatctttcagctacagtgggaagttggaccatttggatgatccacaggttgatgctgttaactcaaatgaaaatacaaagacatttctggagccttcttcatcttattctgcttcatataatgcaaatgaaaaaccagaatctccattgcaaacttatggagataaagataatagtggtgaggccttgggtaacagacaattttctcgtatgttttctgcagatatgattgataactcattccccaatacaggctgggagaaaggaagtggcaaaaatagctgtttggatccggatttttttggtttgccactcaattctcatggtgagctaatcaatttcagttcaagtggaaacttagggatgaaccagtcagatacatcaagtacgttacgtggttcttttagtggcttacccattaataatattctccatcaaagtagccaggaaaatttaagcattaatgagaatcatgttgttcagaagacatttccaaaagatggtcttgatccatttccacatcatccaacccgattacctgtcactgagttacaatctagagagagagaagatatccaccgacctaattcttcagatatgtgttccagtcactatgtcccgccacttaattcagagttgaactgtaagaaaaactcgttcgttgaacagaatcaatgtgaccgagtctggaatcacaatggaaatggggtggtttctctgaaagaaggttcacatcatatctcaccaagttccagccaaccaacaatgaggttgatgggtaaagatgttccaattggtagaagcagccaagagatgcaacaatttgcgggagatgtttggcctgatgaggaatccagaagaaggaattattctgaatatgctgctttagatcattctttattggaaagaagttctaagcaggattgggtatctggttcacctttacaaatatcagctgacaatgtattgcaagcagcaaaaattcaaaacaatcaagcagcacaaggcaccatattgatgagcagtacagactctggattctctcaacagtttattgatcggcaaagtaatcatggagtcaacagaaatgccagttcttatttcaatcccattactcaaaagtctacttcgtatgcagcatttaatggtgcatccaatgacttttcagagcagtttatacctggagctaaacctctaggattgagctctcaattagtggtactacctacacctggcaattttagtcactcgactcatgtaaccaatggtgagctgaatgacaggaacaaaaatccccatgttacaaaatcagcctttggatttcctttcttgcagccaactgtgaatgaacaggccaaaacatcttggtatagtccctacagaagttcaccatcgtggttgtcaatctcaacagatgaaatgctaccagggaccttttctcggcaattttctgcttcaagtagtcaaaactttcctcaaaatctgtggggaaataatttcactacgccatttgtgaatcattcagcagaagttcgctttccttctaatcatctgacttcttctctaggtcccatgcagacgactcctctttctcgagtatcaattggtcatcctctacatgttccggttacaccctctaccataaatagtgataatataaacataaataaggtcgctgacagattgaagttcgatgaccatcagctgtgcacaaataccagaaagagacctgcagcagcagccaatcttgatgattccagaaaacctaccaagttactgaatatgcgagtgcaagaaaacttcagtcgtatgactaggttgcctggtgaaaagtccagtgtggaattgcaacgaaacacaagaacactcgaactggatccacacatgggcagtgctaggagtaggtgttgtcagcatgaggcacaaaatctaaatcctggaagttatcctgctgtaaattcttttaaactggacggcatggtaacatcaggtcctgtccgacttggtcctaaaagagcgaagcacatcttaaattcctcttaa

SEQ ID NO: 83878 - DNA, 4161 bp, Glycine max
  Peptide Sequence Number=SeqID_200656
atgccactctgcaggcaccacattcggagcgcgcacgctctggcggatccggagctgcgccgcaccgccgatagcgacgactccgaagtgctcctagaagccgtcgcaatgtccggactcgtcggctttctccgccagctcggcgacctcgctcagtttgctgctgagatgttccatgacttacatgaagaagtactggctactaccgcaagaggccacagtcttatgtctcgtgttcaacagcttgaggctgaagttccagcactagagaaagtttttttgtcacaaactcatcattcatcattttttacaaatggagggattgaatggcatcctaatcttcggtctgaacagaatcttgttacacgtggagacttacctcgatttataatggattcatatgaagaatgccgtggtcctccaagattgttccttttggacaagtttgatgtggcgggggctggggcatgtctgaagcgttatactgatccgtcattctttatagtggagtctgcttcctctggaaaagcaacagtagaagttcaaagggaaaagaaaatccgtaaagttaagcaaaagaaaggaacacgactgcggaatggtgaaacccctgaagttgtatcgtcacatgcaaaactgcatcagctacttcttcaggagcgcattgagaatgcttgtggggatcctgctcgtcttgtgaagttgaaaaggaaacaattgaatggatctgcagttgaagcaaaaactgggaaaagttacatggagaaaattctggaaatcccctcgcctgattataaaatggtttgtgaaacttcaatcattccacagcctgggaagttggtgtcagatgatactagtgaaagtgggattaaaatacttgaaatcagtagcattactcctatgaataggtctttgggaaatgaaaacacatggtcgtcaccaaatgagcaggaactagaagtgaattcatactcagaaagggatcgggacacagatggatatattgtggaggtgagtgaacaaatctctggtggtgtaacagaggaaatgtcttctgattatctaaaggtactcaatgaagcaggatcagtatttgatgaacaaaataaaagagaatgcaacttagatagctaccactctgatgatgtgattagtgaggttgatgattatatggatgcattagctaccattgactctgaattggatacagacaatgagcgtggatctatgaaagactcattaaatattgaaaatttaactgattcaaatggcaaaggtgaacctcaactgcgagctcgattttcagattctcaatcatttggggactccttgacttctgaagaaattatttcattggagcaagatagaaatggagagcataatgaagtgcaaggtcagatgtcagattctctgtcaacagggacttcctgggcatccgatgataatagtccattcagaagagatataagtgaagaccattcccaactacaagcacagttttcagattttcaatctatcagaaactccacatcaaggattaaagatatgtcatccaaccagcttctccctacttttgagtcgcaaaggacttactgtcatgagtttgttgtgcatgatgatgcacatgttcagggtgaagtgatttctgattctagaccagtctcttctggttcatgtctgatggattctggacattcaatgttttctagtgatcttggagctgcctcagcaatgtccctatctgcagggagtcaatcacatgaaacaccctctggccctgttgagcttcatttaagaatagaagatgatgaagaaaagatgtgtctcgttgaatctatagtggccagatctgatgctctctacccaataagagatgatgctttaccagtggtttcttttgataacaattatttgaacttggatgtttgtgatccccatgtccattccaatgatctgttacaaacttctaatgaattaaacttagctcatgaaggtgaatctggtgatcattctgggatcaaagttttgcaggcagaatctcttaatgaatgctcttctgaaatattggttagtggagatgttagtttacaaggggaggatcccattttcccatctatggaagtagacctgaatccagatactaagctgctgcttgatgtccaagatttaaaatctgaggatgatattatagctacccagcttaactcagaagatctgtttcctgttgcagagactacaacgaagagcagcattacagaggagctatgctttgattttataaatgtaaacaaaccagatttagcagaagttgaagttttgcctcctgaccagcaaatgaattttgaagaggtgccaagcatattgcctggtaatgaaataagcgggtccacctgcagtttggatctagttgaagatgatggtcatattattaaacatccatcttcaaatatcatatcttctccaatgagtaatcatacaaagttggaagaaactctttctatttttgcagatccttgtgagaaagagatgatagtcaatgaggcaggaagtagagaatctttgacagaattagcagcacagaaggtagaggatcaacctgaaattacttctactgatgtacagttgaacatgaacagatcaggtccatgtgatccttcggattttggaatgtggaataatacgcagcattcatctcttaaggagaaaatccagtatagctcttctatcaatgacctgaaaacagtgcctgtatgttctgagctagactctcaaatattatctggccagggaattaatccaacaaagcatgtaatggatccacttaaacctcttattcctgagttcttacccaaggcatctaaaaacaatcttgaggagatgccacctatgccccctctgcctccaatgcaatggagaacaggcaaggttcaacatgcttccctttttacacagagagaagacatagaagtaaacctagcctcactccaaccaatacagccaaataaacttgacgatatttctcaatttggtttacccacttctgaaaaagagaccttgccatatcagaatctatttttgcctgtcatggctgtggaaagtaatatgcatcaatattcttctgggttttcagtgggaatgtcagagcagcctgttgctattccttttcaacttcctgtaatggtaaatgaagcaaatggtcaatataatttcctagttcccgaacatagccaaatccagaaccctttcttatcattacaggacaggcctccacttggatatgctgttgctttggagggagaaaaggtattaaatccaagcccatgcccaccatcgctacctgctgaatgtgttgtttctagggctgatccgattcttcaacaagaaaaatcaactcaatctccaagtgaattaacagaagttaccggcttagaagttacaaaggatagacctgaagaattgcatttagttctacctgcagaatgtccagtttctggagatgatcccatttctcctaaagagaaaccaacacaatctcctagtcagttaatagaagagactagtttagaagtaaaacctcttgagcagtcttccattaatctggaaagggaacaagaagatccttcaacctcacccatgtcacctcctaatctagaaattgaggagaccaatcacagcctgctaccttcagatggagaaatggtgtttccattggttacatcttctcaaacacgtgagcgtgataatactgagatgccaaatggaaaaccaaagaataagcgtcgtcttccccaggatcctgtaattgatcctgttgctgcccttgacaaaagcaggctgaggaaggtcaccgaacgtgttatgccccccagagcaccaaaggaagatgaaagagaatcactgttagaaatgataagatcgaagtccttcaacttgaggcctgctgcagttcaacgaccacccagcattcagggtccaaaaacgaacttgagggtcgcggccatcctggaaaaagcaaatgcaatccgtcaggtctatccctcactctctgtttattgtaacaagcttgtgctcctcaaccccttccctcttccagcaccagctaagtaccagccaactaaactattcttcattattgaattaggcattcgctggaagcgatga

SEQ ID NO: 83879 - DNA, 283 bp, Glycine max
  Peptide Sequence Number=SeqID_200657
atggagagcagcagtgggattgagagcacgggggggcgtgcgccactgtcaggggtggtggcagattgtgtgaagcggtggttcaaagacactctgaaggaggctaaggcaggtgatgttaacatgcaggtcttggttggtcagatgtactatcatggctatggtgttcccagagatgctcagaaggctgatgttattggttggggaatgaagggaagaatttggctgactaaagcgtcgagggttaggtcttcagtttggagagttggtggtaaacgtccag

SEQ ID NO: 83880 - DNA, 826 bp, Glycine max
  Peptide Sequence Number=SeqID_200658
actggaaggcaaagttgctatagtaactgggggtgccaggggcataggtgaagcaaccgtgagagtttttgtgaagcatggtgcaaaggtggtgattgctgatgttgaagatgcagccggaggcatgctagcagagacactatctccttcagcaacctatgtccactgtgatgtcagcattgaaaaagaggttgaaaacttgattagttccaccatttctcgctatggacaccttgacatcatgttcaacaatgctggggtgctagggaaccagtccaagaacaagagcattgtcaactttgaccctgatgagtttgacaaagtgatgtgtgtgaatgtgaagggtgtggccttagggatcaagcatgctgcaagggtgatgattccaagaggggtagggtgcatcgtctcaacttctagtgttgctggggtcatgggggggcttggaccacatgcctacactgcctcaaagcatgccatagttgggattacaaagaacactgcttgtgagttggggaggtatgggattagggtcaattgcatttcaccatttggggtggccacttccatgcttgtgaatgcatggaagccttgtggtgatggtgatgatgagggcattaatttcggggtgcccttcccagaggaggtggagaagattgaggagtttgttagagggcttgccaacttgagaggaccaactttgagggctttggacattgctcaggctgctctttatcttgctagtgatgaatctaagtatgttagtggtcataatcttgttgtggatggtggagtcacttcctcaagaaattgtattggactgtaa

SEQ ID NO: 83881 - DNA, 399 bp, Glycine max
  Peptide Sequence Number=SeqID_200659
atgcaatcacaaggactagtattgcctcttgagcctgtggttggtccttcagctgctcatgtcaacacaaaggagagttgtgttgatcccatagggaataacccaaacacgagtgactcagagaaatgcaggttgtacgtcaaagaaaatcctccccgcctggtttccctaggaagactttatgagtggtcgacaatcgttcacaacatcactttgcgcaatgatcaagtcaaggttggtgttgaggaagttagagatgcaggtgctcccattcttgtacccactcaagagggagttgtgggaccgataaaacctgtagatagaccggatcatgatgtcgatgatcccttatatttgatgacatggaccatcccacagctttttctaaagctgttgtag

SEQ ID NO: 83882 - DNA, 735 bp, Glycine max
  Peptide Sequence Number=SeqID_200660
atgacccagaatgttaaacctttaatcgtcatcaccggtgccagctccggtatcggtcttgccacggcaaagctgctttcggcgcgtggacatgccctgctgctgctggctcgccgtatcgatcgtatgacggcactgaacctgcccaacgccctgtgccgcgcggttgatgtgaccgatcgccacgcattttccgccgcagtgcaggatgctgaacagcagtttggcccggctgatgcgctgattaacaatgcgggcgtgatgctgctcggcgcgattgaacaacaggatgccggcgaatgggataagatgttcgacgtcaacgtgaaaggcctgctcaatggcgtgcaggcggtcaccgcaggcatgattgaccgcaaaaggggcacgatcattaatatcagctcagtggccggacggaagacgtttcctaatcacgcagtgtatgttggcactaaattcgctgtgcatggcatgtcagagaacctgcgcgaagagctgtcgccgcacaatgtacgcgtgatcgttatcgcgccgggcgcagttgaaaccgagctgttgagccacaccaccagcgaagcaatcaaggacggttatcacgcgtggaaagccgaaatgggcggcaaggtgctcagcgcagacgacgtggccagcgccatcgattacgcctattcgcagccgcagtcggtctgcgtgcgggagatcgtgctggcggccacccgccagggcgcataa

SEQ ID NO: 83883 - DNA, 234 bp, Glycine max
  Peptide Sequence Number=SeqID_200661
atggataagcgacagctaaaagcttttatctgcgtgtttgaggagcgcaacatcacgcgcgccgcacagttactcaatctgacgcagcccgcgctctcggccacgatcaaactgctggaagaggagctggccaccacgctttttatccgcaggccgcgcggcgtggaggtcacggaggacgctcgcgtcctttatccgcaggcgcgcaagatgctcagcgatatgcaggcgctg

SEQ ID NO: 83884 - DNA, 123 bp, Glycine max
  Peptide Sequence Number=SeqID_200662
atgacgttcagcgcagaaggggtgctgcgtaagcagcaggggggttatgcgatcggtaaccgcgcggcgctgacggccttagccgaagagatggagcccggcgcagcgctgccgggtcactga

SEQ ID NO: 83885 - DNA, 243 bp, Glycine max
  Peptide Sequence Number=SeqID_200663
atgtgggccatcatcgataagtgcaaagagaagctaaatctagcggcgactcacgagcaaaggctagaggatgagtacgccaagatatcagcagaaagggaagcaagggaaagggagtcaagaacttcccctattgctagccaaggccaaagcagtggcggacacctactccgcccccgaggagatccacggacttctcagctattgtcagcatatgatagacttaatggaccatatgattag

SEQ ID NO: 83886 - DNA, 207 bp, Glycine max
  Peptide Sequence Number=SeqID_200664
atgtcgggatttacacgcaattctcctcaaatttcagccagcccgcatcaattagaccttgcaccttacgcttcagagccctaccatgctcaatggaacgccccggggcttctccatgacaagcacacgttgcgtttgagtcgtattctcggagaaatggaggtggtcttcgtcattggaagtgcggtagacaggctttgtggttga

SEQ ID NO: 83887 - DNA, 555 bp, Glycine max
  Peptide Sequence Number=SeqID_200665
atgggtgaagtagaggaggtgcaagagcaaatgaagtccaacacggaggccttgaaagagaaaatggccatgatgagcataaaggagataatggaagccaatgcaattgcagttgccactgccagcgttgttgctaaggtgaacctgatgcccccatctggcctcaagcaaatgaatcatccaacctcagatatggatgtcaataactccgctcccatagtcattgagatccggcaacctcatcatgtacatgtctctcaacccatgggggagacacatgaaattccccaccacaatctagctgactttgagccttgcctcgaatatgccactgaaggaaatggaaagttggatcatctaaaggaaaggctcagggccattgaaggaggtgaagattatgcctttgctaacctagaagagttgttcctagtacccaatatcatcacccctcccaagttcaaggtgtcggactttgacaagtacaaggggactactagccctaagaaccatctaaagatgtgttgtcgaaagatgggggcatacgctaaagcatga

SEQ ID NO: 83888 - DNA, 644 bp, Glycine max
  Peptide Sequence Number=SeqID_200666
atgggcctgcgccaggcacgccctgcacctcatagacggtggcggcggcgtgaaggcgacaggcgcatcactgtcatgcagcggacatacgcagaaggcgccggcattgctgccggcgcccttgtgcgtttcctgcaactaccaaagcaatcgcagttacagcggacggccgatgcccgagcaggtgctggggttgttcacggccccggcgttggtggcggtcgcaaagcgggtgcggatcgcatcacgccaggccttggtcagcgggatgaacttgtgcgcgcggatggcggcgtcgttcgggccctgctccacgccgttgatcaccgtgctgccgtagtggcgggtcaggaagccgcggatgttggcgcccacggtgccgttcttgtagcactggccgaacacgaagttggtgtagcccgcgatcgggtagcccgcgttcgggttgccgaacaccggcacccagttggccgggttctcagcggcggcatcggtcggcggagcgacggtttccaaggtcgcctgcacgctcacttcgtccggcgagaaacccttgaccttggcgaccttggtggcgtcggtcaggctcgggatcacgtccgggccgacgtagccgatgcggccatcggcagcgtacacggcgt

SEQ ID NO: 83889 - DNA, 280 bp, Glycine max
  Peptide Sequence Number=SeqID_200667
atgtcgcacccgcattcgcccaccgcccgtttccctgctgccctgtggcgcagccacccgatggcctgggccgtcgcagtggccctgggcagcgtggtggctccggccactcaggcccaacaggcgttcagccccggctggttcgccgagcgcggtgcggcgcagggcgcggccgcacagagcgggcgcatgcccaatggtgtgccgatccagttccagctacccgcgcagcagcaggatgcggcacggcagaagctgcagcagtcgatcgacaaccttg

SEQ ID NO: 83890 - DNA, 246 bp, Glycine max
  Peptide Sequence Number=SeqID_200668
atgggcccaaaatctaccctaaggctcagggtcttttcctgcatttctggcccaattttcttggagtcttctatccaatacccttggggggggggggatgctgggttccttagcaatttttggaaaaatttatggactaagctaggaactaagctccttttctccaccacttttcacccacaaactgatgggcagacaaaggtagtgaatagatctctatccatactattaagggctctctcctaa

SEQ ID NO: 83891 - DNA, 252 bp, Glycine max
  Peptide Sequence Number=SeqID_200669
atggataaatcatccaactttgatgaaaattctgatgtgggggctaaagaggatgttctttcaaaagaaggattgaagctgtgtgagtattcaacggatgataaacttgatggttgtgttgattcagcattgagggaagcaaatgcagatgttgtctttgaagatttgatttggtggtattcggttgaggattgggaagatgatgatgaccttgaggaaagtaaatcatcatcattcagtgctcgatcttga

SEQ ID NO: 83892 - DNA, 324 bp, Glycine max
  Peptide Sequence Number=SeqID_200670
atggtgaaacgtatgaactgttattctattaccattcctgagctagaatctataacaacaaggtttaagttcaattcattggtgaaagggaatggtgatgctaatggaatgagggtgagcacaaatcctgatattaatagtcatggagtttctatagtaggtcctctgccaaaaaagaagaatgaagaggaaggggtagctgaaaatgccaagctaaatctatttttaaagggggaggaacctgttggtagaggctggcagggagcatctggattgaagtacgagatcacaaaaaaatgcgggtcttggttagtttcagtttaa

SEQ ID NO: 83893 - DNA, 288 bp, Glycine max
  Peptide Sequence Number=SeqID_200671
atgaggcttcactatgatcaagcgagtcggagacctagcatgaccacagatcaacctccactccttatggctcacatagacccgggtatagggcctaatatctcaatgtgtgtgcgaggtgtagtccccagtggagtcgccaactgtcgcaacctgcccttcagtgggagggcaatgcgagactcgatggtgcatcttccaacaaaggaaaatgcacggagtttccaccaacgtttatttgaggaaaacgctagaaaaaccaaaaagacgaaggtctatagattttga

SEQ ID NO: 83894 - DNA, 273 bp, Glycine max
  Peptide Sequence Number=SeqID_200672
atgatggttcccagggcatctcatgtcaatctcagaattgcatttgttgtgcatagcataagtatgcctgagtcattcatctctatgagatgtggtcgaagtattggcgatcaaaattgctattccttggattatagggttgaatcaagcactttttttaaaggaaaaattcatcaagtcaaggtcaagtatggaagtaaccagcttgcaaagttggggcagaaggtggatcgggttacatcgcctttttgtctattgccaacacatgattga

SEQ ID NO: 83895 - DNA, 237 bp, Glycine max
  Peptide Sequence Number=SeqID_200673
atgttgattcttgctagccaaattgagttgcttaacgccagttgccgtgcaatccgtaaggcccctggctcgcctaggctagcctctggctcacctaggctagcctctggctcacctgggccaccaaaattacttcatggtgaagtaaccagctcgcctgggcgagcaaggttgcttcaaaaggaagtaacagctcgcttgggcgagctacatcccaaatgccttgttttgctataa

SEQ ID NO: 83896 - DNA, 321 bp, Glycine max
  Peptide Sequence Number=SeqID_200674
atgagaattaatcttggcctaaagaaagggtacctcaagaaggctttctatggatcaagaggaccaacttttggcaccaaggttgccaactaccctccatgccctaacccagagctgcttctcaaagatggccagtgggttgatgtgcctccaatgtgccattccattgttgttaacattactattggtgatcagcttgaggttatcgccaatggtaagtacaagagtgtggagcaccatgtgatagcacaaacagatgggaccataatgtctattgcctcattctataacctgttgggcttgttgaacaagtggccttaa

SEQ ID NO: 83897 - DNA, 303 bp, Glycine max
  Peptide Sequence Number=SeqID_200675
atgggcaatctgcaacaagcctattcccacagtggacatttacagggccctatgttttctgcagatctattaattaagagtcgaggactaatcatatttcacagccttctatttagcaccggcttcaaacatagctacagtactactcagctcatgagcaggaaatttggggcacaatcaatacagattgcagagacacttgaaacaatatggcatgcagaaataaggcaggatgatgatgataacactgttctccatatagcagcagaaacaacaaaaatgatatgtgaaaatcttgattag

SEQ ID NO: 83898 - DNA, 291 bp, Glycine max
  Peptide Sequence Number=SeqID_200676
atgaaaattagtaaggaatggactggggaaagagcagggagagaagagagagccaagagtgggattagagagatacagggaaagaatgttgaggatgcgggatttgatgatgtcattattgaggatcaaactgataagacacgaggtgcagagctcaatgagcttgatgtggaagaggaagacgcgacggaggaagaaggtttcaggtcctcgtctccactaaggaacgatgaggtggcgatgaaaaaaatgtgcaagggagaagtagagagcattaatgagtgtatttga

SEQ ID NO: 83899 - DNA, 1080 bp, Glycine max
  Peptide Sequence Number=SeqID_200677
atggccgctcatgcagttgtgcaggctggcgccgccgggggcgaagccgtcggccttggcgtcgtacacgccctggatcaggcccatgaattcgctggcgacgttgcggtggaaccagggcggacggaaggtgttttccattgccaggatgcgcggcgggaagatggcgaagtccatgttggccgtgcccggggtatcggacggggcggtcagcaccgtgaagatcgacgggtccggatggtcgtagctgatcgagccgatggtgttgaagtggcgcaggtcgtacttgtacggcgcgtgcgtgccgtgccaggcgaccacgtccagcggcgaatggccgatcgcggcgcgccagaagccgccggtgaacttggcgatcagttcgaagtcgccttccacgtcttcgtaccaggccaccggcgtcttgaagtcgcgggcattggccaggcagttcgagccgatcgggcccagttcgggcaggcgcagcgcggcgccgaagttctccagcatgtagccgcgcgcgctgtcgtccagcagttgcacgctgaagcgcacgccgcgcgggatcacggcgatctccagcggctccaggtcgatcaggcccagttcggtggccaggcgcaggcggccctgctgcggcaccaacagcagctcgccgtcggcgttgtagaaatagcggccctgcatcgagcggttggcggcatacaggtggatgccgacgccgctttgttcatcggggccgccgttgccgccccaggtcttcacgccttcgatgaagtcggtgggcgcggcgggaatgggcaaggggctccagcgcagctggttgggcgtgaccgggccgtggccgaacgcgctttcccagcccttgacgccggcaaacggctcgaacggcttgtgctgcgcgcccgggcggatgcggtagagccaggagcggcggttctcgctgcgcggcgcggtgaaggcggtgccggacaactgctcggcgtacaggccataggggcattgctggggcgaattgcggcccaggggcagcgcgccgggcagggcttcggtggcacagtcgttgccgaaaccggtctg

SEQ ID NO: 83900 - DNA, 105 bp, Glycine max
  Peptide Sequence Number=SeqID_200678
atggagaacaatgtggccgcagttgtcgccaccagcaccgctgttgaggcagatccgactcacctatcctccataaaccaaacaagccaaccagtcccgaacatg

SEQ ID NO: 83901 - DNA, 1101 bp, Glycine max
  Peptide Sequence Number=SeqID_200679
atgcatgcatcgagtgatggagacgccgtactgaagttggtcgagatctttcggaatcggctggctgccccagcccaggtggctttccaccatcaggccgacgatcgagttgttgccttcgacgatctggttgctgacgttgtccatcaccagcggttgcagggccgggtccttgttggagttggcgtggctgcagtcgaccatgatgttcagcgggattttcgccttgttcaggtcctgctcgcagagcgcgacgctgaccgaatcgtagttcggcttgccgttgccgccgcgcaacaccacgtgaccatagcggttgcccttggtggtgacgatggatacgccgccctgctggttgatgccgaggaagcgatgcgggctggagaccgactgcagggcattgatcgccacggacaggctgccatcggtgccgttcttgaagccgaccgcggaagacaggccggaggccatctcgcggtgggtctgcgattcggtggtacgggcgccgatcgccgaccagctgatcaggtcctgcaggtactgcggggaaatcgggtcgagcgcttcggtggcggtgggcaagcctttctcggcgaggtcgcggagcagttggcgaccgatgtgcaggccatcctggatcttgaacgagtcgtccaggtacggatcgttgatcaggcctttccagcccaccgtggtacgcggcttctcgaagtacacgcgcatgacgatttccagttcgccggccagcgcgtcacgcagcggcttcaggcgctgggcgtactcgatggcggccttcgggtcgtggatcgagcacgggccgaccaccactgccaggcggtcgtcgcggccatgcaggatctggtgcagggccgcgcgcgaggcgctgacggtgtcggaggcttcatcgtcacagggcagcatcgccagcagctgggcaggcggtgtcagcggttcgatggtgcggatacgcaggtcgtcggtgtgcgggggcattgcgggagatctccggaacgttgggggtccccagcgtggcggcatgaaaaaagccgccaggttcgctggcggctttcgggaatgcgtctgaagctttcttcagggtga

SEQ ID NO: 83902 - DNA, 285 bp, Glycine max
  Peptide Sequence Number=SeqID_200680
atgccggaaaccgctcggtcgacacccacattcccccacattcatttcaatactatcggaaaccgctggctggaacccacagaacctcctatcgaagaaaagttgaagaaaaccctacattgttgttggaactgtgtgggtcgaagaaaaccctacactgctcttggaacagtcgtgggtgctcaaagctcgaagctttctacgctgccagttaacaagcttgacgagagttacacgccgagcaaagtttccatccgtgccggtgatggttttcacaacttgaag

SEQ ID NO: 83903 - DNA, 234 bp, Glycine max
  Peptide Sequence Number=SeqID_200681
atggggaaaatgttgagtggtgataacctgactaagggcttttttgtgttgcctgagtctcacgtgccacccaaggtagatttggtggatctcatgtcggagggcaagggagacaagttgagggaggacacatcttttgaggaagatctgtcgacagatgaagaggaccctgtcaaggtgccgaagcctatggaggaggattctttacaagattcctctgaggagtcttactag

SEQ ID NO: 83904 - DNA, 195 bp, Glycine max
  Peptide Sequence Number=SeqID_200682
atgttgcctatattcaaggaagctagaatgaagaaaggggatgatcttgggaggttcaggcaattggatgagatcttgtttgttgatggatatcctggatacatgcagttaatgtctattgtggagaactgtatgcaagtagtttctgaaatcataggtgaccctattcttgtactcattctatttacaacttga

SEQ ID NO: 83905 - DNA, 873 bp, Glycine max
  Peptide Sequence Number=SeqID_200683
atggaagcatgctccggcgcgcattactgggctcgtgtattccaacaacacggccatacagccaagttaatggcgcccaggctcgtggcgccttatcgcatgtcggggaagcgcggcaagaacgatgcggcggatgcggccgccatttgcgaggcggtaacccgtccgagcatgcgtttcgtaccgctgaaagacgagcatcagcaggcgacgctctgtctgcatcggacccggcagggattcgtcgaagaaggaaccgctgcctacaaccggatgcgtggcttgctcgccgaattcggcgtcgtgctacctcggagcccggagcgactgcgaagagagatcacgccacatctggacatcctgccgggttgggcacgacgctgcatcagcgatttgcttgagcatgccggcaacattgaggatcggcttgaagaatacgatcgagcaatcagcggaatcgcccgtgacgacgagcgcagcaagcgactcatgagactgcgaggcatcggtccgaccacagcgagcgcgctgctcgcgagcctcggtggaggacatgatttcaggaacggtcgtcaggtagcggcttggctcgggctcacgcccggccaacacagcagcggaggcaaggcccggctgggcagcatcacgaaagcgggcgatgcctatctgcgcagcctgctggtcctcggagctcgcgccgtcatcgccaatctcggcgagaagcaggaccgcttgagccgctgggtccgaggcctagtcgaacgccgcggatattggcgtgcggccgtcgcgattgcggccaagaatgcaaggatggcttgggcggtcctgaaatacggagaggacttcaagcccgatccggttgctgcataa

SEQ ID NO: 83906 - DNA, 226 bp, Glycine max
  Peptide Sequence Number=SeqID_200684
cgctttgtgcgcagccattggaaatggcaagcaattccgcagcggacgtgactgggctgcatggatcggcctcgtcccgcggcagcatacgaccggcggcaagccaacgctcttgggcatcagcaaggccgcacccggcgattccgacacggaggccagcgtggaaaacgatagcactacaagggcttccccattgagcgcaagctcgagcgtggttttcggttga

SEQ ID NO: 83907 - DNA, 132 bp, Glycine max
  Peptide Sequence Number=SeqID_200685
atgtcggctgaaaaatatcagtcaggggctacttcaagaccgatgtcgactattgagttttctattcaatcccttaatgaaatatgcatgatgtcgacgtcgactgtcaattttttcaatcaatatcggtga

SEQ ID NO: 83908 - DNA, 726 bp, Glycine max
  Peptide Sequence Number=SeqID_200686
atgctgaatagcaatacagcggcgttatgcagaattctcaatcctgatgcacagaaagcgctgcttgactggtttgcaacgttgtcggaacgttatgagcgtaaggacgataaacggatcaacggtcgtgcctggcgggcggagttgaaaagaatggagccgccttatggcgtgatgatgtgtgaggggtatgacgctctccgtcaggcattgcttaaacatatgcgactacaacctcttgatgagatggcgctagcgctgtttgtcagcgtcgctgcggtgaaaattcgcggtacggatggtgttaacgtcctgtcactggccgacggcattatcttatggatggaagagtggcaacggcgcgaaaatcatcagccggaatcccaacgccttcgcgtatcatcgcaaagcctgaagcgtgcctggcgcgtatcggaaacgtttgaaggtgcgatggatgggtttatgggtaagcgtacccgccgaattggcgtggactatgtttaccgtccgatgattgccgctggggttattggtaaaacagcgaaaagcgcagcggagaaaattgctgcacaattcggcaaactgaaaaatgacaaaaacgcctccgatgaaaagaatctcgaaattgagcagatcgttcatgtcagtaatcatgaaattagtttgatcaagcatctggttgacacgctgattgccgataaacgcgaaccgaatgatgaagaa

SEQ ID NO: 83909 - DNA, 261 bp, Glycine max
  Peptide Sequence Number=SeqID_200687
atgagggaaaggagactggtaaatccttccgggggtcaccaccgccatttggtttgcgatcaaagatggcaacaagtccccacacgacatgaaaatcggggcgaactccaaaagcttctttgctggagtgttcctccccggattggcactcatgctagggttggaactgtcggcgaggcgaggttgcgtgtggctgagcggctgtcctttcttggacaggtgccaagtgatgcaatcctacctcgtaagggcattggatag

SEQ ID NO: 83910 - DNA, 108 bp, Glycine max
  Peptide Sequence Number=SeqID_200688
atggatgaatactttagggtatcaaactgtaaaagtgcaaaggatatgtgggataccctacaagaacatgagatggagtttgatcgaggccgtacccgaatcaaataa

SEQ ID NO: 83911 - DNA, 261 bp, Glycine max
  Peptide Sequence Number=SeqID_200689
atggctacgcattgtcaaaatatccttctcaagggatttcctctccgaggccaccttaacatcctgtctccatttttaggccttgtaattgattacacacccttggcaatcgattaccagaggccaatttccagataccactcaagattcatagttggccagtcgcaacacaagcctccttgcttcgtggtctttgttcttttattggttgactgccaggagctcgcctgtttaggtacgtcacaggttctcactgactga

SEQ ID NO: 83912 - DNA, 2139 bp, Glycine max
  Peptide Sequence Number=SeqID_200690
atgccgggaattgttagaaacggggttcatcatgatgaaggtgggagtaatgacctgaatggggaccatgattccacctctaaggaacccttgaatctggttaagtccccgaggggtggttccgtgagtccgcaaagaggccagggtgatgatggtgctaattttgggggtgatgaggtagttgagccctccattgaacagctttatgagaatgtgtgtgacatgcagagttccgatcagtcgccatcaaggcaaagctttggatcagatggcgacgagtctagaattgattcagagttgaggcatctagttggaggacggatgagggaggtggagataatggaggaggaagtgggggaggagaaagggctgccagaagggagttcaagtagtgaaatatcttctgcattgggtggcttgtccaatgataagaagttgaatcaggtggatgagattcaggaggttcagcctgcagctacaagttctggttcctcagaaaaatctatcaaagcatcgatttcaatggtgggacctgataatacttcacccaaatcgacttccaagggaaaaattcctctttcaaaagctcccattccaagaaataatggtaagcctttgaggaaacagattagtggggctactactggcgtgaagactactaagaattctcctatgggtaagtcagtgtcacgaaaccgagctgagagtacggctgagtcggcattagagaaacctgagcgggcaccggtattgctaaagcaagcaagagatctgatttcatcaggagataatccacataaggctcttgacttggctcttcaagcaatgaaactatttgagaagtttggtaatgagaaaccaagtttggagctggttatgtgtttacatgttacagcggcgatatattgcagtttgggtcaatatggtgaggcaattccgattcttgagcgctcaattgaggttcctgttattggggaaagccaacaacacgcccttgctaaatttgctggtcacatgcaattgggagacacctatgctatgctgggccagcttgagaattcaacaatgtgctacaccactgggttagaagttcagaagcagattttgggagagacagaccctagggttggtgaaacttgccggtatgtggctgaagctaatgttcaagctttgcaatttgatgaagcagagaggctgtgtcaaatggctcttgacattcatatagcaaataattcagctccatctcttgaagaggcagctgataggaggctcatgggccttatatgtgagacaaagggaaatcatgaaacagctcttgagcatcttgttttagcaagcatggcaatggtaagtaacgaccaagaagcagaagtggcatctgttgactgcagcattggagacacatacttatccttgtctcgatatgatgaggctgtctttgcatatcagaaagcgctaacagttttcaagaccagcaaaggagagaatcacccagcagtgggattagtctttgtacgtttggcggacctgtataacaggacagggaagataagggaatcgaaatcatattgcgagagtgcacttaaaatatatgagaatccaatgcctggaattcctccggaggagattgccagtggtcttacgaatatctcaactatctacgagtcaatgaatgagcttgaacatgcactcaagttactgcagaaagcactagagatatataatgatacccctggtcagcaaagcacaatagctggaattgaagctcagatgggagtcatgtactacatgttggggaactattccaaatcctacaacactttgaagaatgctatttcaaagcttcgtgctattggagaaaagaaatcatccttctttggtattgctcttaatcaaatgggactcgcctgtgtgcagtgttatgccttaagtgaggctacagaattatttgaagaagcaaagagtattttggaacaagaatatggaccgtatcacccagaaacacttggggtctctagtaatcttgctgccacatatgatgcaattggcagtatttttttcaatttactgtggtattatgagaagcaggctaataatagtaataatagtctgcctaatccagtcatgtcacccgtatga

SEQ ID NO: 83913 - DNA, 243 bp, Glycine max
  Peptide Sequence Number=SeqID_200691
atgattcctacaagttcaatgactatgaaattttgtggagagttagaaattagcattataaaactggggaaaaaggattcgttccaaaacatactttctatgagtgaagagttcagaattcggctatcaaaccaagtggtagtcaagttagacattagcaatataaaactgaggaaagggtttcattcccaaacatacattcctaacagtgaagaatttggcttccaaaccaagtggttttaa

SEQ ID NO: 83914 - DNA, 312 bp, Glycine max
  Peptide Sequence Number=SeqID_200692
atggatgctggcgaaacatgtataggaacgacgtgtggcatccatttcgccattggcatttgcggaatgggtttgaatttcgccagtcaacctggcgacacacaggggcagcaggctaggcctcaggtggcagggagtaggcgcaattttcaggtggcaagtgcaggcatgtatcgtcagcctagtcagcgaaacaggttgcatgtgggtgtcgtcattcccactagcgaaacaccctgtgctagggtgctgaaaattcttgtgagttccctcccccgctttgcctcttgttgcttgtttcgccaaagctga

SEQ ID NO: 83915 - DNA, 410 bp, Glycine max
  Peptide Sequence Number=SeqID_200693
gccaacaaagggagaaagaaggttgtcttcgaacccggagattgggtttgggtgcacatgagaaaagaaaggttttcggaacaaaggaaatcaaagcttcaaccaaggggagatggaccatttcaagtgaaagaatcaatgacaatgcttacaaagttgagctgcctgatgaagaatccgatttgaggaaaaatccttctcaagagggagagaatgatgaggacatgactaggagcatgggcaaggatccacttgaaggacttggaggacctatgacaagggctagagtaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 83916 - DNA, 273 bp, Glycine max
  Peptide Sequence Number=SeqID_200694
atgaaacacttgacaaaacgcaaactgaaagacaaatcgagctcagcaaagccagcaaagaagcaaaaacaaatttggaaaaatagccgaaaaaaggcacactcaacaataacagaacatcaatcaaccgcaagtctccaaacagcaaatataagaagtgaaacacaagcatgcataattgacattcacattcagattaagatgtcaaaaggggaatgcttgcagatatatctaatccagcttcctgcaacaacaatacactttatgatttaa

SEQ ID NO: 83917 - DNA, 395 bp, Glycine max
  Peptide Sequence Number=SeqID_200695
aagttgtgctaccgtttgaggtggaagttccttctttgaggatcatggcggagtccgggttgaaagaattagaatgggcccaagcgcgctttgaccaactcaacctcatagagggcaagtggctgacggctatgagccatggacgtttctaccaaagatgggtgaagaatgctttcgacaagaagatgcgcccacgtaggttcaacgagggagacctagtgctaaagaaggcgtcccaggccctaaaggacaataggggaaagtgggctcccaactatgaagggccgttcgttgtaaagaaagctttctccggaggagccctggtgctcgccaatatggacaacaccggattgctctcgcctgttgatgtgccatcattttcttctattttctaa

SEQ ID NO: 83918 - DNA, 240 bp, Glycine max
  Peptide Sequence Number=SeqID_200696
atggctatgaataaagcacctgaagatgcacatgttgatttagagcagcctcgacatgtagtggaggtttgccaagtaatagctgaaaggttggaaagactgttcaacctaaggataatgattgaaggaacagaagtatacattgtcactgaagaatgcctaaggatcgcaagaggtgtcactatgcaaagaaatgtctacgttcgatcgagacgaagacgacgtatggaagacacatga

SEQ ID NO: 83919 - DNA, 849 bp, Glycine max
  Peptide Sequence Number=SeqID_200697
atggttaaaaccagagatttgggtcgaactttaggaaaggttattggaagagccctaggaagagaagatgttcatgatatggatcacatagatgatgaggtccatgaacagcttgaagaagcagttggtgatgatgtggcgactgatgccgagggttttccaagcgaaccccatgacacatcagtgttaccggctccagagatcgaaggcttagtggctgccacaggattaagtcctttaatcacatgttcgttggacactggtgatcggggacttatgtctactttcatggagaggtggcataagaaaatcagtagtttccatccgtcggtaggagaggtgactatcaccttggatgatgtggcgtcgttgttgcattttcccattacagacgcgttccatacttttgagcctcttcatgtggatgatgtcatcttgctcttagtcaaatttcttgaagtaagtgctgaaaaggtaagagctgagacagtacaatgtcatggtgcatatgttcgtacaattccatggggcatatgtttgactatcctggctacgagacattatgatgagaggaaaccacgtgcctaccattggaagtctgggaagacattaccaatatcgacgtatcgtgggcgtttggatagattgacgtctgatattgtatgctggattccgtatggtaaccatcgtgcattcagagagtttgagaccattcctccacaccatgctgctccttctctatgtatagaagacattgatgatagatggattcagttttctggatacattgcaccggtgggtcagatatgtgtaacgcctaaccagtgttcaccaaactacatggattga

SEQ ID NO: 83920 - DNA, 814 bp, Glycine max
  Peptide Sequence Number=SeqID_200698
atggtgctgagctctgctttgttattcaaaggtggtgaaattgagcaaacagaaaatgtagatcagcataataggggagaagagcttggtaaacagagttcagacacatcggtgtttgtgaactcagagccattgcgtgaggaacaaattcagaatgctgtgaaatttctgtcgcacccgaaagttagaggttctcctgtcatccacagacgatcgtttctggagaagaagggccttacgaaggaggagattgatgaagcctttcggcgtgtgcctgattcacctccaagtgtgcagacagctggcataaatcaaggtgaactgtctaatgtcgaagttgcagattggtcttctgtgtttttcattttcacctttggactgagtttaaactgctattacattgactcatggctcactgtaatactcacagatggacaattgaagccatcatcaaacattcagcagcaaggccaaccacaggctttgcagctgactgtaccagcttctactggtgttactactacgcttggaaccttatctcgccgcagttttcactggtcacatgcccttattgcagttggattactggctgcttcaggtgctggtacagttatagtaattaagaattctattctccctcggttaaaatcctggatacgcaatgttgtcctagaagaggatcatgaccaatcaaagagaacaggctcaaaaccaacattggcagaagaagctgcacaggctgcaaaagcagctgcagttgcagctgctgatattgcaaaagcaagccaagaattactgagttcaaaaattgaag

SEQ ID NO: 83921 - DNA, 177 bp, Glycine max
  Peptide Sequence Number=SeqID_200699
atgttcgaggaagaggtggcagcaataggagaagaggctccacaagatccgccgagtttcgtgcgaccatgccatcccaatttccaactggggaactggcacgtgacgagccagtcaaaagtctataccgctgattcaattatatacattggggaagaaatacacgggttagactaa

SEQ ID NO: 83922 - DNA, 901 bp, Glycine max
  Peptide Sequence Number=SeqID_200700
atgatgcagctgcagcaacaccatcaagaggtggaagaagcagaagaagaggcttcgaattcttcttctcatcatcacaacaaggcatcgccttctcccagtttcagcagctactcatcggagacactcgccgagatcgccgccagggtaatcgaggagctccgccgcgaccctagttcactctccgtcgacgacgacgacgacgcacttttcccgccatgggaaaaccaaaacgacagcttcgtcccccaaaacgacaagccggcagaacaaaacgacgacgacgacgatgatttcgaattcgcgttcgtttcgcgagacttcacttctccagtctccgcggacgacatttttcacaacggccggatcaaggcgatgtacccaatcttcggcgttgtcgttccctcaaacgacgccgtttcgagcgttgttccgaataataataataataatattgcgaacagtactccgcggcgtcgtcttcctttaaggaagctaatgttcgaggagggagaaacggcgtcgtgctcgtcgtcaacggaagagagcgttgacctagaaggggtggtggcagcggaaggggcgtactgcgtgtggacaccgaattccgttgggagggaacggaagaagagcaactcaacggggtcggcgtcgaagcggtggaagcttcgtgttcgagatttgcttttgaggagtcacagtgacggaaaggataataataataataaacaacaacaacaacaacagagagaactcaaagaagtggtgtttcagattccgaagaacaaagtggcggcgaagcctcagaacggaacggaacatgcggaacagaacaagaggaagtccttcttaccttacaggccagaattggttggactttttgctaatgtcaatggccttg

SEQ ID NO: 83923 - DNA, 345 bp, Glycine max
  Peptide Sequence Number=SeqID_200701
atggggtcgtttttgaagtatttccacgaggggactcttttggacgtaaaacgcatgcatgtagcacccaaaccgccagtggaactggtgagtttggtctccgtgaagaaatcgccagtgctaatggcgatatacgtgccagtgggaaccgccagtcaaactggcgagttccaggtacacgatgaattcgattataacagtgttgtatttcaatggaagggcagtaaaaaagtgattcagattaaacgtggaattagtttcagtgctttgaagaaaaaaattggagacaaggaaaatatattgccttgcaaatttgtgatgacaaagacgttgaaacgatgctga

SEQ ID NO: 83924 - DNA, 243 bp, Glycine max
  Peptide Sequence Number=SeqID_200702
atggcgattgatttggtgactattctattaagtgtagcttcatcctatttgaggaactacaaccacaatgaacccaccgatgttgttagcaagatgatttggagatggccaggactcgaaagaattaaatgtttcttcgggaaagtggggaaaaagttctggtcactaacaacttcaggtggtccaggggcttggcagagaccgacaaatgctctctatgttcaaatgatagggagtccttga

SEQ ID NO: 83925 - DNA, 225 bp, Glycine max
  Peptide Sequence Number=SeqID_200703
atggagaagtttttgcagaagggaactgagattactgcacctgtgccaatgactccacttgctggaactactgggcttgggggttttgaagttcctttgtcaaaaggaagtactctgcgatctgatgcaagtgctctaaatgttggtgttctccatctagtaccaacgttggaggtgtttccattactagcagacccaaaatttttatatcaccaaagatggtaa

SEQ ID NO: 83926 - DNA, 924 bp, Glycine max
  Peptide Sequence Number=SeqID_200704
atggaggagccttctgcatatgggaagttaggccttgccaatctcttggaaatgagggaagagtgcttgagagaatttcagtttgttgatgcctatagaagtataaagcagagggaaaatgaggcatcgcttgctgttttacctgacttgctggtggaacttgatagtatggacgaggaatcaaggctgcttacactaattgaaggtgttcttgcagcaaatatttttgactggggatctcgtgcatgtgtggatctctatcataaaggaactattattgaaatttatagaatgagccgcaataaaatgtgcagaccttggcgggtggatgattttgatgactttaaagagagaatgttagggaccggggacaagaaaatgccccatcataagagggctttacttttcgtagataactcaggtgctgacattgttctagggatgcttccactggctagggagctcctccgccgtggaactgaagtagttctggttgcaaactcacttcctgccttaaatgatgtcactgcaatggagcttcctgatattgtagctgaagctgccaagcattgtgacattcttaggagagctgctgaagctggaggcttgcttgtggatgcaatgattaatacttcagacagctctaaggaaaatccttcttcagtccccttgatggttgttgagaacgggtgtggtagtccatgtatagacttaagacaggtcagctctgagctagctgctgctgcaaaagatgctgatctgataattttggaagggatggggagagcacttcatactaacctaaatgctcggtttaagcgtgatgctttaaagcttgcaatggtgaaaaaccagagattggctgaaaaattggttaaagggaacatatacgactgtatttgcaaatacgagcctgcaagttga

SEQ ID NO: 83927 - DNA, 267 bp, Glycine max
  Peptide Sequence Number=SeqID_200705
atgttgaactccagatattcttgtaaggtcaaaattgatcaaatgtatatacctcattcgtctaaatctagttgttcaaagagcataatatgtagaaactcaaatgtcttcccttccaaacagtggaggcccttcagaatcgcttggagctctgcctggacaatagaacaagggggagaagccgaaaatgaagcctctattctcattcctaagcactcatccacattgaatgaagaagacaggtccccatcacattttctagcttga

SEQ ID NO: 83928 - DNA, 571 bp, Glycine max
  Peptide Sequence Number=SeqID_200706
gttgatggggatggtaaatttgagagggttagtgggacaaatgttggtggtgggacttattggggcttgggaagactgttaacaaagtgcaagagttttgatgagttgcttgagctgagtcagaaaggagataatagaactatggacatgctagttggggacatttacgggggtttggactattctaagattggcctatcagcttccactattgcttcaagtttcggaaaaacgatatcagaaaaaaaggaacttgaagagtacagacctgaagacatatcactctctcttctacggatgatttcatacaatattggccaggtgaggggtcatgcctataccatggacactatttcttttgctgtacatttctggtctaatggggaagcacaagcaatgttcttgcgtcatgaaggatttctgggagctttaggtgcatttatgagttatgagaagcatggtttagatgacctcatggtgcatcagttggtggaaaggtttccaatgggtgctccatatacaggaggcaagattcatggccctccacttggagatttaaatgagaaggcaa

SEQ ID NO: 83929 - DNA, 675 bp, Glycine max
  Peptide Sequence Number=SeqID_200707
atggctggttctcttcaaaaccaacgacaacaacttcttggaattatcgaagaagaagaacaagagaaattgcagaaacagaaagaagagactgaggggaacaacaacaataataacaataacaagagtgacatggctcctacggcagggaattcgatccacaggtcgggttcgaggccgcaacttgatgtgagcaaagctgagattcaagggaatgtggaggagaagtatcccaccattttgttgcctaatcaatctgatgatttgtctcatcttgctcttgacattggaggatctctgataaagttggtgtacttttcaagacatgaagatcaatcatgggatgataaaaggaagagaagcatgaaggagccattggggctttctaatggtaacaggagaagcttccctattcttggtggaaggcttcactttgtgaagtttgaaacgagaaagattaatgagtgcttggatttcattcattctaagcagcttcactgtggtgggttggagtcacattattctgatggtgtgactgatcagaatggcataattaaggctactggaggtggagcatataagtatgctgaccttttcaaagaaagacttggggttagtctggacaaagaagatgaaatggattgtcttgtggcaggagcaaatttcttgcttaag

SEQ ID NO: 83930 - DNA, 270 bp, Glycine max
  Peptide Sequence Number=SeqID_200708
atgtacctccgaaagaggagagagagagaatgtggtgatgcaattgcaaagtgcaaacgaggaaggttgtgcgaggggaaggggaaaagttgcggactagcgatgccagaagaagaaggtaacggggagagggagggggaggtgaaggttcgtgggccaaagggaggcgaagggtcgtgggtgccagaagggagagggaaggtcacgggtgccgaaagggaggggggagaagggaggtcttatgagggggagatggaaggggaaaagtga

SEQ ID NO: 83931 - DNA, 195 bp, Glycine max
  Peptide Sequence Number=SeqID_200709
atgcataaaaagcggaaaaaagaagctagcgcaccaccaccgtgggccacttctacgccactgccaccgccaccaccaccaccatcgtcgtccccatggcggcctcgtgttgcggtgccatgcaccagtggcgccggagaggcacgccaccctccgtggtggctcctcctattgcgacgccatttcgaaagttag

SEQ ID NO: 83932 - DNA, 456 bp, Glycine max
  Peptide Sequence Number=SeqID_200710
atgctgagaatcgccgcaagcgcaaagagaattgttcaaacggcgtcgttggaggcgccaccgttggggattagggttctgccgcgtctctaccacgagagggtggtggaccactacgacaacccccgcaacgttggatccttcgacaagaacgaccccaccgtcggaacgggtcttgttggtgcacccgcgtgtggcgacgtcatgaagctccagattaaggttgacgacaaaacggggaagatcgtcgatgctcgcttcaaaaccttcggttgtggatccgccattgcttcttcctccgtcgctactgaatgggtgaagggaaagcaaatggaggaagttttgaccattaaaaacacccgcaccgaaaattccctctgccccctactatcccccgccttcgtacttggtagttttcacaccttgacatgggttgacttgggatttgatagctaa

SEQ ID NO: 83933 - DNA, 216 bp, Glycine max
  Peptide Sequence Number=SeqID_200711
atgaagagatctttatctttttctcaatggtcttggactctcgaaaatatttcttcaaaaatttctccaccacctcctcccatgtccgcaaccaaggagaacgagaataggttgagacggatgacatcttcaggaactccaactatttttactgtgttgcaaatctctatgtatgtagcaaggtgggcatatggatcttcattgggtagtccatga

SEQ ID NO: 83934 - DNA, 507 bp, Glycine max
  Peptide Sequence Number=SeqID_200712
atgcatcatacacaagtcttccggaagttacgaaggccaattccggaagcacttctgccggaattggccttcttaacttccggaagaccttcatccggaagtggaacaacagccactaataaaacttcaaatacggaacacgggaccaccaaatcttcaaatacttcacttcacgggaccacgaacagactgctgaagggaccaccaccgaaacaacagcaaacggaagaagaaacaaagcaaacggaagaagaaacaaagcaaacggaagaagaaagaaagaaagcgcacagcctgaagaagaaagaaagaaagcgcagtaaaacacagccggaagaggggaatcccaaggcagcaggaattggacaaagaagaatttgtgtcttccggaaaaacaaacggacaatttccggaggaacgtcatccggaatgtttccggaagaagcttcttccggaagacactggaattcttccggaagaagcttcttccggaaacattccggatga

SEQ ID NO: 83935 - DNA, 423 bp, Glycine max
  Peptide Sequence Number=SeqID_200713
atggcgaaactgcccttcagcaattcttcttacggaagaagattcttccggaaacttttccggaagaaccttcttccggaagaagaatttgtgtcttccggaagtactcacagacaacttccggaagaacgtcatccggaatgtttccggaagaagcttcttccggaagatttccattgtcttccggaagaagcttcttccggaagcacagaaggaggaaggtccggaatgaccacttccggaagaaggtcttccggaaattacgaaggccaattccggaagaagttcttccggaaactacttccggaagaccttcttccggaattggtcattccggaccttcctccttctgtgcctaaaaattcttccggatacactttttactgtttttcttctctatatactaaccggaaaacgaaatag

SEQ ID NO: 83936 - DNA, 261 bp, Glycine max
  Peptide Sequence Number=SeqID_200714
atgacaaaaggtgcggataaccatacagtacccccgcatgtcatcggacttgccgtctcgggattgcaaaagatgaccaaaggtgcagataaccgtaaggtgtctccgcatgctaccggactctcgggtcgctggatagcaaagggtgtgtacgggttaccgtcgggtgtctccgcatgccaccaaactctcgggtcactggatagcaaagggtgtttgcgggttaccgtcgggtgtctccgcataccatcggactcttag

SEQ ID NO: 83937 - DNA, 906 bp, Glycine max
  Peptide Sequence Number=SeqID_200715
atgcgggggtaccatatggttatccgcagcttttgtcatcccgaggcaacgagtccgttgacatgcggggacggcaagtctgatgacatgcgggggtaccgtatggttatctgcacctttggtcatctagagacggcaagtccgatgatatgcagggatggcaagtccgatgacatgcggggggaccgtatggttatctgcacatttggtcatctaaagacgacaagtccgatgacattcatgggtatcgtatggtcatccgcacctttggtcatcgagagatggcaagggtaccgtatggttatcgacaactttggtcatctagagacggcaagtccgatgacatgcggggacggcaagtccgatgacatgcagaggtatcgtatggttatccgcacctttggtcatctagagacggcaagtccgatgacatgcggggacggcaagtccgatgacatgtgggggtaccgtatggttatccacacctttggtcatctagagacggcaagtccgatgacatgcggggacagaaagtccgatgacatgcagggatatcgtatggttatccgcaccttttgtcaccccgagacagcgagtccgatgacatgcggggatggaaagtccgatgacatgcgggggtaccgtatggttatctgcactttttgtcatcccgagacggcgagtccgatgacatgtggggatggcaagtccgatgacatgcgggggtaccgcatggttatccgcaccattcgtcaaccaggggcaaacgggcctgttgacacgcagagactaacatcgtcttctgtaccttttgtcatcctgacccatgaagtcaggggcaaacgagcccgtttacgcgcagaggctaacatcgtcttttgcaccttttgtcatcctgacccatga

SEQ ID NO: 83938 - DNA, 402 bp, Glycine max
  Peptide Sequence Number=SeqID_200716
atgtcattaaagatcaaggaggaggtgaaaaagcagtttgatgtcggtttcttggcgatagctcgataccccgagtgggtggccaacattgtgctggtccctaagaaagataggaaggtacgaatgtatgtggactatcgagacctgaaccgagccagtcccaaagacaatttccctctgccacacatcgatgtcctcgtggacaacacaactaatttcgctttgttttccttcatggacggtttctcaggctacaatcaaataaagatggcaccagaggatatggaaaagaccacgtttgtcaccctgtggggaacgttctattataaggtgatgtcctttggctcaagaacgtcggggcaacctatcaacgggctatggtggctttgttccacgacatga

SEQ ID NO: 83939 - DNA, 151 bp, Glycine max
  Peptide Sequence Number=SeqID_200717
atgttgactggtgacaacgataaggaatggaaagatagagtttttttccatttgagtgttgctgatcttgactatgttctctatcaacaatttgaaacctctgataaggctatcaagcttatcgataccgtcgacctcgagggggggcccg

SEQ ID NO: 83940 - DNA, 954 bp, Glycine max
  Peptide Sequence Number=SeqID_200718
atgagcttcagcgtacgcaacgaagcgaccggcctagaatataacggcacatccctgaacagcctgtttgcccagcggcgcaacctgctctcccccgctttttatcgcatggtgcgtgatattttgcgctttaacaaagaatccctgagcttgttggcgcctggtaatgaaattgcactgggtgattacctgcaacagcacggatattcacaacaatttatccgtgactatattgtccccatgggcgcagccatctggtccaccgatgccgaacagatgttgcaattccctgcccgattttttgtgcgtttttttcaccaccacggcatgcttacgattgatgatagaccacagtggcgaacaatcgttggcggctcttcggcttacctgcagaaagtaaccgcaggctatcgtgagcacattcaactcaataagccagtgggctccattcaacgccagcatgctgcggtgaccgtgactacgctgaatggcaactcagagcagtttgattatgtattttttgcctgccatagcgatgaggccttaaaaatcctgggggatcaagccacatccgaagaaaagcaggtattgggcgccattccttatcaggacaatacggtgtacctgcacacggatgcccgtttgatgcctaaaagaaaactggcctgggccgcctggaactatcatgtgaccgaaaaacccagcggtaaagtacaggtcacctacaatatgaatatcctgcaaggaattaagtctgcaacgcccttactggtgacgcttaattacacggatgccatcgatccggcaaaagtgatcaaaaaactgcattatcgccatccgctgtatacgcttgagggtgcagaggcacaaacccggcatgctgagattagcgggcaccaccgcaccggttatgcaggtgcttattggcgcaatggcttccatgaagatggcgtg

SEQ ID NO: 83941 - DNA, 924 bp, Glycine max
  Peptide Sequence Number=SeqID_200719
atggaattttacgccaacctctatgaccccgaggataaatcacctaagcaagtgagggtgagaggtcatctagtgaagtttgatgaagatactcttaacacatttctgaagacccctgtaattttggaggatggggagaatttatgtacttattccaggtttgcactcctaagacctgatcctcaagagttggctgctaagttctgtatcccagggaagggattcgagcttaatgttgatgggcagcctttgaagatactgaggaagaatatgaccaccttagctcagacatggagcgttctttccttttctaacatgattcctacctcccacacatccgatgtgaccttggacagcgccaagtcgatttatggtattattatgaagatggatatgaacttggagtacctcatctgccaccagatctcccttattgcacaacatgatacatctagacttggattctctgccttgatcatagctctatgcaaggccaggggagtccaatcagattctagatccctggagaacttgagccataccattaacttggcatatattaagaagaactattggaatcttgatgatccaacagtgacatttagagggccaaggaaggccaggggtaagagatcagaggtccccactacttcagcagcaccagagacaccaactcctacttcttccacagctccagtacctctcattcagactccagttattcctcctacatttacacagctaccacttccagctcctttatatgcaggaccctcagatttttcatttacaccacagatgcttcattccatggcccagagcttacatagggggcagtccatcatcatgcagagcctacagggcttgggcttgccatccattatgagcatggatgagtttaatatgcaggtggcctggccatga

SEQ ID NO: 83942 - DNA, 117 bp, Glycine max
  Peptide Sequence Number=SeqID_200720
atggcactaatcggttgtcgatcctttgctggaattgggcttttcactacaaaagagaccaagaatgtgcgagttaagggagaccaagaatggaagaagtcgggaggtgatgggtga

SEQ ID NO: 83943 - DNA, 324 bp, Glycine max
  Peptide Sequence Number=SeqID_200721
atgacacttgttagcattgcacacctcttgggcttgagttattcctcaagtaaacccttgtgctttgctggtgcccaaaataggaataatgaacatgaaaataaagaaaaaggtatgttttattccattactttccttaactttttaaatagtgatcaagggcttcccatggaccgtaagagaataaaggtcattcctgagtggcctactacaccatgtgttgaggaaaaaagcccagagtttcaagaacctcggcatttgaggtcaaatccttttcaagggggagggaatgatgcaatcctaacccgcaagggcattggatag

SEQ ID NO: 83944 - DNA, 270 bp, Glycine max
  Peptide Sequence Number=SeqID_200722
atgttgcatctcgccatcaagtctggaaccccacgaattgattgcctagcactgttcgtctatcctccaccttcaaatcttatacggagtgtcatgaatatattgcctatggctgttcatgcgtcctccaccatcgagtctggagccacaccaattgattgcctagcgctattcgtctatcctccaacctcaaatcttattcggagtctcatgaatttattgcctagcgctgtttattcttcctccaccatcgagtttggagccccatga

SEQ ID NO: 83945 - DNA, 264 bp, Glycine max
  Peptide Sequence Number=SeqID_200723
atggcggacctaaggtctgagctcagggtagggtggcagacgttctgcaaattgagcgaactcatgttacggcttatggataatcttaggtgcctctatgtttatgatgatgagtatcaagctggtggacattctaaaaatgaggacttgtatttcgttcaaatagttatgagtaacgataacgatttaagcctgaggtatgatccatatccagaacatcttcctactatgggcaaaatagtgagtaaggctagagatcgctag

SEQ ID NO: 83946 - DNA, 420 bp, Glycine max
  Peptide Sequence Number=SeqID_200724
atgcattgcttgtgtgacacacgagtattcatggtagtatgtaaaataataaggggtagttgggctaagcacatatccaccgctaagcacagcttcagcgagcttagcacaaaagagaatctggcagagcatcagcatcaaagccgcgtgctaagcgcgagatcagtgcgctatgcgcaacaggtgccttcagccaggctaagcgtgagattgacgctaagctcaattccacttacccgcgctaagcgcgaaggtggcgctaagcgcagcgtcgcgatttcagagcctattcaaagcctgtcttgtacagaattagggtacaccttttacaacaccttttatgaaaacttctacacactcgtacagaacggccagggcacagaattccagagcagccacaggcctatttggggaaaatag

SEQ ID NO: 83947 - DNA, 177 bp, Glycine max
  Peptide Sequence Number=SeqID_200725
atggtgatcagcctgggccataagggagttcccaaaccaagtgacacaccccctagtagaagtagtcctcctcacaaggaactacaatgtgatatgaggcatgaaacatgggcaccatcaagtgcaaggaccatggatgaattaaagatcctaagacatcccctcgggcatgcttaa

SEQ ID NO: 83948 - DNA, 1090 bp, Glycine max
  Peptide Sequence Number=SeqID_200726
tcattacgacgcgctgggccgccgcagccgcaaggcggtgcgctacaagggcaaaaccgaacagacgacccgtttcctgtggcagggttaccggttgctgcaggagcagcgcgacgacggcagccgccgcagctggagctacgatccggccagcccgtggagcccgctggcggcgctggagcaggcgggcgacagccgctcggcggatatttactggtatcacaccgatctgaacagcgcaccgctggaagtgaccgacgcggcgggtaacctgtgctggtccgggcaatacgacaccttcggcaagttgcagggccagacggtggccggcgcggcgaagcggcagggcgcgcaataccagcagccgctgcgctacgccgggcaatatcaggacgacgaaagcggcctgcactacaacctgttccgctactacgaacccgaggtggggcgtttcaccacgcaggatccgatagggctgcgcggcgggttgaacctttatcagtatgcgccgaacccgctgatgtgggtggatccgttggggttatctgtagaaggagttccacatggctttaatagtttcggccaatttaaacaattcggtgaagcattacaggcaggaatgagtaaattaggatatcccggcacagtttcatatatgcaaggaagctccgtatcggggctatatcaaaaagcagaacagctgggaataggaaaaggagggcgcactggaccaattgatatgggtagtgaaatggctaagaaattaggtattgatgatacattgcaaaaattatctaaaatgtcaggaggtagacctgtgaacgcaatggtctttgagtctgctgctgaagttaaggctaaaggaaagggaactagaatacctgacaagttaaccattactgataattatattcctcactctaatgagtggttagaggaagataacaaagagtttagcacgataattaaggtgtctttcactaatgggaagaatccagaaaaactcagcaggtacaaattcttgaagaatgcgtttaatcaacttgatggattatcgatcataagtgatgagtgcatcgaagaagagtga

SEQ ID NO: 83949 - DNA, 726 bp, Glycine max
  Peptide Sequence Number=SeqID_200727
atggttgagattatatctgatgcaaatctcaaggatgaagggaacactggtaagagtaagactatactaaattggtctgattcattcaatgaagatgatgatgaagaccttcaagagacagaggccaatgaagctcttttggcaaagaacttatctgagctaaagcaatgttacttgaagaaacagtttgatccttcacccaagactgcaatactcgaggccgaatccaaggaattgcagggtgtgatcaaaacctacgagatgaaggggaagaagttggagtcacaggtgagtctcaaggattccaacataatttttcatgaggagaagttggaggaagctaataggcaaaacaaggcaatcaagaatagattaaatcaaagtggccaactatccattcttgataatcttcatataacaggattaagtcctagccacaagagggtgtggcttctacactgcttggccttctcctatgagcctcaggcttcaatcttccaagtagggaaagggtgcagattctctgatgtgtacatggaaagttcaaatgatgaaatcttcctctatttagaagtggaatcagatccacaagttgctgtcatagtagttccagggtttaggattgaaatgaaaaagagaccaagcttacctagaacccaaactgtgacaatggcagtgagatctaaaacaatggcgcagagacttgaagctttcctcgtaccttga

SEQ ID NO: 83950 - DNA, 216 bp, Glycine max
  Peptide Sequence Number=SeqID_200728
atgcagagttcaaaacgcgatgtctaccttggagcctacctgaatgggccaaccaactaccttaaaggaataattaacagtgctttgaaaggacttgatgatactccacagcctgaatccaaggctggtgctaggtggattgttgttaagaccattagaaccagagagattgaaggtgcttcgcatccagtgggcacaattttatctcaaagttag

SEQ ID NO: 83951 - DNA, 581 bp, Glycine max
  Peptide Sequence Number=SeqID_200729
tggctcgtcctaagagtgaagataaaaaacaagcgttactggaagccgccacggccgctttcgcccagtccggcattgccgcttcaacatcggcgatagcccgcagcgcgggggttgccgagggaacgctgtttcgctatttcgccactaaagatgagttgctcaacgagttatacctcgccattaagatgcgcttagtacagacaatgatcgccgggctcaatcctgacgaaaaacgcccaaaagaaaacgcgcggaacatctggaacagttatatcgactgggggatgcgtaaccctatggaataccgcgccattcgccgtatggcattgagcgaacgcattaccgatgaaacccgcagccaggtcaaagagagttttcccgagctgaacgagatgtgccagctgtcggtgaaagcggttttccttagcgacgcctatcgcgctttcggcgatgcccttttcctgtcgctggccgaaaccaccatcgagttcgccagccacgatccacagcgcgcccgcgatatcattgccctcggttttgaggccatgtggaatgcgctgcatgagagtgagtcgtaa

SEQ ID NO: 83952 - DNA, 354 bp, Glycine max
  Peptide Sequence Number=SeqID_200730
atgggacaaaagacatttttggctctggtcatgtttgttatggcatatggtttggcagcaacaacattcactgtatctcaaatccctccttcatgcaatggggatgaatcattactcaccttttgtgggccttatatggggaatatccatcccaatccaacttctgattgttgtaaagcagcaacttctgtgtttgacaaagccatggccacgggtcaaggtataagagatctttgcaattgcctgcgggttgctggaccagttttgaggtttcaaaaagaaaaaatgctaagccttcccgatgtttgtcggattaagctttctttttctatggagttatgtattgagggctaa

SEQ ID NO: 83953 - DNA, 207 bp, Glycine max
  Peptide Sequence Number=SeqID_200731
atggttgaagcacgaaagtcggtgtcccacatcgaaacgttgtcctctgtgattgcgtatcttcaagttaaggttttggtctcggacatgccaagcttcatgcaagtgcatgcctttcgttgtgcgagaaggacttatgatagcttggagaagtttagcgcaaaacacatcgctcataacataaagaaggggcatagggatgggtaa

SEQ ID NO: 83954 - DNA, 228 bp, Glycine max
  Peptide Sequence Number=SeqID_200732
atgcaatctgcgaagaaaacattaacttgtgggaacgaagttgctgacccagctaggctcataaatcttgcaaaaagtcaggcagattacatattgggaaaaaacccactaggaatgtcatacatggtagggtatggagcagagtaccctgagaagatacacccccgtggttcaactttagcatctgtggatatgcacccacaacatatccaatgtcatgactcatga

SEQ ID NO: 83955 - DNA, 411 bp, Glycine max
  Peptide Sequence Number=SeqID_200733
atgggagagaagaaagttttggctctagtcatgtttgttatggcatatggtttggcagcaacaacattcactagttatgtattgggcactactagaaaaagtagatttaacatcgtcattttaacatcggttttgacaaaaacaaatgttaagggtttggtttgtgaaacttgtggtcattgcaatgtccgtttggggtgctcactttgcaatccgtttagacagctgacagggtctcacaacaaggcccaacaacaagtgaatgtcaacattcatgtttgtaaggtattgtgcatggttgacaagtctaggacaaggagagttccaatgggtttgcacagtgttgacattggtgatgttaaacactatgtgtctcttcaggcagaaacacctggaattatcaagtcctga

SEQ ID NO: 83956 - DNA, 234 bp, Glycine max
  Peptide Sequence Number=SeqID_200734
atggatgttatgctacaccaccatcaagagcattcagttgaagttcatagttctttggagaatataacttctagactagaaaacatagagattaggctaactcttagcaacctccttaaccatgatgaagactctccaaatgcactcaaatggaaactcaagtttggcatcatcaaagacaaaaagagggagattattagagatatggggaacaacatgaagattaagctttga

SEQ ID NO: 83957 - DNA, 936 bp, Glycine max
  Peptide Sequence Number=SeqID_200735
atggcttttttaaagatctccattcaggaattgtatgctaatttgtttgaccctgaggataaatccctgaggcagtgccgggtgcggggcaagctgattaagtttgatgttgcgacattgaacgagtttctagagacccccgtggttctggagccaggggagagatattcagcatattccagattctgtcaaaatcacccagaccctcaggagttcgcctccagattatgcattccagggcgagggtttgtgctgaatgctgagggagtgccttggaagctcctgaggaaggacctcactacattggctcagacctggagcatcctatcttattctaaccttgtccctacttctcacacgtccgatcttaacatgggcagggcgagatttcctacactcatcactgctttgtgcatagctagaggagtcgtccctgattccctcaccttcgagtccctgagcctggccattaatttggcctatatcaggaagaactgttggaacccagatgatccaaccatcacatttcttgggtcccacaaggctagggctcggggcccctcagacgcttctacttccactccaactcccacactagcaccaacacctacacctacaccagttctacctccagctcttgctccaacaccctctgaccccttcacttcaagcacatatatgatagtaccgatgctgcagagcctccaccatggcttatgcttgccttcttcctcgaggggaggtgaggctcctatagcccgggagccacagccagaggcggaggcggaggagacgccagatgacacacctgcagccacggccaaggaggtcaccaataagggagacggcgcagcagagaccggtgttgacacaaactatgtggcggatatcattgcggcgcagagcacctgggatccttggcccactccagcatag

SEQ ID NO: 83958 - DNA, 914 bp, Glycine max
  Peptide Sequence Number=SeqID_200736
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagcaaccagcaataaacatgtattggctgagaatatcaccaaagatcgacaagataacctcgatgcactacatgctcaccgcagcaatagtgccatgaaccacttttccgatcctcacactgtcttggcttccaatgtttcccttcagaaacacccatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 83959 - DNA, 531 bp, Glycine max
  Peptide Sequence Number=SeqID_200737
atgcctatgatattagccgagggcgagactttaccagcatattccagatactgcaggttgcccacagattataaagagattaaggctgccttatgtataccaggccgagggtttgttttgaactttgagggccatcctgggaagattctcaggaaagatttgacgactcttgctcaagtatggagtattctctcatattccaacctggctcctacttcacacacctcagacctgacagtagatagagcttggttgatctttggcctagtctctcagatggacatgaatgtgggagcccttatctctggccagatcacatctatagcccagtctaactcttctagacttgggttccctgctctgatcatcaccctgtgtaaggccaggggggctaggcgggcaaggacgaggtcagttgagcctccttccacatctacaactcctattccagcacgtacctttgcagctccttctgtcccagcttctgcagatgttcagtgtcttgaagccatgcttcagagcatccattag

SEQ ID NO: 83960 - DNA, 710 bp, Glycine max
  Peptide Sequence Number=SeqID_200738
cgccaggccgcgctgctggccgagcggctgacggcggccggcattcagccgggggatatcgtcgcggtggcgttgccgcgctccgtgcgcctcagcctggcgctgacggcgattgtgcagaccggcgccgcctggctgccgctggacaccggctacccggacgagcggctggcctacatggtggaggacgccaagccgcggctgattatcaccgagagcgcgttggatgcccgctttgccgcgctggcgccgacgctgctgttcgatgcgctggacgacagcgggcgcgaaccgcctgcgcgcctgccggcggggaacggcgattatcccgcctacgtgctgtatacctccggctctaccgggcggccgaaaggcgtggtggtgaaccaccgggcgatcgtcaaccgcctgttctggatgcagcacgagtatgcgctcgatgcgcaggacgtggtattgcagaaaaccccgtgcagcttcgacgtttccgtctgggaattcttctggccgctgatggtcggcgcgcgcctggtgatggcgccgccggaggcgcatcgcgatccgcaggcgctgacgacgttgatcgacgactatggcgtgaccacgctgcatttcgttccgtccatgttggctatctgggtggaggcgctgaacgagcgggcgccacagcgcgccgccgccagcctgaaacgcgtgttctgcagcggtga

SEQ ID NO: 83961 - DNA, 1179 bp, Glycine max
  Peptide Sequence Number=SeqID_200739
atgacaagcagggttgaggacattgcggaaaaaggaaccaaaacaacttcagtttcatcgatacataatatatatcttctgcttcatcacataatattatcagttctgcttcatctatacatacaaaatattactaacttagttcaacatatattgttggcaatcatgttgagcactaacccaatagctatccttgtgatcttaatttccctcttctattcagcatctaaggttacctccaccagaatactcgataggctctttctcccttcattattgacaggccctcagtcccttgcatttgactccatcggtggagggccttacactggagtttctgatgggagaattctaaaatatgaggaaacttattctggtttcgtcgaatttgcttacacatggcaagacaggaacaagacaatatgtgatggcatttctgacttctcaacacttcaagaaacatgtgggaggcctttaggattgagtttctactatcagacaggtgaactgttcatagctgatgcttatttggggcttgtgaaagtaccttactatggaggtgctgcaacccaacttgtcgctcatgcacagggaagtaatccttttggatttctttccggtgtggatgtagaacctgataccggaaccgtttactttacagaagctagctctggcttcaagctcagggatatccgtgaactactaaaaaacacagatgattattctggaaacctatacaaatatgatccaagcaccaaccaaacctcattgttgctcagcaatcttgctgtggcagctggggtggcagtaagtggcaatggttcatttgtccttgttagtgagtgcaatgcccacagaattcgcagattctggcttgctggacctaaagcaaatacttcagaagtattcttgcagcttccaggaagaccagagaacataaagaggaactccaaaaatgagttttgggtggcaatgaactatccttttgggacacctccacccccaagacctcctgttttgcctctaggactcagagtcaatgaggatggtgaagttttagaggctgtgcctcttgtcgatgagtttggtactgaatcagtcagtgaaattcaagagtttaatggaacactctatgcttcctccctgcatgtttcctatgccaacattttcaaagtctag

SEQ ID NO: 83962 - DNA, 333 bp, Glycine max
  Peptide Sequence Number=SeqID_200740
atgagagttccactgagaagtttgcctagacaatggagaccacaagagactgcgctgagagcatcaaagaacctagacaacctatctattgaggaacttattggtattctcaaagttcaaaaaattgaactccaacaagacaatgaaggaaacaaagggaaatcacttgcactaatcgtccataagaccaagaaaccttcatcatccaaatcattgcctaaagcatcatcaaaagtagttagtgtggataattcctctgatgatgaatatgaatatgaagaagctaacgaagatgatttgtcattaatctgcagaaagatcaggaagatgtag

SEQ ID NO: 83963 - DNA, 264 bp, Glycine max
  Peptide Sequence Number=SeqID_200741
atgactgctcttacctgtatggatgctggcttatgttttatttcccacatgttggctgacttgaaggacttcaagaaagtcaatgagatctatgctaaatttaatgatatctcatttaccaaaaacaaagaccagataggcttgaatcattttaggccaattaaacctttgggatcaggagatacgggcaagttttttcctcattctcttttcaacttcccaacatttgaaacatgcatgaacaggaggtggcatagggcttaa

SEQ ID NO: 83964 - DNA, 591 bp, Glycine max
  Peptide Sequence Number=SeqID_200742
atggagagggagatgataacaatgataatggacatattatcagtgttctactatgagaaaatggtgggttatatgccttcgagctttgcagatctggtatttgcgggcaaaaggattgaagtgggcctaaaaaggggaaaatttgattatgccgcttcaacaagtgctggcaataggagaatcataacaggtggagctaagaaaaaggagggagatgcctatgccgtaaccacaactcccacatggccaaagtcccaacaaattcctcacaagcctacttaccaatatcccctgcatcagtacaattactcagccaatgtcgaatctcctcccagtccgacgaccatccaacaaagaatgcccactcaaccacaagggcctctctcacaaaatccatttcatgcacagtctcgaccaactggatatcccaaccccaacacaaacacaaacccaaggaggaacttcccagaaagaaaactcgtgaagttcaccctgatatcgatgccttatgccgacctactaccgtctttgctcagcaaccaaatggatgtggtgatcccggggaaggtctatcaatatccttttccctga

SEQ ID NO: 83965 - DNA, 290 bp, Glycine max
  Peptide Sequence Number=SeqID_200743
atggtccctcagtggcatatacggggtaaggctcgaagtcagccagagcgtggtctcgaggggaacaggagcagagtggtcggtgttctcatcaggcacatgtacaacattgggtggtgcatagttgggaggcaagctgtatggtgggaaagaattcttgctttgcacaacatggggaccgcattggcagcacttgtagtggcaactgcagccgtgtggacctccattattttcttcatgctcaaaatggcctccatcatggcggccatttggtctttcatggcctccat

SEQ ID NO: 83966 - DNA, 438 bp, Glycine max
  Peptide Sequence Number=SeqID_200744
atgggatttgttgagcatcaactacgaaggtacaaaagatgttcaacttggaatagtgccactctgatgaggcactatgagagtttctccatgaaagaagaattatttgtggatgacatgtttggaagacttcaagttcttataaatggacttgaagctctagggcaccttcaccaaagctcaaataaacctcaagattttagacaactttcccaagattttgatgccctcatgtctaaagagaccatctctagaaaagaagaaaataaaagctattctaaagctcttaaagtacatattgttgagtctgaaaagccatacaacaattctaaagagttcatgaacgatgaagttgctcttatgtctagacaattcaaggagatgctgaaaaagaaaggacacaagcttcaagaagaaattcaaggaggaaagcaatga

SEQ ID NO: 83967 - DNA, 321 bp, Glycine max
  Peptide Sequence Number=SeqID_200745
atgcattgttgtgtgctttatctgaagaggaatgtacaaaagtcttgtcgcaacctacccttcggcgggaaggtgaggcgaaatgtcgaagaacaaaaagaggccatcaaggcattggaccttgaacgatctcaagtgacttcaatggaggaaatgagggcatttgggactatggtagctcacccaggtgagctaatgcttagtcctgaagaaactggctcgcccaggcgagttggttccttcaaccctaagaaatttggggcccaggcaagccaaaggctagcctgggcaagccagggtccagaaaattgcctgaaatga

SEQ ID NO: 83968 - DNA, 312 bp, Glycine max
  Peptide Sequence Number=SeqID_200746
atggatctttgcccctactgctcccaatacagttgtgtagtttgttgcgatgtcaacatcgagcaacaacaaacttcattgttcgctcatcaccactatcaacaagaacaacaacaagccatcagagaagctttgccgatattgaagctggaattgggtttcaaaagcttggtcaatgtagagttcttcaagttgaagtgcatggctagaaccatggattggattgcattgttgcttctgttacaatttcataaagggaaaatgcaaatcttaatgggtaatgcaaggaaggcgaagacatttttgtcctaa

SEQ ID NO: 83969 - DNA, 654 bp, Glycine max
  Peptide Sequence Number=SeqID_200747
atgcgggctggtacaacctggccaatgcacttggcccgccaaggcaactacgacgaagccattgccgcctacgaccgcgcgctggcactgcatcccggcatggccgacgcggtcgccaaccgcgccgtggtcgatgccgcgcgcaagcgcaagcagtcgggtggcaaaggccaggatcagcagaagccaccgcagaacgggcagcagaagccaccgcagaacggccaggggcagcagaatccccagggccagcagccgcagcagggccagcagaatcccggccagggccagccgcaactgggccagcaggggcagcccaggcccggtgacgacaagaacccgtcgagcccgcagcccggcgagcgtggccgcgatggacagcaggcgccaccacaggtggaggatgccaaggcgcaggcgcaggcggatgagcagcagcgccagcgcatgcagcaggcaatgcagcaggcacgtgagggcaagggcgaacaggatggcaagcccgtgccaggcagcgacggcaccaccccgcgccaacgcgaggagcaacaggcggtggaggcgtggatgcggcgcgtgccggatgatccgggcgcattgctgcgggccaagttccagctggaaaacgaacgcaggaagagggaagggcgatga

SEQ ID NO: 83970 - DNA, 615 bp, Glycine max
  Peptide Sequence Number=SeqID_200748
atggcgcaggtgccgcgattaaaacgtttcctgcacgtcggtaccgtcatgtcctgttcaccggagccgggttcgctggtggcggagagcggcgagtttgaggaagacgccgagcatctggtggaatacacccgttccaaatccaccatcgaacagctgatgcgccagcgctgcccgcaactgccgctgaccatcgcccgtccgtcgatcgtggtgggccacacccgcctgggctgccagccttccagcagcattttctgggtgttcggcatggcgctgatgctgcgcaaattcatgtgctcgctgcaggacaatatcgacgtgatcccggcggactactgcgcggatgcgcaggtgatgctgatgaacagcgaaacgttggagaacgacgtttatcacatctccgccggtgaggagagcagcgtcagctttgccgaaatcgaccgcgccatggcggcggcgctggaaaaggcgccggtgggcgatgagtatgcgcaggtgacctatgacgcgttggtgaaaatgcgccgccagctgaaagacattttcggcccgtgcaacgagcggctgatgctcaaggcgatgcgcctgtacggatcgttcgccatgctcaac

SEQ ID NO: 83971 - DNA, 486 bp, Glycine max
  Peptide Sequence Number=SeqID_200749
atggtcaccgttcacgagcaatcgtttcgacccaaactacttcccagtcttccgttgtcgtatgagttggagagtggggccgtccgtctgcaggagagcgaggcggaaatctcaaaggagatcaatatggaagccgaaacctcaacacgtccccgcacgcagttggatgagctggttccttctcgctatgcggtcaaggtcggcgacatcgaagtcatcgtgatcagcgatggtgtcctcgcaccgccggcggagtccatggccacaaacgctgacacgaagagcctaaacgcatggctcgacgatcgacttctcgcgcacgacacgtttggctgggcgctcaacgcagtcgtggtgaaaacacccaagcagacgatccttatcgacagcggcctcggcgaggaatacccagatttcccacgcgcaggacacatgatccagcgaatggaagcagcgggtgtcgaactgggctcggtcaccgacgtg

SEQ ID NO: 83972 - DNA, 417 bp, Glycine max
  Peptide Sequence Number=SeqID_200750
atgtcgcaaccgtcaaatcacccgtcacccgtcaggcagctgcaggttccgcccgaaagtgcgttccatactggaaagaagggtgcagaggaactggttccctcgcgatacgcggtcaagatcggtgacatcgacgtgatggttgtcagcgatggcgtcctgccactgccgacagtaatgatgggtcataatgccgatcccacagttcgtgccaattggatggtcgaccagtttcttccgccggacgcgttcgactggccgctgaatgcggtggtcgttcgtagcggctcgcagactgttcttcttgatgcagggttgggtctcgatccggacctgaacctgccgcgcgcgggacagctgctacagcgtcttcagcatgctgatattgacttgcgtccgttacggacatcgttctga

SEQ ID NO: 83973 - DNA, 294 bp, Glycine max
  Peptide Sequence Number=SeqID_200751
atggccaccacatttgcatcctcatctccacaaattgcagcttcttcttttactcttccacccttccaatccaaaaagttcatcctttttcacaacccagtacttcaaaaaaacaacatactccgacccattcttcttcctcctcctcctgctgctgctgctgcccaagatgcggtggatgctgcggaacaattgtacaaaaccaccgatcaaggggtggccacagtcgtatccgctcttttctttattgctttcgttggcctatccgctatcactattggggtaaaactgtaa

SEQ ID NO: 83974 - DNA, 346 bp, Glycine max
  misc_feature (8)..(8): n is a, c, g, or t
  Peptide Sequence Number=SeqID_200752
gtgacagncggagatacccaagtggttatccgtataaagactctttcgctatccgtcagactcagagtccggcgggggtaccgtatggttatccgcaccttttgtcaaccaggggcaaacgagcctgttgacacgcagagtctaatgtcgtcttctgcaccttttgtcatccagggacagcgagtcaggtggcaggcggagataccttatggtcgtccgcacctttcgtcaaccaaggcgaacgagttcgacggtatcaagatgatacattcaagcccgacgatgcacgagattcttctctgctgggcgaggacaatcaagttcgatagcgtgtggaaacgtcgtg

SEQ ID NO: 83975 - DNA, 300 bp, Glycine max
  Peptide Sequence Number=SeqID_200753
atggctgaagagccaagaagagttactctggaagattattcaagttctaatgtgccacaatttttcaccagcattgataagttatggttgcatgatgtaccatctgtgggggagctcatgaatctggatgttgtattcctattgaagaacaccccactcatgaagtcaattacacgggaaatcagcccaaaaacaattttaatgcaagaggattttcaggattccaacatggctagcaatataatcaacaacagggacaatggaggaaccaccctggaaattagttcaatagagatcaag

SEQ ID NO: 83976 - DNA, 774 bp, Glycine max
  Peptide Sequence Number=SeqID_200754
tcagagggctacacatcgtcaccatcagagtgctacacgccctcacctttagaggactccacgtcctcgccttcagaggactacatgtcctccccttcagaggactacacgtcctcgccatcggagggctacacgtcctcaccttcaaagggctccacgtcctcgccctcagagggctgcacgccatcgccttcagaggactgcatgtcctacccttcagaggactacatgtcttcgccatcagagggctacacatcgtcaccattcgagggctacacaccctcacctttagaggactacacgtcctcgccttcagaggactacacgccctcgccttcagagggctacacgccctcgccttcagaggactacacgccctcgctttcagaggactacatgtcctcgccttcagaggactacacatcctcgccttcagagggctacacgccctcgcctttagaggaccacacgtcctaaccttcagagggctacgcgccctcacctttagaggagtacacgtcgtcgccctcagagggctgcacgccatcgccttcagcagactgcatgtcctccccttcagaggactacacgtcttcgccatcagagggctacacatcgtcaccatcagagggctacacgcccttacctttagaggactacacgtcctcgccttcagaggactacacgtcctccccttcagaggactacacgtccttgccatcggagggctacacgtcctcaccttcagagagctacacgccctcgccttcagag

SEQ ID NO: 83977 - DNA, 187 bp, Glycine max
  Peptide Sequence Number=SeqID_200755
atgctaaagttgctgtcaaagataaaggttaagaaaaaccatacttttccggtggtttacgaatgcgagttctatgacgtaaagggattggttctagttgaagcgctgaatcagcaaccagagaatgatcgggagagggccttggagggattgaaggctaaattagtggaacaatcggacgtctttg

SEQ ID NO: 83978 - DNA, 363 bp, Glycine max
  Peptide Sequence Number=SeqID_200756
atggataaagttgatatctttgtccctcatcctctcacaaacgcatgtttgcttattcaactttcaccggaatgtgggtgtaagccattggtctgtttgctcaagcaacctgcgctcctgagtgttgacttccaagaccgttcaatcagagattactcatcttgcacgttggtggggagaagtgagttatcaagaataggatgttggacaaatggcctcagaaaaaggggggttgaattaagatgcaaagactattccccaattgaactatcaatctctctttttggattaacaatgcacatagggacaaccgttcccttgtgttcaagaatcctctactacaagagacccatggtctcttaa

SEQ ID NO: 83979 - DNA, 252 bp, Glycine max
  Peptide Sequence Number=SeqID_200757
atgaaggcccggaggcagagacactatcaagactatcaattgttgctgaaggcccaaactaatttgaaggcccaaacttatcaaggtaatccttgtggcgtctaccctgacttatcttccttcaccagaagtggcgtctaccttgacttatcttccttcaccggaagtggcgtctaccctgacttatcttccttcactggaagtggcgtcatccaaatattcgtagcctgtatcaagcgatccgcctcgtaa

SEQ ID NO: 83980 - DNA, 432 bp, Glycine max
  Peptide Sequence Number=SeqID_200758
atggagagaagtatgatagatgctgccagtggtggagcccttggagacatgactcctgctgaagccaggaatttaattgagaagatggcttccaactcccagcagtttagcgccagaaatgatgccatagtcattagaggagtgcatgaggtagctacaaactcagctgcatcatctgagactaagaaccttgaaggcaaactggatgcattggttaacttgcaacttggagcaattgagcagcctgaagcctatgctgcaaatatttacaatagacctcctcaacctcagcagcaaaatcaaccacagcctcagcaacaacaacaacaacctgctccttccttccaaaatgctgctggcccaagagcagtttccaacaaaaaaatggaagaggcagagaaagagatcttggaaacgtttagaaaagtagag

SEQ ID NO: 83981 - DNA, 689 bp, Glycine max
  Peptide Sequence Number=SeqID_200759
ggctagacgccctcgccttcagaggactacacgtcctcgccaacagagggctgcacaccctcaccttaagaggactacacgtccttgccatcagagcacttcacgtccttgccattagagggttgcacgccctcgcctttagaggactacatgtcctctccttcagagggctacatgccctcaccttcagagggccacatgccctcaccatcagaggactacacatcctcgccatcagagggctgcacaccctcacctttagaggactacacgtcctcgccttcagagggctagacgccctcgcctacagaggaatacacgtcctcaccatcagagggctgcacgccctcaccttcaaaggaatacacgtcatctcctttagagggttgcacgccctcgccttcagaggactagatgtcctcgcctttagaggactagatgtcctcgccttcagagggctggacgccctcatcttcagaggactacatgtccttgcctttaaagggttgcacgccctcaccttcgtagggctgcacgccctcgtcttcataggactctacatctgcgccttcagagaactcaaggattacgctcgcaagatacccagtggacccggagaagtccaacagggtcctgcgctttctagctctaattactggactttcatcaagaagtactgcgccccttag

SEQ ID NO: 83982 - DNA, 243 bp, Glycine max
  Peptide Sequence Number=SeqID_200760
atgccgatctccccctatggaagtttcagttgggattgcacccataagacacccagtggacctggaggagccgaacagggccctggggtttccagctctggttacgggcctctgtcagtcctacaggggatcgcgcctgcaagatacccagtggacacggagaagtccaataggatcttggggtttccagctctgattacgggcctttgtcagttctacagagtgcctgtcgcccccaacaag

SEQ ID NO: 83983 - DNA, 279 bp, Glycine max
  Peptide Sequence Number=SeqID_200761
atggcatgccttcttgcagatatagttcagtactttgttgatgctaagctggaatttgatgcttcctatatttatgaagatgttatttgtgcaattgaccatgtccatcgaagtggcctggttcatagaggaatactatctgactcacacagatacttagtgaaaaatggaaagatattacgttatcttaagatgctaagggagcaggggaagaagcttttcctgttgactaattctccgtattattttgtggatggagggatgtgttttatgttggag

SEQ ID NO: 83984 - DNA, 875 bp, Glycine max
  Peptide Sequence Number=SeqID_200762
gtccagtccctcgcgctcgaccaggccgcgcgccgcgtacggccggatcagctcgcgccccagcgtcaggcagtcgtagcgcgacaggtccagcggcagcggctgcgccacctggtggaaacagatcagcaggccgataccgtgtcgtgcacattgccggtctgcaggctgcagctgagttgctgccccgcgctccagtcgcgccaccaacccggcaggtgggtcgtggccaaggcataggaggtcgccaagcgcagctggttgcgcgccggcacggcggcgatgcccgcgcgcgcctcgaccagctggttgaccagttcgatggccgcgacgcggaagcgctcgcccgcctcggtgagctgggtcgggaaagcggaacggtcgatcagccgcgcgcccgcccagttctccaggctctggatgcggcggctgaacgccgcctgcgacagattgcgggcctcggccgcgcgcgtgaaattgcgcagctccgacagggtgatgaagtcctgcagccaccgggtatccataccactccttgcgcgattcgcatgggccatgcgcgccatgcatggcggcgcatgcgtacttcgcattggacgtccgcgccgcgcccccggacactgtgtccgccggttccgcattggaacctgcccgcattgaaacctgccttttgccggagtgtaaacatggatcaaaccctgcgtgcggcggcccgcgaatacctcatccgctacggcggcgacactttcccgaacctgttcaagtcggccaagggcacggtggtgcgcgacgacaccggccgcgagatcctggatttcacctcgggccagatgtgcgccaccatcggccacaaccacccggccatcgtcgacgcg

SEQ ID NO: 83985 - DNA, 718 bp, Glycine max
  Peptide Sequence Number=SeqID_200763
agggctacatgccctcgcctttagaggactacaagtcctcgcctgcagaggactacacgttcttgccatcagagggatacatgccctcaccttcagaggactacacgtcctcaccatcaaagggctacacgccctcaccttcagggggttacacatcctcaccttcagagggctacacgccctcaccttcgaagggctacatgccctaaccttcagaggactgcacgtcatcgcctttagagggctgcacaccctcgccttcaaaggactacacgtcctccccgtcagaggactacacgtcctcgccttcagaggactacacatcctcgccttcagagaactacacgtccttgccatcagagggctgcacgccctcaccttcagagtactacacatcctaacaattaatgggctgcatgccctcacctttagagggctacacgtcctcaccattagagggctgcatgccctcacctttagaagactagacgtccttgccatcagagggctgcacgccctcaccttcaaggtgctacatgtcctcacctttagagggctacacgccctcaccttcaaaggactacacgtcctcgcctttagagggtcgcacgccttctccttcagagggctgcacgccctcgcctttagagggctacgcgtcctcactttcagtgggctccacatccgcaccttaaggtcctttgcccttaatgcttaa

SEQ ID NO: 83986 - DNA, 279 bp, Glycine max
  Peptide Sequence Number=SeqID_200764
atgtcaggttaccatctggtcggttcatgtaatgggttgcactgtggggttagcgaaataccagaaggataccatgtttgtttctggaacaaggcgacaagggtgatatccagagaatcgtcagcgctgtctttttccccgggcatcggtcgtagaacaatgtttgggtttggcaatgatccgtcaagtgacaaatacaaggttgtagcaattgcattgactatgctctcacttgatgtatctgaaaagactgagatgaaagttttatggcgcgggtga

SEQ ID NO: 83987 - DNA, 336 bp, Glycine max
  Peptide Sequence Number=SeqID_200765
atggaaggttcccaacaaaacactcactatcctaaggaaaaattgcctaaaattattacacacaaatggaagtttggtaacctattggaggctcccaacacacttccaatgaaaggcctttttgttacaaaacttgaaagcaatgaagtgcttcttagtccaatagctcttaaggtggttggcccctttcttcttgactcaaattcttcaagggttgacaccaatcctccttacaattccctatatggcaacccacaaacaagaaaacaaagagacaaaagcaataaccaaagaccaaacaaaaatgaaatgaaagctaaaccaatggatttttaa

SEQ ID NO: 83988 - DNA, 366 bp, Glycine max
  Peptide Sequence Number=SeqID_200766
atgcaatcctaccccctaagggtattggatagaagactccaagaggattgggctagagcagctaaagaaggccctggggttctcatgaacctaagggtagatttttttagcccatgggccaaggttggatccagtcttctttgtaaatattcaaataggggtgagcttagctattacagggggtgtgtagctaagctctaccttctcatctcaaggagcttctctaggaatcttctcaaggaagtttctcaagagagtttcttaaggaagcttctcaagaagcttcttaaggaagtttttctcaaagaagcttctcaaggaagttttctcaagaaagcttctttgcttctcaaggaagctacctag

SEQ ID NO: 83989 - DNA, 510 bp, Glycine max
  Peptide Sequence Number=SeqID_200767
atgcgcaccagcatgaccaccttgacccagacgtggatgacattgctgctcagcaatgttttgcctagcgatcataactccgatctccctcttccaaagtgccagttggtgtatgccatcctgacacggatgagcgtccacgtggcccaggtgattgctgacgccatttatttgtttgaagcattgatcacgggcctctgccagtcgttcggggttcccgtcacccccactaaggtgatccgaccgccgatcacccaggccttcatcgagaagtattgcacgcctaggcaggtgcagggtgatgcacctcaggtcgcagacgcaccgccaccacctcatcaggccgatcccgctggatcactaggcatggagcgttatctacagcacttggttcgccagcaggcggccaaccaccgggggcaggtgcagatacatgaatgtctctactggtttagcctcagtcagcaggggcagggtttcactccttttgcatgccctactccagagtag

SEQ ID NO: 83990 - DNA, 797 bp, Glycine max
  Peptide Sequence Number=SeqID_200768
gattaagtccactgatagattgttcagttattactggcgatcctggacttatatccgcatttgtggagaggtggcacagtgagactagcaccttccaccttcttgtaggagagctgatgatcacattggatgatgtgtcgtcaatcctacattttcccatcactgacgccttgcacaatttccacgctctttctacggaggaggccagatttttgccgacgaagttgctggaagtgtctgccgaggaggccagagccgagacagcactcacacgtggagcatatgtacgattaggatgggttcaagacatttatgagacgagatgtcaggcccggcggtggattgtcgcagctcgtgcttatctgctgcaccttgtcgattgcactctttttgctaataagagtgcaacatacgtgcatgtggtttaccttgacactttccgggacctcgctcatagtggtggttacgcttggggagttgccgcgctggttcatatctatgaccagttagatgaggcttgtaggaccaccacccgacagcttgcggggtacttgacgctacttcaggcacacatgaagggcatcacaggagcaccctacagcgcccgttgtgatggtttgaccgtcatagatgtgtcctggttgccgtacacggagcatcggggggttagggcgtttcaggagatttcatcgttccagggtcagctcagatggggtcctatgatttgtcacagttcgaccggagagggtggtacgccagttcggttacatccagagcatccctccgtcgcctgttag

SEQ ID NO: 83991 - DNA, 252 bp, Glycine max
  Peptide Sequence Number=SeqID_200769
atggtgattttcattgccctagtgttgggctttgaggtatccatcgttgttttttttcacaaccttgtagcaaggaagaatgaaggaggcgccagcccacatcaattagaccttgcaccttatgctttagggccctacaatgctcaatggaatgccccgaggctccttcatgataagcacacgttgcattcgagtcgtgtcctcggagaaatggaggttgatgaaccttggctggggttatggctaccatga

SEQ ID NO: 83992 - DNA, 333 bp, Glycine max
  Peptide Sequence Number=SeqID_200770
atgtctaacgttgtgatgatggtagctcgtgtgatgttagggcatggatatgagcccgagatgggcttaggaaagaacaacaatggtgttgccaatttggtggaattcaaggaaaaccgcaggagctccattggagcttgtaggcctaggatcttcttcatcaatggattcctttgcttcttggaagatgaatggcagcaaaatggagaaggaagagagagaagacgccacttcaaggagaagatgagtctagaagaagctcaccaccataggaggccatggataagaccttggaggaaaaaggagatgaatgaagggagaggaagagaatag

SEQ ID NO: 83993 - DNA, 177 bp, Glycine max
  Peptide Sequence Number=SeqID_200771
atgacgcatgtatgcaaggggaatgcaaggggacctgccgtgcttgcttatttatatagagagatgtgcaacgccaccgattacaaaactaaatcaatcggaggtggttacgaagtggaaatcagcatattggtaatgatgatcttagagtttttcgtcgcaaattggatatcatga

SEQ ID NO: 83994 - DNA, 534 bp, Glycine max
  Peptide Sequence Number=SeqID_200772
atggctacctcaacaaaagaaacttcagctcctggttcaccctctgcaccatcaaaccaggaacgacctgaattcaatatccagcccatacagatgattcctggtcaagcccctgttcctgaaaaactggttcccaaacgacaacagggagtaaagatttctgaaaaccctagcattgcaacaagtcctagggaagtagacccggagatggataagaagatccgcagtattgtgagtagcattttgaaagacgcctctgttcctgatgctggtgaagatgttccaacatcctccaccccgaatgtttctgtgcctgatgttgataaagatgttccaacatcctccgctccaaatgctgaagccctcccttcacccagtgaagaggaatcaacagaagaagaggatcaagcctcagaggagacccctgcaccacgggcaccagaacctgctccaggtgacctcattgaccttgaagaagtagaatctgatgaggaacccattgccaacaggttggcacctggcattgcagaaaag

SEQ ID NO: 83995 - DNA, 117 bp, Glycine max
  Peptide Sequence Number=SeqID_200773
atgagtgagatgcgaaggtttggaggtttgggaatggaggaacgtcgaggaggcagcctactggtaatcgattacatgaatactgtaatcgattacaggccatctgttctagtgtaa

SEQ ID NO: 83996 - DNA, 192 bp, Glycine max
  Peptide Sequence Number=SeqID_200774
atggaagggaatggagtagttttctggcgttgtattgtaagcaaattggtggcgtacaccaacgccagcatatatgcattctcatattgggacattgctaataaggcaagtcatgcaattggaggcagtaagaagttgcatggattaattccaccagatcctggccaagtggctggggtatggggtacttaa

SEQ ID NO: 83997 - DNA, 219 bp, Glycine max
  Peptide Sequence Number=SeqID_200775
atgccttgttcccatcaagggaacatttggaaatccttcgcacgaggacagaatcttggttcttccttccttccagcgagggaactaattaacggacatcccctccgtgttgtggaagcaaagctttccaagtttattttgatgatgccaaagactcaagtcaagaatcaagagtcaagcaagtatcaagaatcaaagagtcgttcaatcaagaattaa

SEQ ID NO: 83998 - DNA, 387 bp, Glycine max
  Peptide Sequence Number=SeqID_200776
atggaggagtttgatgcacaggtggcctggccaagagaccagccttcttcctctggagggggtgaggcctctacagcccaggagcctgtgattgaggagcctccagcaacagcaacagaggatgaggatgagctcactcctcctactcatgatgcacttctgtattacaacgggaagtggaacatgccacaccaaaacaactttgtaggttacgcgttcataggaaaaaatccaaaaaaatttgacattccttcaggatgtaccatcgatgaactaaaggatttgataaagcaagttgcacctcaagggattccccctcatggaattcatgaatcacaaacggttatggaaatggaagacgacgtggctacgtcactacaggattga

SEQ ID NO: 83999 - DNA, 387 bp, Glycine max
  Peptide Sequence Number=SeqID_200777
atgggtggtggtgcatggccgttcttagttggtggagcgatttgtctggggactatgccgcttaggccacggaagtttgaggcaataacaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 84000 - DNA, 938 bp, Glycine max
  Peptide Sequence Number=SeqID_200778
tacacgcctcacttccgaggactacatgtccttactttcagaggactacatgtcctcaccttcagagggctacacgccctcgccttcataggactacacgtcctccacttcagagggaaaaacatcctcatcttcagaggactacacctcctcatcttcagaggactacacctcctcaccttcatagggctacacgccctcaccttctgaggactacactcctcgccatcagaggactacacgtcctcgcttttagaggactacacgtcctcgccttcagagggctgcacgccctcacctttagaggactacatgtcctcgcctttagaggactacacgtcctcgctatcagaggactacacgtcctcgccatcagagggctgcacgccctcaccttcagaggactacacgtccttgccttcagagggtcatgtaccatcacctttagaggactacacgtcctcaccttcagagggctgcaggccctcaccttcagaggactacacgtcctcgccttcagaggactacacgtccttgccatcagagggctgcatgcccttatcttcagaggactacacgtcctcgccttcagagggtcatgtaccttcaccttcagaggactacacgtcctcgccttcaaagggctgcatgccctcaccttcagaggactacctgtcctcgccttcacaggactacacgccctcaccttcaaagggctatacgccctcatcttcaaagggctacacgccctcacctttagaggactacacgtcctcgccttcaaaggactacacgttcttgccatcagagggctacacgccctcaccttcagaggactacacgtcctcaccttcagagggtcatgtaccttcaccttcaaaggactacatgtgctcgccttcaaagggctgcatgccctcaccttcagcggactacct

SEQ ID NO: 84001 - DNA, 195 bp, Glycine max
  Peptide Sequence Number=SeqID_200779
taactcaggaagccgcagccactcctgaaaagtctcctgaggccactccagagcctccggcaccagtggcagataccacttctccacaacaggcagcagacccttccatgcctgaggatcaaaccaccccagtcctgtctccgaacacctctcctatagctactcatgtacttcatttgttggaagaggaagagg

SEQ ID NO: 84002 - DNA, 612 bp, Glycine max
  Peptide Sequence Number=SeqID_200780
atgatgagcatgaagaaggtaatggaggtcaatggggctatagttgttgctaccagtgtcgttgctgaggtggacctgactcccccatctagcctcaaccaaataaatcatgccatcttgaatattgtagggcagagaggcaaagaattgggaagtacgggcggcccctattttgtgcaagttcaaaacaagcattccttcccactatatgacttagctcccaactatgcaccatccaatatggtgcacactcttaataagaatgtcaataactccactcccatactcatcaagaaccaacaacctcaatttgatcatgcatttgtccctcaactcatgggggagacacatgaaatacaccaccacaatctagccaactttgagcctcgcctcgaatatgcaactgaagggaaagcagttggtggtgtgcccctgccaaacaccttggagggccctcagttcctcccacaaccacaacccttgtattttgtggcgggaagaatccctcttgctatggtggggaagggaaagttggatcatatagaggaaaggcttacagccgttgaaggaggtggaggttatgctttcgctaacacgacggattgtgcttag

SEQ ID NO: 84003 - DNA, 108 bp, Glycine max
  Peptide Sequence Number=SeqID_200781
atgccccagcccccaagacctgacaagttcactgcggctgttgctaagcgcacctacccaagcaggaatcaaacctatgacttttgcattgctaacacaacactttaa

SEQ ID NO: 84004 - DNA, 852 bp, Glycine max
  Peptide Sequence Number=SeqID_200782
atgggtgattcaaggcaggcgcacaatgcgagggcatattccattgcagccaccggaagcgatgtgggagggttggtgggagagactgcctttgtcaagtttggtcttcaaagaactgcttcgcaaacatcagtggttgatccagtgttgtccccttcaagaagcaacattggtgacactcacaagaaatcaattggattcaccaagtttgaggtggttgcaacattcaggcagttcaagttgtcggggtgtgttgatgtccctctcagcaagaagggtatagatgaggcaattgaagctggacaaagaattagcagcattcctgttgatgtcatatttacatcggctttgattcgtgcacaaatgacagccatgcttgccatgacccagcaccgtcgtgggaagggtctcaataagcaagaaacagcagacagatatgggaaagaacaagtccatgagtggcgacgaagttatgacatacctcctccaaatggtgaaagtttggaaatgtgtgctgaaagagcagttgcctatttcagagatcaatcatcatataacgctgataaaggactgatgctattgacatcaattctgcagattgaacctcaacttttatctggaaagaatgttatgatttcagcccatgggaattcattgagatccattatcatgtaccttgataaattaacttcccaagaggtcattagtttggaactgtcaactggaattcccatgctttacattttcaaagagggaagattcattaggagggggagtcccataggaccttccgaagctggagtttatgcctatactaggactgcaatggcacttttagtcctctaccaatag

SEQ ID NO: 84005 - DNA, 195 bp, Glycine max
  Peptide Sequence Number=SeqID_200783
atgtataataatttgcttccttccagatcaatgaggtatttaaggttgcaatattggaatgtcaagaaggcagctcaaatgttgaaacagagcctcaaatggagaaaagaatacaaacctgaagaaattcgctgggaagaggttgctgaggaagcagagacagggatgatgtataaaccaaattatcatgactag

SEQ ID NO: 84006 - DNA, 780 bp, Glycine max
  Peptide Sequence Number=SeqID_200784
atggcaatatcagcagaacagcaggcaaagatcattgaggtgagagggttgatagggccactatctgataaggaatctgtgtactgttctgatgcttcaatctcaaggtatttaagggcacgaaattggaatgtcaagaaggcagctcaaatgttgaagcaaagcctaaaatggagaaaagaatacaagcctcaagagatccgctgggaagaggttgctgctgtagcagagaaagggatgttgtatagaccaaattattctgacaagtatgggagaccagtgattgtaatgagaccttgtaacaagaaatcaacaccagcacaggacatgattaagtattttgtatactgcatggagaatgccattataaatctgccaccacacgaggaacagttggcctggctgatagatttccagggtgtcaagatgtcagatgtgtcattcaagacgtcacgtgaaactgtccatatattacaagaatattatccaaagcatctgggtttggcaatgctgtacaaagcacctaggatcttccaaccattcttctcgatgctaaggccatttctagagacagagctttacaataaagtaaagtttgggtattcggacgaccacaacacaaagaagatgttggaggatttgtttgatatggataaacttgaatctgcatttggtgggaatgatgatacaggatttgacatgaataaatatgcagaaagaatgaaagaggatgaaaataagattctttctttctggacacaggccaagtctgtgtcttaa

SEQ ID NO: 84007 - DNA, 291 bp, Glycine max
  Peptide Sequence Number=SeqID_200785
atgaagcttggagattcattggatagaaacaagtgtgctagagttctttgtctttgcaatttcgaaatctacttcaaggttaggaaactaataaaatgggatgaagcacgtgcatgggcctctattattattctattgaagcatgtgttgacatcgaaaatgataaagaaagctaagagaatccttagtaaaatcgcttatgagagacgtagaaacacttggtttatattggttcactcaaatagagatacgtccacttctcctttacgcaatagtaaaaggttccactaa

SEQ ID NO: 84008 - DNA, 153 bp, Glycine max
  Peptide Sequence Number=SeqID_200786
atgacgcaggctgttctcgcaccagcacaattgccgtacacacagcaattgtgtgtgattttctatttgtccttccctaaaactgatatggattgggcaattcataagtctcataccaattggtcaattcgtatgaggcttatgaatccataa

SEQ ID NO: 84009 - DNA, 318 bp, Glycine max
  Peptide Sequence Number=SeqID_200787
atggccggaagcacacacatagccaacaatagcactgctctcgaggccatgatgctcggatggtttgagtgtgtggggaagctagagaaaatgcataaagaaaacaaaagcaaagcgcgtgataaatgttcaagtgcgttggagcgcaccgtagaggaaggtggtctggcaactaaaacctgccacgtggttatgatgctggcgctgtcggtgatcgcatgtgactctgctagtgaacacaagctgttcggttctcgcaacatgaaagtgtatctattaaccccgcgtcacgcgccgaaaattttgccttctctctaa

SEQ ID NO: 84010 - DNA, 180 bp, Glycine max
  Peptide Sequence Number=SeqID_200788
atggatcttaagttttggcgatcccatgtatcaaaagtcatcatggcggtggattcaggcaacatgttccgtggatggagcggcagtacaattatattcgtggagaataatgactttcgcgaggctatcatgtggaagagactcacacttgacgagaagatggttggagtgcaagtgtga

SEQ ID NO: 84011 - DNA, 135 bp, Glycine max
  Peptide Sequence Number=SeqID_200789
atgccaagaaggttaccatcttcagattcttcaaatatgttgagaccaacaattgacgaagctccttgccgagatattatcaacgctgtggtaggagcctttgtttcacgcttcatttctcaaaccgtgctttga

SEQ ID NO: 84012 - DNA, 975 bp, Glycine max
  Peptide Sequence Number=SeqID_200790
atgacagaagataattatattcttggacagggtggtttctcttctcttgtcagatcattgaggagtcagtgcattgaattgctcactgagattgaagctcgtttggattttgatgatgagatgccaccactggatttgaatctgactatggataaaatccataacatgtcaagagaggttgagaatgcgttggaaacggcaaattatgataagcttctgcaatctggattacagatagcaattgttgggcgcccaaatgttggcaagtcaagccttcttaatgcatggagcaaaagtgagagggcaatagttactgaaattgctggaaccactcgtgatgtgattgaagcaagtatcagtgtcagtggcattcctataacccttcttgatacagcaggcatcagggacacggatgacattgtggaaaagattggtgtagagcgatctgaagcagttgctaggggtgctgatttaattatcatgactgtgagtgctgttgaagggtggacatctgaagacaccaaacttcttgaaaggattcaatctactaagggatcaactggatcatccaccccagtcatccttgtggtcaacaagatagactgtaaaccttgtgctgagaccaaatgggacaaaggatgccagagtcatattttcagtaaacgtgtgtttacatgtgccgttactggtcaaggattgcatgacttagagagggcagtattacagattgtgggtcttgaaggcattcctgctgggggtcgcagatggactgtcaatcagagacaatgtgaacaacttgttcggaccaaggaagcacttgcaaggttacaatcatcaataaaggaggaactgcctctggatttttggacaattgacttgagggatgcggcattgtcccttggacagataagtggagaagatatatcggaggaggttttatcaaatatatttggcaagttctgtattggtaaatag

SEQ ID NO: 84013 - DNA, 5283 bp, Glycine max
  Peptide Sequence Number=SeqID_200791
atggttctggggctgaaggagattcagattcggggagaaatccgtaccaatgttgattacaccattgatcttctgaatgcttcagactacagagaaaacaaaattcacacaggttggctggacagtagaattgcaatgcgggttagagcagaaaggcctgcctggtatctttcggtcgttggaggggcactctataaagcttctgctagcagtgcagctttggtttcagattatgttggttatcttgaaaagggacaaatccctcccaagcacatatctcttgtccattctcaagtgtccttgaacattgaaggaagcaaatatacgattgacatgatacgaggtgggtctggaagttatagattgagaatgaatcaatcagagatagaagcagaaatacatactttacgtgatggagaggaagaagcagctggaactcgccttctaatagatggaaggacttgcttgcttcagaatgatcatgatccatcaaagttggttgcggagacaccatgcaagcttctgagatatttggttgcagatgacagtcatgttgatgctgacacaccatatgctgaagttgaggtcatgaaaatgtgcatgcctcttctttcgcctgcttctgggattattcatttcaaaatgtctgaaggtcaagcaatgcaggctggtgaacttatagcaaggcttgatctggatgatccttcagctgtaagaaaggcagaacccttcactgggagcttcccagttctgggacctcctactgcaatttctggtaaagttcatcagaaatgcgctgcaagcttaaatgccgcacggatgattctctctgggtatgagcacaatattgatgaagttgtgcaaagtttgcttaattgccttgatagtcctgaattgcctttccttcaatggcaagagtgcttggcagttcttgcaacccgtcttcccaaagagctaaaaaatgagttggaatcaaaatataaggagtttgaggggatttcaagctcccaaattgttgatttccctgccaaattattgaagggaattattgaagctcatctttcctcctgtcccgacaaagaaaaaggagctcaagaaagactagttgaacctctattgagtcttgttaagtcttatgagggtggaagagagagccatgcccatataattgttcaatccctatttgatgagtatctttctgttgaagaattatttagcgataatattcaggctgatgtgattgaacgtctgcgtctacaatacaagaaagatctattgaagattgttgatatagtgctctctcatcagggaatcaagagtaaaaataagctgatcttgcaactgatggataaattggtttaccctaaccctgttgcctatagggatcagttaatccgtttctctttactcaaccatacaaattattctgagttggctctaaaggcaagtcaactgctggaacaaactaaattaagtgaacttcgatccaacattgctagaagtctttccgaattagagatgttcacagaggatggtgaaaatattgatacacccaagaggaagagtgccattaatgaccgaatggaggaccttgtgagtgctccttttgcagttgaagatgctctcgtgggtttatttgatcacagtgatcacacccttcagaggagggttgtggaaagttatatacgtaggctctatcagccatatcttgtcaaagggagtgccaggatgcaatggcacagatctggtcttattgctacatgggagttctatgatgagtacattgaaaggaagaatggggttgaagaccaaagtttgagtaaaacagtggaggagaaacatagtgagaaaaagtggggagtgatggttataattaaatctcttcaatttttgcctgcaattatcactgctgcattgagggaggcaaccaacaaccctcacgaagcacttacaagtggttctgtggaaccagttaactatggtaatatgatgcatattggattagtgggcatcaacaaccagatgagtttactgcaagacagtggtgatgaggatcaagctcaagaaagaatcaataagttagctaaaatactcaaagagcaggaagtaggctccaccatacgagctgcaggtgtcggtgtaatcagctgtatcatacaaagggatgaagggcgtgccccaatgaggcactcctttcactggtcagaagaaaagctttactatgcggaggaacctctgttgcgtcatctggaacctccgctatccatttatcttgaattggacaaacttaaagcctatgagaatatacggtatactccatctcgagatcgtcaatggcacctctacacagttgtggatcacaagccacaaccaattcaaagaatgtttcttcgaacacttgtaagacagccgacaacaaatgaaggattttcttcatatcaaaggctggatgcagaaacatctcgtacccaattggccatgtcctttacttcaaggagcatttttaggtctttgatggctgcaatggaggagttggaacttaatgcacacaatgtcaatatcaaatctgaacatgctcatatgtacctatatatcatacgcgaacaacaaatagatgatcttgtgccctatcccaagagaattaacatagaagctgggaaagaagaaataacagttgaggcagtcttggaagaactggcacgggaaatccattcatctgttggtgtaagaatgcatagattaggggttgttgtgtgggaaatcaagctctggatggcagcctgtggacaggcaaatggtgcttggagggtcattgtaaacaatgtgactggtcatacatgcactgtacatctataccgagaaaaggaggataccatcactcataaagtggtatacagttcagtatcggttaagggtccactgcatggtgtggcagtgaatgaaaattatcaacctttaggagttattgaccgaaagcgtctttcagcaagaaagaacagcaccacatactgctatgattttcctcttgcatttgaaactgccttggaacagtcatgggcaatccaacagccaggatttcaaagagccaaagataaaaatcttttaaaggtaacagagcttaaatttgcagataaagaaggtagctggggtactcctcttgttcctgtggagaattaccctgggctcaatgatgttggcatggtagcctggtttatggaaatgtgtacccctgagttcccatctggaaggacaatattggttgttgcaaatgatgtgaccttcaaggctggttcttttggcccaagagaggatgcattcttccgtgcagtaactgatcttgcatgtacaaaaaaactacctttgatttatttagctgcaaattctggtgcccgtttaggtgtagctgaagaagtcaaatcctgtttcagagttggttggtctgaggaatctaatcctgagaatggctttcagtatgtatatttaacacctgaggataatgctcggattggatcatcggtgatagcacatgagttaaagcttgagagtggagaaaccagatgggttatagataccattgttggcaaggaggatggccttggcgttgaaaacttgagtggaagtggggctattgctggtgcttattcaagggcatacaaggaaacttttacactgacatatgtgactggtagaactgttggaattggagcttatcttgctaggcttgggatgagatgcatacaaaggcttgatcagcccataattcttactggtttttcagcattaaacaaacttcttggtcgggaggtttacagctctcacatgcaacttggtggacctaaaatcatggcaactaatggagtcgttcatcttacagtttccgatgatcttgaaggtgtttcttctattttgaagtggcttagctacattccttctcatgttggcggtgcacttcccattgtaaagccacttgatcctccagaaagaccagtggagtatttcccagaaaactcgtgtgatcctcgtgctgccatttctggaaccttggatggtaatggaagatggctgggaggaatttttgacaaagacagctttgtggagacactagagggatgggcaagaacagttgttacaggaagggcaaagcttggaggaatccctgtgggagtagttgctgtagaaacacagacggtaatgcaaataatacctgctgatcctggccagcttgattctcacgagagggttgttcctcaagccgggcaagtgtggttccctgattccgcaaccaagacagcccaagcaatattggatttcaacagagaagagctcccgcttttcattcttgcaaactggagaggcttttcaggagggcaaagggaccttttcgaaggaattcttcaggctggttccactattgtggagaaccttagaacatacaagcagcccatatttgtatatatcccaatgatgggcgaactccgtggtggggcatgggtggttgttgacagtagaatcaattcagaccacatcgaaatgtatgccgatcgaacagccaaaggtaatgtcctagagccagaaggaatgattgagatcaaatttagaacaagagaattgttggagagtatgggtagacttgatcagcaattgataactctgaaggcaaaacttcaggaagccaagagtagcaggaacattgtggcctttgaatccctacagcagcagattaaatcacgcgagagacaacttttgcctgtgtatacccagatagctaccaagtttgctgaactgcatgatacttccttaagaatggctgccaagggtgtcattagagaagttctggactggcgtaactcccgctctgtcttttaccagagactgcacaggagaattggtgagcaatcactgatcaacagtgtgagagatgctgctggtgaccaattgtcacatgcatctgcaatgaacttgctcaaagaatggtatttgaattccgatattgccaaaggtagagaagatgcttggttggatgatgaagccttcttcaggtggaaggatattccttcaaattacgagaataaactaaaggaattgcgtgtgcagaaagtgttacttcaattgacaaatattggtgactcagctctagatttgcaagctctacctcaaggtcttgctgcccttttaagcaagttggagccattaggtcgcgtgaagttgacggatgaacttcgcaagttaggggatcacaaccagcatcaccatgttccatctatttatttgctggttgattga

SEQ ID NO: 84014 - DNA, 108 bp, Glycine max
  Peptide Sequence Number=SeqID_200792
atggacacccgtctccgtgtgattggtgatcccatgaatggagttcaacggagctgctccgtttctcattcctatgacgaagtgtattataaattgtggcgatattaa

SEQ ID NO: 84015 - DNA, 212 bp, Glycine max
  Peptide Sequence Number=SeqID_200793
ctttcgcgcttagcgcgactatggaccgctcagcgctcattagtggattttggcttagcgcgtacttttctcgctcaacggatggactgaagtggtgcgcttcgctggatgagccttcactcagcgaacatggaaagctcatccttcttccagatttttcatcacgctcaaccaaaggagtgttgcgctcagcggatggctcgctaagctag

SEQ ID NO: 84016 - DNA, 201 bp, Glycine max
  Peptide Sequence Number=SeqID_200794
atgctcgctcagcctggaggttcgagcggtgcgcttagcaaattgattctcgctgagcgcatcttggacaactcatctgcttccaagatcttctacacgcttagccacgaactgctacgcttagtggatggatctctaagccagagaattggcttagcgagcttctcaaaatcagcacttccaccaaacttgcctaattag

SEQ ID NO: 84017 - DNA, 2202 bp, Glycine max
  Peptide Sequence Number=SeqID_200795
atgtctcaactaccccaaatgatcaagctgttatataaagagacgcgggtggctttacattatatttctaacaggtatattcttacaggaactgccactgaatgcagagagctgatccaacaaccaatacaagaacagccagctgaaaatgcctattctgttcataatatgcttgaacttaactctgaactgaagcaattagtgaaacagggacaactttgtaaagctaggtatatgtttgataaaatgactcacagagatgagatttcgtggactacattaatagctggttatgtcaatgcctcagactcgtatgaagcattgatcttgttctcaaatatgtgggtccacccaggacctcaaagggaccaattcatgattagtgttgcactcaaggcttgtgcgcttggtgtcaacatatgttttggagaattattacatggattttcagtgaaatctggtttaatacactcagtgtttgtcagcagtgccctaatagacatgtacatgaaagttggcaaaatagaacaaggttgcagagtctttgagaaaatgatgacaagaaatgtagtatcatggactgctattattgcggggcttgtacatgctggctacaatatggaaggattattgtacttttctgaaatgtggagatcaaaagtgggctatgattcacatacatttgccattgctttaaaagcatctgctgattcaagtttgttacatcatgggaaagctatacacacacaaacaataaaacaaggatttgatgagagctcctttgtgattaatactctggctacaatgtataataaatgtgggaaacctgactatgtcatgcgattatttgaaaaaatgaggatgccagatgtggtttcatggacaacccttatttcgacttatgtacagatgggtgaagaagaacatgcagtagaagcatttaaaagaatgagaaaatcatatgttagtcccaataaatacacttttgcagccgtaatttcttcctgtgcaaatcttgctgctgctaaatggggcgaacagatacatggtcatgtattgcgtctaggtttggtaaatgctttgtcagtggcaaattccatcattactctttattcaaaatgtgggctgctaaagtcagcttcactagtgtttcatggtataactagaaaagatattatctcttggagcactataatttctgtttattctcaaggaggttatgcaaaagaagcttttgactatctatcatggatgagaagggaagggccaaaaccaaatgaatttgctctttctagcgtgctgagtgtttgtggaagcatggcactgcttgagcaaggaaaacaggtgcatgctcatttactgtgcattggcatagatcatgaagcaatggttcatagtgctattattagcatgtattcaaaatgtggaagtgtacaagaagcttcaaaaatctttaatgggatgaaaatcaatgacattatatcatggacagccatgattaatgggtatgctgaacatggttatagccaagaggccattaatttgtttgagaagatttccagtgttggtttaaagccagactatgtaatgttcatcggggttctgacagcatgtaaccatgctggaatggttgatcttggtttctactattttatgttaatgactaatgtttaccggatcagtccttcaaaagaacactatggttgcctcattgatcttctatgcagggcagggcgattgagtgaagctgagcacataatacgaagtatgccattccatactgatgatgttgtgtggtctaccttactcagagcatgtagagtgcatggggatgttgaccgtggaagatggacagcagaacagttacttcaattggatccaaattctgctggaactcatattactctggctaacatatatgctgccaaggggagatggaaggaagctgcacatataagaaagttaatgaagtcaaagggagtgataaaggagcgaggatggtcttgggttaatgtcaatgatcaattaaatgcatttgttgctggggatcaggctcatccacaaagtgaacatatcacaaccgttttgaaattattaagtgcaaatataggagatgctcagcaggaaataagatctcttcatgaagatgttgaggatttagcatatagctgcattctgtctcatgggaatgctagaaaatag

SEQ ID NO: 84018 - DNA, 249 bp, Glycine max
  Peptide Sequence Number=SeqID_200796
atggtgcagttatggtttgggaatagggtgaaacacttgcctgtaaaaaaaaaaagagaaggagtagagacgagagtcgtcatcccggaaagggcaggacggacgaaatcagtgtcttatctttgctttcctctcatctctgatgagacatacttggcaccctttgttgcacaatacgtgaagtcccgagacgtgccgaaaatcaaaaggaagcaggcttacgtgatccgtgaaaattccgtaatgtga

SEQ ID NO: 84019 - DNA, 438 bp, Glycine max
  Peptide Sequence Number=SeqID_200797
atgggtgggccgccatacaggaattctgagccttgtgtttgtacacttcttttgaggccaccccgggcctattcctccattaattatgttgttggccacacaagaaggtgcagtggggcctttcaatcgaggccagcgactattgctcaacaccttcaagggtcctcaaacactgacaagttgaaggttgacttagagaagactgagagctctttggactcagctcttcaagccaatatcactttggctgaagataactcaaatctaaagtggtgcatcttatatcttgagggaaagatgaaggtgttggagaaaagggctcttgatgccaaggctttggacaaacttaataaggaggaggtggcaaggttggaagttgtgttggccaccaccgagaaggagaggaatgctgaggaggagaggcttcagattgagtag

SEQ ID NO: 84020 - DNA, 438 bp, Glycine max
  Peptide Sequence Number=SeqID_200798
atgaagtccaagtggtacattcgctatgacatcaacgacacggttgatgagttggtcaagttggaaaccttgcctagacttgggcagttgaaaactttcaaactacgcactctctctttctcctatgtgtcgacaaaggagtgcatgcaagttgaaacacaagagcttgaaagctggaaaaccacgattgttgagtatttgctcaagggcatacttttggaggaaagggagaaggccaaaaagtggaggactcaagctgcaaaatacaaaatagctaacgaaatgtatcaacgaggtttcttctcaccattgctcaaatgtcttgacaacgagcaagttgactatgtcgtaagagaactttattataagggcatttgtggcatgcactcaaggggaaggtcaatggcagcccgagtactaagggttgggtactactag

SEQ ID NO: 84021 - DNA, 369 bp, Glycine max
  Peptide Sequence Number=SeqID_200799
atggcagaatcatccaagaaacaaaagggatcctcttccaccaccaccactgcaggccatcgccgccatggaaccttcggagacccaccagcaccaattcctccttctctttcatctccctggccatccaccttattttcctccgatgatcagcgtcagaggtactactctcaattttgtaatcgcattattcttgaccctaagtacctagaccttgaattctttgatggtgaaacatttgattgtttccaagtgtttcaaaactctgaattggttgaattcatgtctctcaaattgccttattttcctgaattagttagagtcttctataataatttgaaaattcaggatggtgttctttattctgag

SEQ ID NO: 84022 - DNA, 357 bp, Glycine max
  Peptide Sequence Number=SeqID_200800
atgggcaccatcagggacatccgacaaggtcaatgcaccccccacgaacatacacaacatgcatcatctcaatgcatttccaacatcatcaacattttatttcaatatcattctcaacataaacatcatctcgtctcaatgacattatcaacaacaacaacctcattccatatcaacatcatcacatatcaatttaaagttatcaatagcaacatcaacagattgagggattttctccaccgaatcttcaaggaggattctgaggattccgctccgattaaagtgttcctcttggtgtgggggtccaacagcaagcaacgatggcttacgatggccaccggtggtcttgggtggtga

SEQ ID NO: 84023 - DNA, 195 bp, Glycine max
  Peptide Sequence Number=SeqID_200801
atggcttcatatggtggtgagcttgttattggctcatcttctcctcgaagcggtgtctccaatcacctttcatccttctccattttgctgccattgatcttcaagaagaaaaggattccattgatgaagaagatccaagtcctacaagctctacttggagctacatcatgtggttctatcatttttcagtcataa

SEQ ID NO: 84024 - DNA, 298 bp, Glycine max
  Peptide Sequence Number=SeqID_200802
gggggacgaagggatcaactgccccgagaacctcataacgcctattacaccccatagtgctagcaaatctcatatcttggatcaagctttggctactgaaatcctagccatgcccaaaagagctaacactcccccaaaggccaacttctccaaactttatagataccaccctaaccgaggacattcaaccaaggagtgcagcattctaaaagacaagatagaagacctcatcaaagttgggacacctaaaggattttatccacaagcctcattcatatcagcacaacaacaactatag

SEQ ID NO: 84025 - DNA, 1059 bp, Glycine max
  Peptide Sequence Number=SeqID_200803
atgaaggagaggcaacgttggagagctgaagaggatgctttattatgttcttatgtcaaacagtatggtcctagggaatggaatcttgtgtctcagcgcatgaacacacctcttaacagggatgcaaagtcgtgcttggaaaggtggaagaactacctcaagcctgacataaaaaaaggttctcttaccgaagaagagcagcgtcttgtcatccgccttcaagcaaaatacgggaacaaatggaagaaaatcgctgcagaagtcccagggcgcactgctaagcggttaggcaagtggtgggaagtcttcaaagagaagcagcagagagagaaaaaggatgtcaatagaatctccgacccaattaacaatagtaagtacgagcacatacttgagagttttgcagagaaactagtgaaggaacgcccttcaccatcatttttaatggctgcttccaatggggcatttctgcacaccgatacaccagcacctgcatcatccttgcttccttcttggctttctaattctagtagtcctgccgctgatgggccaagttccctttcggtgacactaagtctttcttcctcaatggtgatcgcgcctccattttcatggttgccacccaagagaggaccagacaatgctccttttgttttggggaatgcagcagcacttcagggagttattccaactctaagtgataacatgcttatgtctcagatggtggagcaccgtaaagagttggaagaggggcatcgtgctttgggcacacacaagaaggaggcagcttggaggttaagtcgggtggagttgcagttggagtcagagaagacaaaccgaagaagggagaagattgaagaatttgaagcaaaaattaaagctcttcaagaagaggagctagctgctttgggtagaattgaagcagaatacagagaacagttagatgcattaaggagagatgctgaaaacaaggagcaaaagttggcagaacaatgggctgcaaagcatttgcggcttactaggttactagagcaattagggtgcagagcagggctcccttag

SEQ ID NO: 84026 - DNA, 309 bp, Glycine max
  Peptide Sequence Number=SeqID_200804
atgggctcaaaaatctaccctaaggttcatgagaaccctaaggccttctttatcaactctatcccaatcctcttggagcctcttgctcatggctctgaagcaaaggactccattgatgaagaagatccaaggcctacaagctctacatggagctacatcactataagcccctttgagcagatgatgatggcaaagatggatgagctcgagaaggtgcacaaggaagactatggagagtttaaagcttgctttgaaactatcttagagaggttgggtgttatgagagcatcatatgttgatgacttatga

SEQ ID NO: 84027 - DNA, 585 bp, Glycine max
  Peptide Sequence Number=SeqID_200805
atggaggattttgaattcacattagcactgagaattgcaaggatcagtttcagttatattaacttgaaaaaatcacagaagaaaagaagcattgaagagaatgcaaaaactgaagcatacccaggtggaaaaaaccgaaggagaagaagtgggaatactcatagagtagcagcgcgaagtacgcagaagcatcttctggagaacgaaacggcgccgtcaagagggaaacgagagagggagaagagaagaagcagtggggatgacatgtcgatgacgatgaatgatgataggatagagagagagtgcggtggtggggagaagacagagcactgtaatggagcagagagagagaaagtgagaatagacaagacaggcaagagagagaggaaatggggacaggggtatacgtcggtttcagcgcttaatatgcgagaaagatgcacgcgaatgataagggaggagggaacggaacatcaacaacaaccagatgctactcaaagggttgaggaggttgaatttgttgatcttgcacattttcctaagcttccaatgctagaaattttgcatggactacatgtatcatga

SEQ ID NO: 84028 - DNA, 339 bp, Glycine max
  Peptide Sequence Number=SeqID_200806
atgatagatggagaagatgaatgtgcacaaaaaaacaaaggggggccccgaagggtgcatagatcacattcaaatcttaaaaataaaactaaccgatggttacacgaagaacaccgaacaaggaacgatgtagggattggtcacagtcgtgatccgacagcaaagggtcactttatggatgttgcaggcgagctgaaacttagtgttgaagcaatgagctcgcccaggcaaaggagaagaggagaggggaggcaccatccactaaggaataagccaaggaagaaggagcttcaccaccaagaattgccttggataagaagcttgaagaggatgctttaa

SEQ ID NO: 84029 - DNA, 444 bp, Glycine max
  Peptide Sequence Number=SeqID_200807
atgcttcggagcatacatcaggggcagattattttactgcaaagcctacaactggtagcgcctccagactccatcccgacagtagagcaatttaatgaatgggtagcctggccagggactcagcctcctcttcacagggaagacgaagatcccgccgctcaggtaccccatcagtcgaaggatgagtcatcaaagtcttccactcctgagcccttgatcaggaaaaggagggtagttgtaacccaggaagctgcagccacctctgaaaagtctcttgaagctactctggagcttccaacaccagtggcagataccacttctccacaacaggcaacagacccttccacgcctgaggatcaaaccacctcagtcctgtcttcgaacatctctcctgtagctactcttgtacttcatttgtcggaagaggaggagggtcagacatag

SEQ ID NO: 84030 - DNA, 572 bp, Glycine max
  Peptide Sequence Number=SeqID_200808
atggaaatatatcatacagagctggatgaattcaaggctaaattggagaggcgtaacttccataagcgcctcaccaatttagctgacaatagcattgacctagcattggtgaaggagttctacgccaacctttacagtcctgaaggaccttctccaaaacaagtcagaatacagggccacttgataaggattgatgcagacaaccttaatgtctttttagaaacacctatggtgcttgctgagggtgaatctttacccgcttactcaagatactacaggatgcctactgacatcagggaaattgaggctgctctgtgcatacccggccaagggtttattttaaatgttgaaggtcaccctgggaagatcctcagaaaagatctaaccacacttgctcaggtctggagtgttctctcatactccaacctggcttcgacttcccacactttggatttgactgtggatagagctaggttaatctttggcctagttactcagctggacatgaatgtcagagctctcatctctaggcaaatcacttcaatggcccagtctaactcctctagactcgg

SEQ ID NO: 84031 - DNA, 588 bp, Glycine max
  Peptide Sequence Number=SeqID_200809
atgattggtacctcaaagccctacactagtgaaatgaaaggtaccatgcataaacctcaagtgaacataggggcagaacaaaaaaagttggacgccctcaccttcagaggactacccgtcctcaccttcagaggactgaatgtcctccttttgggagggctacacgcactcgccttcagaggactatatgtcctcctcttcagaggattacacgtcctccccttcagaggactacacatcctcaccatcaaaggacctcacgtcctcgccttcagagggatacacgtgctgaccttcataggactacacgtcctccccttcagagggctacacgccctcgccttcagaggactacacgtcctcaccatcagagggatacacagcctcaccttcagaaggatacacatcctcctgttcagaggactacacgtccacgctttcagagggctacacgccctcgccttcataggactacacgtcatcgccttcagagggttgcacgccctcgcctttgttgggcttcaccccctcgccttcataggactccacatctgcgccttcagagaactcgaggtcctccgcccttaa

SEQ ID NO: 84032 - DNA, 645 bp, Glycine max
  Peptide Sequence Number=SeqID_200810
atggagcaaacctatgatgttaaggtaatgttctcgcgcaatgcattacttgtggacattgttggtgagagtatcggtcgagtattgaaactagattcaattcaagctggccaaatgtggaaaggaatagatgtaatgatatttgactcttggcattggtggattcacacaggaagaaaacaaccatgggatttgattcaagtagggaatcgtacatatagagatatggatcgcttggttgcatatgagatagcattgaatacatgggccaaatgggttgattacaatattgatcctacccgaacaagggtgttcttccaaggagtctctccagatcatcaaaatccagcgcaatggggtgagccaagagcaaacttatgtgaagggcaaactaggccaatattgggattcaggtacccaggaggaccactcccagcagagttggtattggagaaagtgctaagagctatgcaaaagcctgtgtatttgctggacattactaccctatcccaactaaggatagatggccacccgtctgtttatggctttggagggcatttggacccggattgtagccactggtgcctagctggtgttcctgatacttggaatgagcttctgtatgctagtctcgttaaaaattaa

SEQ ID NO: 84033 - DNA, 510 bp, Glycine max
  Peptide Sequence Number=SeqID_200811
atgaccactcttacacaaatatggatgacgttgctacttagcaacattttgcccagcgatgacaatggatcgcgcccacaagacacccagtggacttggaggagtccaacagagccttggggtttccagctctggttatgggcctctgtcagtcctacaaggtgtccgtcccccccagcaaggtcacaccatcgtgacatagggattgcactcgcaagatacccagtggacccggagaagtccaacagggtcctggggtttgcagctctgattacagacctttgtcaattctacggagtgtccatcgcccccaacaaggtcatcaggccccctattaaccgaactttcatcaagaagtactgtgccccccaggcaagcacagggcgagacaccacaacagcctggggatggccgacaacgggcaatagacgcaccactgccacctccaaagcccctcagctcatcttcaaaggctggagtgtttcctacgacccgtggttgggatattga

SEQ ID NO: 84034 - DNA, 144 bp, Glycine max
  Peptide Sequence Number=SeqID_200812
atggagacatctccattccttgctaagctgtatggggcttgtggcacagctgatgtgatcctaattgagaaccaattggttgagagcaactttacaactgataactcttatttaatagaggaagtctgccgacttatacagtaa

SEQ ID NO: 84035 - DNA, 153 bp, Glycine max
  Peptide Sequence Number=SeqID_200813
atgaaacttaaacagtctggctttaaatctgacccctttttacataatcatgaaagttacattaagaactcgatgcagaattcaaaaacaggatgtgtacctaggagcctacctgaatggggcacattggcaaatggtcgtcattttgcctaa

SEQ ID NO: 84036 - DNA, 288 bp, Glycine max
  Peptide Sequence Number=SeqID_200814
atgtatagtcattcttcaacaaagagacaatctgaaaataacagagcagacaacaataaggacaatagcctctaccagaaaatcctcacctacctcgattctcttccctctgttgaagattctgattaccccaatccctccgacatcttcctccacctcgaccataaccacaccgttcatgacaccttccttggcgccaggctctcctggaccaacgcctccggcgacgcgctcgttcttcgattaaagaagaaagacaagcgcagagtcttccggcagtacttctag

SEQ ID NO: 84037 - DNA, 519 bp, Glycine max
  Peptide Sequence Number=SeqID_200815
atgattcctcccttgctcagactctaccacatctattgcattatgctcctggccatagctttgataccactgttggataatcaatactctcacaaacaaaattacccacactcacaaaggatcatgagaacacaacaaagatcacattgtaggaaaaccaacagcaaccctaacgcaaaacttgttgtcgctcccaaggcctctgccgtctccgttgtgccagagagagaggtggtgatgtcttcaattagattcctatggatcctgatggtgtctttgacggaatcatgcacgttaagccaaccgcagaagttatcaatgtacgatgttctgatggagtacgggttcccggtgggtcttcttcccaagggagccatagggtattcacttaacaaagtcagcggtgagttcgcagtgtatttccaaggagtgtgcagcttcgacatagagtcctacatgttcaagtacaaatccaccatcacgggtgtcgtctccaagggcaagctctataatctctaa

SEQ ID NO: 84038 - DNA, 286 bp, Glycine max
  Peptide Sequence Number=SeqID_200816
atgactacaacaattgctattgaagatgtgagaagggaggtgaaaatacttcgagctttgaatggacacaacaatctgatccagttctatgatgcatttgaagatcaagacaatgtctacattataatggaaggagggaaatacttagaagatgatgcaaaggctgtcatggtacagatacttaatgttgctgcattttgtcatcttcagggtgtggtacaccgagatcttaagccagaggatcctactgcccgactacaacacgcaaagtttcttgtgacagtag

SEQ ID NO: 84039 - DNA, 738 bp, Glycine max
  Peptide Sequence Number=SeqID_200817
atgttgtgcattgctccgttgttgggcttgactgtgagaaggaaagtttggctttgttcgattgttcgttttgggtgcgagaaatcaaagttatacttttgtacccatgtttggattgttaactttggtttccggtggttgaggtggctttgtgattataaagttatggcacgtgttcctgataaaattaagttgatagatggatcgagggaagctcttaagctttctgtaaggatcactgatctttggttcattgggatccctgaaaagtttgaacaagccgaaatggtggttgttgattctgatggagatgaaatccatgttgtttgcaaacaagatcagctaaagtcttggaaggctgatttgaaggaaaatttgacttatgtgatgcataattttaaagttatgaagaatgatgttattggcgtggttgatgaagtggtattccgatatgtgtcatcgaaaaatacgaaggtactatcctgcacactctgggaaaattactgcttacagtttttgtcttatttgaatgaggttgaagatgaaagacccatcattattcttttgacacatgccaggatcaaggaagcccagggatcatatctgccatcagtcagtaattctttcaaggcgtctaaactcatgatcaacgagcttgtgctggaaattcaagaattgagagagaggcttttagatttagggatggaggttagatcagttttgacgcctattggataa

SEQ ID NO: 84040 - DNA, 303 bp, Glycine max
  Peptide Sequence Number=SeqID_200818
atgcagccatgttgcaagatcgagagttcaatacttgagtcgaccgatcctacagagcttgaatatcaatctgtctctgttactgctgatgatgatcgttcaatgcttgactcgactgagcctacagagcttgaatctcaatctgtgtctattaccgcagatcatgacccacttctcaggattccattaacaccaactaagcgtgtatcttctgatgagttggatgatgagcccaaaaactttgagatttcacttgcccaagtttcctcaaataatttagccaagcattgtcaagctgaatga

SEQ ID NO: 84041 - DNA, 399 bp, Glycine max
  Peptide Sequence Number=SeqID_200819
atggttctacatggaaaaaccattggttttaatcttgaagattatgattcaacccttaatacttgtcacactcctttctccacaaacatgcctaccatcaatggagaagatgaagttgatgatacatatggctacaccattaagcttccctcctcccgagcagcaccttcaatgtttatgtccaagaggactagaaaagccgcatggttcacatcattgtctgccaaacctgtgggtttggagagaccactagttcatgtggatcctaacattaagacaattgctagtccatacagaaagaaattaagaacttatttgggggtcatcggtcaagacaaagttgatgttacatatattaattggatacatgttcctacatctcagaaggatttgatttga

SEQ ID NO: 84042 - DNA, 237 bp, Glycine max
  Peptide Sequence Number=SeqID_200820
atgctactgaagggctcgctcagcgagcctgattggctaagcaaggctcatccacttagcgagggagcctgctcgctaagtgagtatgaaaccctagagaatgttgagtctgagagcagcacgcttagcgtgcagctagcccgcccagcgaggatggtgtctcttttcacgcttagtgcgtccaagcttgctttgcgcccaaccactaactctcgcacagtgagacatgctcactga

SEQ ID NO: 84043 - DNA, 318 bp, Glycine max
  Peptide Sequence Number=SeqID_200821
atgctgccattgatcttcaagaagcaaaagactccattgatgaagaaaatccaaggcctacaagctccacatggagctacgtcaaaagtgttgggattcaaccttaagactaaccctactattttgcactatacttttgtcatcttgtcctttaatgtagaacacatacttgttgatatcatatccctaccaagttctaacattttgtttaggcacataaggaaatcgggacattttcagaaggattgcccaaagtataagtcttggttcgaaaagaagggtgagcttagtgcttatgtatgtttgaatcaaacttaa

SEQ ID NO: 84044 - DNA, 507 bp, Glycine max
  Peptide Sequence Number=SeqID_200822
atggctctaggtcttaaatttgttgataagaatgaatatgttaaagacatttttttggatatgatacaagtgcaagatactacatcatccactctcaacattcaaaatatttatggtcaaggatatgatggagctagtaatatgcgtggagaatggaatgatttacaagccttgattcttcaagaatgtccttatgcatattttcttgatgaagatttagctgctaaaggatctacttctgctcaacgaggtgatgctacttgtgctttgaaagcattgatttcatttgattttgtttttactctacatgtgatgaaagaaaccatgggatttactgataaactttgtcaagttttgcagcaaaaatctcaagacattttgaatgctatttgtttggcttctagcataaaatctttaattcaagagttaagagattctagttggggtacacttttagaaaagtcacatctttttacaataaagaagcaattcaaattccttaaatga

SEQ ID NO: 84045 - DNA, 239 bp, Glycine max
  Peptide Sequence Number=SeqID_200823
tggttgatcaacatgctgacatttctaaggaggctgctaaggatcatcaactcgaagtagaggctgtttttgataatgaggatgctagtaggagaaggattccttacaaactcaatttacggattatgcatgggtactattctatttctaaatctattgatatagcagaggttctctcaaactccaaaaataagaggataaggaagctaatcaaatggttagaaatgagaagcacataa

SEQ ID NO: 84046 - DNA, 216 bp, Glycine max
  Peptide Sequence Number=SeqID_200824
atgcgagagaatgagaatgagtcacaaaatcgcctaatcaaactgaaagctagggcttctgcaaaactccgatgcgagagacaacctgtggatttaagagaaaatgagtttagaaacctagggcgattcaaatcgagtttagaacaggttcaaatttgtgagaaacctatgaacaagtttgaatctgtgagaatgagaaagatagagagcgaatga

SEQ ID NO: 84047 - DNA, 901 bp, Glycine max
  Peptide Sequence Number=SeqID_200825
ccgcggcgtacttcgcaaagctgtccgactgaggtacgccttcatccgtgacaacatctgttgctggcctgttcgcctgctctgtcgggtgctggatgttcatcccagtggtttttacgcctggtttaagcaaccgtattctcagcgccaccaggtagatctgagactgacgggacagatcaaacagttctggctggagtccggttgcgtttatggttatcgcaagatccatctggacttgcgggatagcgggcaacagtgcggagtgaacagagtctggcgactgatgaatcgtgccgggataaaggctcaggtcgggtaccggagcccgcgggcacgcaaaggcgaggccagtatcgtatcgcccaacaggctccagcgacagttcaatccggatgctccggataagcgttgggtaacggacataacctacatcaggacccacgaaggctggctgtatcttgccgtggttgttgatctgttctcacgcaaaattatcggctggtcaatgcaatcccggatgacaaaggacattgtcctgaacgcactgctgatggctgtatggcggcgtaatccccaaaaacaggtgctggttcactcggaccagggcagtcagtacacaagccatgagtggcagtcgtttctgaaatcacacggcttggaggggagtatgagccgtcgcggtaactgtcacgataatgcggttgcagaaagctttttccagttgctgaaacgcgaacggataaagaaaaagatctacggaacgcgggaagaagcccgcagcgatatttttgattacatcgaaatgttttataacagtaagcgtcggcatggttcaagcaatcatatgtcaccgacagaatatgaaaaccagtattatcaacggctcggaagtgtctag

SEQ ID NO: 84048 - DNA, 904 bp, Glycine max
  Peptide Sequence Number=SeqID_200826
tccgcacgggtttcgccaatccagttagcctggaagatcaaccagttcagcgccggcgggataacgctccagataatccacaggctgagtaacgtgagcagcgtattcagccagctggagaacagacataatggttccgttctcttaacgctcaaccagcgcaattttgcggttatagaggttcatcagcagcgaaatgagcagactgataatcagataaaccgccatggtgatggcaatggtttcaattgcctggccggtctgattcagtacggtgccggcaaacagcgacaccatatccggatagccgatcgcggccgccagcgaggagttttttacgatgttaaggtactggctggtgagcggcgggataatcacgcgcatcgcctgcggaatgatcacctgacgcagcgtaaccggtgccagcgtcagcgctgccagttccggaatcatggcaaagccaccgcggaagttgaaaccgcgcagctcgggcacatcccagtgcgtggcggcaccaaacagcgtgcggcgcagctgaccggttttcagctgatgcttgcggttaaagcggaacagcgcggcgctggcggcgatggcaatcgccagcgcgatcaggaatggccaggtgccgggtgcatactccggccacggtatatacaaaccgcggttgctgacaaaagccagatcgaacgcgttcagcgcctgacgcgggcccggaagattgcgcagcacggcaaagtaccagaagaagatttgcagcagcggcgggatattacggaacgtctcgatataaatggtcgacagcttgcgcagcagccagttatccgacaggcgcgccagaccgatggcgaagccgaggatcgaggcgaagacaatacagagcgcggagaccagcagggtgttg

SEQ ID NO: 84049 - DNA, 617 bp, Glycine max
  Peptide Sequence Number=SeqID_200827
ctgaatacgacagcattcggacagttaagcagagcgtcgctattccgattatcgcgaatggtgacattactgacccgcacaaagccagggcagtgctcgactacaccggagccgatgctctgatggtgggacgcgctgctcagggaagaccgtggatcttccgggaaatccagcattatctggacacaggggagctgctggcaccgaagccgctggctgaagaaagtgcccctgacgaccagtttcggcgcacattcaacgccatagaggatgccagcgaacagctggaggcgttggaggcatacttcgaaaatcttgcgatcagtcgagcagcctctgttggacatggtgatgcagtatacccgtggcaaccagacccgcgctgccctgatgatgggcatcaaccgcgcctttgggctggcgtttttgttgctgctgtttgtgcgttaacaccgcgtgaaacgattatcgtcaaaatggtaacgatagttgcaatcgccggcgtgatagctcatctctctcagggccgctgccctgccctgtttttgcgcagaaaaaatcctcctgatcgcccctcagcccgctttgtttgtgatcctgaaccgcttcagcggtaa

SEQ ID NO: 84050 - DNA, 451 bp, Glycine max
  Peptide Sequence Number=SeqID_200828
atgatgctttccaccctgattgctgccgcctcgctgttcgccgtgacccagcaggcgcacgcaggcaccacgctggacgccattaagaagaaagggtttatacagtgcggtatcagcgatggtctgccagggttctcctacgctgacgccagcggcaaattcaccggtatcgatgttgacgtgtgccgcgctgctgctgctgcggtcttcggcgatgccagcaaagtaaaatacaccccgctgaccgctaaagaacgcttcactgcgctgcagtcaggcgaggtggatatcctgtcgcgtaacaccacctggacctcatcacgtgatggcggcatgggcttcctgttcgccggcgtaaactattatgacggcatcggcttcctgacccataagaaagccggtctgaaaagtgccaaagagctggatggtgccaccgtgtgtatccaggccg

SEQ ID NO: 84051 - DNA, 420 bp, Glycine max
  Peptide Sequence Number=SeqID_200829
atgggtcttgcgatgaactcgctaagtgagcctgcctcgctaagcgagttcatacattttgatgaatttctgggtttcaggatgaattcgctaagtgtgccttgttccgctaagcaacgtgccctgcgtgctaagccacttgctgctatttctatggcctcaaagaaaagatgtgcttcatcctctagaccacatgagctttatgacacatctcgatttgtgtcggagacagcttgggacagagctggagcaacgctagtggcacaggaacttgacaagaggaagatgatcaagtttgatgcaaccacactgaatgcattcttagagacacctgtggtactagagcctggagataggtacttagcttattcttgtttttgtcacactcaccctgaccctcaggagattgcagcatactag

SEQ ID NO: 84052 - DNA, 438 bp, Glycine max
  Peptide Sequence Number=SeqID_200830
atgcaaaacagtgagtgtcatgatgacaatccccgtgtagcttccatcccttactttggtttcattgaagaaatttgggaacttaactatgtgaaattcattgtatgtgtttttaaatctaaatgggttgatagtaataccagtgtgcggaccggtgatgtaggatttgtgttggtgaatcttaagaaactcgcttaccagaatgatcctttcatcatggtagaacaagctaaacaagtattttatgttcaagacccttgtgatgaaaggtgttcagtggttctacacgggaaaacagtatgtgttaatgttgaagatgatgattcatacattgatacttatgttagtcctttgtccacacaaatgtcgcctaatgtcgttggacaagaagaaactaacggcgttcttgttaatcgtaatgatcatgatgaaggataa

SEQ ID NO: 84053 - DNA, 831 bp, Glycine max
  Peptide Sequence Number=SeqID_200831
atgatcattgccgtccatagtcttctggctgcgactggatcattcaggcgacttctgaagtggagatgtctcgggagccgattgcggcgtaatgttattgcgcgacaggagttcaggatgaaagttgccgttctcggtgcagctggtggtattggccaggcactcgctctgctgctcaagacccaattacccgcaggttcagccctctcactgtatgacattgccccggtgacaccaggcgtcacggttgatctcagtcacattcctaccgccgtgaaagttgaagggttcagtggcgaagatgcgacgccggctctgcacggcgccgatgtggtgctgatctcggccggtgtggcacgcaaacctggcatggaccgcgccgatctgtttaacgtcaacgccggtatcgtgcgtaacctgattgaacaggtggcgaccaccgcgccaaaagcgctgattggcgtcatcactaacccggtaaataccacggtggcgattgctgccgaagtgctgaaaaaagccggtgtgtacgataaaaaccggctgtttggcgtctcaacgctggatgtgattcgcgccaacacctttgtcgctgccctgaagggcaaacagcctacggagattgaagtgccggtggtcggcgggcattcaggcgtgaccattctgccgttgctgtcgcaggttaaaggcgtcagcttcagcgagcaggagatcgccgacctgacgaaacgtattcagaatgccggtaccgaagtggtggaagccaaagccggtggcggctcggcgacgctgtcgatgggccagcggcggcgcgctttggtctgtcgctga

SEQ ID NO: 84054 - DNA, 1470 bp, Glycine max
  Peptide Sequence Number=SeqID_200832
atggtggtggcgcgcgtattgatgcgggtgatgctgccggtcaaatcgcgaatggtcacggtatcgccgatacgaatcggtttctcaaacaggatgatcaggccggagataaagttggcaaagatctcctgcatcccaaagcccagccccagacccagcgccgctaccagccactgcagttttgaccactccacgccaataatcgagaaaccaatcagaccgccgaccagcatcagcgcgtatttggtcagggtggctgaggtgttgcagcagcgccagctccagcagcgccggcatattgcgcaccagctgggtggtaatgataaagatcaggatggcgatcagcacggcacccagcgtaatgggctgtacgctctcgacgccctgcaccgtggtgctggcatcccacagcgggatgttgtcgaggaagctgaacgcggagtggatctcagaccacagcacaatcaccgacaccagcgcaatcagcgtcagaatcgagcggaccagccgcagcgactgcgcgctgatcgcatccagatcgataatcggctcttcgacttccacggtatcggtgctgacggcagactgctgctctttttcctcttcgctgcgcgcgcggttggccagcatatcggcacgacgctggcgcgcgcggtcaaaggcgatgcggcggcgctgaatcagcatccagcggcgaatgatgtggtaaatcaccagcaggaagaaccagatgccgaccgaggtttccagacgcgccagcagcgcctgcgcggtggccagatagccaatgcaggaggccagcgctgccaccagcgggatggcgatcatcaggctgacggtgacaatgctcagcgccccgcagatcagaataaagcacaggcgccccagcgtagcggagaactgcggatcgtcgaggttggcgaaagcaatcagcagcataatcagcggtacgatcaggccgaccgtcagcgagtaataacgcatggcgcgcgcgacccgcgcctgcggccagcggaagtgcacgacaaacaggccgtcaggacgggcaaaagccgcgctgatcatgaatgcccacagcagcggcagggtggcagtgatgccatcgccaatcgctacggcaaacgggtaaggccaggcgtgctgcaggccaaacccgagcgcggcccacagcaccggcagcggcaccgcgaccagaatcgaccagaagacggtgcgcagtgtcaggctgaagcggtcctgcgtcactttccccacgcggctggccgcgcgcgccataaaggcgttgtagtgacgacgcgtgctgatgctaaagcccaccagcagaatggcgccaataatcggcagcaccgtttcgcggttagtgaacatcatcgccagcgctttgcccagctggcccagcgtgtccagcgacagcaggcgcgtcagatcggtggccacgtccagcggatatttcaggccaaccgggctgac

SEQ ID NO: 84055 - DNA, 150 bp, Glycine max
  Peptide Sequence Number=SeqID_200833
atggccactagacacatggttgatttcatgtgtttaagtatgaatctgataactactggttcggatggagcagaaattagaggtgaaataaagatcactggatttgaaaatggagatatagatctttcaaaatcattatggacctatcag

SEQ ID NO: 84056 - DNA, 393 bp, Glycine max
  Peptide Sequence Number=SeqID_200834
atgtttgatcaacaggcagctgtgtctccagcaaaacctccagaaagcccggatcatgaggtcgatgatcccctgtatctgatgatattgaccatcccacgactgtttgtgttcggggtgtttaatcaaaacttctcattgtacataaagcatgaaaatctctctgaaattgcacatagtggtcaatgtctcagcatatctgttatacagttgtggattctgcatctgactgagacaagtatgcaagcggggagttacgatgtgtatggattcctcgagccacagtccattcagagatctgggcaatcgcaatttgaatcgaaaagttacatcaagagttggatgcagagttcaaaacatggtgtctattttggaacctacctgaatgggtaa

SEQ ID NO: 84057 - DNA, 279 bp, Glycine max
  Peptide Sequence Number=SeqID_200835
atggcagagaggacagggatggacataaacctggggtatgtcactactagctgggcaatgccgccggagaaagggagggaggggacaatcaaggttatcaatggcggatggctgatggctaaaatcccgccatataaacacgccattgcagcctatggcactgccatagcaggccgcccttcacaaattgcttgtggcagagcgatcacaaaacaccatgttatagtgttatggcagcactgtaactgttatttaacaacaatgggggcaacatcctga

SEQ ID NO: 84058 - DNA, 1056 bp, Glycine max
  Peptide Sequence Number=SeqID_200836
atgttcgcttctgaagaaattatgtcattcaaatcttaccagaaccgggctaatttgtttgtgaaggaatatttactagccgactctctgattccatatatttctgttattagtggcatgttagcttgcaagatggtctacgagcttactcagcttattggttctaattactttaagatctattccagcttctccaaattccaacgtattgagtggaacaaccgtgctatatcaactgtacatgccattttcataacaactgtgtcgttgtacatggtgttttgctcaaatctattttctgactaccagtctactgaacttattactgagcgaagctcttcattgtcgacttttgcactggggaggggaggttgttataaaaagggagggagggagggaaaccatgagagaagagtagctattttgggaactcattggcgtggcagaggttcaggtctcaaaattgcctggaaggtttctgttggttacttcattgctgatctagggacgatattatggttttttccttctcttggtggatatgagtatgtgattcatcatctgttttctttagtagcagtagcatattcaatgttgagtggggaaggacagctttacacgttcatggtcctgatctccgagacaactactccaggaatcaatttgagatggtatcttgatgtagctggaatgaaaaagtccaaagcttatctcatcaatggggttgtaatattcatttcttggctggttgccagaatacttctgttcatttacatgttttaccatgtctacttgcactttgataaggtagcagattttgacattcaattcttggcctttaatgactcaaacgatgtctacacattattctcttggatgataaatggcctagatcatggatctatgtatttcttcttatcagctaaaattgtaatttatgctttccaatttgggagcaggaaggttgtttgtggtgcaaggatcgatattttactatggttgtattgtgtctatagacacatgtacaagcataccactatcactatgcctacataa

SEQ ID NO: 84059 - DNA, 613 bp, Glycine max
  Peptide Sequence Number=SeqID_200837
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatattctaaatcatctagagatgccgaggatgcaggatttaatgatgccattgctgaggatcgaactgatcagtttgtgaacacgctacagccagagttagaagcccttgagaataagaaggacgattttattggtgactttagcaagatggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 84060 - DNA, 2218 bp, Glycine max
  Peptide Sequence Number=SeqID_200838
atggcctcctatggtggtgagcttcttctagactcatcttctcctggaagtggtgtctcctctctctcttccttctccattccgctgccattcatcttccaagaagcaaaggaatccattgatgaagaagatcctaggcctacaagctccaatggagcttacatcactacatcaaacatacattattttgaaattccggccacgccaatggctaagagctctgttctctacaaagtcctcaaggtggattttgaagattccgctccgattaaagtgttcttccctatctcgcttagggagctcatctcgctaaccgaaactccaattttggtgctgagcgcaacattttgtgttgagcaaattacctcctcaggaattgcgcttagcgcacttgtctttctaagcgaattctcctctcaagttggaattgtgcttggcatgtttgtctcgctaagcaaatttccctctcgggttggaattgtgcttagtgcacttgtctcgttatgcgaatttctctctcgggttggaattgcgcttagcgcgcttgtctcgctaagcaattttccctcttgggttggaattgcacttagcgtgcttgtctcgctaagcaagctatccaaagatgttatttggaaaatcgcaatggttatcttcaaaatcttggttgacaggcttgcaacggttgcccttaaaatcatctccactcaacagaagggatccattaaagaaaggtccatttctgattgtatcagtgttgcgtgtgaagtattcaacatgatcaactatagatcttttagggttctgtggttggatttctaccatcctaagtttagttcatctttctttctctttcaatggctctctgtgaggataccttgcaaaatgggggtgaggaactaccctactcttactcatgtcctctacgtcgatgatatattggtgttttatagaaaaactaaaaggaacctctcctctttgatggacctctttcagtcttatgggaatgtctctgaccaaattattaatccgaacaaatgcttgctattttccagttccatgactccttacataatgttggaaattgaatccctcttgggtttcaaggccaattttctcaaaaacacaaaccatctatccttttacaagaaatcctcgctttggccttccctcaataggcactttgaggagttaggttttcacaataagcctactgacttccattctgctttcattcaaatctctgtgtccattactttggctgggatgctttctaaaggctttttgtcctactctatgcttgaattctcctttctgaaatcttttgatgtggacattcacccccctaaaccgcatctaattaaaagggtggactgctgtcctcctcttgcaggtaccattaaatgcaatgaggatggcttggctaaaggtgctcttggtcatgctaggagtgggggcatcttttcagttctcatggtagcttcttgggttgcttctcctcttataccctcgaagtcgagcctctcgctcggtgacctcgtctttgtggtctccatctccatgcgcaactctaacattgtctccattgcgaggccctgtggcatgttgtgcgtggacacagtcgaggtgtttctcttcagcatgagttgcgatggcaccgttttgagggaaggggtggaagaggtgaggatggcgtggaacatggtgttgagagggtggaaaggggttttcacgatgatggagcgcatggggaagatggggtttaggctcgatggtgaggggtggttctcgcaggagttgccagcactagggtgttgcttcggtgcaatggagagtgcagtggtggtagatttgaaagtggggatgtgcgaaggggagggtgagaatctgaatggggttagggtgaacgaagtgagtgtggggattttgagtgttgtggattggaggtacgctagtgttgaagataggcttagcttgattttatttttccaatggtgcattggtaagcgatctatttatgttgctttgcaagatccttccataacaattcttagaaaattgctcaagaagaatgattggaatgttgcgaaacgagggtgggatgctcaagttcttggtgaagccccttataagtttacaaatgctcttgaagctatcacaaagctaagggcagaaccaaaggccaacaaccaatatttgcctccttttgataggacttctg

SEQ ID NO: 84061 - DNA, 306 bp, Glycine max
  Peptide Sequence Number=SeqID_200839
atggctagacggaatgatcgtgtgatagctgatgctttccaagccttatcccaggctatggggaatcaaaatagtgatgttgagtatgaagggttggatcgcttccaacaaaacaatccaccttctttcaatggagaggagcagaaggttgcttttggcacatacactctgttagaagaagctgagtattggtgggagaacactcaccaatacttggaggctgaaggtcaagctatgacctgggaaaccttcaagagcgtatttctagagaaatacttaggacatgttactgaatttgatccttag

SEQ ID NO: 84062 - DNA, 348 bp, Glycine max
  Peptide Sequence Number=SeqID_200840
atggataagcctcttatccaaactgccctagtcctcgatgattctactgaccctgccattaagcaggttgagaagaatttgaagcaacttgagaagctgtggaaagaaatgaagacaagaagggtagcaccgaataagcttttcaatgagtataggatgaatgaggggcttattgatagggccatggtaggtataatggttagtgtgttctctaaagttggtctggttgatgaattggtgaaactcttacaagacatgaaagcagaaggaacaagactagatcagaggttgtaccaatctgcttcgaatgcttttaaagatgtcgggttgcaaattcaggcaaggtag

SEQ ID NO: 84063 - DNA, 405 bp, Glycine max
  Peptide Sequence Number=SeqID_200841
atggcgatgacacatgaacaacaactgaataatgtccttcaaaatggaaggttgggtgtggtgacaaaatcagattttgggaggactgctagacttgtgatggtgaatctggatgatgcattcgaggacttatgggagctaaaaatcccagctaaagctttaatctttgcttggaggctaatcagagatagattgccaactaaagctaacttgcgaaggagacaagttccactttgcagcattttgcctcatgttcagctggaggctattgtctggggtattggaacatctataggggaggttcctcctgactgtatctccagggtggagaaaaaagaaaaaagtagcacagttccatcttgtgctgctactaatggcctttttgattatggaagtcataattaa

SEQ ID NO: 84064 - DNA, 810 bp, Glycine max
  Peptide Sequence Number=SeqID_200842
atgacctcatcacatttgatgaggttaggaaacatagggaagcctctccatagtatgaatttggatgatgaacttcaaaaaaatgtgatctcaactgatcaaagtggacaacttgtgcaagaccttttatctgatcataattcatttattcttcctagtttgaaaaataataatattggcacattgagtaacaaaaccaataataatattaataggccttggaaggagattgttcaccaagaacatgtgaataggtctatggacacccccttgaagcaacctagtttgggggaaaccctagaaagttttctagttcgagcaggtgtgatcgatgtaggagatcatcaagatgacaataatgataatgttgttgttggtggtaatactcatcatcaggccctgatgggaatggatccagtggtgatgctttcacagaaggaacattggttgcaattgaaaattcctatagctattgacatgcaccaacatcaggagcaacatcatcaacaaagagatgttggggagcatcaagatttgattgttcctaagtcattattttatgagaaccaagaaatggaaattggttactcagaaaatccaggggggatttcagtgtcaccaacatattcagattcaaagagtgctatttttggaaagaacaagtattcagacgaggtgctggaaaagactattgagaggaagcagaagagaatggccaagaaccgcgaatctgttgtaagatccaggacaaagaagcaagttagtactagaatgactcctcaattatcatcaaagcatgcatgcggttag

SEQ ID NO: 84065 - DNA, 408 bp, Glycine max
  Peptide Sequence Number=SeqID_200843
atgactctacctgtaattttaaggtttcctacacaaaatttaattttagctgttagggaacgacaaattgccttacacaaggttttactggttgccactaatacattttgctacattgggaaaccaattgtaacaaatgttgtagtatatgcaatagtggaagagcagggtctagaccccaaagtaattgtcttcaaatataaaaagaagaaacactatcccagaaacattgggtacagacagggagcaaggaaggtactgaagatcaacgcgtttgccctgatggagcttaacatgctcaaaaaccttgttggtttttttgtcaccagtgttgttggtgggtttaacgctcatgctagtaacattgtttctaccatctttatagccactggcaaagatccagcttaa

SEQ ID NO: 84066 - DNA, 228 bp, Glycine max
  Peptide Sequence Number=SeqID_200844
atgtggaaccaaatagtctcaagagtgcacattctgcaaaagaggcttgacaaatgctcaggcttaggggggcatatgaatatccataggaacaacaaaaagagaggaaatcaaggtctccaaattggtccaaatcatattgatgataagattcatcatgtcaggagaggaaatcagaaagagagtgatctggacttggaggtcagacttggccatgatccacactga

SEQ ID NO: 84067 - DNA, 159 bp, Glycine max
  Peptide Sequence Number=SeqID_200845
atgcttcctttcgacttccggcatttcgcggaacttcacggattgcctaacgatggacagagacagaggcagccgagggatgatgaatttccacatttccttggaggaagcggagccatacaaccgggatcgccatacttgcaatttatccttcattaa

SEQ ID NO: 84068 - DNA, 1041 bp, Glycine max
  Peptide Sequence Number=SeqID_200846
atgagagacgtagagcaactgctttctttattggtggtcatagagggagagagaggggatggctgttgtggtcaatttgatcaaatttgcaatgcgcgattaccccgagctcttgatccccgctctgttccatcagaagagctttccacttctttgggatacatggtgcaacttctaaatcttattgttcataacttggctgccccagcacttcataactcaggttttgcgggttcttgctctcggatatggcaacgagattcttattgggatgcacgtccttcctcaaggaggagtaatgactttagcctgacatactttcttgttttcagcaatgaatatcccctgtttatacctcgccaaaattattgctctactggtggagaaaactcatggtctgagagaagctcaagcaattttggagttgcttcgatggaatctgagaggaggcatcgcctagattcatctgggagtagtagctttaattattctttagcttcttcacattctgttcaaacacacaaagatttgcagaaaggaatttcacttttaaagaaaagcgtagcctgcatcacagcttactgttacaactccctatgtttggatgtcccttctgaggcatctacatttgaggcttttgcaaagttattggcaacactgtcatcatccaaggaagttcgatctgttttttccttgaaaatgcctcgctctaggacatgcaagcaagttcaacaattgaacaagtctgtttggaatatgaattctgctatttcatcaactactttgctggaaagtgcgcattctgtgcccacaacggactgtatgtatcagtgttccttggatagggcttttagaattgaaaattatctgccaagtgctacggctagttttctttatgccactgattctgacggaaaaaatgagtgcctagttgaaggatgggatatcgttgagcatcccacatttcctcccccaccatcgcaaagtgaggatgttgagcactggactcgagccatgttcatagatgctaaaaggaagtga

SEQ ID NO: 84069 - DNA, 465 bp, Glycine max
  Peptide Sequence Number=SeqID_200847
atgatgcaagccggtttcccgaacgatttgatggtttggaatgcatttcccaagcaacgagtcttcggttcgaaaccagcagagagagagaagatcaatgatgcaactgatttcatgatctaccctggcaatccgacaacaatctcaccaactagttatcctcagtgtgattgggattatatgtctccatacaaatcatatgaccaaatgatcttacaaacatttgctaaaagggaagccttttccgccaccatccatgcaccctactgctattaccgccaccatccatgcaccctactgccattaccgccaccatccatgcaccctactgccattaccgccaccaccaccccacagccaacaccatcacccaccactatcatgggaaaatggagggagagtggttgggcagttagtgttgtggcaagggagagtcctagatctctcgaatatccagggaattag

SEQ ID NO: 84070 - DNA, 906 bp, Glycine max
  Peptide Sequence Number=SeqID_200848
atgaattttctgagagactcgtcgtctgcttgtcgtaaactggccaaggtggtgagatctactggatatgtattatgcaccgaagtgttcgatgggggtgtcgaagctgtctatggatctaggtgggaatccaccataccagatcaatttcgtccccttgagggacattggaaagacacgacaaaagattgcatcgtcattggtgtgcttaggcaatgtgtgggtagagagctcgtcatcctagggatgcctaacatgaggctccagtcgatcatgtgggatcatggactttgcacgtcagctttgagagtgacctttattaagaggacaggaggagggacctgcaaaataaatgactctaacgctcaatttggatcaaaacaagaaaacttagagactagtgttgttctaggtgacttatttcaaaaagagcataagagtgattccatgaaatctaaaattcaagttgatactgttggacaagattcttctagtgttaacgtagaaaacattggagactttgagcataaaaaggatgatggcaatagaagcaaggaatctacacaaaagaatcaaaagacagaaaatacttcagaagacaatactttgaagcttgaaatgggtggatctaaggtgcatagcactaaaattggttgcaacacatcaatacatattttggacaccaatccaaaggctccatgtgtggttgagaagacaatttctcttagaaactttgttagggagaaaagtataatagcagtctccattatgttacgtcatctttctgaaaaaagatataaaggtgttgtaggtaattcttctaatgtgggtaaggatgcttcatattcatccaaagacaatgaaatgaaggaggtttatgagaagacaatggagaaaacaacttga

SEQ ID NO: 84071 - DNA, 303 bp, Glycine max
  Peptide Sequence Number=SeqID_200849
atggcagaagctacaatcatcaaacaatgcaagacttcaaacagtcgcaatatatcttcaaattcttcagaatcatttaatcaaacaccttgtaggaaaaaatgggcaatgctagacatggagagaaccttgaggtctaccaaactcaagggcatcaaatttgacattaagcctaagaaaatagttccatatgcatcgtcatcagaaattgtcactcacggaggaggaaggtggtgcatggcggtcagaaatcgcctcatggtagcggcgaccaaaaacagaggggttttgttgtggacgtaa

SEQ ID NO: 84072 - DNA, 195 bp, Glycine max
  Peptide Sequence Number=SeqID_200850
atggaattcagaacattagagaagatagatgggtcactagctagtgcgccaccaccgtgggcctcttccgcaccactatcgcccctgccatccccgtggcggccttgcatcacggcgccatgcaccaatggtgccggggaaacgtgccaccctccatggtggcttctcctattgcagcgccgtttggggagttag

SEQ ID NO: 84073 - DNA, 210 bp, Glycine max
  Peptide Sequence Number=SeqID_200851
atgggtctccgaaaaaagtggagaatggagaattggcgaacagcgctaggcaatgaattcatggggctccgaaaatgtggagaatggagaattggcgaacaattcatggggctcctaaaaatgtggagaatggagaattggcgaacagtgctaggcgataaattcgcggggctccagactcgttggtggaggacacatgaacagcgctag

SEQ ID NO: 84074 - DNA, 168 bp, Glycine max
  Peptide Sequence Number=SeqID_200852
atgattctattccatttgcgagaaggtgagattgggttgagaaagtggatgatggacaaagatacactggggtatagtaggtggagaagttcgaagaacttaggggaactaggaactcataagcctcactttgctactcctgatgggctccgagactatgatttttga

SEQ ID NO: 84075 - DNA, 882 bp, Glycine max
  Peptide Sequence Number=SeqID_200853
atgccgctctatactaagttcctgaaggacctcctcactaaaaagggaaaatatatcaacaatgagagtatagtggtggaaggaaactgcaatgctgttattcaaataattttaccacagaaattcaaagatcccgggagtgtgaccattccttgtttcgtaggagttttattagtgggaaaggcattgattggcttaggagcaagcatcaatctaatgccactttcaatgtgcaggagaatagggaacttgaggattgcgcccacaaggatgacacttcaacttgcagaccattcgatcacaaatccctatggtgtagttgaagatgttctagtcaaagtccgccaattcatatttcccgtggattttttcattatggacattgaggaagactcagatattccactgattttgggtctcccattcatgttgacagctaagtgtgtagttggcatgggcaatggtaacttagaaatgagtgttgatgataaaaaagttaccattaatttatttgaagcaatcaaacatcccaatgaccacaaggcgtgtttcaaagtggaaacaattgagcaagaagctaatatggtggttcaaaacatgacctctcactctccattggagaaggtgttgataaattctattgattgtctcacaaaagaggaggagaaagatcttatggcctgtttggaggacctagataaactgaaggtaattccttcaggagaatgtgtctttgaagagctaaagaagaatcccacaatagagaaacccaaggtagacttgaaagtcctgccagcgcatttgaagtatgcattcttggaagagaatgaagcaaatctggtggtgatcaacaacaccttatcctctaatgaagagttctga

SEQ ID NO: 84076 - DNA, 291 bp, Glycine max
  Peptide Sequence Number=SeqID_200854
atgaagaagaagcaggaagaagaagagttgatccgaaagaagaagaagcagaagcagaaacgcggggagagagagaggtttagcgcagatttgggtaagaatgaggttgaggtcttgaagcatgtgtcaaactacttagatccagttgactcagaattattattagacctacttgccacttctgagttgaaggctagaacaatgtggttccctggaatcgcagaacaacacgagaagctgaggctttggctctgctgcatgctcttcagtggacgtgtacctcgcagctag

SEQ ID NO: 84077 - DNA, 282 bp, Glycine max
  Peptide Sequence Number=SeqID_200855
atgacaataattgttgttcgtgtttcagaggggaagctggtggtgaaggagagaacgattttgactgaaatgtcgaaggacgtggtggagacattgatgatggaagaaatatcaagttgtggtagatgtttaagaaaatgggagatcgaggaagggacattccattggagactcaattttagttggtggaaaccaaagatgtgtccagaaccagaaccaaatcatgtacacagtctttctacctctcatggaaggctcattcagagtgtgcctccagggtga

SEQ ID NO: 84078 - DNA, 183 bp, Glycine max
  Peptide Sequence Number=SeqID_200856
atgacaggggaaagggtccacctattattggtggagaaagttcaaaaacagatggtgatgaaggaccagatgtggataagaaggctgatgagttcattgctaagagaattgagtcaatcaagaggagtagaaggagtgcaagaaactcttcaagcacaacctgcatttcaaagatacctttag

SEQ ID NO: 84079 - DNA, 2398 bp, Glycine max
  Peptide Sequence Number=SeqID_200857
atgaaccccaactacagcaaaatgagaaccatttctttagtccagaaaaaagcaaaaccgggaaataatgaaacactagtctttaattttgagggtactctgttacgatccacttcattgttcccttacttcatgctggttgcttttgaagctggtggggtattaagatctctcatcttgtttctttcataccctttggtgtggttggtgggtgaagaccaacttggcttgaagatcatggttttcttgagcttctttggcctcagaaaggacacattcagaacaggatcagctgttctgccaaaattcttcttagaagatgttggatgggaaggctttgaagctgcaatgtgttgtgagaagaaagtggcatctagtaagttgccaagggtcatggttgaaaatttcctgaaggattatttaggggttgatgctgttatagcaagagacttgaagtcctttaagggtttcttgttgggagtttttgagaataagccaattaaaatcccttcatgtaaagttaatggagggactaaagggagcaacatcaacaacagtattgatattatagacaaccatgttgaatatattgaccaggaggagcttttccaactattcaaggaggtttacatagctgatgagaggagaaattggcatgttcttccaagagagaggtaccccaaaccattgattttccatgatggaagattggctttgaggccaactcttgcatcttctgttgctttgttcatttggttaccctttggactagttcttagcctcctcagatttacaataggcatagcattacccctcaatgtatctgctccaatattggccctcacaggaacaagaaccacagtttcaagaccccaaagtgcttctttgtctttggtccactatgaacaaaatcaaaagggcatgctctatgtgtgcaatcacagaaccttgcttgaccctctttatgttgcaattgttttaggaaaaccactttctgcagtcacatacagcttgagcagattgagtgaaatagtgtcccccatcagaactataagactaacaagggacagagtgaaagacagagaaataatggacaaaatgctgacccaaggcaaccttgtggtgtgccctgagggaacaacttgtagggaaccttatttgctaaggtttagtcctttgttttctgagctcacagataacattgttcctgtggctgttgatgttaaggttagcatgttctatggaacaacagctagtgggtataaatgtttggacccctttttccacttcatgaatccaaatccttcatatttcataaaatttcttgggatgttaccacaatcacaaacatgtcaaggtggtggaatgcccaagattgaagttgccaatttcgtgcaaaatgagatatgcaatgctttggggtttgcatgcaccaacttgaccaggagagacaagtatttggtcttggcaggtaatgagggtgtgagcccaagcaatgattgcaaccataacaacgacgatgatataaatattagtggtgatcacggtggtagtggtgatggaggtgacattggtggtggcagtgatgatgtggtagtggtagtagtgttggtggtgacaaccaatggtgacgatgttggtggtggtagtggtgatgaaggtgatattagtggtggtggtggtgatggcagcgttggtggtggtggcagtaatagaggtggtatttgtaacctctctaattgtcgacttctcggtgactctcatactataacaattcacacggtgacatttcactcaactcctcattggttagaaccctccgtcgatcagaaccctccatccgttggcgtactttgtccttactcacatgtttttcgggaaactttccagaaggtcattcgtcccataattgctccaagtcaagcacacttaactgttgagttcttaagtgacgaactaccaaaaagtatatgcattgtgattcattggaatgttacagtattagtggtggtggtggcaatggtgatgctagcaatgtcggtggtgatggtggggacaatgatgatggtggtgtgtggtggtggttgcagcaacgttggtgatgattgtggcgacgatgacggaggtgatattgttagtaatggtggtagtgttgacaatgacattgacggtggtgatggtagtaatgtcggtggttatgatgatgttagtggcgacgatgatgaccgtgacaatagtgtttgtgttgtggtggtggtggttgcgatgacattggtgatggttatggttgtgacaatgatgatgatggtgacagtgacaacgagaaaggtggtggtggccgtggcagtagggatgatggtggtggtagtgaaaagtgtcattatcaaatatggaaaat

SEQ ID NO: 84080 - DNA, 616 bp, Glycine max
  Peptide Sequence Number=SeqID_200858
atgagtaatatcaccatctatcacaacccggcctgcggcacgtcacgtaatacactggagatgatccgtaacagcggtaatgaacccactgttattcactaccttgaaacaccgccgactcacgatgagctggttaaacttatcgcagagatggggatcgtcgtgcgtactctgctacgcgagaatgttgaaccttatgcccagttgggactcgcggaggacaagttcaccgacgagcagttaatagaatttatgctcgctcatcccatcctgattaatcgccctattgtggtcactgaacggggaacccgcttatgtcggccatctgaagtggtactggatatcctgcccgatccgcagcaaggcgcttttagcaaagaggatggagaaaagcggcgtacacgtattatcggggctgccgccactgaagttacttcagcggcggcagacagtttatcgctatcagaagcggtaatcgacggccataaagtagcgacggccatcttcggtgtagctgtaatcgtcgcggttcagatctttgtcaccaacgttaagcacgccggagcgcagtttcacgtttttactgacctgccacgcggcgccgatatcgaacatg

SEQ ID NO: 84081 - DNA, 1566 bp, Glycine max
  Peptide Sequence Number=SeqID_200859
atggtgaaaagcgtggttcatgtgaaagagggaggggctggagtgtacctaacacccatttctcaccgagcatgcttgttatcctacacatgctggatgcttcctatgcctttagttttacagcagctaggggctgaagtcaatttttctaacattatggctaataccaaggccaatcaaagtgagtctagtgaaatctctccaaacgagaccagcaagaggcaaagaatgtcacctgcctctgttgaagaatgtccaagacttattcctaatctccctgatgagttatcccttcagattattgctagacttcctagaatttgttactatcatgtaaggctggtgtctaggaagtggaaagcgactatcacgagttcggaattatataaagtaagaaaagagcttggaacaactgaagagtggctatatctgttggttaggattggacaaaataaactcttatggcatgctctagacccccgttctcgaatatggcagagacttcctattatgcctagtgttgttgatgaggaagattcccaaaagggttcttctgggctttggatgtggaacatggtaaaaggtatcagaattgctgaaattattagaggtctgcttggacagaaggatgcattggatgacatgcccttttgtggttgtgcttttggagctgttgatggatgtctttatgttctaggtggattttctaaatcttcaactatgaaatgtgtatggcgatttgatccgatacaaaatgcgtggaagaaggtgaattctatgtctacaggtagggcttattgtaagacaggaatcttaaataacaagctttatgttgttggaggggttagtcaagctggattgattcctcttcaatctgctgaagtttatgaccccttctcggatacatggtccgatgtacctagtatgccgttctcaagagccggagtcctgcccacagcttttttggctgacatgttaaagcctattgccactgggttaacctcgtacaagggaaggttatatgttccccaaagtttgtattcatggcccttttttgttgatgttgggggagaaatatatgatcctgaaacaaattcatggatggaaatgccaaatggaatgggtgaagggtggccagttaagcaggcaggaaccaaattgagtgttgtagtgaatggtgaattatatgcttttgatccttcaaattctgtggatagtggaaggatcaaggtatatgatcaaggagaggatgaatggaaagttgttattggaaaagtccctgtatatgactttaccgaatcggagtctccatatctattagctggtttccatggaaagcttcatttcatcacaaaagatgccaatcatgatatttctgttctgaaggctgatcactgcagtaatgtggattcttcaccatcaacctcagcacctcaatcacccaaatacatggaagatgaattgttgcgagaatcagctgaaacacatgaagctgtttggaaactagttgcaagtaagggttttgagcaggctgaactgatcaattgccaagttattgacatctag

SEQ ID NO: 84082 - DNA, 489 bp, Glycine max
  Peptide Sequence Number=SeqID_200860
atggtcctccaaaacacaaacaatatcacagataaccataagtccttcagatacaacgatgcaagaaacaaaatcaaggccaagagcaaaaccaaaacgaaaatgttccctccctatatacccttactagctagaactcaaaacctggcctcacacatgccatgggtgttgaagaggtactacacaaacgagggaaggttgattctgaaagaggagaagatgaagcaccacgagtactttcgtgcacatagggccaatggtagactcacattgcaccttgttaacgttccctttgatggccataatgagtactttgaagaagcaacaccatctaatactccacatgatgaagaggttcattatcacactaatattgttactattggtggtggtagagtcaagtgtttgaactgcagtagtgtgagaacaggtccaacgtgtaacatttttgggttgcctgtgcttccgattagaacggttcatagttga

SEQ ID NO: 84083 - DNA, 123 bp, Glycine max
  Peptide Sequence Number=SeqID_200861
aatcctaacagagcatttagaggagaagctctagaaagcactagaaacgtcaccattgctaatggagaacgcttgaacaactacatcgaggtaagggatgagttactcgcgcttggagattag

SEQ ID NO: 84084 - DNA, 741 bp, Glycine max
  Peptide Sequence Number=SeqID_200862
atggcttccgcaagtggatatcttccaacctccctacttgttctaaccaacaagaactatgataggtggtgtgcccatataagagttatctttcaatttcaagaagtcactaaaatagtgagagatgggctccaagaagtggagaaaaattcatttgatgcacaaatagcaacccatcatgatgcggagaagagaaatggaaaagacttgttcatcattcatcaatgtgtagatacaaatgattttaagaagattgtctcatccaatacagtgaaggaggcatgggacactcttgaaaaagcacatggtggtgctgataaattgaagaaggtgacgttgtatatattaaggaggcagtatgagctactacaaatgaataaaggtgaaagtgttgctaagtacgtcactaagttgttgaccattacaaaccagatgaaaactaatgttgaacaactggcaactctaatgattgttgagaagggacattttgttgatgagtgtagaagcaaacaagtgaaagataaagaaaataaggcacaacttgcacatgatgatgattctgattcagaacatgtcttattgatgttaacaacaaaatctaaaggtgattcttcagatcattggtatctgaacacaggctgcacaaaccacatgttaggaagaaatgtgtggttcattgatctcaatgaaaaggtgaaaagcaaggtgaagtttggtgacaattttgtagatattgaatga

SEQ ID NO: 84085 - DNA, 339 bp, Glycine max
  Peptide Sequence Number=SeqID_200863
atgctgcctaacaaccttgtgacagaagaaagaaatctggtccatctagccttgttcatagaagcagagcctgttaccattgaggagacaattaaagatgagaagtggttgaatgctatgaaaaaagagttgaattcaattgagaggaatcacataggacaactagtttcattgcctcaacataaaagacctattgcagtaaaatgggtttacaagattaaaaggatgcctgatagaattattgctaagtacaagacaagtttatgtaactcccgatctaataactttgcctcttcattctaccaaatttttcaggacatagtcaaagagttagaataa

SEQ ID NO: 84086 - DNA, 1356 bp, Glycine max
  Peptide Sequence Number=SeqID_200864
atgggtttaaaagaaataggggatagaagggagttggagtggatgctgaagaagggtggcaatggtgtgttgcattacacatggattgatatagggactccaaatgtttcatttcttgttgcattagatgctggaagtgacatgctttgggttccctgtgactgcattgaatgtgcttccctgtcggccgatgctcccttttatatgggggcatctctgatgcaggacagggatctgaatcagtatagaccatcattatccaacaccagcaggcatctaccttgtggtcataagttgtgtgatgtccattccttttgcaaaggctctaaggatccttgcccttatgaagttcagtatgcctcagctaatacctcaagttctggatatgtttttgaagacaaactacatttgacatccgatggcaaacatgcagaacaaaattctgtgcaagcctctatcattttaggttgtggaaggaaacaaactggtgactatttacatggagctggtcctgatggtgttctaggcctagggcctggaaacatttcggtcccaagtttactggcaaaggcaggacttattcagaattccttttcgatttgtctagatgagaatgaatcggggagaattatctttggtgatcaaggtcatgtcacccaacattctacaccattcttacccattattgcctacatggttggagtagagagcttttgtgttgggagcttatgtctcaaggaaactaggtttcaagcacttattgacagtggatcttctttcacatttcttcccaatgaagtttatcaaaaagttgtaacagagtttgacaaacaagtaaatgcgtccaggattgttctccaaagttcatgggagtactgctataatgccagttcacaggagttggttaacattccaccattgaaactcgctttttctaggaatcaaacttttttaattcaaaatcctattttttatgatcctgctagtcaggaacaggaatacaccatcttttgtttgcctgtaagcccttctgctgatgactacgctgccattggacagaacttcctgatgggttatcgattggtgtttgatcgggagaatctaaggtttggctggtctagatggaattgccaagatagagctagtttcacatcaccttccaatgggggatcaccaaaccctttaccggcaaatcagcagcagactgtccctaatgctcgtggtgtaccgcctgccattgctggacacacgtcccccaaaccctctgcagccacacctggacttgttactacctctaggcattccttagcttcattgttactgatatgtcacctttggctttggttatcttgttaa

SEQ ID NO: 84087 - DNA, 744 bp, Glycine max
  Peptide Sequence Number=SeqID_200865
atgaagaaggccacaagaatcgtttcaatcttcgtgatctcgatgctctgtttccaagaactcatccacgtttcttcgtcacctttcttgtacgcacaccaggtctatgaggaatcttctggtggaagaaatcttaaacaggaacaggaacaggaacagaaacatgctcaagaagtgcattgctccagggagagaagtagggcagctcggaaagtgatagaggagtatttgacaccatttatggaacgagaaaactaccaactttcaagtaagtgcaaacttcaccctgaaaatgatatattcacggatcaggaagagcataaaatttacatagatcgacatgaatggcggtgtggatattgtaagaaaagctttcgtgaagaaaaatttcttgatcagcattttgacagcagacactacaattttctgaatctaagtcatggtaagtgcttgggtgatttatgtggcgcattgcattgtgatgctgtgatgaatttcaaatcctctagaagcaagtgcaatccggcagctgctgcaagaaaccgtcatctatgcgagaatcttgctgacaactgttttcctataagtgagggtccatcagcaggccgccttcatgaattgtttctgcaccaattttgtgatgctcacacttgctcagggaaacataaacccttctctagaggaggcaagtcatacctatcaaaacttgaagttatactgtacctttctgttgggaaggcttaa

SEQ ID NO: 84088 - DNA, 381 bp, Glycine max
  Peptide Sequence Number=SeqID_200866
atgacgcgagcaactatcttcaccagaacaggaactcgcccagcacatcaatgtctagctagtcccaaaagtgacacctacacgtcatatgggacatcaacattaatcttgctgacactcccctacagcgaagtctcattcctatcatggacaacaacttcatggggcatcaatcccgtcaaccaagacgaccccgtggttgtctccatcaccatagcaaacttcatggtgtacatggtccttaccgaccagggcagtttcacagacatctcgtattggaaaaccttccaaagagtcgaggtctcacccgacattgtccacccttacactgatctaaacctcggctttgtgagttcttcagggaacgcttacatacaatga

SEQ ID NO: 84089 - DNA, 225 bp, Glycine max
  Peptide Sequence Number=SeqID_200867
atggtgagcaaaggttggagctttgatggagcttcaatggtgaggaagaagaagggaatagcaattttgcaagccgtttctctggttccagtccctcgcgtttctctgcacccgtcggggccagttttcgaaggtaggcaatatatatatcaaaacgctcagaatgaaaccccgagcgtggttcagaggttggttttgttaaattttaagttgcacgcaaaatga

SEQ ID NO: 84090 - DNA, 198 bp, Glycine max
  Peptide Sequence Number=SeqID_200868
atggatggcgaggagctaccttcacccgtgaactccgatgttgtcaagcggagcagaatcgtcttaggcgatggtcaaataccgggccaaatccaaaggcagagaccaatcagggtaaacggtaacgtggccacagtttgttgcgcaatgtcatttcctgttttcaggtacttagggacggacacgagtagaggctag

SEQ ID NO: 84091 - DNA, 528 bp, Glycine max
  Peptide Sequence Number=SeqID_200869
atggcggatcttgaaaacagcgaaaagtatcttgtagatgtcttgacacgtgtcatacagagaaaggaatacttgttgagcaaccatctatcttcgtatgatccatctggtattcaggggataccgacctctttcgagaatgtaggttggttgcaggatgggaatcagaaccatacccagatttttgatgcatctgctcctttagatcctttgagggacttgtcttccaccgtgtatggttcattttcccaagggacaagttcaaatgctaatccacgaatcatgggggagtgccacgtgtcaaatccaagtgatgggaaccttcaagcatggcctctagggtacaccttgtatcctcatcatcatattcagcatggcatggtgggacccgacatgacagatatgatgccaaatgggcaggtgaacatcccaatcactccctcacacgtggaacaacctaagaatgaatctgtagaatatgaccagtccaaacaacctcctcctcatcatcaacttaatgctcaatga

SEQ ID NO: 84092 - DNA, 288 bp, Glycine max
  Peptide Sequence Number=SeqID_200870
atgcatcatatccgacttctcaaacaaattctcaccataaaaaatgcaaactatttgacaaatgggaatttagactctgccatagactggattcctggcttgaagaacatcactctaagggaccttgctggcatttatcgtaccacagatccaaatgatatacttttggactttgtggtggaacaaattgaagaaacttcaaaagcttcgactattattcagcccatatttgatgccttggagcatgatgtgctgaatgcactctccacaatgtttcctaaactttaa

SEQ ID NO: 84093 - DNA, 222 bp, Glycine max
  Peptide Sequence Number=SeqID_200871
atgaactgttttagcaccctagtacctagtggaggagtgtatgtagggttttcttcgagccacagttccaagagtagtgtagggttttcttcgatagggggttctgtgggttcgaacgagcggttttcagcagtattgaaaacaatgtgggacaatgtcggtgtcaagcgagcggtttccggcagatttcaagcgggaggagaaagagaagaccgagtgtag

SEQ ID NO: 84094 - DNA, 1215 bp, Glycine max
  Peptide Sequence Number=SeqID_200872
atgttgttatcaaacagcattgagagaccaaatcatgtatggtctgaaacatatttgcaactggaaatagaagagttacagaatttggcattgcttgagattgaagatatattacaatccaacaaaaaatcattgaaggattatccagccatgccttttccaagacatgtggtgttgtcacatatagtagaaaaaatgatggctcatgtagtagctaccttcctttttttctatgcaaatacacatgaacagaggcatatctttgatagtatcattaatgctgtcaatagaggcgctggtggaatgtttttcctatatgggtatggaggtactgggaagacctttatgtggaagacattagcttctacattacgttcaaaaggtgatattatgttaactattgcgtcaagttggataacatcattgttattaccatatgacaaaactgcacattcaaaattttctattcctgtgcctacattacaaaactcaatgtctaatatccaccaaggtacagaacaggctgaactattaaaggcaaccaaattgattatatgggatgaggctcctatggctcataggtattgttttgaggcattagataagacattgagtgacatcatgtgtatgtctaattctgacaatgttccatttggtggaaaagttgtagtatttggaggtgatttcaggcaaattcttcctgacattcctagaggaagtagatcagatatagtgcatgctactataaatgcctcatacctgtgggactactgtactgtcttgaagctgacaaaaaatatgtgtttgcagtcgaacctcacattgacaaattcacaagaaatcaagagcttttcccagtggctgatagatgttggtgatgggaaactaggcaaaagtgatgatggctgttatgagataaaaattccacctgatcttttaataacaagcttcaccgatcctattgaagcaattgtaaaccatacatacccagatatccagaagaagtataaagatgaggaatttctcaaatccagatctatacttgctacaacaaatgaggttgtagaccaaatcaatgactatgtattaaacattatccgaggtgaagaaaaggggtatttcagctatgactcaattgacatgaaaaatgctgcaacaactaaagcttttgaagcaattacactagagtttctacattcattaaagacatcatga

SEQ ID NO: 84095 - DNA, 729 bp, Glycine max
  Peptide Sequence Number=SeqID_200873
atggacttaaattcactggagtggaccatctgtaaatctcatgccagacaaaagctcaaaatctactgtctcaaattagcagaggagcttggggtgatagttcctaacccatgggttacttgctttaaggcggctagtttacctgccattgtttgtcttcttatgccattgattttgtacaagctctatccccctgaaatcaaagacacaccagaggctcctgccctggctgccaagaaactggaaagtatgggccttgtcattaaaaacgaatggattatggtcggcacaatgctccttgcagtgtctttatggatctttggcatagcaagtgctgtagctgcaatgattggtttatcaatactcctcctattaggagtccttgactggaataactgttggaatgaaaaatcagcatgggataccttagcttggtttgccattttggtaggtatggcaagccagttgacaaaccttggttatgtgagctggatgtctgattgtgtggccaacaaccttcggtcattctctttgagctggccggcttcagtagctgttcttcaggcagcttatttcttcatccactacctttttgcaagtcagactggacacgtgggggctttatactccgcagttcttgccatgcataaggcaggtggtgttcctggtattttggcagcccttgctttaggttataatacaaatctttttggtgcaataacactatag

SEQ ID NO: 84096 - DNA, 183 bp, Glycine max
  Peptide Sequence Number=SeqID_200874
atgggacacaagcgggataaggaggtggcaaggtcaatgatggttacgcgacagtcacgtgattcgggcatggctaaagggaggagaagcaagaaaatgtggtggtgtcattatagggaagagagggaaatgcagaaagtaattagagacatgttaaagctttattgtccatatttttattaa

SEQ ID NO: 84097 - DNA, 405 bp, Glycine max
  Peptide Sequence Number=SeqID_200875
atggatgtcttgtgtcttgttggaacaagtgtgaaaccaaccaaacacagagggcgggcaaggaaagcgtcgattgctgctaggtctatcaaaccatccacgtacttctgtggtaggcccgctatgccgttccgagtctgttttatgcggtccaaacctctggctgaatccttgaccacagttgcaattctgctcaaagaggggagacacccggaggaaagatatggtttccttcccccgagaggacatcctagaatttcctcaaattcttcaatggttggtactaattggaagtccccgaatgtgaaagcatctcaagggctggtcgtagtattggggggttccatcaaccgccctaattccttgatgccggtggtatctgggcttttgaccttgacttggtag

SEQ ID NO: 84098 - DNA, 397 bp, Glycine max
  Peptide Sequence Number=SeqID_200876
atggtggaatctgaaagacttagctatatcagaaacaaccaaaagaagcttagagttgataagtattctagcttacaaacttcattggatactagaatggctaaaggcttaaccaagggaaaaagagtcatcttaccctcaacgtttgttgggagctcacgttatatggatcaactttactttgatggtatggcaatatgcagtcatgttggttttccaaatcttttgattactctaacctgtaatccaaattggcctgaaattcgtagattactttcacctttgaatctcaaaccaacagacaggccatatattgtatcacgaattttcagattaaaatatgaacacatgctgtcagacttaacaaatggtcaattaataggaaaagtggttgcat

SEQ ID NO: 84099 - DNA, 282 bp, Glycine max
  Peptide Sequence Number=SeqID_200877
atgcattttatgaaaagatgtgactcttcacaattgaatttgaatttcaacgttcagatacactggtgtcgcaacctacccttcggtgggagggtgacgcgagactcacggatgcgtcttccacgaaaggaaaatgcgcagagtcgccaccaatttgaggaaaacgtcgaaaaaacaggaaaaagatgtggtctacgaactttaagtgaaaggttcgggagttgtatttacgcacggggaagggtgtttcccttgctcctacgtattcctcaattgtggtaa

SEQ ID NO: 84100 - DNA, 381 bp, Glycine max
  Peptide Sequence Number=SeqID_200878
atggttttcggggcttccgcggcttccgtaaaatttccgaaaaccttgggtaagcatattccacttaacattggtgaaagggaagagaaaaaagatgaaaatcaaattcgaaaacagttccgtaaggcttccgtaacttttccaaaaatcaagtcgaagtacttccgtaacgcttccgtaagcgattatgtggaaattcttcatcgttcttcgtcgttcttcaccgttcttcatccattcttcgttcgctcttcggtcttcaacgggataaagacaaacttaacctttgttcacaaagaactacgtaggtctgatttccttatcgcaattaaggaatacgtaggagcaagggaaaccccctcgtcgaccacaaaaagataa

SEQ ID NO: 84101 - DNA, 213 bp, Glycine max
  Peptide Sequence Number=SeqID_200879
aagtcgcaactagcagcattcttagcaagcgcaaaatctaaagaaagtcttgctcagaatctcaaagaagttctccaactacttcaacaggaagtggaagaagaaccttccaagaaggaaactgaatcatcagagactaatgatgaccaagaagatgatccattctaccagaatgaagatgactgttttggtatatcattggacgacgattaa

SEQ ID NO: 84102 - DNA, 720 bp, Glycine max
  Peptide Sequence Number=SeqID_200880
atggtgcttggtgattttgaagtgagtagggataggatatttatctctaccaaccaatttataacatctttgaaagaagatgcccaagtgtacatgatcctgtccaacctggaagtagagagcaaggtttctatgagtgatctccctgttgttagagagtttcctgaagtgtttactgaggatctatccggtttaccacctgggagagatagagttttctatagatctagtacctggtgcagacgctttgtgagacccagcgtgtctctatgggaagcgctagtgttgttagtgaagaagaaagatggaaccatgaggttatgtgtagactaccaccagttgaataagcttgctaagcaagtcttacaggttataaatacgtccagcagtgagagaaacacgattttctaccctttttctcctgaaaccctaaacctacctcctcactcacccattaccaccaacggccaccatgagccaccaccacttgtcgctggaccactgcacagagtggaaccttttgattggagcgaaaccttcaaaacccaactcatggattcagtagagaacggagccctcaaccctcccttcacggttttttcaagatatcaagggcacaccgaaacggcttacaaacccaggtttttgaaaacaaagaaatcgaagcggcggcagagccgcacaggatcggtgaggggagaagggagatatgaaaaatag

SEQ ID NO: 84103 - DNA, 276 bp, Glycine max
  Peptide Sequence Number=SeqID_200881
atggtccttcatgaagacctacatatcaaccttcggcagcattcaacgttgcagctatcaaagctccaaggtgaaagatggttggtggtgtggctcgtgaacatgtggcgcatctggtattggcacaagcagtgcgtgtttgttggtagtgtatcatttgattctaaagacatgcatgatgtattagctacttctccatttattcatggccaggtcacacatttggctttatttgtacatatgctgcaagcacttgctcatggtttaaacttctag

SEQ ID NO: 84104 - DNA, 573 bp, Glycine max
  Peptide Sequence Number=SeqID_200882
atggctagtgaaagatctatgttaccacctcttcaatatgattgtatcaataactctcatgaggcacgaaactctaggtgggcatctccaaatttaattctcaacactggcaaccagagttccacaccaatggtttcttcagctggttcatctaatgttatcattcctatgcaaaatctgagacaaaacttacaaattggaagggagctgagtagagaagaaccaaatgaaacagcaaggaatttcatactcatagagggacaagtagaacgactatgggataatcaacgatttgaaattggagaaggttcatcctctaagcgccaaaggacaaatgcacctgcaaggcgaggacctaacacaggccttgcactccagctaccaaacaatgcacctgaaaatcaaggggtgcagaatcagaacaacaataaccctgaaaatcatgtggaaattaggagtaattctctctatgatccagtatttgagactcttggcctagctcctgaccctcacattagattgtttgaagcacagaacggtcaagcggaaagagggtattacatgtttaaatga

SEQ ID NO: 84105 - DNA, 833 bp, Glycine max
  Peptide Sequence Number=SeqID_200883
ttggcccagggcttccggttatcaacagggacaccagatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgttctcgactgagaggaattggactggtggcagagagatgagaatggctggaggattgcagagtgtccgtgtctttattcctgttattgtccatatccttgagactacggacatgtttttggcatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttgtcattgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 84106 - DNA, 358 bp, Glycine max
  Peptide Sequence Number=SeqID_200884
aatactcaagtgggtctcgcaagatgaagatgaccttaaagaaacccccaagggtaggatccaagcagtgattctggacatgactaacctgatgaatgttgatacgtctggaattctagcacttgaggaactgcacaagagattgctttcccgtgggttagaactagctatggtcaacccaaggtggctagtaattcacaagcttaaacttgcactctttgtagacaaaattggaaaagaatgggttttcctcactgttggagaagccgtagacgcatctgaacatctatacggaaagggacaccatgctatactggaggggcaggaatataccatgcaccgtgagggtgggtcataa

SEQ ID NO: 84107 - DNA, 1476 bp, Glycine max
  Peptide Sequence Number=SeqID_200885
atgagagaacaaggggcctttcatcttgaggaacatggccagacagagaggtcccagtgggtgcttgattctcccaaccctccccctctctggaagaagctatttagttctgtcaaagaaaccattttgcctcatggcaacaagttctgcttctcatccaagaggaaaacttcccatgggcatgcactctcatgtctgaagaatttgttcccaatcattagttggttgacagattacaaagcctccatgttcaaagatgacctcttggctggtttaactcttgccagcctctgcatacctcagagcataggatatgctactttagcaaaagttgctcctgaatatggcctgtataccagtgttgttccacctcttatttatgctatgatggggagctcaagagaaattgcaattggacctgtagctgtagtgtcaatactgttagcctctctggtcccaaaagtggaagatcctgttgccaatcctaatgcctatagaaatcttgtctttaccgtgacttttttcactggaatttttcaaactgcatttggtgttttcagattgggttttcttgtggattttctttcacatgctgccttagttggattcatggcaggcgctgcgataattatcggtcttcagcagctcaaagggttgctggggcttagtcactttacctccaaaacagatgtagtatcagtgttggcatctgtttataagtcactacataatcaaattgcctctggagaaaaatggaaccctctgaattttgtcctgggatgttctttcttgattttcattctaattacccgatttattggcagaagaaatagaaagcttttctggttgcctgctatttctcctcttctatcagttatactatcaactttgattgtgtatttgtccagagctgataagcatggggttaatataataaagcatgtcaaaggaggcttgaatccaagttctcttcaccagttgcaattctatggtccacatgttggacaagcagcaaaaattgggttgatttgttctgttattgccctcactgaagcaatagcggttggtcgatcttttgcttccatcaagggataccatcttgatgggaacaaagaaatgttatcaatgggattcatgaacattgcaggatctttgagttcatgctatgtggcaactggttctttctcaaggactgcagtgaatttcagtgctggatgtcaaacagcagtatcaaatattgtgatggctgttacagtgtttgtgtccctggaattgtttacaaggctcttatactacacccctgtggctatccttgcctctatcatcctctctgctcttcctggattaattgacctaagtgaggcttgctatatctggaaggttgacaagttggactttcttgcttgtattggtgcttttcttggggtgttgtttgcgtcagtagagattggccttcttgttgcaagacagaactaa

SEQ ID NO: 84108 - DNA, 273 bp, Glycine max
  Peptide Sequence Number=SeqID_200886
atgttggatcaatttgtgccatttatacagggtttcattcacaacgttgtggatgtgaaagtggacagtaactgtggatatcgttccattgttgctttattaggtatgggggaagattcttggccgttggttagtgtggacaagtggatggatataacggagatgagatatgtcattgcatcaaggtataatgtttatttgaaagaccattgtcctttactgtctctagcgttgttgtggtcaagcaattgttatcctcagacaaagcagtga

SEQ ID NO: 84109 - DNA, 336 bp, Glycine max
  Peptide Sequence Number=SeqID_200887
atggataaccattcatggtgttatccagcttgtgttcaatgtcataggagaactaacatccaaacaggaccattcacatgcggatgtggcaaggataatgatcaacctgttctgaggtatagagttgaaatcatggttacccaaaacaatgagagtagcaagtttttgctctgggatcgtgaatgtgttgaattgattggtgagacagctgatgatgtgaatagggtcaagattgaactggtggatttgtcctgtttctggcaggatggtgatcttgatttgaatgcttctcctcaagcacttgacaaattgttgggtcatgtgcttgcttttaag

SEQ ID NO: 84110 - DNA, 876 bp, Glycine max
  Peptide Sequence Number=SeqID_200888
atgcccgtcacgcacagcaggatgggcgcaccaccagcgcgattgatgtttctctatcttggccgcagctcgcacccctccagcctggagcatattgccagctggacggggtttgcgctgatggcccagggccagaaagcactgcgcatgggcgatgatgtgacgcattacgggccgggcgatctgctgctggtcaccatggacatgccggtgcagtcctgcgtggtgctggcgacgccagagaaaccatgtcttggcgtcggcatcaccatcaacgaagcgcgcctgctgcgctatctggagcatttcccgccgcagcagattggcagtgccgccaccgaacgcagcattaccgtccataaagtcgcgccaccgctggtggatgcggtgatacggctggtggcgctgctggatcagccgcaggatatcgccgcgctggcaccgctgattgagcaggagattttctatcgcctgctgaccgggccggaagggccgcgcattctgaatatggcgctgaccgagcgcccgggcaacaaagtggcgcgcgcggcgcgctggctgcgcgaaaattttcatcagccgctgaaggtggatcagctggccagcagcgttggcatgagcatttcatcgctgcaccatcactttaaagcggttacggcaatgacaccgatgcagtatcagaagcagctgcggctcaacgaagcgcgccgactgatgatgattgagaagctggatgccgggacggcgggctatcgggtgggctatcagagtgcgtcgcagtttagccgggagtacagccgtttttacggccagtcaccggcgcgcgatgtgcgcaagatggcggtggggccggaaggactctccccaccgcagtaa

SEQ ID NO: 84111 - DNA, 276 bp, Glycine max
  Peptide Sequence Number=SeqID_200889
atgaattgcagggatggaaaagccgtatgcatcaatacgcagaaaatgcttgtacgggtaatgatccaccaacccgctagttctttttatgaggcacaaacgggagaatttatcctggaagcggaagagctactgaaaatgcgtgaaactatcacaagggtttatgtacaaagaacgggcaaaccttatgggtatatgcgaagacatggaaagggatgtttttatgtcagcagcagaagcccaagctcacggaattgtagatcttgtagccgttga

SEQ ID NO: 84112 - DNA, 300 bp, Glycine max
  Peptide Sequence Number=SeqID_200890
atgccattaatcaatttttggggcatccgttggtcttggaagaggggcaacattgcgagtttagtcagaggaaaagccagacctcgggattttgaggaggccataggccagctgctgtgtgttctaggacaggactttgcacagagtgtgacggggagacgagtgcagatcatgcgcactagcatgaccaccctgacacagatctggatgacattgcttctcaacaacatcctccacagtgatcataattctgatcttcccttgccaaagtgccagttggtctatgccatcttaacccag

SEQ ID NO: 84113 - DNA, 747 bp, Glycine max
  Peptide Sequence Number=SeqID_200891
atggctgaatcaacgaaaaagagaaaaggctcttcctccaccaccgctgctgctggccatcgccgccacagaccatctgaagcacccacagcaccggttcctccttccgtgatcattctagaccctaagtaccttgatcttgaattctttgatggagaaacatttgattgttatcaagatggtattctttactctgaggtgcaaaatatacctattgttattaatcagtctttattcttctcattgactaaattacccagtcaaggtgttccttttgatagcactattgttgatgactggaagttcgattactcgagtcatgatgctcgttgtatggtctgtaatgaccaggctgatatgaccgacagattgcttgctgggtcattaacctttgactatcgcatcatgcactatatcattgttcgcattttgcaaccccgttcgtctaatcttgctcaagcctctgaggaggacttgattctcatgtgggtttttcttaccagtcatcagatcgaccgggcccacttggatgttgatagtcagtggatttgtaaacaagacttgcctccgcctattcttgacgaacgtaccccatctcctccaccacaaagggttgattcctcttctcttctgaccgaagtcctcacaaaacttcgtggtcttcgagcttttgtaggtgaacgatttgatgtgatggatactcgccttgatgcaatggatgcacgctttgatgggatggatacatga

SEQ ID NO: 84114 - DNA, 189 bp, Glycine max
  Peptide Sequence Number=SeqID_200892
atgactttcagctgtaatacagtgaggaaaattttagttccttcaatgagtgatggaaacagttcaactgcagcattgaatcacaagaacaatatgcatatcatgatgcttgcagctctagtgttcaaccgaaaagtgaagcaaatcaaagacacaagcaccttagttctgtcactaactgagcagtaa

SEQ ID NO: 84115 - DNA, 796 bp, Glycine max
  Peptide Sequence Number=SeqID_200893
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatattttgtctgcagaacaagatgcaggatatcatgcgcatggatgctgccctggacgcaatgcgtccacttggatttaggacacaactgattctacgaacggttaatgagcttctcgatgttgtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 84116 - DNA, 549 bp, Glycine max
  Peptide Sequence Number=SeqID_200894
atggaagaaccttcttccgttgacactcgcggaagaaatttttgcgtgggattcaacggaaaaactttcttccgcagttcttctacagtttgtctcgcggaagaagttcttccgtgggattccccggaagaaggtttttccgcagttgacattacaactgcgaaaaaagattctttcgtgaaatcctgcagaagaacttcttctgagagtgtcaccggaagaacgttgtttttaaagaacaaaaacgctcaaaggcatttttgggattttgaaaatttgctggatgcccctagcaaatcccttggagtacatgcatttgatcctcctgggccacatgatccggtgtctccagctccaagcccagccccagaaagtgaaagccctgcaccatccccttcagttccaagtccagaatcacaaagccctacaccatccccttcagtacccaggccaaaacctaaaaattcttcagcatctcttgcagcacagtctcattctcttttgctccttgttcttctcactggtattttgttagtttatttctattag

SEQ ID NO: 84117 - DNA, 711 bp, Glycine max
  Peptide Sequence Number=SeqID_200895
atggctcccaaagaactcgagcagctgactcaacaaatcagggaccaactggaggagtcgatcacagaaaaaatccaaccacagggacttgcactacctccggaacctgaggttggtccctcagttgctcgtgtcagcataaaaggaagttgtgttgatccctcatcgaccaatccagacacgggtgactcagacaaatgcgggttgtatattgaagaaaatctttctcgcctaattgccctaggaagagtttatgagggatccacaacggttcacaacatccctttgttgcatggccaagtgaaggttggtgttgaggaggttaaagatgtagaggctctcgttcctgtacccactgatgagacagctgtgtctccagcaaaacctccagataggccggatcatgaggttatgtgggatgctaccatgttcggggtgtttaatgaagactttccattgtacataaagcacaaaaatctctctgaaattgcacacggtggtcaatctctcagcatatctgttatacagttgtggattctgcatctgactgagacaagtatgcaagcggggaatttcgatatgtatggattcctcgagcgacaatccattcagagatctgggcaatcgcaatttgaatcagaaagttacatgaagagttggatgcagagttcaaaatgcgacgtctaccttggagcctacctgaatgggtaa

SEQ ID NO: 84118 - DNA, 120 bp, Glycine max
  Peptide Sequence Number=SeqID_200896
atgacaaccgtacggcctcaatcaaatttggcgccgttgtcggggagcagtggtccaaagtgttctgtttcgcatttcagtcgtgtcctctatttagcgcttccctgtttcagttgctga

SEQ ID NO: 84119 - DNA, 303 bp, Glycine max
  Peptide Sequence Number=SeqID_200897
atggagtcaggtggcaggcggagataccttagggtcatccacacttttcgtctaccaggggcaaacgagcctgttggcgcgcagagactaacatcgccgtctgcaccttttgctatccagggacagctagtcaggtggcaggcggagataccttgtggtcatccgcacctttcgtcaaccgaggtgaacgaatttgatggtatcaagatgatgtttttgctctcgtcgtccgaagacattcaagcccgacgacacacgagattcttctctgatgggcggggacgatcaagttcgatggcatag

SEQ ID NO: 84120 - DNA, 576 bp, Glycine max
  Peptide Sequence Number=SeqID_200898
atggcaccccatggagagtctttggcaagctctttctctaggaaaagcaacatgccaacatcatcaaagccaccaaagctttcatcagagaaccttaaacgaacggtctcagacatctctttcgagctggcaaaagaagagatcgatgatcatttgaagctgccagcaatatccgaggtcgagaatgcaaattgtgagtgctgtggtatgtgcgaggagtgcacaccggaatacattgaccgtgtgcgcgagaagttcaacgggaagtgggtgtgtggattgtgtgctgaggcagtaaaggaagagttggagaaaaatggagggaaaaaggaggaagctgtgagtgcacacatgagtgcatgtgttaagttcaacaaatatggtagggctttcccggttctgttccaagcacaagccatgaaagagatgctgaaaaagaataccctagatggtagaagggctaagtctattagccctagggacaaaggaggtgcaaagaaaggagggatttctcgtagctcaagttgcattccagcaatcacaagagagatcaatgatatcaaaatagccaattaa

SEQ ID NO: 84121 - DNA, 330 bp, Glycine max
  Peptide Sequence Number=SeqID_200899
cgtcagcgccagcgacgccgccgtccagggcgcgacgtcgatgccgaacaggccaacgccgaagaaggcaagaaacagctgcatcagcagcggcgtgccctgaaacagctcggtataacagcgaatcaggcgggtgagccagcgacgctgcagcagacgcagaaacagcagcggcagtgtcaccagcgtgccgccgaaaaaggccaccagcgacagcaaaatcgtccagcgcgccgccagcagcaggttgcgcaggatgtcccagtcagtaaacgttgtcatgccggctgcgctccaaaccatttgcgacccagcgccagcagcagctga

SEQ ID NO: 84122 - DNA, 1503 bp, Glycine max
  Peptide Sequence Number=SeqID_200900
atgatgaaacagctcgatgaacgccttcgcagtcactatccgcaactgtcgccgcaggagcagcgcattgctgactttgtgtttgaccattttgatgatctgattagctataacagcgctgagctggcgcggctcagcggcgtatcaaaggccacggtgagtcggctgttcaaacgcctcggctatgaaaaatacaaagacatgcgtgatgagctgcgcaccctgcgccagagcggaatgccgctgaccgataatcgcgacgcggtgcagggcaacacgctgctgtcgcgccattacaagcaggagatggcgaacctgacgcagtgggtcaacagcattgacgcccggcagtttagcgaggtgattgccgcgctgggcgccgcacggcgggtgttcatcattggcgcgtgcccaggtgcaggtattgccacagccaggccagacgctgggcgaagagctggtggacatgacgccggaagatgtggtggtggtgatggcgtttcgccgccggccacgcatcattcgtccactgatgcagcagctgcagcagagcggcatcccggtgctggtgctgtgcgaaccgcaggcgcagggtattctcaccctggcgcgctggcagctctacgcctcggcaatgagcctgatcaacctgctggccaacgcgctgctgcacgaaatgctgtcgcaggggcgtcagcgcatccatcagattgccgatctttaccagcagctcgacgagctggaacaccgctaaagggcaccgttttggcaggcagcgccatggccgatcagctgcaggatatccagaagcgtggcgtgattcgcgtggcggtgccgcaggacttcccgccgtttggctcggtcggtaccgatctgcagccgcagggctatgacatcgacatggcgaaatacctcgcgaagcagatgaaactgaagttgcagctggtgccggtgaccagcgctaaccgcgtaccgtatctgcagaccgataaagtcgatctggtgatctccagcatgggcaaaaacgccgagcgcgaaaaagtaatcgacttcagccgcgcctatgcgccgttcttcctcggcgtgttcggcccgaaaggcgagacgctgaaagatgcggcggcgctgagcgggaaatcgattggcgtgacgcgcggtgcggtagaggacatggtgctgagcgatgttgccccgaaagatgctcaggtgaagcgctacgaagataacaacaccacgctgtccgcctatctctccggtcaggtgcagtatgtcgccaccggaaacctggtggtcgcagcgattgcgcgccagaacgcggaaaaagccccggtgccgcagtttatgctgaaagattcaccgtgctttatcggcctgaaaaagaatgagccagcgctgaaagagaaagtgaacgcactgattgagcagggtattaaagacggcacgctgaacaagctgtcggaagagtggctgaaagcgccgctgcctgccaacctcggcgcataa

SEQ ID NO: 84123 - DNA, 236 bp, Glycine max
  Peptide Sequence Number=SeqID_200901
tggcttggccaggagaccagccttcttcctctggagggggtggggcctccacagcccaggagcctgtgactgaggagccaccatcaccagcaccatcaccagcagcagcagaggaggagaccactccagctcagaccctacaaccatctccaccatttgcacctgctcctgaggagactcaaccattaccactggatcttaatgaaaaccagccacaggaggagcaggacgtttaa

SEQ ID NO: 84124 - DNA, 988 bp, Glycine max
  Peptide Sequence Number=SeqID_200902
tacttccgatgaaagcactctttccccgggcgctgctgctggcagcgttcacgctgccctctgccagaacgctctggccggcgtggtggtcaatggcacgcgagtgatctatcccgcgcaggcgcgcgaagtcaccgtgcaggtcgacaacgtgggcgattcgccggcgctggtgcaggcctggatcgacagcggcgacgccaaccagaccgccgataccagcgatgccccgttcgtgctgacgccgccgatcgcgcgcgtcgaacccggccgcagccaggcgcttcgcctgatcttctccggcgcgcagctgccgaccgaccgtgagtcggtgttctggctcaacgtgctggatgttccgccgtccccggacaacgccgacagcggcgaacagaattacctgcaggtcgcgttccgttcgcgcctgaagcttttctaccggccgcagggcctgaagggcgtcgccaacgacgcgccggcagcgctgcgctggacccgcaccggcgaccgcctgcgggtggaaaacccgagccccttccacgtcactctggccgaagtacatgccgtgaccggcagcagtgaaaaggccgtcgaggacaagggcgcgatggtcgcgccgaagcagagcctggagttcgccgcaccggcgggcaccgaccaggtccgcttcatcaccatcaacgactacggcggccgggcgctttgcctgctggttgctggcgtggcctgcccaggatgggcgctggctgccccggccaatctcggcgaacaggcgctgatggcgcagagtggtgcggccaatgcgcgcgcaccggagtcggcccagttcaattccagcttcctgtctggccaggccaagcaggtcgacctggcggccttcagcaacggcaacccgatggtggccggcaactatcgtgtcgacgtctacgtcaacggtgcctggcagggccgtcgcgatctgcagttcaaggccgatgcgcagggccgt

SEQ ID NO: 84125 - DNA, 1398 bp, Glycine max
  Peptide Sequence Number=SeqID_200903
atgacgctggcagccttatcgattagccagctgcagcaggcactggcgcagggcgatctcagcgcgcgcgacatcgcacagcagacgctggccgccattgaacagcataacccggccatcaacgcctggaccgccgtcaccgcgcagcgcatgctgcgggaagccgatcggctggatcagcagcgtcagcgcggcgagccgctgccggcgctggctggcattccctatgcggtaaaaaacctgtttgacgtcgccggtcacagcacgcttgccggtgccagcctgttcagcgagcggccggtggcgcagcaggatgcatgggcggtttctaagctgcagcagagcggcgcgctgctctccggcatgctgaatatggacgcctacgcttacggctttaccaccgagaacacccattatggtgccacccgcaacccgcgcgatctgtcgcgcgtggccggcggctcatctggcggttccgcggcagccgtcgctgccgggctggtgcacttttcactcggcaccgacaccaacggctcgattcgcgtgcctgcttcgctgtgcggcattttcggcctgaaacccacctttggtcgtctgtcgcgcagcggcagccatccgtttgtcgccagcctcgatcacatcggtccgtttgcccgctcggtggaagatttgagtctggtctacgatgcgctgcagggcggcgacgccagcgatgcgtttcaggcggcgcggcctgcggaaccggtcagtgacaggctctctgctggcagcgaaaagctgcgcagcgcggtgctgggcggcttttttgctgactggtgcagcgatgaggcgcgcgcggcggtggcggtagcggccagcgcgctcggcgcgacagaagaagtgacgctgccccaggccgaactggcgcgctcggccgcgtttatcatgaccgccgcggagggcggcaatcactatctgccggcgctgcgcacccagccagaacgctttgagccgaattcacgcgaacgcctgctggctggcgcgatgctgcccgccgcgtggtatgtgcaggcccagcgtttccgccgtcacttccagcagcaggtgctgccgctgttcgaccattacgacgtgctggtcgccccggccacgccctgtaccgccaccaccatcggccaggaaaccattcatatcaacggtcaggatttgccgacacgcgccagcatgggcatgctgacgcagccgatttcgttcctcggcctgccggtgtgtagcgtaccgctgctcaccgccagcggcttaccgattggcctgcagctgattgccgcgccgtttaacgaacagctggcgctgcgcgccgcctgggcactgcagcagcagggtgtgacgctgccacaaacctcttttatggatgcctga

SEQ ID NO: 84126 - DNA, 2136 bp, Glycine max
  Peptide Sequence Number=SeqID_200904
atgccggtactgcgtagcggagcgcgcaagggccgggcagcacccaaacagcaacaacagaaacagcagcagagtcctgtggtggaaggggaggctattgcgacgaggacgcgtcggcggcgtgcggcggcggctgcagcagcggcagtgccggagagtaacaacaacaacaacaataccaataaccagcagcaacaggtggagcaggtggcagtggtaaatgagaacgtagctgttgcggcgagggaagaagataatcgagtcgcggaggaggaaggtgttgttaggggtggtggagcggagagggaagaggttgcggagaaaaagatgggtgggtgtgacagtgggggacggagcaatggtaaggccaatgcagctggtgaagatgacgccaatacccctcaggttcctcagaagattcaagtaggtaattctccttcctataaagtagaaaaaaaacttggcaagggtggatttggtcaagtatacgtcgggcgacgtactggtggaaatttgaatgaaagaactggacctggagctgtagaggttgcattaaaactcgagcatagaactagtaaaggatgtacctatggaccaccctatgagtggcaagtgtacaacactctcggtggcagtcacggtgtacctcaagtacactacaagggcaggcagggtgactattatgtcatggttatggatatgctgggacctagcctctgggacgtttggaataatagcaatcatcacatgaccaccgaaatggttgcttgtattgccattgaagcaatatctatattggaaaaaatgcactctcgagggtatgtgcatggggatgtgaagcctgaaaattttctgcttggtgctcctgggacacctgatgagaaaaaattgttccttgtagatctgggattagctactaagtggagggatagtacaacaggctcgcatgtggaatatgaccaaaggcctgatgttttcaggggcacagtccgctatgctagtgtgcatgcacatttagggagaactgcaagcaggagggatgacttggaatctcttgcatatacactgatttttcttcttcgaggtcgccttccatggcaggggttccagggagaaaacaaaggatttctggtttgcaagaagaaaatgggaacatctcctgagaccctatgctgctttagtcccctcccttttaagcagtttgttgaacatgttgtaaacttaaagtttgatgaagagcctaattatgcaaaatacatttctctatttgatggggttgtgggtcctaacccagatattagaccaattaatacagaaggggcacaaaagctcattggtcacaagagaggtcggttggtgatggaagaagaggatgatgaacagcccaaaaagaagattcgtattggtttgccagcatcccagtggataagtgtttacaatgctcgtagaccaatgaaacaaagatatcactacaatgtatcagatacaaggctatcccagcacattgagaaaggaaatgaggatggcttatatattagcagtgttgcttcttgtcagaacctatgggcgttaatcatggatgcagggacaggtttcactgctcaagtttatgaactctcacccttctttctccataaggaatggatcatggagcactgggaaaaaaattactatatcagcgcaattgctggagctgtaaacggtagctcgctagtagtaatgtctaagggcacacagtatttgcagcaatcatacaaagttagtgattcatttccttttaagtggattaacaaaaagtggagggagggcttttacgtgactgcaatggccacctcagggtcaagatggggagttgtcatgtctcgtggtgcgggattttcggatcaggtggttgaactagattttctatatcctagtgaggggattcacaagcgttgggactgcggatatcgaatcacagctactgctgcaacttgggaccaagctgcttttgtcctgagtgtgccaagaaggaagcctttggatgaaactcaggaaacgcttaggacttctgcttttcctagcacacatgtcaaggagaagtgggcaaagaacctctacattgcttccatttgctacggacgcacagtttcttga

SEQ ID NO: 84127 - DNA, 1518 bp, Glycine max
  Peptide Sequence Number=SeqID_200905
atgaagttaagaggagcaggtttcatgccaaatcattctgaagtgacctctgcggtggcctctgaagccaacgcccattacagcccgcgtctgtgtaacgacgacctggcgccgacccgcaaccagagctggtcgtggtacaacattttttcgttctggatgtcggacgtgcacagcatgggcggctatgtggtggcggccagcttcttcaccctcggtctggccagctggcaggtgctgctgtgtctgctggtgggaatttgcatcgtgcagctgtgcgctaacctggtagcaaagccgagccagatggccggcgtgccttatgcagtgatttcgcgtcaggcatttggcgtgttcggggccaacatcccggcggtgattcgcgggctgatcgccttcgcctggtacggcattcagacctatctggcggcgaatgcgctgatgctggtgctgctgaagttctacccgtcgttaagcagcatgacgcagagcagctggctcggcctgtcgcagcttggctggtgctgtttcggcgtcatgtggctgctgcaggcgatggtgttctggcacggcatgagcgcgatcaaacgctttatcgatatcgccggtccggcggtctacgtggtgatggtggcgctggcgggctggattgtatacaaaaccggttttgacggtatctccttcaccctcgccagtaaatcactgagcgcgggcgagcaaacctggcagatgatcaccgcgaccgcgctggtggtctcttatttctccggtccgctgctcaactttggtgacttctcgcgctacggcaaaagcatgggtgagattcgccgcggcaaccgctggggcctgccgttcaacttcctgctgttttcgattgtgaccgtggtcattgtctcgggtactcagtcgctgtttggcaaaatgatcaccgacccgatcgaaaccgtgagcatggtaggcaacgatgtggcggtcgctatcgggctgctgactatgattaccgccaccatcggcatcaatatcgtggcgaacttcgtttcgccagcatttgatttctctaactgctcaccgcagaagatcagcttccgcgccggtggcatgattgccgccgtgggttcagtgctgttgacgccgtggaatctgttccagtcgccggagctgattcactacacgctggatgtgctgggatcgtttatcgggccactgtttggcattctgatcgccgatttctacctgatcaaacgcagcaaggtgtacgttgatgacctgttcaacgatacgccaaaaggccgctactggtatcgcggcggtttcaatccgaaagcgattgctgcactgctgccttccgtcggcatttgtctggtgattagctttattccgtccctgcacgcggtggcaaacttcagctggttcatcggcgtggcgctgggcgctggctgctaccgctggctggcgcgcgccgaacgtgaggtgccgcaagccacctatcgtgcggaagtggcggtacagaaggattaa

SEQ ID NO: 84128 - DNA, 1581 bp, Glycine max
  Peptide Sequence Number=SeqID_200906
atgacggcgaccatcggtgcagcggcgcgcgccgtggccgcacctggcacggagattgtggcggtgtgcccgagcgagggcgtgccctccattgaaggacactttgatgaagcgattgccgcggtgggcgtgctggaacaggtaaaacgcggcaaagagcagggcgtcagcggccatatcatcgcctgctttggcgatccgggactgctggcggcgcgcgaactggcgagcggaccggtgattggcattgccgaagcggcgatgcacaccgcgacgctggtggcgacgcgcttttcgattgtcaccacgctgccgcgcacgctggtgatcgcccgccatctgctgcagcagtacggattcagccatcactgtgccgcgctgcacgctattgatctgccggtgctggcgcttgaagacggcagcggcgtcgcgcaggagaaagtgcgcgagcgctgcctgcaggcgaaacgtgaagatggcagcggggcgattgtgctgggctgcggcggcatggcgtcgctggcgcaggatctgactaaagagctgggcctgccggtgattgatggcgtcagtgcggcggtgaaaatggtcgagtcattactggcgctgggctttggaacttgcagaatgagtgatgtatctgaaaagaaagagtacagcttcaacaaaaactatccgcgcgatctgattggctatgcgggccagccgccgcacgcgcagtggccgggtgaggcgcgggtggcggtgcagttcgtgctcaattatgaagagggagctgaaaacaatgtgctgcacggtgacgcgggctctgagcagtttctctccgacatcatcggagccgccagctatgccgatcgccacatgtcgatggattccctgtatgagtacggttcgcgtgccggtttctggcgcatccatcaggagtttcagcagcgcggcctgccgctgaccatctttggcgtcgcgatggcgctggcgcggcatccgcagattgtcgaggccatcaaagccgccgattacgatgtggtcagccacggctggcgctggattcactatcaggggatggatgccaaaaccgagcgtcagcacatgcagcaggcagtggacgtgctcaccgagttattcggtaaagcgcccaccggctggtataccgggcgcgacagccccaatacgcggcggctggtggtcgagcagggcggcttcagctacgacagcgattactacggtgacgatctgcccttctggacgcaggtcacctgtcaggacggcacggtgaagccgcatctgatcattccctatacgctggagtgcaacgacatgcgcttcgccacgccgcagggattcaacaccgccgagcagttctatacctatctgcgcgatacctttgatgtactgtatgaagagggcgcgacggcgccgaagatgatgtcgattggcatgcactgccgtctgctggggcgtccggggaaattccgcgcgctgcagcgtttcctcgaccatattcagcagcacgacaaggtgtgggtgtgcacgcgtcagcagattgccgatcactggatgaagacgcatccggctgcctga

SEQ ID NO: 84129 - DNA, 1077 bp, Glycine max
  Peptide Sequence Number=SeqID_200907
atgccggatatcaccgtcgatttccgcgctccacctccctctccggtggcttccggccggagttccaccgtcaccaacgacgacgttttgacggagtttttagaggcctcgctccgcgtccccgatcttgtattgcccgacaagatcttccccaaacagaaccacctcgaagcacctcccgaggttgatttcgtctccctctgctttcactgcgacgacgctctccgcgacatcgtttccgactcgctggccagaatcggatgcttccagcttctcaaccacggaattccattacagctcatgaccgcggtcgcggaggccgccgccggaatctttcaagtgccaccagcgaatagagtgtcggccacaaggtcgccggagaagccctgggggttcgaggagtatcacgctggagaggaagaaggcgatgggagtgaagaattcgtgtggtgcaacgaccacgagttgaagtcaaaaatggatggaatttggccaattggatatccaaatttcagtgagaagatggaaaagctgaagtcacgcatagagatggtgggtaggaaaatgttgggtgtgatattgaagaaggggagcatagaatttgtgggtagtgggcatgaggttgggacactttgctgtgtttacaagcatcgaagagatgatcatagcattagcagctcgttgaaatatgatgtgattagaatgctgattaggggaaccgattactcccattcattgtgcttccatgtttgtaatggatcttcacagtttcacgtttactccaagaaaagttggctctctttcttccctcagccaggtgcccttattgtcaccgctggagatcaaacccagacattcagtggtggagagtacaagcacgtgattggaaggccaatctttaaaggagagaaagaagagaccatttcaatggctttcctctattctactcaaaccaccaaggacaattttcaaaccagtaggggaagaactatttcacttggccagcaagccatcttggctttaattctgccccttgtgtaccatgtcatcaattttttctacaaaaaacttaattaa

SEQ ID NO: 84130 - DNA, 3614 bp, Glycine max
  Peptide Sequence Number=SeqID_200908
atggatgggaataatttcagcagaagcataagcaggagcataagcaggtcaagttggaaaatggaggaagtgtttgcgagtggaaggtattctcgcaggacttcacatgtggatgaggatgaggaggctctcaaatgggctgccatagagaaacttcccacctatgataggctaagaacaagtatcatccaaacctttgccgagggcgatcaagccggtgtgcacaaggaaatcgatgttcggaagttagatgtgaatgataggcaacaaatcattgacaagattttcaaggttgctgaagaagataatgaaaagttcctcaagaagttcagaaacagaattgacaaggttggaattcgacttccaacagtagaagtgaggttccaaaatttgactgttgaggcagattcctatgtcggcagcagagctctaccaaccctaccaaatgttgcactgaaccttcttgaatcagctcttggcatttttggcattagtacagctaagagaacaaagctcacaattcttaagaatacctctggcattgttaaaccatcaaggatggcccttctactaggacccccgtcttcagggaaaacgacccttttgttggcattggctggaaaattggactccgaattgagggtaaaaggagaaatcacatacaatggacataaacttaatgagtttgagcctagaaaaacttcagcatacattagccaaaatgatgttcatgttggagaaatgactgtaaaagaaacactggatttctcagctagatgtcaaggagttgggactcgatatgacctattaaccgagcttgctagaagggagaaggaagccggcatattcccagaggcagatgttgaccttttcatgaaggcaactgctatggaagggacagaaagcagtctcattaccgactacacactcaaaatattggggcttgatatttgtaaggataccatagtgggtgatgaaatgcacagaggggtatccggtggccaaaagaagcgtgtcactacaggagagatgattgtagggcccacaaaaacactattcatggatgaaatatcaacgggtcttgatagctcaacaacatatcagattgtgaagtgcttgcagcagattgtgcaccttaatgaaggaactatcttaatgtcccttctccaacctgctcctgagaccttcaatctctttgatgacatcatcctcatatcagagggccagattgtgtatcaaggccctcgtgagcacattgtggaattctttgaatcctgtgggttccgctgtcccgaaagaaagggaaccgctgatttcttgcaagaggttacctcaaggaaggaccaagagcagtattgggcagacaaaaacatgccataccgttatgttacagtgactgaatttgcaaacaagttcaagagattccatgttggaataaggcttgagagcgagttgtctgtggcatttgacaagtcaagtgcacacaaagcagctcttgtatatagtaaaaactctgtgccaacaatggaccttttcaaagcatgttgggacaaggagtggcttctgatcaagaggaactccttcgtctacatattcaagacagcccaaataatcttcattgccttcatagccgcgacactgttcttgaggactgaaatgcaccggaaaaatgaagatgatgctgcactctacattggtgcaattttgttcaccatgatcatgaacatgttcaatggttttgctgagctagcactcacaattggaaggcttcccgtgttttacaagcacagagaccaccttttccaccctgcttggacttacaccctccccaatttcttgttgcgtattcccatttctgtgtttgagtctcttgtttgggttggtgtcacctactacatcataggatttgctcctgatgccagcaggttcttcaagcaattgttgttggtgtttctgatccaacaaatggcagctgggatgtttagggtcatttctggagtgtgcaggacaatgattatagctaacactggaggagccctcatgctccttcttgttttcctacttggaggcttcatccttccaaaacgtgaaattcctgattggtgggtgtgggcttactgggtgtcaccattgacatacggctttaatgccttgtctgtgaatgaaatgttagctccaaggtggatgcatccacagacttcttctgataaaaataccacattgggtctatcagtactaaggaactttgatgtttatgctaaaaaagattggtactggattggagctgctgctcttcttggtttcacagttctgtacaacgttctcttcacccttgcgcttatgtaccttaaccctcttggaaagaaacaagcaattatttctgaggaagatgcaagtgaaatggagtctggaggagacaccaatgaagaacccagacttgtaaggcccccatcaaacagagaatcaatgcttcgatcattatctactgctgatggaaacaattcaagagaagtggcaatgcagcgaatgggtagccaagctaccagtggattaagaaaagttgagtcggcaaacgattcagctactggagttgcccccaaaaaaggaatgattttacctttccaaccacttgcaatgtcctttgacactgttaattactacgtcgacatgcctgcagaaatgagagatcaaggagtgacagaagataggctacaactgcttaggggagtaactagctcctttaggcctggagtcctaactgcactaatgggagttagtggcgctgggaagacaactttaatggatgttttagcaggaagaaagacgggtggctacattgaaggagatattagaatctcggggttccctaagaaccaagaaacctttgcaagagtctctggttactgtgaacaaactgatattcattcaccccaagttactattagagaatctttgctttactcagccttcctccggttaccaaaagaagttagcaaggaggaaaaaatacaatttgtggaccaagtgatggatttggtagagttagataatctcaaggatgctatagtggggcttccaggagttactgggttgtcaaccgaacaacgaaagaggctgaccatcgctgttgagcttgttgctaatccttcaattattttcatggatgaacccacttctggtcttgatgcaagagcagcagctattgttatgaggactgtgagaaacactgtggacactggaagaacagttgtctgcacaattcaccagcctagcattgatatctttgaagcctttgatgagcttttgttgatgaaaagaggaggacaagtgatctactcaggaccattaggccgaaattcccacaagattacggaatactttgagggtttagtatcaagtttcatcccatgtccttggtcacaggcaattccaggggtcccaaaaattaaagagatgtacaacccagcaacatggatgctagaagtgagttctgtagcagctgaagttcgtcttggaatggactttgctgaatactacaaaacatcatctttattccagcgaaacaaagctcttgtaaaggagttaagcacacccccgcctggagctactgattt

SEQ ID NO: 84131 - DNA, 348 bp, Glycine max
  Peptide Sequence Number=SeqID_200909
atgacagtgagacataaagaagatttcacggcaaaattagaaggggacaatgtgaagttgcagaaagtggagggaaagcgaaaacagaggaagaagcatggtgtgcgtcagatgttgctcgcatgcgatggtgattttcgactgtcgtatgcgatgatgtcccttttctttcctatcatttgcctctccttttcttacttcctttctctttctacaccaccaccatgccctttatttcacatctccctttgtcgtcggagaccaagagggaaagggatatgcgaaataaacaagggagaggatcgactgacttgtgtggtggagtggggtgtcactgttcgacggtga

SEQ ID NO: 84132 - DNA, 1767 bp, Glycine max
  Peptide Sequence Number=SeqID_200910
atggagaatgagacaaatggctcttccacggtggacgacttcgacgtcaaccccatccccagcggcggcgttcgggatgtgtacggcgaggacaaggccactgaggatcagtttgtgactccctggagtatctctgttgctagtggatattctttgttgagagatccacactacaacaaaggactggccttcactgaaaaagagagggatgctcactatttgcgtggccttcttcccccatcagttatttctcaggaaactcaggtgacgaaaatgatccgacatatacgccagtatgaagttccattgcacaagtacatagcaatgatggatcttcaggagaggaatgaaaggctgttttacaagcttctacttgatcatgttgaggagttactcccagttgtgtatactccaactgttggtgaagcttgtcagaaatatgggagcatcttcatgcatcctcagggtctttatataagtttgaaggagaaagggaggattcttgaagtactaaggaattggcctgagaagaacattcaagtcattgttgtaactgatggagagcgaattctgggtcttggggatctaggttgtcaggggatgggaataccagtaggaaaactttctttatattcagcacttggtggagttcgtccttctgcttgcttgcctattaccatcgatgtgggtacaaacaatcagaagttgttgcatgatgaattatattttgggctcaggcataaacgagcaactgggcaggaatacactgaacttctgcatgaatttatgaatgcagtcaagcaaaattatggtgaaagaatcctcgttcagttcgaagactttgcaaaccacaatgcttttgatctacttgaaaaatatagatcaacacatcttgtctttaatgatgatattcagggaacagcatcagtggtccttgcaggagtagtttctgctctaaaattggttgggggagacttgactgatcacaggttcttattccttggtgctggagaggctggcacgggaatagcagaactcatagcacttgaaacatcaaaacggacaaatgtccccctagatgaagtgcgcaagaacatttggttggtggactcaaagggtttgattgtgagttcccgtaaagaatcacttcaacattttaagaagccatgggctcatgaacatgaacctgttaaggaacttgtagatgctgttaaggaaattaagccaacggtgttaattggaacatcaggacaagggagaacttttactaaagatgttattgaagctatggcttccattaatgagaaaccaattattctttctctttccaacccaacatcacagtcggaatgcactgctgaagaagcttatacttggagccagggacgtgccatttttgctagtgggagcccatttgcccccgttgaatatgatggaaaagtgtttgtgcctggccaggctaataatgcatacatttttcctggatttggtcttggtttaataatgtctgggaccattcgagtgcacgatgacctgcttctggcagcttctgaggctttggcttcacaggtgacccagaaggactatgacaagggactcatatacccaccattcagcaacatcagaaagatttcagcacgcattgctgccaatgttgctgctaaggcctatgagcttggcttggccactagccttcctcaaccaaaagatttggtgaagtttgctgagagctctatgtatacaccactctatagaggctaccggtga

SEQ ID NO: 84133 - DNA, 174 bp, Glycine max
  Peptide Sequence Number=SeqID_200911
atgggttaccacgttgaagcatcaacaagtgaaggacctgagaaaaggcaatacctattctttccttacctcatcaagaatgtgcataaattctgctcatcttcttcacaacagaatccattggtaggaagacataacatattgttgaaagcagctagcatgcatgcccactaa

SEQ ID NO: 84134 - DNA, 618 bp, Glycine max
  Peptide Sequence Number=SeqID_200912
atggacagaaaccaatcccgcaggcaggttgctgcaatgaaacagtccctctttgatcagttttttgcatcaacctcattcattggcaagtgtaaaaatgcatgtcaattggtagttaatgaaaattacatattccacttcatcagaatcctgatcacctttaatcacaagacacgggaaagttgtgtgatgttcatagcgggtatagcattagtaactatggggttacttgatgaacagtttatccaactggaagaattgcaggatgatgcaaatcctaactttgttgaagaaattgtgactcttcattaccgtgattcgtcgcggcttatctcaagcatagagcaggctctcaaagagaggaaccctctggatttcaacaagctggacacacttatgcatcagttcaaaggaagcagctcaagcataggagccaaaaaggtgaaaacagagtgtaatctgttcagagaatattgcagggcaggaaatgcagaaggatgcatgaggagcttccaacaactgaagagagaatatgcagcactgagaaagaaacttgaagcttattttcagttagctaggcaagctggaccccaggaaacagcatgtcgctccaaatga

SEQ ID NO: 84135 - DNA, 2082 bp, Glycine max
  Peptide Sequence Number=SeqID_200913
atggcctcttacaggcccttccctccccaatcgagtcaaattccaaacccgatcccaggtgggaatcatcagtataataataataataatcaaaatcaaaattggggtgcttatggagatccctctacttcttcattcccccaaatccctccaaattccaattatcatcaaaatcaacatcatgttccatatgcaccagcaccttcaaatccccaccaccctcctcactatccatatccaccaccaccgccgccgccgccgccaccggaggcttcataccagccgccgccgccaccaccaccaccagctcctatgtattatccctctagtagtcagtatagcaaccagccacctccaccgccaccgcccttgtcgccaccaccaccacctcccccggtttcgcctcctcctcctcccccggcaactcagaacaacaacgaggagcggcgtttcaaggagccttccaagtctggccggcgcgaatacgagcattccaatcacggcattgctcacaaacagcacaagcagcagcagcctccccttccggtgaagaagatgaacaacgggcctcccggcagggctgagaccgatgaagagaagaggttgaggaagaaaagggaatttgagaagcagaggcaggaggaaaagcataggcagcagctgaaggagtcccagaatactgttctgcagaagactcacctgttgtcatctgggaaggggcatggcatgattgcagggtctcgaatgggtgaaaggagatctactcccttgttgggtgctgagagggttgaaaataggttgaagaagcccacaacgtttttgtgtaagctcaaatttcgaaatgaacttccagatccaagtgctcaacctaagcttatgtccttcaagaaagataaagatcagtatgtaatcttgttgtcagttgtcactttacatcagtgtgtagctaggaaatatacagataaagatcaatatgcaaaatatacaatcacgtctctggagaaaatgtacaaacccaagctttttgtggagccagatctagggatacctctggacctgcttgatctcagtgtttataagtactgtcctcagttccttttggtcagaccaccccttgctccagaagatgaagaattgttgcgagatgatgaagctgctactcctattaaaaaagatggcattaaaagaaaggagaggcctactgataaaggtgtagcatggcttgtaaaaacacaatatatttctcctctaagcatggagtcgacaaagcagtctttaactgagaaacaagctaaggagctgagagagatgaagggtcgtggcattttggacaatctcaacagtagggaaagacaaattagggaaatccaagcatcatttgaagcagctaagtctgatcctgttcatgcaaccaacaaagatttgtatcctgttgaggttatgccattgctgcctgattttgataggtatgatgatcagtttgttgttgctgcatttgataatgctcccacagctgattcagaaatgtatgctaagatgaacaaatctgttcgtgatgcctttgaatcaaaggcagttatgaaaagttatgttgcaacgggtttggatcctgctaaccctgagaagtttttggcttatatggccccagcaccaggagagctgtcaaaggatatatatgatgaaaatgaagatgtctcgtactcttggattcgcgagtatcattgggatgttcggggtgatgatgcagatgatcccacaacattcttagttgcattcgatgagtcagaagcacgctacttgcctcttccaactaaacttgttttaagaaaaaagagggcaaaagagggaagatcgggtgatgaagttgagcaatgtccagtacctgcaagagtgactgtaaggcgaaggtctagtgttgctgcgattgagcggaaggattctggggtatatacaagttcaaagggaaattcctttaagagagttggcttagaaatggatgatggtctcgaagaccaacatagaggtgcaccacaccaggacaattatcagtctagtggagcagaagattacatgtctgattga

SEQ ID NO: 84136 - DNA, 1167 bp, Glycine max
  Peptide Sequence Number=SeqID_200914
atgggtttgggtagtgaggttgaagacgatcttcatcgccttcgttatctttcttctcttctccatcagattgacgagcttgtcgtgcaagccattgaagtgaattattgcaacaacaaaaccataagcaaagagggcaaaacgcaaattgagtctttttctcgtgtcctttctgacatgctctcttctttggagccatgggttcccaaaattcaaaaagcccttaaccctcaaaacacagtttctgacgatgaaaccatagaatgtgacagtcctgaagagacaaccttgaatttagtgtctccttcaccccttgtgtcatggcgtgccaactgcactgttgaaagaggaagacaaatgttcatgcttacacctcttccattatcatccaaacaccaccaacctaaaccacacttccctcctcccaccacatcatcaaccactaccttcaaggacagtgttatggtgaaaccaaccccaattaagcagcaacttccaaacaaccaagacggatccatgcttcttatgatgactccgtgcttgaaaatgtcgcctcctagatcctgccttttgctcgaacccatatccgaaatctcacggttgggagatcgcaatgctcgcaagggcactccctatcctgttgggattcattgcagtgattcagaatcttccagtagtgacgattcttcgcgtgatctgtcgttgatgtatccggagctcctggggatacacaagtcaggaattgggaagaaaacggtggaagcctcgcccgattggtttacctcacctcctaaaacttgtgttttgttggagccacctgatgaaaagattgatgaacacttgtgtgttcagatagctgacagtattcttaatgaacaagtcagcaagtttgaagatgatgatgtttcaaaagatcatgatcaagccaagaagtcttgcaaccaagatcattttgttggcaacttatcacatgtaaagagcactcccttgcctgaaagttcgtttcaaacggggaaatgtcctggcgaaaatactttgaagaaggagttatggactaagtttgaggctgcatccacttggggatgtcaacccaaggtacccactggtcaaaagagtgctcacaaagggtttcttgatttactggaagaagcttcctgtgatgaataa

SEQ ID NO: 84137 - DNA, 375 bp, Glycine max
  Peptide Sequence Number=SeqID_200915
atgacccagcttttgcaaaagttttcccgtgtaagatctaacttcgagcaccctattttaatttcttattcaggaattttaaattctttcaaaaatgaaggaattctagaatttctagtggctttcacagaggagcttggcagggctatcgttgtagtcaggggaggaggcgaggtgggcgacagtggtctaggccttgatgtgggggaggtagctgaagcaaagaagggaggcattgtagagtgtgaggttggccttggtggcaaagacaatgaggaggtcgaggcagttggcgtcgagacagtgaagttgacgctcattgctgaggcgcgcgatgatggactggacgcacacgagagaagaaagttgctctag

SEQ ID NO: 84138 - DNA, 343 bp, Glycine max
  Peptide Sequence Number=SeqID_200916
atggatgcctatgatggcctagctttccttcccaacacaaccaggatggccaggaatggtgctgttgtgtcactgacgttgttttgtggctgttccagtggattatggaactatttggtcagttatgtgatgagagatggagatagtgttgagtccttggcaagcaggtttggggttagtatggatagcattgagagtgtgaatggcattggtaatcctgataatgtcactgttggttcactttattatataccccttgattctgttcctggtgatccttatcccctaaataatgctgctccaccagttcctgttccttccccatccttcgataatttttcag

SEQ ID NO: 84139 - DNA, 120 bp, Glycine max
  Peptide Sequence Number=SeqID_200917
atggaaggaggaagaacgggaatgcctaaaaaagcacgcgactctctagtggaagatgaaatactgatcgtctctacttctgtaactagacccaccatcataatcacccctttcaattga

SEQ ID NO: 84140 - DNA, 882 bp, Glycine max
  Peptide Sequence Number=SeqID_200918
gttggtcaagatgttgtggcagaattaactaaagccattcggagacaaggtcttgatatgcgtgtaaatgctctggtcaatgacacagttgggacattagcaggaggtcgatatacaaacagcaatgttattgctgcgattattttaggtactggtacaaatgcagcctatgtggaacgtgttcaagcaataccaaaatggcacggtcctttgccagattctggagatatggctatcaacatggagtggggaaacttccggtcatcacaccttccattaactgagtatgactgtgcattagatgctgagagtttcagccctggtgatcagatttttgagaagatgacttctggcttgtacttgggagaaattgttcgtcgagtactatgcaaaatagctgaagaagctttcttttttgctgacaatgttcccccgaaacttaaaattccgttcatattaagtacacctgacatgtgtgcaatgcatcatgattcatctactgatctcaatgtggtaggaagcaaactgaagaacattttggagatatctgatacctccctggaagtgaggaaggtggttgtagagatctgcaatatcattgccacccgtggtgctcgtctttctgctgctggaatcttaggtatcctgaagaagttgggaaaagacaccaagagtgaagttgagggtcagaagaatgtgatagccatggatggtggattgtatgagcattacactgagtatagcaagtgcttagagaatacccttaaagagttggttggtgaagatatctcagaaagtatcatcattgagcatttcaatgacggttcaggagttggtgctgcccttcttgcagcctctcactcccagtaccttgatgcttag

SEQ ID NO: 84141 - DNA, 816 bp, Glycine max
  Peptide Sequence Number=SeqID_200919
atggcgagaatagcagggggggaataccaaggaagtgcttggaggagaaggctgaaactctggccagtcaaggagagtgagcatcattcatcgacgctggtggatctagcagcaattgacacctttcttgcttatcaccacagcaaggaaagcccggttattgctgttttggcagatgcgtatgatacatttgacttaagatgcgagaagagtagtgcgaggattgtctattgtacgcctgctttttatgtatggttggtatcccacgtcttcaatcatgagagtagatctgtctgccccctacaaggtcatcgcatctgcgtcgaaaaggacaaagcaaattgggaagaactcttggcaggcatgacaagagcgtccattagttggttcccatggtggaaagaaggaggggagggagtgttatgctcatgtgaaggatttccaaatgtcccttggatggggacgaggggttgcattaattataatcccatgttggccataagacagttaggttaccctatgagaggtgcaccatcagaggagaccatcgcgcctttcatcacgcgaggtttcaatgaagctaatgtaaagacactccagaggatctataaggaatggaataaagcagaaagaaaagataaagaacttagtggaagtagccaaggtgtcataggcagctatcacaaatggttgaagtcgagaacgcaagggataacttggctcccaaagttaaagtttctgagcggggaagaggctgaaatgcttgagttgagtgaagacgtgcaagctttgaaagctgagctcgaacatacaaga

SEQ ID NO: 84142 - DNA, 198 bp, Glycine max
  Peptide Sequence Number=SeqID_200920
atggcaagaactgctccatttgaagtcaaagattcattttatgtgaacaataagtctgctgataacaagaaacaagcagatactacaatcgtcgaagtcaaagaagcagctactactactattgaaatcaaggaaaagatggatattgattccatcaaagaaaagaagaaaaagatggatattgataccattgaataa

SEQ ID NO: 84143 - DNA, 408 bp, Glycine max
  Peptide Sequence Number=SeqID_200921
atggggaatgattctgtcacactggtgaaaaatatagtggccagtggaaatgaagtgtttcagcatgagctacagcagcagttgcagtgtactgaccaatttacctttttttttttctggggctttattttgaagccgaatgcaatgctagggatggttcttgattctgcagaaaaggttctctcagaagctgtgcaagagccggagattgagtctaccatcgacagtttagatatcagtggcaatgtctggaagtggcaattgttcaagtggagaaagaagagagccagcaatttgggcttgcttgatcgttcaagcatgcaaattggaactgatctgcatcaggctgaagagttggagctgagatttgtcagcctttgtacagtttgcatttttttgtgcatttga

SEQ ID NO: 84144 - DNA, 153 bp, Glycine max
  Peptide Sequence Number=SeqID_200922
atgagacggttgttgtcgttaggtgaggcggcaatttcaaccatgtatggaggttgtggcagagacgaaagcgagggtaggatgacaattattttgggtcgacagcgagagaaaggtatttttgggctcaaagatgctcaggaattgagatga

SEQ ID NO: 84145 - DNA, 1623 bp, Glycine max
  Peptide Sequence Number=SeqID_200923
atggggggctcggaaggggtgggagcatcgtcgaagcaattcggtgtcacgaagcccatatcaatggctggcccaacggttactgatttgcagaggactcgtgagttagagaagtttctcgctgtttcggggctttacgagagcaaggaggaagctgccaaaagggaagaggttcttcaccgacttggagagatagtgaaaaattgggtgaagcaacttacccgccttaggggatacactgatcaaatggtggaagatgcaaatgctgtcattttgacttttggttcttatcggcttggtgttcatggtcctggggctgatttagacactttatgcattgggccgtcctatgtaaaccgggaggaggattttttctacacattgcatgatatcttagctaacatcgaggaagtcacagaactgcaaccaattccggatgctcatgtcccagttatgaaattcaagtttgatggaatatcaattgatctcctctatgccagtatttctcgattgattgtacctgaagacttggatatatctgatgtctctgttctacacaatgttgatgagcctaccgtgcgaagtttgaatggctgtagggttgcagatcaaattctaaagcttgttcctaatgttgagcactttcgcacaacacttcgttgcttgaaattttgggccaaaaggcgaggcatttattctaatgtgacaggttttcttggtggtgttaacttggcacttcttgtagctcgagtgtgccagttttatccaaaagcagttccaagtatgcttgtttctagattcttcagggtatatacacagtggcggtggccaactcctgtcatgttatgtccaatagaggagaatgatcttgggtttcctgtttggcatcctggtaaaaatcctcgtgacagatcccatcatatgccaatcattacccctgcctatccctgtatgaattctagttataatgtttctatgagcacacttcgtgtgatgatggagcagttccaatatggcaataaaatctgtggggaaatagaattgagtaaagattgttggaaggctctgtttgaaaagtatagtttctttgaaagctataaaaactacttgcaagttgatgtagttgctgctgatgccgatgacttgcgcagctggaaaggttgggtggaatcacgccttcgccagctgactttgatgattgaacgtgatacttttgggaagttgcaatgtcatccctatcatcatgagtttgtcgatacttcaaggcagtgtgcccattgtgctttctttatgggtttgcataggaaagagggagaagttgttcaagaaggccagcaatttgatatacgagggacagttgaagaatttcggcattctgttaatatgtacatgttctggaaaccagggatggagatttatgtttctcatgttcgtagaaggcaaattccatgctatgtgtttcctgatggttataaacgatctcggccatcaaggccaacatcacaatttgagaattgtaaatcatttcataataatgaggtttctgtgactgaacatgtggagagaatccgtaagaggaagaacaatgatggtgtgggatgtgagggaggatgctatagttaa

SEQ ID NO: 84146 - DNA, 1209 bp, Glycine max
  Peptide Sequence Number=SeqID_200924
atggggaaagctagcaggtggttgaaggggttgttggggatgaagaaggagaaggaccacagtgacaattcaggctcattggctcctgacaagaaggagaagaaaaggtggagttttgccaagccaccaccttcttcagttcctgccactgataacaacaacacctggctcagatcctatatttctgagacagagaatgagcagaacaagcatgcaattgccgtggcagccgccaccgctgctgctgccgatgccgccgtggccgccgcacaggcggccgtggctgttgtgaggctcacaagccaggggagaggggcattgttcagtggaagcagggagaaatgggctgctgtgaagatccaaactttttttagaggctacttggcacggaaggctcttagagcactgaaaggattggttaagatacaagctcttgttagagggtatttggttagaaagagggctgctgcaactcttcacagtatgcaagctctaataagagctcaaactgctgttagaacacagcgagctcgtcgttccatgagcaaagaagacagatttctacctgaagttcttgcaagaaaacctgtggaacgatttgatgaaacaaggagtgaattccacagtaaaaggctacctacatcctatgaaacatccttgaatggttttgatgagagccccaagattgttgaaattgacacatacaagactcgatcgaggtctaggcgcttcacctctacaatgtctgagtgtggagaagacatgtcctgccatgcaatctcatcccctcttccttgtccggtccccggtcgaatctcggttcctgattgcagacacattcaagattttgattggtactacaacgtggatgagtgtagattctccactgctcatagcaccccgcgtttcacaaactatgtgagggctaatgctccagctacaccagccaagagtgtttgtggagacactttcttcagaccttgctccaatttccccaactacatggccaatactcagtcattcaatgcaaaactaaggtctcacagtgctccaaagcaaagacctgaacccaagaaaaggctctcactcaatgaaatgatggcagcaagaaacagcataagtggtgttagaatgcaaaggccatcatccaatttctttccagactcaagaagaatcctggaattttttacaatcacaaggaatatttga

SEQ ID NO: 84147 - DNA, 297 bp, Glycine max
  Peptide Sequence Number=SeqID_200925
atgtatcaccaattattccaaattaaattccaatacttggcactaagggtggataagcgagccggatcgtccctcataaggtccacctgttggtggttgcatgatggtggtgcggtggtggcacaaggaaaaagaaacgacccgtgtgatgataacagatgttacacaatgcatacgcctaaagagatccatgcgaggagaacaggtggcacagtggtcaacgcctgtgttgcagtggctatgattgtgaggtgcaacgtgcgatgtggagggagtgatggagaagaaggaacctga

SEQ ID NO: 84148 - DNA, 132 bp, Glycine max
  Peptide Sequence Number=SeqID_200926
atgtctaataggttgagtttgattgctattaagaggaccatctttgggcatcttctgagtggtctattagagaaagcgacaactaagaagttctttgatgctctaggaaagaggtaccaagtgatggaataa

SEQ ID NO: 84149 - DNA, 597 bp, Glycine max
  Peptide Sequence Number=SeqID_200927
atgaatgaaatagagaaggtgcaagagcagatgaaggccgacatggaggccttgaaagagaaaatggccacaatggtagaggccatgatgagcataaaggagatagtggaggtcagtgcggcttaccaaacccgtgctagagctagagtaatgggtgaagtagagaaggtgcaagagcagatgaaggccgacatggaggccatgaaagagcaaatggccacaatgatggaggccataataagcatgaaaaagataagggaagtcgatacggttgcagttgccgctaccagcgctgttgctaaggtgaacccggtgcccccatttggcctcaaccaaatgaatcatccaacctcaaatatggtaggcaaagatttgggaagtacggacggccccatgatgtgcaaattcaaaacgagcatgccttcccatcatatggcttgcctcccaactatacaccacccaatgtggcatacactctcaatgaaaatctcaataactccactccgatactcattgagaaccaacaaccccaaactgatcatgcacatgtctcttaaaccgtgggggagacacatgaaattccccatcacaatctag

SEQ ID NO: 84150 - DNA, 333 bp, Glycine max
  Peptide Sequence Number=SeqID_200928
atggaagggttagtggacctagcagcgattgacgctttcctcgcctttcatcatggcaaggaaagcccggtcgtcgccattttggccatgtatgacacgttcgaccggggatgtgaaaagagcagcgcaagaattgtttgttgtgcactggctctctatgtgtggctggtttcacaccttttttctccaagaaggagtcaagaacttccccgattgctagccaaggccaaagcagtggcggacacctactctgcccccgaggagatccacggacttctcagctattgtcagcatatgatagacttaatggaccatatgattagaaaccgctag

SEQ ID NO: 84151 - DNA, 171 bp, Glycine max
  Peptide Sequence Number=SeqID_200929
atgaatccttgcgggatagggaacataaggtgtgcttatgccatgtcaggtttgtccgagataatgaataagagatggatagcaagggtgaaaacctcagttaaggtttgtgaacctgcatcgattggcaactgtggtcttaacaatggaagaaccagtagagaatactaa

SEQ ID NO: 84152 - DNA, 258 bp, Glycine max
  Peptide Sequence Number=SeqID_200930
atgcaagtccatggtcctcaacatgttcatcaagatcaaaaatgggatatgccacttgtgtcgcacattctgtcacgtgtgcccagtgtaccaataaaagacaaggggatctacaactcatgcatgatgaacatccaggattgcaacaacctcgcttgcctcactgacaataatgttgccgtcacacttgttcgtgataaaggatttggtagtagacatgacgaacttctacaaccaattagccaggctaagaaatag

SEQ ID NO: 84153 - DNA, 264 bp, Glycine max
  Peptide Sequence Number=SeqID_200931
atgcccaagttgatctattgcctaataaacgatgttgtcatcatagaaggtagctcagttgctactattgtggcattggcaatggtgctagccatcggaacagatgctactaccactagaaatgagcttaaagttgatgttggcatgcttgacataggttgtgtcaccatcaatgctgttggaacaattgttgtcgttgtcataagaaatgatggcatacccaactttttccaaaaggtagatgcatacactgatgtgaattga

SEQ ID NO: 84154 - DNA, 854 bp, Glycine max
  Peptide Sequence Number=SeqID_200932
aattaagtggtcaaatttgtcagatctatggggatgagctggaagttactgtgaatggggagccatttgttgattgcaatgaatgtgcattccctgtgtgcagaccttgttatgagtatgaaagaagagagggcaaccgagtttttcctcagtgtaaaaccaaatataagcgcatcaaaggtagtcctagagttgagggtgatgaagaagaggatgatactgatgatttagaaagtgaatttgatattgggatgtccttatttaatgtgacaattaatgatggtgatgcagttcaaccaagacctatggatcctaaaaaagatattgttgtttatgtatatggaagtgttgcatggaaggaacggatggaggattggaagaaaaaacaaagtgaaaaacttctggttgttagacatgaaggggataaagatagtgatgagttggatgatccggacttaccaaatggaccttatgaaggaacctccactcattactgcaaacacaattatgtctatccttgctatggattatccggtggacaaggttgcatgctagaaattgacttctctgttgtccttttctcagctatcccggtgttgtccacttacacggggacaactggaaaaggggcagcagagaagccaggtcctgcatgctatgtctcaaatgatggtgctgccatgcttacatttgaagcactctccgggacttatgattttgcaaggaaatgggttccattctataagaagttctgcattaaaccacgggctcctaaatggtattttgctcaaaaggttgactacttgaaggatagggtggatgccgcatttataagagaacgtcatgccattaag

SEQ ID NO: 84155 - DNA, 369 bp, Glycine max
  Peptide Sequence Number=SeqID_200933
atgggcctttttcttgtgaagatcgaacatgtagttgacatagaatttccaattctgttagttcaagagcatgttttagaaagtgagatgtcaaggcttcttcgtcacaagataccaaacactgtaaacaatgaaacattgcataaaattgttcttggagatttcaaaattgaattgaagccttccaggagaggccaaggagtaaattattctgccttagaaatttttaaaattccacaagaggcagatgaggcctatgaaaatgtccaaggaagccaattaaagagggctttagaaatgcatgaggcagttgatgtttccaagacaacaaagatggatccaaaaattgaagaggatatgcctccatag

SEQ ID NO: 84156 - DNA, 311 bp, Glycine max
  Peptide Sequence Number=SeqID_200934
gtggcaaagtgcaacgttttgatggttgaggttgggtcgtgggtgtttgtggtggtgattgtggaggatagagtgatgcggtcaatttgggttatggtgtggtgtttggagatgaaggttgaaggagaaggcagggaagggaaaaatgatgggtcgagaggattggagacaagtccggtggttgaactaaggctagcgccaacttacatagtggtgaatgcaattttggagaagaaggaggatgaattggggtcgaggtgtggccacttgttgacagcggtggaggcaatcggagaggaagggacaccgag

SEQ ID NO: 84157 - DNA, 462 bp, Glycine max
  Peptide Sequence Number=SeqID_200935
atggaaggagttttagtttctgggggtgagttatggaaggcgcacgtgtcgatggtaatggtgcagctattcagtggaggctatcacgtgatctccaaattggcccttaacgttggggtcaaccgtattgtcttctgcgtcttacgggatctcattgcactcctcattctctctcccctcgcttatatccgtgaaaatcataagagagatgacctaaagattacaagttgtctacaagatcaaggaaccgacttaagtaagaaatgtcttagcagcaagcctactttagatgtacccaatgataaaaggatccatcgtttatggatctttgttatggtgagcacacaaagcaaaaatgcttccgcaacagcaacatactcttcacctgtgactaaagccacgacctgtccaacaatggaagagaatgtgcaattggctgagttcatggagatgcctaggtag

SEQ ID NO: 84158 - DNA, 645 bp, Glycine max
  Peptide Sequence Number=SeqID_200936
atggcagcagtgtcaggaggaggagggactgagatatggaaggcccacacggcaatggcgatggtgcagttattcaacggaggctatcacgtcatcaccaaagttgcactcaacgtcggggtcaaccaaatcgtcttctgcgtctttcgcgatctcattgccctcgccattctcgcccctctcgcttacatccgcgaaaagatatttggcaaccaccttttgtttcttattggcttaagctatactaatccaacttatgctgctgcaattcagccagccactccggtctttacttttctgttggctgtaatgatgggtacagaaagagtgaacttgcttagatatgaaggtctggccaaggttggaggaactttttcctgtgttttaggagctgtactgatggttttatatcgtggtccggcattgataggatattcagaaacagactttgtatcacacagtgaaataagtgcgaaaggtcaaccggagccttctggatgcaacaccatgacagttgcggggactgctggtgagaagtgtttcctaccattgagaattctgaaagggttaggaaagtcgagtttgaacgagaagatcaagcatgggcaacaatcaaaatggtggttttggaaagcaaatgagtga

SEQ ID NO: 84159 - DNA, 189 bp, Glycine max
  Peptide Sequence Number=SeqID_200937
atgggaattccctgggatttattgcatctgcccttaattatggactcattacatggtgcaacaagatcttggggccagccatggttgctctttataatccacttcaacctggagcttctgctctcctatccagaatttttcttggaagtccaatttacatgggaaggtacattttctattacctcctag

SEQ ID NO: 84160 - DNA, 213 bp, Glycine max
  misc_feature (144)..(144): n is a, c, g, or t
  Peptide Sequence Number=SeqID_200938
atggatttcgtcgtggcgttcgcattattgtgtctattcacgatggagccatggcgcgttctctcgcagcagcaacagagacttctcgtgaacatgacgctcgttccaaacgctcgtgctagcggtgctcttggagagtcgganatattttgtagtttgtttggacggaagtttaccggcgtatcacttgcacagaggatttggagctggtaa

SEQ ID NO: 84161 - DNA, 1263 bp, Glycine max
  Peptide Sequence Number=SeqID_200939
atgaattatgatcatgtctacactatatttgttgcttatgaggctctgcctccagatgccatagtggctttggataccccttcatggactagaccagtgtatcccaacttagtcaagatgggtcctcattggattcccaatggtaccacaaaaaccattcatccgtctctgatggtagtagaggaaaagcaaaagaaagctaccacttctagtgatccttccgataaagtactaaatactttgcctgcaaccgccatcaacatggacccatccaaggagaatcccattcctcaaacccaatggtcaaaggaggtggacatctgtacccttcacaccaaatccattccctccaaccctacatgcttaagaccctctaaacaggatcttgacatgataggagatatcctgaagcagatgtacatacctaaccaagccactacttatcccagtggactccatatcagtaaatgcactaacttcaagatggtgtcgaacaaaacatgcccaaggctgcgtatctatgatgaagggaagaaaaagtgcttcaagctctgcttcaacgaagaaatgttaagcggaggtcaaaagacacgactagtcaaccattcacggtgcaagtccctcaaattctacacaggagcctacttcaaatcaaagggattccattcaagtgttgcatccaaccaagtataccactttgatgatgcaaaaacttgttttgtgaataaccctgaggatgacttcctagagtgtctaaagaagatgcctattatcctctatcatcgcatattcgacataaaaaagatgagtatgaagaaactggaagcgtgtgtccaacaccttcatgggttgcaacaaactaacaacgccaagaagcaaagagaaaggccgatacagaagacagatgcaaagttgctatcaagagaaaggttgaagcaaaggcggaaaagactagaccaagcaacactaaaagtggttgagtccactccaattcctattgttgagaagcccaaaaataaggtagatgaggctccaactgaaccaacctcaaatgaagcaatatccaaagacacaaatgttgtcattgtccatactactttgttgagaagcaaagggctgagaatgatgagccttgaccctccaccacaaacaacccttccccaaacactttcgccaccacctactcactctgatactccaccaccaccaaaccacccaccaccatcccaaccacctccacaccttactcaggatcagcaatga

SEQ ID NO: 84162 - DNA, 399 bp, Glycine max
  Peptide Sequence Number=SeqID_200940
atgacaaactctagcaaaaatactgctcctaccatgaccatcatcaccacaaacaccactaccgtccacactgaaagggaatccactattcatattgaacacttcttcaacaaagctatttcaatgatccataatatgaggaacgctaaactcaagggttggaagaccattgtgtccaaggttcttggaaaggaggtagtgttacccatggagtctattgcatacgtcacatggtgcgtcagggaaggaagcacataccaagaagactgggagaaaacctatgatagtcatgttccaaaagatctatatgggaagaacctcaaggaggcagatgagaaaaggaaggttcagtacaactttctgtgtgatatggccaaggtctggtacaacatcacttag

SEQ ID NO: 84163 - DNA, 1863 bp, Glycine max
  Peptide Sequence Number=SeqID_200941
atggtctttggcaaacatccaggcgtcaagaaccacctccgaatctcctcctccctccaagatctctcctcctatcgctacgacctcgaacatggccccacacccaacaacttcacttccagtttctccaaaaccaaaccggttcaactccccaacccggttcgccgcaaacacctcttcctcttcccgatcctcatcctcctcctcttcctcctcctctttttcctctacaccctctactcccaccactcctcccccaaatactacgtcgttctcgactgcggcagcaccgggacacgtgtctacgtctacagagcccaaatccaacacaatgacaaaaaaaccaccctccctatctccatccaatcactaaaagacggcttgcgcaagaacccttcaagcggccgcgcctacgaccgcatggaaaccgaaccgggtctcgacaaactgctccacaaccgaaccggtttaaaaaccgccctcgtaccgcttctcaaatgggctcagaagcagattccagaaacttcccataaaaccacttcgcttttcctctacgccaccgcaggggttcggagactccccttcgacgattcgaaatggctgctcgacaacgcgtggagctttttgaagagctcttcgccgttcgtgtgcaagagggattgggtcaagatcatttcggggaccgaagaggcttactttggatggattgcgcttaattacgattccgggattcttggggttaagccgaggagagaaacatacggtgctcttgatttgggagggtcttcattgcaggtcacgtttgaggggaatagcaataaagagccgcaacatttgttcaatagtgagactagtttgtatgttaggattgggtctgtgaaccatcatttgacggcttattcactcgcggggtatggcctcaatgaggcatttgataagtctgttgctcatgtttttaaggagtttgggtatggtatggaggatgttgttaaggggaatttggaggttaagcatccctgcttgcaaatcgggtacaaggagaggtattcgtgctcacattgttcttctgctgtgaagaaaggaggggagagtctgatggttgagggaaatgggaatgtggtggggaagaaggagggaggatcaaggactgtggtgacgcttgttggcgccccaaattggttgaagtgtagcacgctggcgaaggttgccgtgaatttgtctgagtggagtgatgttaggcctgggctggattgtgaggttcacccgtgtgcccttcgtggtaatttgccccagccaatggggcacttttatgtgatttctgggttctttgtggtgtatcggtttttcaatttgactgctgaggccacgcttgaggatgtgttggagaaggggagggagttctgtgataagagatgggatgttgcgaggaagagtgttgcccctcagccgtttattgagcagtattgcttcagagcaccatatattgcatcgttgctgagggagggtttgcacattactgataagcatataactgttggctctggaagcataacttggactcttggggtggccttgttggaagctgggaaggcgtattcggttaggtttggactccgtggtttttacttgcttcagatgaagatgaatccgcttattcttattcccattttgatactttctttcattcttctgctttgtgctttgtcgtgggttgtcaattggatgccaagatttttccggagacagtatcttccatttttcaggcataacagtgcgtccagtgcatctggtattaatatcccatctcctttccggtttcagcggtggagtcctatgaattctggtaagctacgtgttaaatga

SEQ ID NO: 84164 - DNA, 249 bp, Glycine max
  Peptide Sequence Number=SeqID_200942
atgtatctgcttggcatcacaaatcaactgaaccggaagccagcacttgaccatggcagtggtgcgggtgtgcctgcgcctcccttttcggcggacacttcgttcttctgcttcgtccaccgcatccctatgcttcaagctctctctctcatctcatataattatcgagatacatgttcgcacctgacccaccttccattttcagatcactgttacaacaatatctattctatgcaggtcgtgaactaa

SEQ ID NO: 84165 - DNA, 162 bp, Glycine max
  Peptide Sequence Number=SeqID_200943
atgaagaagaaacaaagcaaacggaggaagcaaaatgatgaagaaagaaagccagttgctgaggaaatgacacaattagaggcagtggctttcaagttgcaaacagatatcacaatcaaggcactctcaactgggcacccaaaatgtccaaaaaccttataa

SEQ ID NO: 84166 - DNA, 123 bp, Glycine max
  Peptide Sequence Number=SeqID_200944
atgaaggctgttgattatggagtccacaagctctgggaggcaaataatgttgggttgggaatataccgtatgatgccacagaggaacaacttattgaaatctgccaggaggttggcccagtag

SEQ ID NO: 84167 - DNA, 459 bp, Glycine max
  Peptide Sequence Number=SeqID_200945
atgattaagagaaacgacgatatcactgcatcagtggcagagtttgatgcatggccttttgaggaggaacacagacgaattattgaaaacagaaagagtggaacaaatcttacatggtctgaagttaataacatgccgtacacagccaaagtgattagtgaaactcttcgtagagccacaatactaccttgcttttcaagaaaggcatcccaggattttgaaattaatggttataaagttagaaaaggttggtccatcaacctagatgttgtttctatccaccacgacccagaagttttctcaaatcctgaaaagtttgatccctctagatttgatgaacccttgaggcctttcagctttcttggatttggtagtggaccacgtatgtgtcctagaatgaaccttgccaagcttgaaatctgtgtcttcatctatcaccttatcaacaaatacacgtaa

SEQ ID NO: 84168 - DNA, 390 bp, Glycine max
  Peptide Sequence Number=SeqID_200946
atgacttttcctacggatctccgaataaagaaagaaactgtcgcaacctacccttcggcgggagggcgacgcgagactcgcgggatgcgtgttccacgaaaggaatacgcgcggagtcgccaccaacgtttatttgaggaaaacgtcggaaaaaccggaaaatacgcgatctacgaacttttaagtgaaaggctcgggagttgtatttacgcccggggtcgccaccaacgtttatttgaacaaaaggagagaaacgttaaagcatttggaccattaacgatctcttggggtggtcgacaaaagcggggcttttgctcctacgtatcctcaattgcgatgaggaaatcagacctacgtagttcttgcaaaagcggtaaagtcacatgttga

SEQ ID NO: 84169 - DNA, 1160 bp, Glycine max
  Peptide Sequence Number=SeqID_200947
gttcaagttctaattttatgactcctttcgaggattgtcaatctccaactaatcagcctgtaatcaacactgaaggatattctgatcttggtgatcaactcatccaatgtagatattgtaatgcacaaatgtggtatgatgaaagaatatcaaaaaataagaattgtctgaatccaaggttcagtttatgttgtggagatgacaaagttgaattgccattattacaaaatccaccccaatatctgcaacaacttctatttcatgatgatacaattgatagtaaaaattatcaacataactcgcgagcatacaacatgatgtttgcctttacttctgctagaattaagctagataaaacaattaataattcaagaggacctcctacgatcagaatacaggggcaaccatgccatagaataggcagtctattaccaatgcctaggaaaaaacccaaatttgcacagctatatatctttgacacagaaaatgaagtgcaaaatagaattaatgtcatgagtcaatattccagaattcagaatcatattgtttcagctttaagtcacatgttcgatcaacacaattctcatgctaaaagttttagaatgcccagagatagattggcaactgatcaagccaataatatcaaattgcaactcatagctgctcggggaaaagatggtcgtgtatataatatgcctaatgttccggaaattgctgcacttattgttggcgattttcatccaggctcaaaaagagacattattgttgaaactcaaaatgtagaattacaaagaatccatgagcttcatcctagctatctaccactacagtatcctctactctttccttatggagaagacggatatagagctgacatacttcatcgttttacttcatccagcaaaaaaagaaagcgaaaccgtttgacaatgagagagtggtttgcttatagacttcagtccaggtcaaatgaagcacagactttattgcattctcgaaaattatttcaacaattcattgttgatggttataccatggtggaatctgaaagacttagctatatcagaaacaaccaaaagaagcttagagttgataagtattctagcttacaaacttcattggatactggaacagctaaaggcttaaccaagggaaaaaga

SEQ ID NO: 84170 - DNA, 1434 bp, Glycine max
  Peptide Sequence Number=SeqID_200948
atgagttcagctcccagtatgagagtcagcgagcaagagcactttcatcttgaggatactagtgacatagagaggtctatttgggtgctgaatcctcccaatccaccacctcttaggaacaagctatttagtccactgaagaaaactgtgtcctttttttcatccaagaagaaaacttgccttggacatgctgtttcattcttggagagtctattcccaatccttacatggttcacaaattacaaggcctccaaattcaaagaagatttgctagccggtttaactcttgccagcctcagcatacctcagagtataggatatgctaatttggcaaaacttgatcctcaatatggtctatacaccagtgttgttcctccacttatctatgctgtgatggggagttcaagagaaattgcaattgggcctgtagctgtagtttcattgctgctatcctctttggtccccaaagtggtggatcctgctgttgatcctgatgcctacaggaatgtcgtctttactgttaccttatttgctggaatctttcaagctgcatttggtattttcaggttggggtttcttgtggattttctttcacatgctgcacttgttggattcatggcaggcgcagccatcatgattggtcttcagcagctcaaggggttgctggggattactcactttaccaacaaaactgatgtaatatctgtattggaatctgtttataagtcgctccaccaacaaatcacatctggagaaaaatggtaccctctgaattttgtcatcgggtgttcattcttgattttccttttaattgcccgatttgttggcagaagaaacaaaaaacttttctggttgcctgctattgctcctcttctatcagttatattatcaactttaattgtgtatttatcaaaagctgataagaatggggttaacataataaagcatgtcaaaggaggcttgaatccaagttcagttcaacagttacaattccatggtccacaagttggtcaagcagcaaaaattggattgatctctgccgttattgctcttactgaagcaatagcagttggtcgatcttttgcttctattaaaggataccatcttgatggcaacaaggaaatgctagcaatgggatgtatgaacattgctggatcgctctcttcatgctatgtggcaactggttctttctcaaggactgcagtaaatttcagtgctggatgtcaaacatcagtgtcaaatattgtgatggcagttactgtgtttttgtgtcttgaattgtttacaaggcttctatactacactccagtggccatacttgcttctatcatcctctctgcacttcctggattaattgacataagtgaagcttgctatatttggaaggttgacaaatttgactttctagcctgcattggtgctttcttggggtaa

SEQ ID NO: 84171 - DNA, 744 bp, Glycine max
  Peptide Sequence Number=SeqID_200949
atggaggagcgggtgtcttcgtcatcgctaccgtcgccatcacccccacctcttgaaaagaaccataataccgacaaactcaagttaccagacttagaccctggcacctacgttgtccaggtccccaaggaccaagtctaccgtgttccgccgccggaaaacgcccaaatcgccgagagccataagaaatctcctcccaacaaggaagcaaaaacgtcacgctgctgcttgtgttgcgtgttgttcttcattatattcttggtccttgcaattcttctcggagccgttctaggtggtcttttttccatgttactcacaccagaggaccctaagttttccatcacaagctttaaggtcgtggagaccaagccacaccccaaatacgacgtcactttggaagtccacaatccaaattccgacgtgggaattttgtataatggcaaaggccatgtctccctctctctaaggcgacaagagaatattgcttcaggagcataccctactttccgtcaagactctcacgatacgacaacgtttgggctaactttaacatcatcctcaaaagccggtctccctaaggaggtggaggaaagcgtcaggaacgataagaagaaagtgagtgtgacattctcgttggccattcacgccctagcacacatgaaaatgggcttgttgcgtagtgggacaatgaaattcgatgttacgtgcaaagtgaagttggatacgttggccaaaaccactcac

SEQ ID NO: 84172 - DNA, 591 bp, Glycine max
  Peptide Sequence Number=SeqID_200950
atgcagaatatacttagtttaaagtgtgtaaaggttgtgtggagacctcttcctgaagattggttgaaatggaacgtggatgggtctgtggttctcataggtctaggtccgtccctggttctcaatggttcgaaggcttcgtgtggaggggtgttgcggaattgctttggtgcctggatttcaggctttcttagaaatattggaaccacttacgtgctttctgctgagttgtggggtattttttctacattagatatctcttggagagtggggcataggcgagtcttagttgaatgtgactctaaggtgacggcgaaactcatgtctaagggttgcttatcctcccatccttatagccccctgattcattcgatccagcgattcttcagtagaagttgggtgctgcgagttaaccacgtttacaggaagagaaatgctgttgcagactcgctggcagcgttggctcattcaaagcctattgggttgtttttacttcaatcccatccccctctttgttcttcccttttgttaaaggatctggttgctggacctattgttcgggctgtagcttttgtggcattagtgatgtga

SEQ ID NO: 84173 - DNA, 775 bp, Glycine max
  Peptide Sequence Number=SeqID_200951
gtatcccccgttgtatgaaaaccaagatcatcatcatccccaactcatgatgcctaatggtcttggacagcaaagtggtgcctttttgcaacagtggtcccagggattgccgaatcagaatagtgaatataatcaaaggatgaacactcataatctacaacgggagagtaacacaagttcgcaggcaagtcaatcaaggattctgggccactcaagtaatggaacaattgaaggaacaagttcccaagtttttagcaccagggaggctgagattgcacccgtttcaagggctcaaccttcggaggctattcgcagaattctggatatgaaccccaccagactagttacgcatgctcctactaacaacatgcaaattggaaggtgtacacataattatgatctaggaaaccaattgttgtcactgagagagatacgttatgaaccgccacgtcgtggtcgtccccgaaaacgacgtgatgatgaagaagagtcatcttctcaaagtggaaagaaacgttctgaaccaccacgtcgtggtcgtccccgaaaacaacgtgatgatgcaactgaatcattttctcaacgtggaaagtcgcggaaggtttcttctaaagctcaaaaggctgaaacaacctatgcatctcaacaaataccacaacagactcctgacagtgtaatgaatacagatcaaaatgccatactcacaaacactgtctatgacatggaatttgagacgaagggtattcctccaccaccaccaccaccagagaactaa

SEQ ID NO: 84174 - DNA, 758 bp, Glycine max
  Peptide Sequence Number=SeqID_200952
atggaaagacagaaacaagccaaaaccattgtgcctacgtctcatgaggaattctcgatctcctctactcctgaaagcactgcagcgcccactcttgttcctaatccgctgaccctgtcactatcaaactcttcaacttcactgattagtggaacacaatcaagtcacccttttttatccccggacggattggcgttggaaggagttgtttcatctactcaaggacaagatatgacacaaacaggtcacttcaatcaatttatcgacatgcaaaatgaaatttcttttgcgcttcaaggtaccaaacaatccacacttggcaccaaacacaacccaaacccaaacaatccacactttgtaccaaacacaatagaaaacaacaatttcaatggtgtcaatccagcattgtttaacccaaaccccgtacatgcaaggcctgaaaaccaccaattctctaattctgatttctatggtgcacgatacgcaaccaactacacacagtcgccccaaccattcaatactatgcagaatcaacaagtaggccatgcctctggaatgcagcagatgtttgatttacaatctcaaaatcctatgaggttggaaccatactcaaatcttgagcctgttgttgcaacaatgcccccaaatcctgctcaacaaggttatagatccgtgctggctgatcctgcagctccttctgcatccatacttgcgacaacaagaaattcctttggacacagatcttcaatgcctcctat

SEQ ID NO: 84175 - DNA, 297 bp, Glycine max
  Peptide Sequence Number=SeqID_200953
atgatgataggtagtcgacatgcgacctccacctctccacatcctagtcgcactccatcaagcccgccttctcccttgctattttccacatcccagccttactcgaattgtgacccagatctatcgaatctgaatcgtctcagtgtgtggagtttgatctcactcgaaggacccgatgtgttggagaagggagggcccaagatgcatcaaaggtttgaggatggtttccaaggaagaatatatgccgggcacaagttagcttcggttaacacattttttatggtgtttggaggttag

SEQ ID NO: 84176 - DNA, 396 bp, Glycine max
  Peptide Sequence Number=SeqID_200954
atgaggggttgcatcagttacaaccccgttcttgctataaggcaacttggctaccctatgagaagggcaccactagaggaagagatcgtgcctgtcatttcacgaggtttcaataagaccaacgtggagacacttcagaaggtctgcaaggcatgggaggtggtgcgaaagaaggacaaagaactcaggggcagtaacaatgggcccatcgatggctaccgtgagtggttgagagcccatgtgcaaggtttggattggctcccaagtttgagaaccgctaaaagggaggaagttgaggcaccggaggaagacgaagaggtgcaggtccttagggcagaactcgagcaagcccaaacagtcaaagaaaggttcaaatcagcagctcttaagatctga

SEQ ID NO: 84177 - DNA, 369 bp, Glycine max
  Peptide Sequence Number=SeqID_200955
atggtaaagcatttggtcaacacattaactatcagaaatcagagatatttttcaacttcaacacatccaggagcaattaatattgcgacactgcttggagtatcacaaacaattggaacattaaagtacttagagctgccatccattattggaagaaggaaaaaagccatttttgggtttctaaaaggcaagctatggactaaaatcaaccactggtccaccaagtttctcagaaaagctggaaaagaagttctcatcataacaatggcacaatctatccctacatactgcatgagtgtgtttttattgccaattaccttgcagggtgagcttgagaaaaatgatgaactatttctggtggggaagtag

SEQ ID NO: 84178 - DNA, 855 bp, Glycine max
  Peptide Sequence Number=SeqID_200956
atggatggtgtacagaacatggatgggaagtctaagccagaaagccttggtgtgtacattaacgacgacttcgtagataacctaccaacactttttcctttcggtagtctccgtgatggttttgaagaggcgaatttaatggaatcttttaactttcaagctgatcttcctacccaaaatattcaggaaacaatttccaatctgagtgttgttcctgcacctctcgagggattgacgttggaaggggctgtttcatctatagaaggacaagatatgaaccaaactggttacttgaaccaatctcatgacatgcaaaatgaggatatgcttgcgcttcaaggcattcatcattatgacgagcaaaacccaagcaatccattggtatcgaatataaccaaaaacaataatttcaatggtgtcaataaccaggcatccccttatccagcatcgttccaccgaaacccagtactgacatggccaaggattgaaacagggttttcaagtggacaacttgtaacacctaaaagacctaagttattccctcctcgcaacaatcatattcatatcagtaactctcatgctgcgtgcaattcaaggtggtcccgaccattcaataccatgcagaatcaacaagtaggccatgcgactacaagcaattcctttctacccagatctttagtgcctgctacgtcccaaggagtgccaaatcagattagcaaatacaatcgaaggatgaacactcctaatctacaacggcagagtaacacaagttggcagagacatagggtggctgagattgcaccagttttgagcaaaagaagcccctactcaaggcaacaaaagaaaacttcctag

SEQ ID NO: 84179 - DNA, 459 bp, Glycine max
  Peptide Sequence Number=SeqID_200957
atggttgacaacacacgcatgaaggagcttacaggggatgtcaaaaggatcctggagatgatggaaaaccgcaataaagaatatgctgctcggtttgagaccttagaaacaacactggagatgacactcaaggatataaaacttgagatcctgggagttaggaatgttaagattgattttcccatattagatggatcagatgttttacaatggatattcaaggctgaccagttttttaaatatcataaaacaccgggtgagcaacgattaattattgcttcaattcacttggataaagaggttgtgccctgctaccaaatgatgactcgtgaaaattcattcaaaacatggattgcttttacgcgagccttagagacagaatttggcccatcaccgtatgaatgtcctagatctcagttgtttaaactcgctcaaattggttcagttcagtcatattac

SEQ ID NO: 84180 - DNA, 306 bp, Glycine max
  Peptide Sequence Number=SeqID_200958
atggctcaaaatactgaacacaccttcatctatagccaggaagcaaattcctcaagcatgggaggaaaccctccacaacttgctgtgaatgatgccaatcagttgcccttgttctctccaagcacttcagctccattactggatccggatgaaactgaatccaactgttatgtaccttccatggtgggattgatctcatcagaagaagcaggtttatcggttcaagcccaagatatgactaccccgaccctgatgaactactacaatcaatatcatctcacgcaaaacaataatttgcctatgtag

SEQ ID NO: 84181 - DNA, 386 bp, Glycine max
  Peptide Sequence Number=SeqID_200959
agactgataccacttgttcggaagccagaaacgggaaagatattcagggaatcccctgggagaggcttaactatagcagagacaaataccgtgagaccagactcaagcaatacaaaaattaccagaacttctctctctctcctcaccacctccacaaggagtgtttccaagtgcagaaggggcaaactttctatgacttcttcttcaataccaggcttgtcaaatccacaattgtccactttcagattccggaacattcgggcgtattggggtcattcatttgggatgttatgccttttactgttacatgtcggataaatgggttatacctgcagggagttcttactgttgttcgcagccatactggctgtgagttatctgactga

SEQ ID NO: 84182 - DNA, 1038 bp, Glycine max
  Peptide Sequence Number=SeqID_200960
atggatttggaatgtggttcttatttgacatatcacgctaaatcagcagtgttgcagaaaaagttaggcatgtctgaaatagaccgtgcccttcagaatctgttctctattagaatgaggctaggcctatttgatggaaatccaacaaggctctcattcggcttgattggctccaatcatgtatgttccaaagagcaccaatatctggctcttgaagctgcaagaaatggcatagtcctcttaaaaaactctcccacacttctcccacttccaaaaacaagccccagcatttccttagcagtgataggtcccaatgccaattcttctccgctaactcttcttgggaactatgctggccctccttgtaaatacgttacaatactgcaaggctttcggcactatgttaagaacgcgttttatcatcccggctgtgatggtggacccaagtgttcttccgctcaaatagaccaggcagtggaagttgcaaagaaagtggattatgtggtgctggttatgggattggatcaaagtgaagagagggaagaacgcgatcgcgttcatcttgacttgccgggcaagcaacttgaactcattaacggcgttgctgaagcttctaagaaaccagttattttggtcctccttagtggagggcctttagatatcacttcagccaagtataaccacaaaattggaggaattctctgggctggttatccaggggaacttggaggcattgcacttgctcagattatctttggtgaccacaatccaggagggagactaccaactacttggtacccaaaagattacatcaaagtaccaatgacagacatgaggatgcgagctgatccttcaaccggctatcccgggagaacttaccggttttacaagggtccaaaggtgtatgagtttggctatggactaagctactcaaagtattcctatgagtttgtttctgtcacacatgacaagcttcacttcaaccaatcatccactcatttgatggttgaaaattccgaaaccataagttacaaacta

SEQ ID NO: 84183 - DNA, 315 bp, Glycine max
  Peptide Sequence Number=SeqID_200961
atgccgggtgctgcaccgagaagacctgcatgccgatccttgccagtacctgctgcagccctgggaggtccaggctgtcgtgcagcacttcgcgttcggccaatgccaacagcaggtggccggggtcatgctcgcgcagtacgtcgtagagcaggcccgccgaggcctgcagctggcgcagcgaccgcggcatgccgccgggcaggctgggcaccagcaggccggctacgcgtgcgatgccacggaactggcgccgcgccagctcgcccaggttcactgccgcgcgcagatcgtccagcagctgatcgggggtga

SEQ ID NO: 84184 - DNA, 381 bp, Glycine max
  Peptide Sequence Number=SeqID_200962
atgcacgtccagtgcagcattgcgttcacgccatcccagccattgctggtaccaggcagcgcgatgcgctggcccatgcaggatgtcgcccaggatccacagctcgcggcaggcatgcctgtccagcagcccctgcaggcgttgcaggtcttcgccggtgccgccgctgggcaacgcgatgccggcacgacggaatgcatcggccttgcccaagtgcaggtcggcgatcaacagtgcctgccgcgcaggccagtacagtgcacgcgcgccaagcagaatcagcgattcgccggcgcgcagcagcggcagttcatcggccatggcggcgctccagctgctgggccgcgcgttgcacacgggtgcgccagtcttcgttgctga

SEQ ID NO: 84185 - DNA, 207 bp, Glycine max
  Peptide Sequence Number=SeqID_200963
atgcctcgtattcatgacgcgatcctgtattacaacgggaaatggaacatgccaccgcagaacaaatttgttggatgcgcgttcacaggaaaaaatcctaagaaatttcaaattccttcaacatgtaccatcgatgaactgaagaatttaatcaagcaagttgcacctaaaaagattccccctcttggaattcacgaatcacaaacg

SEQ ID NO: 84186 - DNA, 123 bp, Glycine max
  Peptide Sequence Number=SeqID_200964
atggaggaggcacgaggagaagccttggctgcgcagcaacactggtttcataggagtaataagccttctggtaatcgattacaggatgttgtaatcgattacaggctgcctattcttgtgtaa

SEQ ID NO: 84187 - DNA, 228 bp, Glycine max
  Peptide Sequence Number=SeqID_200965
atggagacctcagccggcctgccatgggtggtcgctaaaatccgtctctacttgatttctactactactctgttttgccgcaagaaaaagtggtcactaagttcgtcgcaaaatactattcacagcaaaacacccaaaactgaaacaggggaagggcttaataggaaaactgaaacaggggaagggcttaataggaaaataccggtaaacaaaataccgggacactaa

SEQ ID NO: 84188 - DNA, 956 bp, Glycine max
  Peptide Sequence Number=SeqID_200966
atggatcgaacaacatctgctggcggtggccaatcaagccgaagcagtgcgccgtgcggcggtcgtcgcaggctggcagcagctgtgcagcagcgaacgcctggtgttcaacaagctgctgaccggtgccctgcgcgtaggtgtttcgcagcggctggtacagcaggcgctggccgaatgctgctgtcgccggatgagcttccgctggaccgtcagcagccctacccgttcttcctcgcatcgccactggaaggtgaacctgccgaacggctcggcccgatcgatgactggctgctggaatggaaatgggatggcattcgcctgcagctgcttcgccggcgtggcgaggtcgcattgtggtcgcgtggcgaagagcggctggatggccgcttccccgaaatcgagcaggcggcgatggcgcttcccgatggctgcgtactggacggcgagctgctggcctgggacgaaaacgccaacctgccgcgtgccttcaccgcgctgcagacccgcatccagcgccgcaaacccggtgcggccaccctgcgcaacacgccggtgcgcgtgctcgcctatgacctgctggaagtcgatggcgcggacctgcgtgagctgccgttgcaggaacggcgtacgcggctcactgaggtcatcggtgcgctggacgatgtgcggatccagctgtcgcccgacgttgacgccgacgattggcaacgggcagcagcgatgcgcgacgtggcacgcgaacgcggcgtggaaggtctgatgctgaaacggcgtgtctcgccctaccagaccgggcgacgacgcggcgactggtggaaatggaaggtcgatccactcacgatcgacgcggtgctgctgtacgcccaggccggccatgggcggcgcagcacgctgtacaccgactacaccttcggcgtctgggacggagacacgctggtgccggtggccaaggc

SEQ ID NO: 84189 - DNA, 287 bp, Glycine max
  Peptide Sequence Number=SeqID_200967
atggccccagggaagcttgcctcaaagagatccaggaaagacaaagcggttgaagaagacaaagcggctgaaggaaccagttccgctcccgaatatgacagccatcattttaggagcgctgagcaccagcagcgcttcaagaccatcaaaggatggtcattactctgggagatacgcgtccagcttagggacgacgagtatactaacttccaggaagagatagttcgccggcagtgggcatcgctggttacccccatggccaagttcgacccagacatagtcctcga

SEQ ID NO: 84190 - DNA, 1150 bp, Glycine max
  Peptide Sequence Number=SeqID_200968
atgaagtatcgcgccggggtggacgacaacgggcgtattctggcgatcaaaatcgatattcttgccgatagcggcggttatgcggcgtcttccccgttcgtcacctggcgttcttcggtgcaggcggcggggccgtacaatattgataacgtccatatcgacgtcaaagccgtctataccaacaacagctatacctcggcgatgcgtggtttcggttcaccacaggtggtttacgccaacgaatcctttatggatgaaattgccgacgtgctcaatctctcgccggtggcggtgcgtgaagtgaatgcgctgcgtcagggagatacctcggtcaccgggcagcggtttgataaacacaccgtctcggcgactgaagtcctgagtaagtcggtgaatgcctcggaatttgcggcaaaacgccagcactatcgtgaattgaaccaaaaaggcggcgtttatcgctatggcattggcctggcgctgagctaccgtggttgttccatcggcgcggaaggggtagatacctcgacggcgctcattcaggtgaatgaggacggcagcgtcaatctggcgacatcggtttctgaaaacggtcagggtctgcaaaccgcgatgtcgctaatcgccgcggaagcctttggtattcctctatctgaactgcattttatggaaccgccgacctcggttatcggcgacggcggatcgacggcggcaacccgtgggactatggtcggcggtggggcgattcttgacgccgcggacaagataaaacgccgcattctcagcgtcgtcggcgacagcatcggcacccgcgagttggctgaaaccttatggcaggatggctttatcatcaacgtccaggacagtgaacggcgtattgatttcaaaaccgcggttaataaaaccaaatgggccagcgtcagcctgaccgagtacggctggtttgtgccgccgcccattcattgggatgaagaaaaaggctgcggcagcccgtactttacctgggtctacggctgccaggtggcggaggtacgggtgaataccagcaccggtaaaaccgatttgctgcatgttaccgccgcccatgacgtgggccgggtactcaacccggtggggtttgaaggtcaggtttaccgtggggtggcgcaag

SEQ ID NO: 84191 - DNA, 285 bp, Glycine max
  Peptide Sequence Number=SeqID_200969
atgatcgataatgtcgtctttgccgccgaacgagccgcccatcaccgcgcgtttgacgttaatctggctttgcgggcagcccataaacttagccacgaagctgcgtacgcggtgcgggttctgaatggagccggagataatcaggctaccatcggtaggatcaagccaggtcagtacgacttccggttcgatgtaggcgtgttcctggaagcccacttcatattcacgttcaatcacgtgactggcttcggcaaagcctttggcgatgtcgcccttaacagtgtg

SEQ ID NO: 84192 - DNA, 568 bp, Glycine max
  Peptide Sequence Number=SeqID_200970
atggcaggtcaaaacaaacgagcagtcaccagttacgatgtcgcgaaagcggctggcgtctcgcaatctgcggtatcccgcgcctttaccgaaggagcgaaaatttcgccagccaccaaagaaaaggtgcgtaagatcgccgccgagctgggttatcgtccgagctttatcgcccagtcgctgatcacccgccgctcaacgcttattggtgtcgtcgttccggggttggtgaatcccttctacgccgcggttctggatgaactgtcacaggcgttgaacctgatgggataccgggtactgttgttttcgatgtaccgcgatgatgacactacccccatcatggaagagattctgcgtcatcgtgttgaagcgctagtgctggtgtccagcagcctttcttcacactttgctcatgaatgccagcagctcggcctgccggtgctgctgctcaaccgcaaaaacgacagccggtcggtttccagcgtcaccagcgataatctggctggcggcgccgcgattgccgatttcctgctggatctcggccatcagcagctggcatttgttgccg

SEQ ID NO: 84193 - DNA, 255 bp, Glycine max
  Peptide Sequence Number=SeqID_200971
atgactaaagcacgtcaaaagggggtacgaaaagaaaataagggacgagcttgccacccagctcgcccaggtgagctcagctcgcccagacgagccaggttgcttcctctagaagcaaccgccttctggaggaacatcctggaaggcccaactttcggaatgttacggaaactcacggattgcataacaatacttccttttgatttacggcatgttacggaatttcacggattgcataacaatgcttccttttga

SEQ ID NO: 84194 - DNA, 762 bp, Glycine max
  Peptide Sequence Number=SeqID_200972
atggttgagcacgataaaatgatcggcgaggtgctgaagaaaatcaaagatctgggtatcgaagataacaccatcgtgatttacaccaccgacaacggtccgatgatcgccacctggcttgattccggcatgacgccattccgtggcgagaaaaataccggctgggagggcggcttccgcgtccccgcgatgatcaaatggccggggcatattaagcctggcacgatgatcaacgatattttcggcagcaacgactggttcccgacacttgttgccgcagcgggcgtgccggatatcaaacagcagctgctgaaaggctataagaccagcgccatgacctacaaagtgcatctggacggttacaaccagctggatttcctgcagggcaaagggcccgatcagagtaatgagttcttctactggagcgatgacggcgatctgttagcgatgcgctacggtcgctggaaagcccatttcatgattcaggaacacaccggcctcgacctgtggaaatatccgttcgttaaactgcgcacgccactgatcttcgacctggagatcgacccgctggagcgcggtgacagcggtatggattacaaccactggttctatgaccgtctgttcctgctgggtggcgcgcagaaatatgccgcagaaatgctgcaaagcttcaaagagttcccgcctcgtcagaaacccggctccttcaccgtttcggatgtgcagaaactgattgacgaaggcagcccggccaccaactga

SEQ ID NO: 84195 - DNA, 288 bp, Glycine max
  Peptide Sequence Number=SeqID_200973
atggtcattcccaagttcaaggtgccagactttgacaagaacaaggagactacttgccccaagaaccatctaaagatgtattgtcagaagatgggggcatacgcaaaagatgaggaactacttatacatttcttccaagaaagtcttactggggtagctgttacctgtatcaatacaattctgatatggcttcagataggatgcaactatagaaccatgtgcaaaaaagagcatgaatccttcaagcgaatatgccccagaggtggagggatctgccagctcaagtag

SEQ ID NO: 84196 - DNA, 207 bp, Glycine max
  Peptide Sequence Number=SeqID_200974
atggtaggaaaattaataaagattcccatacccattatacaagtagggtggctaaaggctcaaaagacatctgaggaactagaaaggcttgtaatggagatgggtaagagtgcattgctgacaactgcttgtgggaataacaaagctactaagtctcaagctaatcagaaagggaatgatagaataccacctcaagctgatatttag

SEQ ID NO: 84197 - DNA, 468 bp, Glycine max
  Peptide Sequence Number=SeqID_200975
atggcgagggcgtgtagccctctgaaggtgaggatgtgtggtcctctaaaggtgagggcttgtagccctacgaaggtgaggacatgcagtcctctgatggcgagggcgtgtagccctctaaaggtgagggcgtgcagccctttgttggcgaggacgtgtagtcctcttcaggcgaggacgtgtagtcctctgagggtgagggcgtgtagccctatgaaggtgaggacatgcagtcctatgatggcgagggcgtgtagccctctgaaggtgagggtgtgcagccctctgttggcgaggacgtgtagtcctcttcaggcgaggacgtgtagtcctctaaaggtgatgggtacaagtacccaagggtccacccttatgagaaagcaagagatcgactcatcgagagggccggtcatcccaaatccacaagatttggacattagatgtaggaaatctatgcagttaacatga

SEQ ID NO: 84198 - DNA, 639 bp, Glycine max
  Peptide Sequence Number=SeqID_200976
atgctagatgaggccatagaatatttaaagcaacttcagcttcaagtgcaagcgagttttctttcatttggcttgtgttgccattgtaagaaccttgcttcgaagtatgagaaagttgcttctatcttgagtagtcataatcctcttattgttttggctaaagtagatgctaatgaggagaagaacaaagaccttgcatcacaatatgatgttaagggattcccaacaattaacattctgaggaataggggaaataatgttcaggaatacaaaggtccccgtgaagcagatggcattgttgactatttgaagaaacaaagtggtcctgcttcaactgaaattaaatttgttgatgaacctattgcttttgttggttggagtttttctagagaggagtttgacaacttttctgccttagcagagaagttgcgttctaagaagttgcgttctgataatgactttggtcacactctgaatgccaaactccttccaagaggagagtcatcagtttctgggcccatagttaggttgttcaagtcattcgatgaactttttattgacttccaggttattatttatattgtttatcatcattattattattatatggtcccttacaattgtgttgttttatcctaa

SEQ ID NO: 84199 - DNA, 246 bp, Glycine max
  Peptide Sequence Number=SeqID_200977
atgcaaaaaatcttggtcaatgtgtgggccataggaagagatccaaccatttgggagaatccagaaatgtttatgcctgaaagatttttggagtgtgagattgattttaaaggtcatgactttgaactcattccttttgggacaggcaaaaggatatgtcctggattgccattagctcatagaaaacatgaacatggaggagcaatatggaataagcataaagagggtccaatcccttctagttga

SEQ ID NO: 84200 - DNA, 300 bp, Glycine max
  Peptide Sequence Number=SeqID_200978
atggagaaccatggagatgctaagctgataagcagtgatgtgattggatcgggttgtccagaaaatgatgctttgataggagaggttgttgaggaagctcgggactgtgctactgatgtgggtgtttacgatgaggacttggtgtacagcagaaaatgtatgtcgttagcagacaagccatcaattgttgatgaagacttagaatttgttcctttgcccttcccatcaatttcaatctcctctagggaacgcatgtgtagtgatacgacaccttatgcttcaaagaagttgtataaataa

SEQ ID NO: 84201 - DNA, 279 bp, Glycine max
  Peptide Sequence Number=SeqID_200979
atggtttctcttggctatatggttcatccggggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgatgctacatagttggttctcatccttcagagactacgagtataataggagcatccgtcaacaaaaggatcaccctaagatga

SEQ ID NO: 84202 - DNA, 1095 bp, Glycine max
  Peptide Sequence Number=SeqID_200980
atgctgctcaatcccggccagccgtatgcgtttcagggcgagacgctgcactatcccgacattcacctggtgcactgggcaggtggcaatccgttccaccatcaccagcagctcaaccggctggtcgagggctggcagcgtccggatacggtcatcgtgcaggatatcgtctggacgcccgcggcgcagatggcggacatcgtgctgccggccaccaccacgctggagcgcaacgacattggcggctcgtcgcgtgaccgcttcgtgctggcgatgcaccaggcgattaaaccgcaacatcaggcgcgtaacgactttgatatttttgccgatctggccgatcgcctcggctaccgcgagcgctttaccgaaggacgcaacgagatgcagtggattgagcatctttaccagcagtgcgcgcaggcgcatgcgcagctggacatcgcgttcccggagttcgaggcattctggcagcgcggttttgttgagattccgcagggcggcaagccgtacgtgtttatggatgatttccgcgccgatccgcaggcgcatccgattcacaccgccagcggcaaaattgagctgttttgccagaccatcgccgattaccagctggcggatttcgccgggcatccggagtggcgcgcgccgcaggagtggcttggcgcagcgctcagcgcgcagttcccgctgcacatgatttcggtgcagcctgcggatcgcctgcacagccagctggatgctaccgccacggtgcaggccggcaaaaccgccggtcacgaaacgctgtatatgcacgttgacgatgccgccgcgcgcggtatcagcgacggcgatgagattgaagtgagcaacgcgcgtggccgtatgctggctggcgtccgcctgacggacggcctgacgcccggtgtggtgatcatcgccaccggcgcctggttcgatcccggttttggcaaagcgtggcagccgtgggaccgcgccggcaaccctaacgtgctgacgctcgacatcgggacctcgtcgttaactcagggcccgaacgccatgagctgcctggtggaaatcaaaaaacacgccagttgcacaatcggctaa

SEQ ID NO: 84203 - DNA, 580 bp, Glycine max
  Peptide Sequence Number=SeqID_200981
gtatggtgcctactaggcaccctctggacacagataagtccaacagggccctggggtttccggtgctgatcacaggcctctgccagtcctacagagttcccgtcacccccagtaaggtaatccgactgccgatcacccgagccttcatcgagaagtactgcacgcctaggcaggcgcatgctaggccactgggcgtagagcgttatctacagcatttggttcgccaacaggcagccaaccaccgtgggcaggggcagggtttcgccccttttgtatgccctacctcgaagcagtttggggctgaggttgcatggcctggagactggcccgatgcccaggtaggggaggagcctgcaggatcccccggtgaggcagatgaatcccatatggatgaagatatgattgacctgctaggtttcttggggcaaggatggacattctcaccctgggtcaaggtttatggtgagttgggattttggctcaaggctcattgtcgcaacctacccttcggcgggagggcgacgcgtgactcgcgggatgcgtgttccacgaaaggaatacgcgcggagtcgccaccaac

SEQ ID NO: 84204 - DNA, 411 bp, Glycine max
  Peptide Sequence Number=SeqID_200982
atgcattgctggttacaagctgcagatgcaagatcagtagccatctctgaggttacgaatcaggcgggacgcgcagatctctggatcaggtatcgcagtgacgaggcccaaaactcagctattcttgaattaaaggttctacgtgagaaaagctaccataaagaacatcagtctgcgaaaaaggtagcggatgcagtaaataaaaaggctgcaaatgatgcaattactcaggctgatgcttatagaactcgtttgggtacttcgcgggcattagcatgcattttcgatatgagaaagccacctggcaatccagatatcactaaagaggccgaagccacagcagttcaaaaaagtgtaacattcagactaactccggtaaataacgccgtgagtataagtcgaataagctaa

SEQ ID NO: 84205 - DNA, 274 bp, Glycine max
  Peptide Sequence Number=SeqID_200983
atgcctagatctcctgcaaatccgagtgtacgccgagcaatgtgtgaccgtttagcaaggctacttaaaacagcgtacgacgataattggtccgagcttgcggaaaagcttggttatgctaacgcttcgggaatgttatcaatcaagcgtggagttgcttttcctgatgtgcagcgtttaaatcgtattagtgaatgggaaattgagggcggatttataccatccttagactggatattgaccaataaaggcccagcagttattagatatgaag

SEQ ID NO: 84206 - DNA, 174 bp, Glycine max
  Peptide Sequence Number=SeqID_200984
atggaagccgggtcacattttatcgtttggattaagtacctctgtcaaccgttgttgcagcacggagcgcatttctccatccagcgcacgtcgttcgctgttggcaaggatgaacaaatcctccacccgttcgccgatggtactgatgcgggcgccgtgcagcgaaacgccgag

SEQ ID NO: 84207 - DNA, 366 bp, Glycine max
  Peptide Sequence Number=SeqID_200985
atgcccgagccacacaccgagaagcaagtccgaggtttcttgggacacctaaattacatagcaagctgtggcataagaaccaatctgtccaatgggacgacgactgccaagtggcatttggccgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgagatctacgaactttttagtgaaaggttcgggagttgtatttatgcacggggaagggtgtttccctttgctcctacgtattcctcaatttgggatgagaaaatcagacctacgtag

SEQ ID NO: 84208 - DNA, 357 bp, Glycine max
  Peptide Sequence Number=SeqID_200986
atggacatatcatgcctgcatttttcgtttatcatattcatgcattgcatttgcataaatcactgcattaccacacatttgcatttagcatgctcttttgttccgataactgctgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgtgatgaggaaatcagacctacgtag

SEQ ID NO: 84209 - DNA, 213 bp, Glycine max
  Peptide Sequence Number=SeqID_200987
atgagccacgagcgcttgtatcaaagatgggtgaagaatgcttttgacaagaaggccaaaaaagacaatagggggaagtgggatccaaactacgaaggacctttcatcgttaagaaagcattctcaggaggagcactagtgcttgccagcatggatgatgaagagttaccttcacccgtgaacaccgatatcgtcaaacgatattatgcttag

SEQ ID NO: 84210 - DNA, 1007 bp, Glycine max
  Peptide Sequence Number=SeqID_200988
aagaataccctcatgtgctcgaacctctcctgcgtcctgagacggatgcagtgaatgttgaggaacagggtgaaggtcaaggtattcgatccagcagtcctcatggatcgagtcagaaaagttcatctgaagaaaacttctccgatgaagaggccatacaagaggctgaagctggaggttcggacatttacccggcgtcttcaacctctaagctttccgctagcgtagggatcgcagaagaaacgttcattaaaatgcaagacgaagacccagctgcagcccttcgactcttgctgaacaccagtcaagcccacacctcaagtgaaaagattcctggtgcttcgtcctcatctgatgctgaaataaactcttcagtacgccaagattgcctgctcttgaagttatcaatggaatacgcacgggcagacgtacttaaatccattgaagagaacccctctgctgcttttgggcacctgaactttttgaagaaattgcataacccccttacctctgatgagattctaggcaaagttatccaaatcgagtccattatcaatcaatttgcaagtactgtgcagaaaaagcgcgagaatgacgccagactagatgcccagaaacaggcacatatccttctgctcgagaaagcccaaactgctcaacatgaagtcgaacgtctcaccaaagaggcgaaagaaggatcttctgagatcaaagcctgtgatgataacatctcttcctgggaggcaactattatggatttgctgtctcaggttgatgatttaaggcagaaaattgtgacagagcaggccaaacgcaaggaactccaggagaaggccgctcactcgattcagaaactgattgctgaaaaagggagggaaggcctgaaggcctttagcgcatctcaagctgtagcagatgaggcaagagttatggagggtgctgaccaggtcttaactaaagaaatggccaccttgaagaagctatatgaggatttgatcatgacttag

SEQ ID NO: 84211 - DNA, 360 bp, Glycine max
  Peptide Sequence Number=SeqID_200989
atggatttgtctgctttgcgcaaggagggtgatgttgatttaaatgcttctcctcaagcacttgatagactactgggttatgtccttgcttttaaagtcaaggttcaaccaaagttcaggaatgttgttgttcttagatactcaaatgaattagatttgatcaatgttgtgctagacatgttgcctgatattgagcaatctgtgtctgtgacagcagaacatgatccaattgtagggttctcgttagcgccaaaaaaatgtctatcatctgatgaaattgatgatgaaccaagaagctctcaaatttcaccaacccaactttcctctaacaaattagctagacattctcaaattgaatga

SEQ ID NO: 84212 - DNA, 288 bp, Glycine max
  Peptide Sequence Number=SeqID_200990
atgagtcatttgggcattccgacagagacaaaggcttttgtggtgggaaacgctgatgctaggtcatgggtatttgcgcatctactcactgttggctactcaaagatggaggagtatgttatgtatgacctggtagccactagatggaagctgttgagaggactgattatggatagcattagtagctatgtagagcttgttgaacctcagagctattccaaagggcataagtcatcatcggcttatacgacaagctttaaaattgttgcagaagggcttaggagctga

SEQ ID NO: 84213 - DNA, 412 bp, Glycine max
  Peptide Sequence Number=SeqID_200991
ggtaggttgcgataggcagcgatggggtcgagcacccacgatatgtcgagcgtcgtgcataggcatgcaggggcttcatggcagggagccaggagggggagagcgtgccaacattgaggacgagggcagcgatgcacggggtgaagtcggggagctcctcaatggcatggagcatggtggggcaggcgccagcagagaagagtgtgttggcaacgatgtccatggagatgaagttggtgatgattggatcaggggggattgggaacggagcttggagagaagcaaaggtctaattgatttgaatgcaacttctggtcgatcagtagatgaagtttttgccctactatgcaaaccaaggaaactcagatatgtcgatgagatcattgctcagatgcctgataaatctgtgtag

SEQ ID NO: 84214 - DNA, 219 bp, Glycine max
  Peptide Sequence Number=SeqID_200992
atggatgatgggtggctggccggggtttcgttttgcgagaatttgaagactctgagggttcagtcgtgtaaggtgatcgatgggagccccgggttggaggagcatttgggttgctgcgaggcgcttgagagggtgcatttgcagaaattccagatgagggatcggaacggcgtgggagcgctggattttttgaactgggatgcgtttatgtactattag

SEQ ID NO: 84215 - DNA, 213 bp, Glycine max
  Peptide Sequence Number=SeqID_200993
atggatcatggaaaaagcccaaacgtaacaggtgaaggaggtccttacacaagggtctgtgaatccaaaggctttcaagtcaaccatgatctgggcttggaaagcaaaaggggatgtagaggctcaagacgtggagaagaaattgtttactttccggattttccaaaagaaggatatagacatcatcatgaagttggcatactagaactttga

SEQ ID NO: 84216 - DNA, 372 bp, Glycine max
  Peptide Sequence Number=SeqID_200994
atggtggagctgattaaccaaaagatcactaaggaggaggtggaaacaactctttttaaaatacaccccacaaaggtgccaagactagatggaacatgttcgaacccagcaagaatgaagcatcgaactcttggggaacttgtgttacttggtggccttgttggtgcttgcgcccttagcgcaactctggctcgcttagcgtgcattagtgaattttggtttagcgctcgtcttttcactcagcggatagacttaggcagtgtgcttagcgggattagcccttgctcagcgaacatgcataactcatccttcttccagattcttcctcgtgctcagtcaaaggagtgttgcgctcagcggatggctcgctaa

SEQ ID NO: 84217 - DNA, 225 bp, Glycine max
  Peptide Sequence Number=SeqID_200995
gtggattctcccgaggatgtcatgtcggcatatgaggcagactctacgaggatagtggccctggagagatggcgatcagtggaggctcttcatcatagtagacagctcattggactagaatttgatgattgtatacatgtggctaaagccactacagtggacacctttgctctggatgacactatgtattttgcaaaactcccatattttggacagcttaaatga

SEQ ID NO: 84218 - DNA, 369 bp, Glycine max
  Peptide Sequence Number=SeqID_200996
atgcccgagcactccacgcgacaaacctcactcgaacgcttggaggaagcagtccacaagctcacccaacaccaagccactcttgctcagaacaatcagatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 84219 - DNA, 776 bp, Glycine max
  Peptide Sequence Number=SeqID_200997
atgaagaagttgcgtgtgggggctgtcgtggccgtcgccggcgtcgcggtggcgatgaccggctgcgcgagcagcggcggctccggaggttccgccgacggcgacacgatcgtggtcgacatgtgggcgggcagcgaggccgacgtcgaggcgctcgaggcgcaggtcgcgttcgcgcaggagcagaaccccgacatcaccatcaaactgcagacgtcgccgtggagcgacttcttcacgaagctcaccaccaacatggccagcggcaacatggcctgcgtgaccggcatgagcggcgcgcagctgggcggctacaccggcggcttccgcgagctcagcgccgacgacctgaagacggccggcatcgactgggcggacttcaacccgagcgccgacggcatcctcagcttcgagggcaaggtctacggcgtgcccttcgacgtcgccacgatgctcgtctactacaaccaggacatgctgacggccgccggtgcggcgacgccggagatcggctggacgttcgacgacttcgacgccatcgccgcggacgccacgaaggacggcaagtacggcttcggcatgggcatgggcggctaccagtggatgtcgatgccgatcgcctactcggcgaagcagccggcatcggaagacggtgcgctgcacatcgacgacgaggacttcgtcgacgccgcctcctggtacgcgggtctggtcaccgacaagaaggtcgccgctcccgtggcctcggcctccgacaccggctggggcgagaacca

SEQ ID NO: 84220 - DNA, 297 bp, Glycine max
  Peptide Sequence Number=SeqID_200998
gacgccggcgtcgaggagcgattgcacgcggagcccgaccgtcgacgccgcgacgccgagagcggcggccagctccgaccgcgatcgcgcctgcccgcgcgcgacgagatcgaggatgcgccgggtgtgcgggtcgtcgacggtggtgtcggcggtgttcgtcatgggggctctttcgtgtcggagcatcgtcagcgtagcgggcggcggcggtgtttccgtggcgttacgaattatcaccctccgataaacatcggatgttcggcttgcggcctcttccgaagtatgacagcgtaa

SEQ ID NO: 84221 - DNA, 333 bp, Glycine max
  Peptide Sequence Number=SeqID_200999
atggaggagttccttagccaagtggcttggccaggagtccatccttctccttcgagagggggtgaggcttccacagcccaagagcctctgctagaggagaaggacgagcccatccctcctgagccatatgtttgtgagactgatccagctagtgctcaggaggaggtagcatcaccaaagcccattcctcacccatcaccagctccagtccttgatgctccggagtcatctacaccagcaccagtgcctgaccagcctcttgctcaagaccctccagctgcatcagtgttggatctgaacgagcatgcagagtatcatttgctgaatgattga

SEQ ID NO: 84222 - DNA, 694 bp, Glycine max
  Peptide Sequence Number=SeqID_201000
atggaagccgtcgagatgcagccagcagccgggttcgtcctgcagcaaatggcggtgcgaggtggcgcgcagctgctcaaggctgtggcggctgagcgagaaggcaaagtcgccgctgatctgccagctgccgctatccagctggcgcgtgccgcagcgcaagccattctcacccggaaagactcccagccagctcacctggtgcgggacctgagccagctggcagcgcaggccgatgcgcgcgggcggcggcagaccggcggcctgttgtacatcgacgctgatagtcagttcgccatcgccactgatgccataacgcttatggctggtaaacagatgctgaccctcacccagtacgcgatgccaggtttcaatctgcacgccgtgctgcaggctgtcgacctgcatcgccagcagctctgtttgcagccgatcatagcccgcgcgtttccagcgctcgacccaggcgttagggtcgatattggcagcttcgctggtgccgatatcattatcgatcggtgcgcgaataaagcactcctccagcggtgtcagcatggtttcacgatcgttcacccaccactgcagcagcgcgccgctgcggcgacagaagtgccagcgctgcgtgggcagcaccaccgacaccagattgtgattggtttccagctggggcgcgcaggcgctgagcggcggcaac

SEQ ID NO: 84223 - DNA, 688 bp, Glycine max
  Peptide Sequence Number=SeqID_201001
atgacgggacggcacagacgaactgatacttccgcagggggagatcagcattacgatcactgggcagaatggcggctctgtgaagcggcctgggtgaaatcttgccccggtatgcatagtagctgcgtgatagcctccctctctggttgtgcttacacagttggtcgccctccaatattaggggatgtggagcacactgaaatgaggacacgtagccctctaaaggtgagggcgtgcaaccctctcaaggcgaggatgtatagtcctctggaggtgaaggcgtgtagtcctctcaaggtgagggcgtgcagccctctgttggcgaggacgtgtagtcctctaaaggtgaaggcgtgtagccctctgttggcgaggacgtgtagtcctctaaaggtgagggcgtgtagccctacgaaggtgaggacatgcagtcctctgatggcgagggcgtgtagccctctgaatgtgaggacgtgtggtcctctaaaggtgagggcgtgtagccctacgaaggtgagggcgtgtagccctctcaaggcgaggacatgtagtcctctagaggtgagggcgtgcagccctctgatggtgaggacgtgtagtcctctccaggcgaggacgtgtagtcctctcaacggtgagggtgagggcgtgcagccctctgatggcgaggacatgaagtcctctgaag

SEQ ID NO: 84224 - DNA, 318 bp, Glycine max
  Peptide Sequence Number=SeqID_201002
atgcagggcctgaatgccgggaagcagatcggaaggagagaagggctttctaggagggaagagcggcgagggcgcttggagggaggggagccgaggttcgcggcggagtcgggttctagaaggttcaggaaggattggagtgaggcggagatagagtcggagagaatgggagggagagaagaacagagaggggaagagggcttaatggaatggactagggttttcagagaagcttttgaagatttgaggattttctttgtggctgaggattgcagagatgaacgaagcctcttctccaccgcgctttatccactgtaa

SEQ ID NO: 84225 - DNA, 1749 bp, Glycine max
  Peptide Sequence Number=SeqID_201003
atggtggaaggagaatttggcgggaagagagtccttaatttctcagagtcacccattcctgctgtcaaggtcgctcaccctgaagaagaaggtggacgtgcacagggtctgcgtgcttcgcgaggcgttcgctctgttcgatttcgacgacgagagcatcgaggatttgaagctgttacggagcatgggaggcggtttctggcgtttgtgtttgggctgagcgatcagcttgggaaggaatttctggcgatgattcggtcgcagatttcgttcgggaggaagtcgatgctggaggcttatggggatattctgtttcgggtgtggagagctactcaagtggattcgaggactgggattgagaatgggttcttgcaggaattgattgaggctgccatacacgctggttccggagtttttgcttggtatattaggagggtttttggaacttttattaaccagaggaccaccgatggggttgagaaaatgctttatcgactcgctgagcctgtcatatttagctctctacaggtaaatgccatcatagatgaaacactcccacccccgttgaatttgaatgttggttttacatgtaggttttcacaacccaggaaaataccacagcctctagcctgtgtagtgcatgttttggaaatgcatgagaaagcaatgaatcatgttgcaaactcaaatgttcgtcaaaatgctttgcatctacttctggacatgttcccccttgaagatcctgatgccacaaaagaggagaaagatacattgcttgataagcagttctttttattagaaaggctacttacagatgattgtctggaagtgagaataattgctgttgagggttcttgtcgcatccttcatctgttttgggaagttattccttcaccaatcataacaaaggtgatgacaaaaatatttgatgatatgtctcatgatggatgcaatgaggttaggctttctacgttgaatggcatcatttatttacttggcaacccctgctctcacgaaattcttaaggtgctgttgccaagactgcagcacctaatgcttgacaaggtggcggaactagatgtgctattgtctgcacttgctagtgatcaacctcctgtagctcagaagataacaaaattacttataccttcgtactttccctcaaaaatacccattgaggaggcatgtaatcgctgcattacacttttgaaaagggctccaatggctggcgcaagattttgccaggttgctatcttggaaggagcatttaaatctcatcttatggaactggtcaaagtatttctgagttggattttggcacccgataagctagatgcaaatcagattgagggtttcctttttgctactagctatgtttgtgatagcttggcttgtgagccatgctatataaatgctctcaaagagttacttgatggagagaaaatgaaaggtttactaactgtggcatctaaaggccaagcccaatcttctttattcaacattgtctccattgtctgtccagatgatgttgctggacttcttgaatggataggtgttgttacaaactgcagcggtttacctgaggatgttgatcaacaaactaaaatcaggtctgcgcacaagttgttgctttcactgggcggttttgatgacttgattgaagccttaacagccttcttgcataaggctgcctatcgttgccacattaaatttggtgcagacatgccatctcagtgtttcatttgctaa

SEQ ID NO: 84226 - DNA, 1210 bp, Glycine max
  Peptide Sequence Number=SeqID_201004
atgctggcggaaggactcagcagcggctcgctggatatcggctggatgcgacaaaactacgccctgcgatccaatgactatgccgcctcgcccatgctcgacgcagggtggcgctacggggtgaataaccagctgacgctggcgctgcacacggagcagcagagtaaactgcgcaatgtcgggacaggggtcgactggctgatctcgcccgggacagggattatcagccagcatgtcgccatcagcgacagcccctacggtcagggaaaacagtggggccttggctggcaatggaacggtcgcgggacggggatctctgccagtaccgttcgtaccgatgccacatttgccgataacgcccgcatgagcggtaccctccccgtcagacgcagcgatagcgtttgggtcagccagtcgataccccattcaggtaccttcggtgcgggctgggtacagcaaaacattcagggcaccaaacaacgctatctcaacgcctcctggtccgcctcgctgccggcacacatttccaccacgctgagctacacccgctcgtttacggatgcatcgagccacgttcagctgatgctctcgatcccgttagggcgtgaggataccctctccgttcaggccagccgcgatatgccgcgcatggattatcgccatcagccggacgatcaggtcggcggctggtcatggcagctggggcgaggctttggcgagcaccgggaaacctatgcggacgtgggctatctgggccacgcaggtgagtggcacgtcgggatggcgcagggcgctaactatgcctcagccgagggtagcctgacgctgctggatggcagcctgcacacgctgcgctacagccaacaaagcctggccctggtctccacgcacggtgtcggacatgtgccggtgatgctggaaaaccgcccggcaggcgaaaccgacgagaaagggtatctgctgctgaccgacctgccgcgttaccacgccagtaaagtcagcatcaatccgctggatctgcctgccgacgtgattgcccccgtcaccgacatgcaggccagaccgggcaacggcggcgcggtaaaagtcgattttaacgtccatcacgccgtcacagttcaggcccgactggtggacagccaccacaatccgctcccgctcggcagcattgtctcaacgccacgcggtgccaccattgtggggcgtgacg

SEQ ID NO: 84227 - DNA, 198 bp, Glycine max
  Peptide Sequence Number=SeqID_201005
atggaaaatggtactcctggaaaacaatatacaatcaaacatgacgcaaatggaaatacacaagtttctgatctcaaagtagtggatgttcatagtgctaaagaggttgcatttcttttaaatcaacctgcaaatagcaggtgtaacaaactattgcatcttttagctatatatgaaggtgatgctatgctgtcctaa

SEQ ID NO: 84228 - DNA, 135 bp, Glycine max
  Peptide Sequence Number=SeqID_201006
atggctggtacattattacttttgaaacaacaaaatagtttagaggttatgagcgggatgccacagaatccacttactcgcgctaagcgcgagggtggcgctaagtgcaacgtcgcgaattcagatcctatttaa

SEQ ID NO: 84229 - DNA, 113 bp, Glycine max
  Peptide Sequence Number=SeqID_201007
atgaacgtcatgctaccacgaccctcacgtcgtgaccgtcttagaatgaacgttattcctaagacggtcttcatgtggagagatcgtcttagaatgaacgacattcaaacacg

SEQ ID NO: 84230 - DNA, 1287 bp, Glycine max
  Peptide Sequence Number=SeqID_201008
atgacttccttgactcacctcgacctctctcttactggattctatgggaagattcctcctcagattgggaatctctccaatttggtctatcttgacctcggaaattatttttccgaacctctgtttgctgaaaatgtagaatgggtatcaagtatgtggaagcttgaatatctttatttgagttatgcaaacctatccaaagcatttcattggctacacactctccaatctcttccttctttgacccacctatctttgtcaggatgcacactccctcactataatgaaccatccttgctcaacttctcatctctgcaaactctccatctttccttcactagttattcccctgccatttcttttgtccccaagtggatattcaaattgaagaaacttgtttctcttcaattatggagtaataaattccaaggttcgattccttgtggtatccgaaacctcacacttcttcaaaatcttgacttgtctggaaattcattctcatcttctatacctgattgcttatacggtcttcatcgtctcaagtctttggaaattcattccagcaacttgcatgggactatttctgatgccctgggaaatttgacttctcttgttgaacttgatttgtcatacaatcaacttgaaggaaccattccaacttctttgggaaatttgacttctcttgttgcactttatttgaaatataatcaacttgaaggaacaattccgacttttttgggaaatctccgcaactcaagggagatagatttaacaattctcaatctctctattaataaattcagtggaaatccatttgaaagtcttggatcactctctaaattgtcatctctttggattgatggcaataattttcaaggagttgtcaaggaagatgatcttgcaaatcttacaagcttgacggattttggtgcatcgggaaacaatttcactttaaaagtgggtcccaattggattcctaattttcaacttacctatttggaagtgacatcatggcagttaggtcccagctttccattgtggattcagtcacaaaaccaacttcaatatgttggactatctaacacggggattttagattctattcccacttggttctgggaagcacattctcaggttttgtatttaaacctctctcataatcatatccatggtgagcttgtgactacaataaaaaatccaatatctatccaaactgttgatctaagcacaaatcacttatgtggacaagccaatgcaattagaatttctcaatcttgcatcaaataa

SEQ ID NO: 84231 - DNA, 225 bp, Glycine max
  Peptide Sequence Number=SeqID_201009
atggttcaagttgaagaagtggggggacattgtcatgaaattggtggagtggcctatgggatatggatcaacttgaagaagtcagagaccttaatatggctggactttgtggagtgtcctaagaagttgaagaagtcagagaccttaatatgggtggactttgtggagtgtcctaaggttcaagatgaaaaaatggaggaccttcacatggacttgatggagtag

SEQ ID NO: 84232 - DNA, 1004 bp, Glycine max
  misc_feature (8)..(8): n is a, c, g, or t
  Peptide Sequence Number=SeqID_201010
tgtcatanatttgagttctaatttgttcaaggttagattgccaagtgtgtctgcaaatgttgaagtgctgaatgttgccaataactcaatttccggaacaatttctccctttttatgtggaaagccaaatgctactaataagttaagtgtgcttgatttttcaaataatgtcttgtctggtgatcttggtcactgttgggtgcattggcaagctttggtgcatgtgaacttgggcagtaacaatatgtctggtgaaattccaaactccttggggtatctgtctcaacttgagtctttgctgttagacgacaaccgcttctcaggatatattccttcgacactgcaaaattgctctacaatgaaattcatagacatggtaaataaccaactttctgacacaataccagattggatgtgggaaatgcaatatctaatggttcttcgtctaagatccaacaatttcaatggcagcattactcaaaagatgtgtcaactttcttcccttatagtgctggatcatggcaataacagcctgtcaggatccattccaaattgtttggatgacatgaaaacaatggctggtgaagatgacttctttgcaaacccttcaagttattcatatggctctgacttcagttataaccactacaaggaaactcttgtcttagttcccaaaggagatgagttagagtacagagacaatctgatattggtgagaatgattgatctttcaagtaataagctgtctggagcaattccatctgaaatttcaagttatctgctttgcggtcaaatccctcaaagcttatctgatttgtccttcctcagtttcctgaatctatcataccacaacttatcaggcagaattcccacgagcacccaacttcagagctttgaagaacttagctacactggaaatcctgagctttgtggtcctcctgtaacaaaaaattgcacaagcaaggaatggttgagggagagtgcttctgttggacacggtgatg

SEQ ID NO: 84233 - DNA, 405 bp, Glycine max
  Peptide Sequence Number=SeqID_201011
atggcatattttgttgggagggttgaaagaagacactacgaggataccatggctgaacagagagccttatgcttactggaaaggattggtttcgagaatcacaagaggggttcaacaaatcagacttgccaagtcaatgcacttatagatataaggtgtacattgaaggttctgcttggtcagtcagtcaaaaatacattctgtcatgtgactctaccactctacgtgtacgactacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaatggtaatatatag

SEQ ID NO: 84234 - DNA, 396 bp, Glycine max
  Peptide Sequence Number=SeqID_201012
atggtgaagaaggaggtgatgaagctactagttgcagggatcatttgtcctattcaagatagcgctagggtttcacttgtccaagtggtccctaagaagtcagacatcactgtttggccaacagctggtaagattgcattgactataggatacttaatcatgcaactcgcaaggaccatttccctctcctattcactgagcaggttctggagaggttggcagttacatgtagattcatattgcaccggaggaccaacgttattactttctgatgagcatttcatgcacttgcatttattacatgttacaccttggtttgctgacattgtgaatttcattgttgcatctattgtcccacctcatgcatctaggtctcaaatagacagacaaacttaa

SEQ ID NO: 84235 - DNA, 366 bp, Glycine max
  Peptide Sequence Number=SeqID_201013
atgacgaatgaagaacgatgtagaagtcgattacggtcgcaattcggtagcgcctcaacctcatttttctcttctttcttcttcctctctctgatttctctcaatttctctcaatgttggaccttggaaccctttacttggcctccctcacacttatttatagaaaaatatggaattaggggtcatggcagctcgcctggcagcagacacaacaagaacagccattctgacagcaacaattccagccctccaccaaaacattccaagctctcccattcagacaacaacaacaattctagcaatctacacttacacttgaataatcggtgcacaacaaaaattctagaccttccttggaggagctaa

SEQ ID NO: 84236 - DNA, 456 bp, Glycine max
  Peptide Sequence Number=SeqID_201014
atggtcatattattcaatgttgaagatcctctccacaacaatgagcctctcgcaaagagaactcaaggcattctagtttcaatagcttgttggaacatttggaaggctcgtgattctgatgttttccaagatcgtcccatcaacacaacttcagtggtcatcaagaactatgcaacaactatctctatgcgtcatacaaggaaggttgcctggtcgcgccctcctatgggaaatgccaaaatcaacccagatgatgggaatttgatccatggcttcccatgctcttgtagtttctcctctagcacttgtgctaagcttcatgctagtgctctatttgattgtgcaaggggtttagcaatgacattcatatgcccctctaattgcaaaaattcaaagcttcaaatcatatgcatggagcttgactctcatactcatcaacaagtcaacacagtgtga

SEQ ID NO: 84237 - DNA, 135 bp, Glycine max
  Peptide Sequence Number=SeqID_201015
atgaactcgctaagtgagcatgctgcggcgttctcagaggaacttgctaagtgtgcctaccgtgctaagcgagttcaacttttgaggatgaacattcatcctcttgctgagatgcctgtggctaagcgaggctga

SEQ ID NO: 84238 - DNA, 1701 bp, Glycine max
  Peptide Sequence Number=SeqID_201016
atggagaagagccttgggaaatccatactcacggaggaagagggcgaagatggggacgaaggtccggcggagtcaggcggagacgggtcggggaagaagacagcgagttctgcttcgcgaaagatgccgagcgacgtgatttctgagtttcgacaatcggcgaagaaggtggagctacctatgtttgatggagaggatccggctggatggatctctcgagcagaagtgtactttcgggtgcaggacactactccggccgtgaaggtagatctggcccagttgtgtatggaggggccaactatacatttcttcaattccttactcaatgaggaagaagaactgacctgggagcgattgaagggagcgttggtggagagatatggaggccatggtgaaggagatgtgtatgaacagctgacagccctccggcaagtggggacggtggatgagtatatcaccgagtttgagtatctcacagctcaaattcctccattaccggacaaacaattttccggttactttttacacgggttgaaggcggatattaaagggaaagtgaggagtttatcggcggtgggaaatttgagtcgagggaaattgctacaggtgacaagggtggtggaacgagaggttaggggtgatgctagaacgggtattagtaaacaccccaaatcgggtcatgggtcacccaaacccgggtttggtgggtccagtaagggaggtggagctgactgggtgatggtcaaagggaaggagaatgggcctagtggaggtagtaagggaggtggttttgggcccagaagtgaaaaaggaagaaacggcccacttgatagaggtttctctcatttatcttacaatgagttgcttgagaggaaacaaaaggggctgtgtttcaaatgtgggggtccttttcacccaaaacatcaatgccctgataaacacttgagggttttgataacagaggaggaggaaacggaggaaggaggaggaaaactattggcagtagaagtggaagatgaagaaggggggtctgaaggagagatgagcatattgagcttactccaattgggccagttgggcactgataagcctcagtctatccagttgaaaggtgcagtgaatggggtgccagtagtaattttggtggacagtggggctacccacaactttattgataaaagattggtgcaaaaaatgagctgggctgtggacaattcaacttctatgtgtatcaagttgggagatgggactaaggcccaatccataggggtctgtccagacttgggcgttgaggtaggagaggtgcagttagcaatacgagcccatttgtttgatttgggtggtgtagatattgttttgggggtggattggttgagaaccttgggagatattattatgaattggaacaagcacaccatgagtttttggcataacaaaaaatgggtgactcttcaagggttgaatgataacatggaaaccttgaatagtattgtgggaggcaccaacagaggaggaaaagggtggatgtggagtatagagaagaagaggggtgatgagaatgatctcaatattgggcaacaaaaggagttggaggggttgttgtctaaatatgagcacattttcaaagagcctagggggttaccaccaaggagaaagaaagagcacgctatcaatttgaaaggagggctggaggctgtcaac

SEQ ID NO: 84239 - DNA, 1302 bp, Glycine max
  Peptide Sequence Number=SeqID_201017
atgattgcaaaggagattcttcagaagaattggaatgacaaagacatgatagggtggtcgttctccagaagaattggtcaattgtgtatattccagcaagttgagatgagtggaggcacacataaccaaaacaatgaaacaggtgatgtaaaagatcatacgaacggaggtagcaatggtgatgatgctttgactataaatcagttgctatccagactaacaagggcagaagacaacattgataaaaaattacagtggctggagttccagggcaataagcgcaagagacaagatgacgattggttggataaactaaaggacctgaaaaaaagagctattgatgtgaaaaactcactgcatcagtctgggtcgactaatgaattccccgagccttatgaattgggtgatgagtttgatgaattattgctaatgaagccttggatgttgctagatgagcgagatgaaaatatggagaagatgtgggatcttctggagcatgaggaagttttgattattggcatagatggaatggggggagttggaaaaacattcatggcaactcatttcaagaatgagattaaaagaaaggggactttcaaggatgtcttctgggtcactgttttcgatgatttcaccactttcaaattgcaacatgacattgcagcaacaatacaggttaagctttacggagatgagatgactagagcaacaattttgacgttagagttggagaaaagaggaaaaacactgcttattttggatgatgtttgggaatatattgatctgcaaaaggtggggattcctcttaaagtgaatggcattaaattgattatcacaactcgtttgaaacatgtgtgtctacagatggattgcctaccaaataatataataagaatgcaccctctctctggtgaagaagcttgggagttatttttgctaaaacttggacaccgtggaacacctgcaagacttccccctcatgtactagagattgcaagatctgttgtaatgaaatgtgatggtttacaacttggaatcagtgtgatggctcgaaccatgaaagggaaaaatgagatctattggtggagacatgcattgaatatacttgacagattggagatgggagaagaggtcttaagcgtactaaaacgtagctatgacaatttaattgaaaaggacattcaaaaatgtttcttacgatctgcactgtttcctaatgagactaggaaagaggaatgggttatgatggttgttgagagtggtggcacagtgagtttgtttgtgatattccagcaagcatag

SEQ ID NO: 84240 - DNA, 351 bp, Glycine max
  Peptide Sequence Number=SeqID_201018
atggttcagtcatggagtagacaacataagagttggtcaggaaaaagacagatcaggaagctgagtccaaagaaggtcaacttggttgctgctctggttcgtggtatgcttgttaaagatgcatcgatgcagttggaatcgacaataaaacgagcagcaaaaactgtatatcaggttaaagagttccatagaagagatggttttgaggtagcaagtgctgacaagatggctaagtcatgcatgatgacaagggacctgaaagaggaatgccgagcttcaattctgagttacccaattccaattcatgggttgaggatgttacaagagtttgggatccttgttgaccagtga

SEQ ID NO: 84241 - DNA, 318 bp, Glycine max
  Peptide Sequence Number=SeqID_201019
atggcaattgatcgcatgggcttaacgattgacacaatacaagacctttcagatgggggtccatgtgtgaacaacattgttgaagaatgtgctaaagaatgcctgcaagaagtggtgaatgacatgaagttggtctctagattttggggagatgccatcagtgatgaatcagaaggtgaagatctagcagcggaaaaggaaccgccttattatatccccgtggtgtctaaatccagcaaaaataaaaattccaaaagctctaagatatctaagaaaaagccatcttcaagggctagtagcctctcacctgtcttatga

SEQ ID NO: 84242 - DNA, 630 bp, Glycine max
  Peptide Sequence Number=SeqID_201020
atgtataataggaagagcagtggtttctctagaagggcctctatatacagaggagtaacgaggtatttgtctagcacccaagaagaagctgctgagacctatgacattgctgctatcaaattcaggggattaaatgcacaacaaccttcaagctccaacttaagctttgccatacccattaagcaagacccttcagattactggtccatcttggggtaccataatactccccttgacaacagtggcatcaggaacactactagtactgttactacaactacttttccatcctccaacaatggcactgctagtagtttgacacccttcaacatggagttctcaagtgccccctcaagtaccggcagcgataacaatgccgcgtttttcagtggaggaggcatctttgttcagcaacaaactagtcatggtcatggaaatggaagcagtggttcctcctcttcttctttaagctgttcaatcccatttgccacgcccatattttctctaaatagcaatactagttatgagagcagtgctggttatggaaactggattggacctaccctgcacacattccaatcccatgcaaaaccaagtctctttcaaacgccaatatttggaatggaatga

SEQ ID NO: 84243 - DNA, 594 bp, Glycine max
  Peptide Sequence Number=SeqID_201021
atggtcatgagcagcatcacatttcctccaaacagtgacgactacattggcactgagagctgcacggacctccaaaacatagaccatgtcattgataaccaccagtcctttaaatccaacgatgcaggaaacaaaaccaaggtcaagaacaacatcaaaatgaaagagaacaaagtgttccctccccctatacccttactagctcgaactcagaacctggcctcacacatgccatgggtgttgaagaggtactacacaaacgagggaaggttgattttgaaagaggaaaaggtgaagcaccatgagtactttcgtgcacatagtgccaatggcagactcacattgcagcttgttaacgttccctttgatgaccatgatgagtactttgaagaagcaacacctagtttgatgaagatgaagagaatgaggctaggcattgttgctgatgagctttctacggaacagggtagtgatgttgttgtagctggtagtggtagagtgaagaagtgtttgaacagtagtaatgtaagatcaggtccagcgtgtaacatttttggggtgcctgggcatcctattagaacggttcgtggttga

SEQ ID NO: 84244 - DNA, 513 bp, Glycine max
  Peptide Sequence Number=SeqID_201022
atggaattctgtgatgattctgaggcaactttcagaagagccttcaatttgctgcaggatggatgtgtttatgctactggtcttaatgattttggacagcttcgtgtatcagaaaggaaaggtggtggagttagacagggaactgcaagtgaagctgtactagttgtcttattagctgcccgtgacaagatcttaaggagggttggaaggaatgcccttcctaagcttgtgatgtatgcatatgatcaaacacactctgctttactaaaagcttggcaggttggtaccacttcatcaacagctgttgatcctctgcttgcattgggaaaaattgccaaggcgaccgatgtagaatgtttcagcattctaagacggtcttctgcaatcgtcgtagaaaatctttcattttttacgacacctccaacaacgacggttgtaaaccgatgtagaaagacttatttaaccgatgtagaaagcctactttgtagtagtgattggtctgcaattctgtag

SEQ ID NO: 84245 - DNA, 636 bp, Glycine max
  Peptide Sequence Number=SeqID_201023
atggaggacgagtttgagagactcttgatagtggtggaggaggaggagggtttcaccttcaatctagaagaagccaatgaggcgacaacagacatctccttttgtctcgctggacacttcctgacagataaatcgatcaatggacatataatgaaggaggatggtggatgcttggagcgcatagtagaaagtgcgtcatggtcgtttgacaaccacatgctagtgctgggaagattaagcacaggggacatgttgacacagattcctctgttcaatattccattgtgggtacaattgcatgatgtgccaacaggttttgtcacgccaatggttgggaaacacatggagaatttcattagggagttcttagaatatgactctaagaacaacactggaggttcgagaccgtttatgagaattaaggtgctagttggattgaggaatccactcaaaactgggaagaagcttatcaaacctaaaggagagtggcagatgattgaatctaattgcgagagacttgttgaggtttcagttcagctaacacagcaattagccgaatctgaaactgatttgttaatggctggtttcattatcatcaattttaagtacatctatggtattgtcagcaatagttaa

SEQ ID NO: 84246 - DNA, 351 bp, Glycine max
  Peptide Sequence Number=SeqID_201024
atgccttcttctcttcggttcaccactttcagctccaaagaaaccctagaaaacacgttccgtcgccgaaacctcagaattcctgggattctccctagcggagagggatcgatggtgccaatgtgggggaaaaatggacggcgccgaaactgcggccaaggaatccgagtaggatgcgaaaaacctaaccgtttggagagaagttggggtcgttggaactgcggcgaagggaattcgaagaacgataaggcgttggtcgaaagggaggtgtctctctcgaaacctgttgggaagaggaaatttttttttttacaaaagaatgcattgagaagagaaagaggtgaagaatag

SEQ ID NO: 84247 - DNA, 225 bp, Glycine max
  Peptide Sequence Number=SeqID_201025
atggataatgttttgcagacactcaagctagtagtctacatcttaaggctatggatgcaggaagaagaacatgtagatggatcatgtaggggatcaagaagtcagaatactgaagatgtttataccaaaattaatgcatatgaacaacaactgatgactgtgaatgagaagttaagactttcagaagaagaaattactaaactgacgattgagcttgaaaaataa

SEQ ID NO: 84248 - DNA, 246 bp, Glycine max
  Peptide Sequence Number=SeqID_201026
atgaaggtgatccatgtgttccaactccctgggaatggatttgagagctcaaatgcaactaaggcaacaaagacaatgctcacatctaagaatgcattagatgagaatagcctcgcaaacccaacaaagatttctggctatgttactgttaacaaggttgctggtagagctctcctttactggctcactgaagttaccctaaatcctctcaccaaacctttggtcatttggctcaatggaggttag

SEQ ID NO: 84249 - DNA, 519 bp, Glycine max
  Peptide Sequence Number=SeqID_201027
atgcccgggttccggtttaaccggttggcctggctggtccagtctgagttttataacactgcacacaagatccctttggtcttgaatcacagacagtacactgcccacttaccttgtactgaaattcaacattttattaaaagaacgaagacagcacgtttgaactctattcatgttacattaggtctttacgcctttatcttattctgcaatgactctttggatcatgccaatgaattatcaaactccctgaaagaaagtgccaatattaacactgtttgggcatcgcttattgttgaagaatgcacaagacttggtttgatgtatttgtgtattgctcctggatctagaccttcccctgttgctgttgctgttgcaagtcacaaattaatcacatgtatttcatgcttcgatgagcgttcacttgcatatgatgctgttggatatggaagaggatctcacattccagcagtagccattacatcatcaggcactgcagtttccaaccttcttcctgct

SEQ ID NO: 84250 - DNA, 153 bp, Glycine max
  Peptide Sequence Number=SeqID_201028
atggaagatgtgcaactcatgttctcgatgcatataaggagaatggtaaaacaaactatctgcaattactttaggaggccatgttctataatattcttcaaggaggaatggatgaatgagttggtgtttagagatggaaggttttcctgttag

SEQ ID NO: 84251 - DNA, 366 bp, Glycine max
  Peptide Sequence Number=SeqID_201029
atggctttgattttcacttttcctcatcggagactcaacaattttccgatctgcactctattgattgtagcatttctcttatcaccaccaaaagtcctaacttttccgatatgcactctattgaacgtgcaaatcattcgatcttcatctgactatttaaagaagtttaagtttgagagtcaggtgcagccaagattgaaagtgacaccaaactctttatttaacttggatcatggagttgccgacgatgatatcaaggttattcattatgaccagattgggagatcaaagggaacaacagaagttgtgttcgtgaggcactatgatgctttagcagccatcaagaaatacaacaatgaggtttaa

SEQ ID NO: 84252 - DNA, 333 bp, Glycine max
  Peptide Sequence Number=SeqID_201030
atgcagtttatgcaagtatttgatggtggctctggtagagcatctatttcaacttggagaacaaaaaaaggaactgtccagaatcaacataaagtgaggcctttggagcttctgattccaagaaagtcgccagtcccattggcgatttcgtcatgcattaggagtagtcagtcaaactggcaagttccaagcacagctaggtgcagctggggcgtagggggaggtcaaggatgtagtgcaacaggcggagcaggtgcaggaaggactcgccagtcctattggcggtttgcggagagagaggactcgccagtccaactaacgagttgcttttaa

SEQ ID NO: 84253 - DNA, 243 bp, Glycine max
  Peptide Sequence Number=SeqID_201031
atggaatcgagagctccaagtgggccatttttgggaatcgggttaaaattcctgaaccgggacgtggcggctgacggcaacgttagggagtccggagacgtcggcgggggccccggaaaagagttatcttttctgtttaacagcctgcccaccctggaaacggctcagccggaggtagggtccagcgggctggaagagcaccgcacgtcgcgtggtgtccggtgcgcccccggcggcccttga

SEQ ID NO: 84254 - DNA, 225 bp, Glycine max
  Peptide Sequence Number=SeqID_201032
aaaataacgattttatcgaaagagcaagagagaatcactgagcctgtgtcacatggtccagcatcagagcatcaatttccagcacaagagtttcacattctccagtcatgtgttgaaactcaaggcatagacaggcaaagggtggctgttgaagcggaagaatattcccaacaaatggtggagcgtggccatggaatgtattacacaccaccaacattttattag

SEQ ID NO: 84255 - DNA, 519 bp, Glycine max
  Peptide Sequence Number=SeqID_201033
atggaactactctttttaagagttggacttagggaggaggaaagaacaagcatagctaggttccttagtgggcttaatatggaagtgagggacaaggttgaactccttccatatagggacctagatgagctagtccaactttgtataagagtggagcaacaacttaaaagaaagccttcttcaaaatcttatggctttcactcttatccaaagaaggacaaagcccaaggaattttaggggctgcaccttcaaaacccaaggaagataagggtaagaccatagagaaatccgctcctaagactagtttccaagaaaggactagcaacattaaatgcttcaaatgtcttaggagaggtcacattgcctctcaatgccccataaatggttcaaatgtggccaaagatcaactaactatgaaagataagagggatgatgaagaaaaactagaagaacaaaagaaaaagaagactagtaaggccttgtcttcaaaggccaaggggaaggacaaagaggactag

SEQ ID NO: 84256 - DNA, 318 bp, Glycine max
  Peptide Sequence Number=SeqID_201034
atgaatcagctgctctatagaagattgaaactctggggacagaagcttatcggcctgacaaacccaaaaagcaatcagaagcctcatattgataaagggcaatccaaccagacaaggagccatgcaaaacaagaacagaagcagcagcacatagaaagaaggccagcaacaccacaacaggacctcacaatcaggctagacagacaatgggatctctttgatctagagatgccaaaagaagacaggttccagcaatacaagtgttatcaatggcatatcacgcaaaatgacaaaccaataacccagtatatcatataa

SEQ ID NO: 84257 - DNA, 648 bp, Glycine max
  Peptide Sequence Number=SeqID_201035
gattacagtagagggtacatctacttgggttgttatactgagaacaagagagggtacatctcttgtggatcaattcaagtggaaggtacatccacttggttgttcaaagagaacaagggagggtacatcccttgtggatctttggcttgtaaaggattttacaaggttgaaataaatctcaagaatcgttggttgcttgggaactggatgccacttgatccaacaaagatttcagtaagagggatagaggtggataaggcaaagattgatgtaattgagaaactacctcctcccacgaatgtcaaggggataagaagtttcctaggacatgcggggttctacaggcgattcattaaagatttctccaaagtagccaaaccgctaagcaatttgttgaataaagatgttacttttgtgtttgatgaagaatgtatgaaagcatttaatgatctgaaaacaaaattagtgtctgcaccaatgattatagcaccggattgggggcaagaatttgagctgatgtgcgatgcaagtgactatcttgtaggtgttgtgcttggacaaaggaaaggaaaaaatttacataccatctactatgccagcaaggttctaaatgacgcacaaatgaactatgctaccacagaaaaataa

SEQ ID NO: 84258 - DNA, 225 bp, Glycine max
  Peptide Sequence Number=SeqID_201036
atgttagaagaggaagaggataaatgggtatggaaggaagacaaaaacggcatatattctatcaaattggcttatcaggttattaaggccaacataggaggagccaaagatgtgttattctttgagaagatgtgggaaatgaaacaaggcttgttattccctctcaagttggatgctaaacccaaggggctgagaagcattggagttgcaagctgggaaacgtga

SEQ ID NO: 84259 - DNA, 315 bp, Glycine max
  Peptide Sequence Number=SeqID_201037
atgaacacctacatcaatcatcattccgaaaaacagaatttcgaggagcgaacctgcagatctgacggcacggagtggaggtccttaaagtggctggagctgcagcaagagcgatcggagcaaaaatcgccggaaacaaccgtgccggtagaactgacggaagcttccggcgagacggtagtgtcgggaaactgcgtatcggaagagcgtaactggaaggaagcggtggtttttcttttcttggaaatggaatgttggcttgaagaaggttgttctatggcggcaattgtgagagagcagcgaatacacacctga

SEQ ID NO: 84260 - DNA, 901 bp, Glycine max
  Peptide Sequence Number=SeqID_201038
atggtccggtgcatgctttgtgacaaacaagtacctaaggctttttggccagaagctgcaaaatggacagttcatgttctcaacaggagtcccacattgacagtgaaagataaaactccagaagagatgtggagtggaatcaaacctaaagtagattactttaaagtatttgggtgcctaactcatgtccatgtacctgatcagaaaagaacaaagctggatgacaagagcctgcagtgtgtattgcttggggtaagtgatgaatctaaagcttatagattgttcgatccagttgcaagaaaaattatagtcagcagagatgtgagttttgaagaggataagggctggaattgggggaggactgcagaagaagtgaagcatgacgtgttgatttgggaaggtagtaatgatagtgaggatgcctcctctgaaaatgaagaagaagctgttgtggaaggtgctaagaagattggagtgaaatgggtttttagaaccaagttaaatgagaatggtgaagttgataagctcaaagcccgactagtagctaaaggctatgctcagcaacaagggattgactacaacgaagtgtttgccccggtagcaaggtgggacacaatccggatggttttagctctagcagcacaaaagggatggaatgtgtatcaactagatgtcaaaagcgcatttcttcacggagaattgacagaggacgtgtatgtggaacaaccaccgggttatgttcgaaagggtgaagaagagaaggtctacaagcttaagaaagctttatatgggttaaagcaagcaccacgtgcttggtatagcaaaattgaagcctattttgtgaaggagggatttgaacgatgcgatcatgagcacactctctttgtcaaaacaggaggag

SEQ ID NO: 84261 - DNA, 531 bp, Glycine max
  Peptide Sequence Number=SeqID_201039
atggacaccatactatccccactcaggcagcacaaaacaagatgctatttggcagatggactcgaaaacttcataagagaattagaaatatacgagtcgaccatcatcaacttctttgcatgcaatcatctctacgagtttgacatacacttcacccctccattacaccgacaaacatgtagcagaccaagacatctgtgcagaaagcatatctggagtgttaaaattactcaggccatggtccctgttcttgaacccctgaaacttccaccatctgcagaaatacctcttaatgcttgtggccatcacatgacagtattaagacaatttggccctccattgcaatggcctgttgaaactctcaaccctggcattgctgctaaagccattgctcaaccatggtatgattttcttgtagaaactgactttgatcatggagatgaagtctccttttattatagaccttttgacaaagtctgggaaattgtaattagaagacaaaaggattgggatgatagtgacactcattaa

SEQ ID NO: 84262 - DNA, 117 bp, Glycine max
  Peptide Sequence Number=SeqID_201040
atgtcggctgaaagtagcaactttgtgcagccagcaatacccaagtttgatggtcattatgaccattgggctatgctcatggagaattttcttcggtcaaaagagtattggcatttg

SEQ ID NO: 84263 - DNA, 309 bp, Glycine max
  Peptide Sequence Number=SeqID_201041
atgacgaaatgcagttcagaggaaacaataggagaaggttggagaaggaggcatatggagcagccaaagcttgaagcgggttgtggctggttgtgtttgaattggaagagaagagaagaaaatagaagaagaaagaaaggaagagtcacgggagaaatagagagagaaatggaattaggcatagtagaagaaagaaaggaagaggcacgagagaaatggacagctgtagagtcacgtggggacacgtgtcaccacctggagcatgggcacaatagacatttccatatacatctcatttataagacttag

SEQ ID NO: 84264 - DNA, 540 bp, Glycine max
  Peptide Sequence Number=SeqID_201042
atgaaagcaccaagttgctatgaccctgaggtcaaggctagaattcgaggatctagcgcctccaagaagaaaagaatttggcatatgtgccttggaggaatttgtaaattgctatggtgggtggcaattgaaatttcatcattctcaaaatttgctggttttactggggttcggcttgggtggacagttgtccctgaagagttgttgtatgctgatggttatcctatcataaaggattatgatcgcattgtttgcacatgcttcaatggtgcatctaatattgttcaagctggtggacttgcatgcctttctccacaaggatttcaggtatatggcggcaaaaatgggccatatgtatgggtgcattttccggggttgcgttcatgggaagtgttcaacaaaattcttgagagagcagccatagtcactgttcctagtatagaatttggtcctggcggcgagggttatattagagtcagtgcctttggtcacagagaatctgtattggaagcttcaaggagattgaggaaactactgtaa

SEQ ID NO: 84265 - DNA, 604 bp, Glycine max
  Peptide Sequence Number=SeqID_201043
atggcccgcaaccaccaacttcccacttggtcaggctttcttcaggcgattgaagcttgctttgccctctccccttatgaggatccaactggccagctcttcaatttggttcagaaagtccggcgtctcagcctagaggagcttgccagccgccgtgaacgcggattgtgcttctattgtgacgagaagtacaatcgcggccactgctgcgcctcacgcttcttcctcttggttgcagatgaagaccctgatgatgacccacttaaccctaatatcagccctcctctctcccctaaatcgacccggcccgataactcaaataacccaattcactcacaacccgacccaccccaggcccagattagccttcatgcactctcgggccacacgacccctgagaccttgcgcatgaccggccggatttcccatcagcccgtcgtgatcttgattgacagcggcagcacacataattttgtgcaagcacgcctcgtcaagtcacttggattaaatccccagcctaccccgactctacgcgttcttgttggtaacggtaatgaggtggtttgctctcaagtttgcctcgcggtcaccattcaccttcaag

SEQ ID NO: 84266 - DNA, 542 bp, Glycine max
  Peptide Sequence Number=SeqID_201044
atggcagctggtgttgaacttgctgaagcatatgtgtcgtggaagcagcacaaggagaaaatgaaggaaacagaaaagggaagagccaaaatgaacaagattggtgccaaggcaaatacatcaagtggatgcttctcttggtttcccaaaaggctcagaagacatacatgggtaagagacggcgatgagaaagacttgattaagtcaaaacctccactctcaatctcactcgctctcatcactctcactcgcaacgttgctcactctcaccgtaggtgtcgccgttggccatcctcgtcttccgctggcttggtcgctgtctcgagccttcatccccatcacttcgtgtcacagtttttcataatgttgtccatgttactttatgcatttgacttttggaacaaagagcttcaaagaacttatggtggggaggtttcccttggttgggatgtagatctgtttctcagtcagctattggtcgttaggaagcttaagatgttagacttttctgattttgcagacacggaatttgaactgacggg

SEQ ID NO: 84267 - DNA, 2970 bp, Glycine max
  Peptide Sequence Number=SeqID_201045
atgaagttcctccatcaagggcaacttatcgagctgaagggaaccacagacatgcatctcctcgccgtctctccaccgcaattaagacacatgcttcaaactcaaagtgtgagcgaattctttcacattcgcgtgtgccctcccacttcaccatccccgacaactcatcctgagattctctccattcttgaccaattcgggcctctgtttcaacccccaaccacactcccaccatcacgatcaaccaaccactctattcacttccttcctaattcccctcctgttaacacacgcccttaccggtaccctaatttccagaaacaggaaattgagtctcaggtttctgcgatgctccacaatggaattatcaggccaagtacgagccctttctcgtctccggtcctccttgtcaagaaacgtgatggatcatggtgcttttgtgtcgattatcgcgcgctaaatgctcttacggtcaaggaccgttttcccattccgaccatcgacgagctgctagatgaattggggagagctcattggttttcgaagttagatcttcttcagggctaccatcaaatactaatggcgccggaggatattagcaagacaaccttcagaacgcatcacgggcattatgaattcctcgtgatgccgtttggcttgtgtaacgctcttgcttcctttcaagccactatgaatcagaccttggggccgtatttgcagaaatttcaagtggaatacttgggccatttggtatcggagaaaggggttgaaccagtcccggcgaaggtaaccgcggtgcaacaatggcctactcctcgaattacgcgcgccttacgaggtttcttgggattatcaggattctaccgccgtttcattaagggatacacatcattagctgcccctctaaccgccctcttagccaaggaccaatttcattggaatgaggaagctgacagagcattttcacaattaaaacttgctctgtgccaagccccggttctgggtttaccagatttcaattcttcctttgtcattgaaactgatgcttcggggattggtatgggggccattctttcacagaatcatcatccccttgcctttttcagtaagccattttgctcgaaactgctccgcgcttccacctacgtctgcgtgctcgccgcaattactactgcggttaagaaatggaggcagtacctcttggggcattattttgtgatccttactgatcatcggagcttaaaagagctcatggctcaagctgtgcaaactcctgaacagcaaatttatttggcgcgcttgatgggctttgattatacgattcaatatcgcgtcggaaaagccaatttagcggccgatgctctctcacgactaccaccatccaatcagggagaatgttatgtgctgaccatacccaattgccttttcttgcaggaactccgagcagcacttgctgttaatcaagactttctatctcgacgacaacagctgcaggatgatcctcaccctgattgggaattgcgagaggattttattatgtatcaagggcgtatttggcttcctccaaaatttccattaattccggcaatattaatagagcttcattccacccttaccggaggtcacatgggtgttatgaaaactcttgctagggtccgtgagaattttgtgtggacttccatgaagcagaatgttcatcattttgtgaccacttgtctcacctgtcagcagattaagtctgataatcgccggtcgtccgggctcctgtgtcctctaccagttccggcgaggccttgggaggatctctccctggactttattgttggtcttcccttacactgcggacactctgttattctagtcattgtagatcgtttttccaaaggtctccatctggggtctctgccacagcaccacacggctgctggagttgccaaactatttatggaaatatccgggaagcttcatggaatgcccaagagccttgtatctgatcgggatccactatttttgagtcatttctggcaggaattgtttaaattaagtggaacaaagctctgcatgagctccgcttatcatccccagtctgatggtcagactgaggccatgaatagagtggtggagcagtatttaagagccttcgtacatcagaacccttcttcttggggctgttatctgctatgggctgagtggtcttataatacttcgacccactcagccacgggtatgtcgccgtacgaaatcactttcggtaagaagcccccatgttttcctcaatatctcgaaggcgcatcaaaggtggaagcagtggacgaatggctcactcaacgtgatcgaatggttaccagccttgtgaagaagctttctaaagcacaacaacgtatgaaggagattgcggaccgacaccgtcacgatgtgagttataaggagggagatcaagtcttagtcaaattaagaccccaccgacagacatctgtttcagggggtgcttactcgaaactggcaaagaagttctatgggccattttcagtcatcaagaagataggaaaggttgcttaccaacttcagttaccccctggatcacaaatacatccggtcttccattgttccctgttgaagccctaccacccctcagctgaagacaaccccgccacattacccattttatcagaggataatcaaccttgcatcactccattagtcatattggatactaaatgggtatcttcacctgctggacgcaacctgatggttcttgtgcagtggacgggtttgcttcctgaagactcttcgtgggaatcttgggacattctcaagcgcgattacaaccttgaggacaaggttgttttggaagcctgcagggatgttatgaacaatgaatcaacagaagcaagggacacagagcatggaacagggacaaagaggaaaagccagaaaccacgatacctgagggattacgtggcaaaatga

SEQ ID NO: 84268 - DNA, 393 bp, Glycine max
  Peptide Sequence Number=SeqID_201046
atgtggaggcttttggcagtgagagatttggtgaggtggcgggtgtgtttggaccttgttggtgtgggcgttggagcagtggtggtagaggggagatggaaggctgaggaactaggttttggagtcttggggagagagggtggaggaggtgaagacgaagaagaaagtgaggaggaagacaaagagggtgaagtaaaactagaaggagaagaggttgttgttgggtttggtaggtgggcctatgagcgtgagtgtatgggttgctctggttcaagttcttatgtgatgatagccatgctcactactcactgctctgagcttcactatgactacaagactaaaggttgtgagtgctggttacggggacaatatcattgcgtgagtaatggggcg

SEQ ID NO: 84269 - DNA, 171 bp, Glycine max
  Peptide Sequence Number=SeqID_201047
atggggagatcaaggtctgaagggaatctgcaaatgttggaagagttacatgtaaagtttgagtatcctttggtggagcttcagaggattcaggctcaacaaaaaatggacgatcttcaacaaaagacacataagcaaaaattgttagacaagtggcctcagatatcttaa

SEQ ID NO: 84270 - DNA, 279 bp, Glycine max
  Peptide Sequence Number=SeqID_201048
atggggaccgcaacagcaggaggatgggaatggcacctagagtggagaaggttttttagggaagtggaggttgatatagttgcaaaattaatgaaggacattgaggctgtgacagtgcaagtgaatcagcaggataattgggggtggaggttagatccttgtggggtttacaccgtgggaagtgcttacaaagagagacttccaacaaaggttaacttgagaaggaggaatgtggagttgaatgatatcttgtgccctttctgcggatctaatgagtag

SEQ ID NO: 84271 - DNA, 540 bp, Glycine max
  Peptide Sequence Number=SeqID_201049
atggaggcctacaaagttctcccgtctaacgttgtcgttgccttggacactccttcatggacacgaccagtacattccaacctagtcaagatgcaacttcattggttgatccaaaggacacaacaatatgtgcgtccagcttcagatgaagaaggagctaaaaaggatgatactttgcaagcattctcttctggttatgatggcagtgacaatgctaaccacaaggattcaatccaagtgttacatccagtcaagacataccattatgatgatgcttgtacatgctttgtcaaagacactaaggatgatgcagtcatatccaagctaaaggcactccccatcatctttaactacactatttatgatctcacaaagatggatgagtgggattttaaggatcacatgattcaactttgtgaagtgcaaatgcctaaaagggaaaaggtggaaaaaacttatcaagaaattctggctacaaacaaagttgctgaaaaggctagtaaagaacaagctaaaaaggaagcaaggcctgagcaataa

SEQ ID NO: 84272 - DNA, 333 bp, Glycine max
  Peptide Sequence Number=SeqID_201050
atgtataaagataagtggacccaacattggcccatgggctcaaaaatctaccctgaggttcatgagaatcctcgggcattcttcaacagctctagcctaatcctcttggagcctcttgctcatggctctggtaactggtcccttcctagggaggattgcatcaaattgttggagaaggactgggtccaagagagcctaagcccttgtgttgtgccagtgttgttggtgaccgaaaatgatgtgatggagcagcgagggttgaaattgaaagagagaaggaaggaagtgatacctgaaggaaaaagaagaggaagagccaaggttcaaagttag

SEQ ID NO: 84273 - DNA, 246 bp, Glycine max
  Peptide Sequence Number=SeqID_201051
atggggttcaaggatgctgctttgaaatatgtcttgaaagggaaacatgggtttgttctgtgtgaagaccccagatacttagtacctgctaacacaatcaatataagagaagtctcagtctctcagtgtaactgcagatacccttcctatggggaaggagttgtatcattatcttttgaaaactcctccggtgtagtcaaaaagtcattggacgaggagaataaaagaagctttcagtgcagctaa

SEQ ID NO: 84274 - DNA, 228 bp, Glycine max
  Peptide Sequence Number=SeqID_201052
atgacccaacgaagaaaaagaagaaccacaactaggaagaaccgaaaaccaacaatagcaacaaccgcaacgaggaagaacctgacggtgaaggacattttagccctttcacctagggtgttggatgttccaacaaaaatgttgggtgcccaaagtaacaccctcgaatggtgggtgcatctcacgacatcctcgaaccatactacttgggctataagactaaaataa

SEQ ID NO: 84275 - DNA, 552 bp, Glycine max
  Peptide Sequence Number=SeqID_201053
atggtaggtgaaaaggtaaatctgcttgaagtcatcttcttctactggcttcaagcattcaaggatagatttcatgctaaggacaagaagaaccttattccttatggaatgttgttcactcagatcatgaggagtagtggagcagatgtctctgtgatggaaccatctacaagagccacacaacttaaaggattgacctttgacaaaatgggaatagttgcgaacttccctaaatatgctcaaaaacatgtcaaaagaaaggttcaacaacaatttcttaatccagagcctagagcagcatctcaacagactcacagggagcaagctcaagatttagaccccatggagaaggaaactcttgaagaagttatgcttcaatctgtcattgaagctttggtcaatgagtcgagggacaacatcattgagatagaccctggtgttgaacctatcaaatcaaggccaatgtctaatgctaatgaaagaaaaatttattttgtcttatctaaagtagagggtgaagaaaacattgaacattttgaagccatatattga

SEQ ID NO: 84276 - DNA, 405 bp, Glycine max
  Peptide Sequence Number=SeqID_201054
atgtctgatcgctccttctcttttatggtgatttttccattctttcgattcttcttcacacttcatgtggaccctatcattgaagaagttgaatttgatattgatgttgcatctggttccctggctgttcaggtgtataatcctcctccttctcaagcctatgttcaactgcttttaaaagagcttattagaactagagaggccattgcaaaagctttgaaggatcttgcccatgctaagaagaaggctcgcagatggtctttgataggtgaattcatttacaataatgatattgggtggaaacctcttcactctctaactcccctagcttcccttactatctcctttgatttcaaggactctggtgacgagttccttaagaagttgaaactcaacatcatctaa

SEQ ID NO: 84277 - DNA, 228 bp, Glycine max
  Peptide Sequence Number=SeqID_201055
atgacaactccaacaatggaagttgcacaccttgagatgaagttacccaactgtgaacttttaaatagcattctaaggtggaaccacacattcatacttcagattttattgtcgaatgttgatttgtatatgtcgcaacctaccctttggcgggagggcgacgcggggctcaagggtgtgtctttcaagggaggaaggcgtgcggagtcgccaccaatgtttatttga

SEQ ID NO: 84278 - DNA, 339 bp, Glycine max
  Peptide Sequence Number=SeqID_201056
atggaggagaagagaaggaaagaaagagaagacacccctcttgatgtaaacccatttgcacaggggttgagaatggatcttcaaaggttttttctttttaacaagtacaaaattcagaaaatggaatggataaggagaaagaaagtggcgagtttatggagggctgaatggaagggatttggttcaaagtttgaatgtgtttggatagagaatgatgatgataacaatggtgttcaagtgagattaaaggctgaattaagacacaaaaacatgtggaaaaatgcgcaactcctggtcagccaagaggcagccacaagcctagagtttccaccttattaa

SEQ ID NO: 84279 - DNA, 519 bp, Glycine max
  Peptide Sequence Number=SeqID_201057
atgactgtagtagagttacaaggaagcattgagagacttgtgaccagaatcttggaaaagacagagaaagtaagtgaagaagcactaaagagtcaggtgaatctcaacaatgttgcgaaaaccagtcaaaatgctgaaaatagaggtcgagataacttcaacaatggacgaagaggaaattttacagatgaaacagtaaaatctaccatgagatttggaaataatgcaaaaattccaattatggggaaaggccaaattactattagattgaacgatagttctcaaagttttatctttgatgttttctatgctcttggtcttcatcaaaatttattgagtatgggacaactgttagagaaaggctacaacatgcagattcatcatgaccactgcacgttgatttacataaatggaagattcgttgcaaaggtaaaaatgactcctaattgcctattccctttgagaattcaccatgaaaaattgtcttgcttgagttctgtgattcctaatgatgattga

SEQ ID NO: 84280 - DNA, 309 bp, Glycine max
  Peptide Sequence Number=SeqID_201058
atggctctttgcaacataatgctgcttttgctctttatggccttgcagataatgaatgaggataatgcatccgacttcataagggtaggtggagttcagagacggcaggatggagaatttattgttcaggcaactaaagattgtgtttccaaaacattgaaaagattagaggagaactttgttattaaccttttttacaaagcaaggtatgggaagaagcaagaaggcatgacaactaaagaagacctcaaatggaaaatggaggtgacaaaaagtgaccagaaagttggcacacacaagatcctctga

SEQ ID NO: 84281 - DNA, 519 bp, Glycine max
  Peptide Sequence Number=SeqID_201059
atgcctcgtgggacgcttgaagttactctaatcagcgcaaaagacctaaaggacagtgattttttcaatgcggaagaggttgcccataatcttatgaaggaactatctcatctaagaaatatgttagaaagttatgctagtagttgtgagatcgcatgccgtgaaaatatttcaattgcacagggaagtcctgagccgttgaagggtggaacgccttgtgttgctgattttgttcatggtaaagatggactagggaacacattcctacccccacctaaaggtgagaaaattgagaagagtgcttgtgagtttttggttgagaaagtctctgaatatcccggtgaagcaatcaaaggagattttgcgtttgcaagcaaagtgaagagaatagttatacttggtggtgcattctttgccttggggaatgtgaatcctgttgcagaagcaaatcataagatttacaaatccagtattgagcaccttgacttagtgtcatctaagaaatattttgtttcatga

SEQ ID NO: 84282 - DNA, 450 bp, Glycine max
  Peptide Sequence Number=SeqID_201060
atggttccaataccgaatctacatcatcaaggcggccgcagcagcgaaggcaacggcggcgacagatccggagccggagactctgcggaggtgggcgtggctattggggctgacgacgggggagtcagcgggcccctcactgatggaggcggggtcggagggagagacgggggtgaggggagagccggtgggggagttggaggagggagaagaggtgggctcaagcatttgcgaaggatgcgagctgccgtggaagtggatggggccaagttgttaaacgctgccgcggaagtggatggggccacgtcgttgaacgctgccgcggccatggctgtctctcccacgcacgtggtgacaagcttcaaccccgctaggatgcgcgtgagcacagggagtcaagcgagggaaagagtggacgcaaaaatgaagagtcaagcgagggagaaatga

SEQ ID NO: 84283 - DNA, 1197 bp, Glycine max
  Peptide Sequence Number=SeqID_201061
atggctcgaacaaagcaagcctcgtgcgttgtcggacatgatcattttcatgagggcccctcacatgaaggggacaatgttgcagagaggcatcaaaggctaacagtgcctaaacgtggctggcgttcggcgatgccagagctagaaggaccaccgacagtgccacaaacactgggcattgttggacctccatttggaggaggtccaattgatctgtccttgcttcaatcgtacaaggaccactacgttggtgaacttgtcagccacggtgttcatgtgctaccactccctactgcatcgacagtgaaagcttatatgttgtggtcggggttagccagcttagtcacagtgcggtaccctaccgcaaacaagggcttcatgaatgcctttgtggagaggtggcatcaggagacgtcttccttccacctacctgttagagagatgaccatcactccagatgatgtgtcttctctcctgcatctgcctatgacaagcaagcccattgatcacatcccatccgcctttgaaagagactctatgaagattccgctaatgagcctccttggcatatcgacagaggaagaggctatggtggcgaccaccacaggtgccaagttaggctatagcatgagggttgtcacgacttatcttctgcacttgttcgacaatacgatatttgtcgaaaattccttgactcatgtccatgtcgcctacctcctctacctcgataacaggatgcttgcacaagtacgtatggggagccattgcactagcttacctatacgaccatttcttctatgtgagccagtacccaacaatgtttgcacatctgccaatattcactattcagagcatgtgatcgatgctctagatgaccgggtgcccacagatggaagccaaccaaaggttctggctttgttgttccgattagggagaagttggatgagctacaaatggatgttgttgtgtggtgtccttatgagggccacagaggtgtcacaattttctcacaagtgtccttatgctctcagcaatgttgtgccacctaggggtctttgggcttgcacccctaactatctaccttggttttacaaggtttcccacccctatgtcattccgctagtggacgggcaaccaccatgtcctcctgtgcatttaccgcccatcccatacagttaccatctaaatagccactag

SEQ ID NO: 84284 - DNA, 315 bp, Glycine max
  Peptide Sequence Number=SeqID_201062
atggctttacaatttctgaaacaccccttaaccatctcacgaggtttgcagaacgagacaaccttaacttttctttctcggctacgaaatccgaagctcccattgtcgggattccttcttaataataataataataataatcatgatgatgatgatgatgatgatgaaaaatgtggtggtggtgcactgatattcttactgttgttttttcatgaattaactctagtgagatgcgaagacaatgttcagattccaacttctttccggagctatgctactgcaaaatcagaaaaggttttgcaagtgaagaagtaa

SEQ ID NO: 84285 - DNA, 561 bp, Glycine max
  Peptide Sequence Number=SeqID_201063
atgccgatctccctctatgaaagtatcgattggtctgtgtcatcccgacataggggttgcgcccacaagacacacagtggacctggaggagcccaacagggccctggggtttccaactcgggttacgggcctctgtcagtcctacatggtgtccgtccccccagcaaggggtcgcgcccagaagacacccagtggacccggaggagcccaacagggccctggggtttccagctcgggttacgggcctctgtcagtcctacagggtgcccgtccccccagcaagggatcgtgcccgcaagacacccagtggacccgaaggagtccaacagagtcttagagttgccagctctgattacgggcctctgtcggttctatggagtgcatgtcgcccccagcaaggtcatcaggccccctactaatcgagctttcatcaagaagtattgcgcccccaggcaggcgcaggacgaaacaccacagcaacctggggatggccggcagcgggcaacagacgcaccgccaccacctctagagttcacctcagctcatccacaaaaaggttag

SEQ ID NO: 84286 - DNA, 1103 bp, Glycine max
  Peptide Sequence Number=SeqID_201064
gcggtgagcgtcccgttgtatggcagactggcggatatctggggccgcaaacgattatttttcatcggcgtaacgctgtttttgctgggctcggtgctatgcggttttgcccataggactgggtgccggggcgattatgccgctgaccaccaccatcgtggcggacatttattcgccgcgcgagcgcgccagcgtgcagggctggctctccagcgtctggggtgtcgcggccgtcatcggtccgctcagcggcgcctggctgcatcagggcgcaacgctgaatctgaccggcagctgctggttgatgatcagcgtcaccgcactgctggtggcgctgctacaggcggaagcgctggggttctggctggtgccgtttctggcgctggcgctgctggccggctggcggctgaaacatcacgagcagcgcgccgatgcgccgctgtttccgctggcgctgtggcgcagccgcctgattgtggccggcaatgccgggaacctgattatcggggccaccatgatgggcatcagcgcgtttctgccgacgtggattcagggcattactggcggcacgccgctgcaggcgggcagcgcgctggcgatgatgtcaattggctggccgctggccagtacgctcagcgggcgcctgatgctgatcacctcgtatcgttttaccgcgcagctcggcgcatttttactgattgccggcagcgcgctgttactgctgctgcgcgccgacagcagcatcatgcaggccgggctgacggcgtttgttattggcaccgggatgggcatgaccagcaccacctttctggtgtcggccagcgatccgatgcagaaaattatggcaccggagagccgtcaggcgctgccgcaggaacagttacacttctggaccgggcagattgccagttcgctgcactgggtatttgtggtggcattgctgattgcgctgctgacgttgtggattgcgtggctgatgccgcgtcagcggccggaggcggaataaagcagggcggccgaccagccgcccgaagagattactgtgcgggagcatcctgcgagctgcccgcgctgtccggcacgctgctgtccgcatcgcgacc

SEQ ID NO: 84287 - DNA, 302 bp, Glycine max
  Peptide Sequence Number=SeqID_201065
attgtaatgaggttctcgtcaaaatcaacaaatttgtcatcaacaaagaaggcttagtatgtgtggaaacgttgtgtatgcctgttactaaaccagaaagatttgagttggatgcttttgagttagatgaacctgaagatgctggcaggtatatagttagaaagagcataaagagtgcaaaagacatagttcgtttccctttccaacaggatgccaccatactttacttattgcacactgtgtacagaggcagagagaatctcccattacttactgtgcactatctcttctatctttactaa

SEQ ID NO: 84288 - DNA, 489 bp, Glycine max
  Peptide Sequence Number=SeqID_201066
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggatgaagaaaaggccatgtggggtatatgcatccctctccgagagtggagagtattattcccaccgaccgccaactcccctactagacaccgtcaactatcctattcatatgaagaatctctctgccaaggagctgaaacaactcgcggatgaactgcgttctgatgttattttcagtgtttctagaactgggggccatttgggctcaagccttggtgtggtggaactcactgttgcacttcactatgtcttcaatgcccctcaggacaagatactgtgggacgttggtcaccaggttggttttcaacttccttgctgctttttgctttacttgttctaa

SEQ ID NO: 84289 - DNA, 363 bp, Glycine max
  Peptide Sequence Number=SeqID_201067
atgggtgtgaatactcgagatgttcagagggtgcgaatacggtatctatatgcaatggatgtgaatgcccgagatggtgaaggtgtgaatacccaagatgttgaaaggggtgtgaatatcctatatgcaatgggagtgaatattcaagatgctaagggtgtgaatacccgatatgcaatgggtatgaaagtcgaacatgtaggttctaggaaggcactcaaggctggaggactacataccgcaccgatgttccatcgaccagtccacgacttcaagcctttttcgtgcttaagcattcaaggcttgtgtactgtaccggccgttcatcgactggtctacgacttcaagcctcgtcgtgcttaa

SEQ ID NO: 84290 - DNA, 321 bp, Glycine max
  Peptide Sequence Number=SeqID_201068
cttctccttgatgctgtggtcgaggtccacgacggcattatccttgttgtggatgtagtccatgtagttgttgatagtgtattggtagaaagagttgttttgtttaggggaagaagagaggtggatgtggaatttggcaatttggacgaggcaatggatgagagcgaggaatgttggccattgggtcctatgatggctaagaggtgtgtgggtatttggagaatggaggagttggaggctagggtattctttgatgcaaaggtgagctgggttgaaagtgggtttgggttatggatgttgggttatgggtatttgacttga

SEQ ID NO: 84291 - DNA, 330 bp, Glycine max
  Peptide Sequence Number=SeqID_201069
atgggggctactagctcattgaatctgctcaagctgtatgtaactgcagagagagggttttggggtcttgaaagagtggttcttgttcctgagaaggccaatactggagcagataaattgaagggcaatgcagtgccaaaggtgaatctgcagatggaaaggaatagtccaaggggtaaccacatgaagaaagctagagaagatgcaggggttggcctgaatgccaaccttccatcatggaagatcaatggctttggatacctctcttttggaaggacatgccaatttctcctctcctctgagcttaacattaagcaaaccttctgctga

SEQ ID NO: 84292 - DNA, 382 bp, Glycine max
  Peptide Sequence Number=SeqID_201070
atggacaaattgctgagcctaggaaaccttgtggtgtgtcctgagggaacaacttgcagggaaccttatttgctaaggttcagtcctttgtttgctgaactcactgatgacattgttcctgtggcggttgatgttaaggttagcatgttctatggaacaacagctagtggacacaaatgtttggacccgtttttccacttcatgaacccgaatcccacgtacttcattaaaatcctcgacagggtaccgctgtcagaaacatgtcttggaggtggaagatcaagaattgaagttgccaattttgtgcaacgtgagattgggaatgctttaggatttgcatgcaccagcttgaccagaaaagacaagtacatgatcttggcag

SEQ ID NO: 84293 - DNA, 592 bp, Glycine max
  misc_feature (7)..(7): n is a, c, g, or t
  Peptide Sequence Number=SeqID_201071
atggagnccatgaaagagcaaatgaccacaatgatggaagccatgatgattataagaagaatgatggaggtgaatgcggctacagttgtagccacaaataccaccacagaagtggacccgactcacccacctggcatccagcctcgaataagattgtctcctgctatggtggaaaggggaaaatttgatcatatagaggaaaggctgagggccattgaaggaggtggagattatgcttttgctgacatggcaaagttgtgcctagtgcccgacgtggtcattcctatgaagttcaaggtgccggactttgataagtacaaggggactactatgagaagatggtggagggatttggcagctcaagtagtgcctccaatgatggagagggagatgataaaaatgatagtagacacgttatcggtgttctactatgagaagatggtgggttacacgccttcaagctttgctgatttagtttttgccgacgaaaggatcgaagtggatctgagaagaggcaaatttgattatcctgctatgatgaataggaagccttgggaaaatggagaggataagaaggagggaggaacccatg

SEQ ID NO: 84294 - DNA, 258 bp, Glycine max
  Peptide Sequence Number=SeqID_201072
tatgctgatgagtcaggaggaggtgggttggatgatgaagggatgtctttagctcttgctctctttcttgaggccatctatcccactaagcctaaaactttccgtaatgatgtgcgcttagctctccctgagccacgcttagcggtgcgctcagtgagttctacttgtagaagcaagcttcatgatgaatcaagattgattcaaagatgttttgatgatgacaaaggtgatgacaaaaagctcaaagatcaagaatga

SEQ ID NO: 84295 - DNA, 264 bp, Glycine max
  Peptide Sequence Number=SeqID_201073
atggttgtcatcaccaaaaagggggagaatgtgaatcttgcaggctttgatgatgtcaaaaagaatttacttgataatgattgttatcatcaaaaagggagagaatgtgaatcatgcatagggtacatctacttgaggattgttatactgagaacaagagagggtacatctcttgtggatcagttcaaatggaagggtacatccacttggttagtcaaagagaacaagggagggtataattccttgtggatctttggcttgtaa

SEQ ID NO: 84296 - DNA, 108 bp, Glycine max
  Peptide Sequence Number=SeqID_201074
atggaaaataaggtggttaatttcgtgggtcttaataagattaagtggtggttggacagaaatatagaaatgggaataactgaagctacagggctccaaatgagatga

SEQ ID NO: 84297 - DNA, 285 bp, Glycine max
  Peptide Sequence Number=SeqID_201075
atgcctacacgcatgacccttcagttagttgatcactccatcacaagaccatatggagtgattgaagatggtttggtgaaggtgaaacatcttatatttccagttgattttctggtaatagacatagaagaggatgctgatattcctctcattcttggccgcccattcatgtctactattgcttatccgctaagtgcaaaccttgcactaagtaccatctctccacgcgctaagctgagcttgctcgcgctaagtgcaaagacccctgattggttggctgaatag

SEQ ID NO: 84298 - DNA, 840 bp, Glycine max
  Peptide Sequence Number=SeqID_201076
gagccgcataactgggaacagcttcttcaagccagccagcgcctgaacgacccggctaaaaaacattacggcatcgcgttaccgactgcggaaagcgtgatgaccgaacagtcgttctctcagtttgccctttccggtggcgcgaacgtgtttgatgcaaaagggaatgtcgacatcgataccccggaaatggccaaagcgctggcgttttataaagcgctggctgcgaccaccatgccgggttcgaacgatgttatggagatcaaagacgccttcatgaacggttctgcgccgatggcggtttactccacctacatcctgcccgccgtctacaaggacggaaaccctgccaacctgggcttcgttgtcccgactgaaaactcttcggcggtgtacggcatgatcacctcgctgacgatcaccaccggacaaaccgaagaggagaccaaagcggccgagaagtttgttacctggatggaacaggctcaaaacgcgacggactgggtcatgatgtcgccgggcgcggcgctgccggtaaacaaaggggtggtgggcacggatacctggaaaaacaacgacgtgattaaagcgtttgggcagttgccatatgagctgatcgcacagttcccgaacgtgcaggtgtttggcgcggttggggataaaaacttcacccgcatgggcgacgtgacgggctccggcattatcagctccatggtgcataacgtcacggtggggcagaaggaacttaacacaacatatgcctttcgccatgctgctgttggcccccagcctgattctgctggggggcatggtggcctggccaatgatttccaatattga

SEQ ID NO: 84299 - DNA, 351 bp, Glycine max
  Peptide Sequence Number=SeqID_201077
gatgtgcggaaaaaagcacaggccatccagaagcaaaacaccgccccccacgtgtggtctcgtgagggttatgattatttagaacagaagctgatggctgagaagacaaagaaaaaactagaggaagctgctcatcgtgtgcgtgttgctggagccggtgtcaccatcaagcaatactttggctccgctccacgaagctcctgcatttcctccttcatccctcccgaagaactcgagcagctcactcaacaaatcagggaccagctggaggagtcgatcacagaaaaagtgattgggcagctcatggcatccttcagccaaatgcagccccagcttcagtcacaaatgtaa

SEQ ID NO: 84300 - DNA, 234 bp, Glycine max
  Peptide Sequence Number=SeqID_201078
atggaagatgaagaagaaggcagcaatggagaccctcctcgcaagaaactccgtctcacaaaggaacaatctcgtctccttgaagaaagctttagacaaaaccacactttgaacccaaagcagaaagagtctttggcaatgcaactgaagctgcgaccgaggcaagtggaggtgtggtttcagaatcgtagggccagacctcatgaatctgaatccgatgctatacccccttag

SEQ ID NO: 84301 - DNA, 267 bp, Glycine max
  Peptide Sequence Number=SeqID_201079
atgggtctgcattttcctaattgtactttctcgcttctgcaaattttcgaccacatgaaagaaaaaagggagtttcgatgtttccttgatgatggttacggagatacccgtgtcgatgaaagtgcgagcctgtttgaggaagttcaccccatcgacgtggtggttgattgtttgcctcatgctctgcatgtagttgatgccgattttgttggtaagggcaatatggatggaagaggaagatgccgcattcaacgagcacaaagctaa

SEQ ID NO: 84302 - DNA, 297 bp, Glycine max
  Peptide Sequence Number=SeqID_201080
atgaagatgagaagagaggagtttttccaacgagttgctggagcagtggccagagatcctaaaataaaaaagagagaaaaaagaagaatcgtcatcggttacatcgaaagtggaaggggaataaagagagagagagagcaagaacagaggaaagcggaagaaacctcggtaaaaatcatgggagtgatgaatgctaggaatggcatcaaggaaaggaagcgtgttggcgaaatgaagaagagtgtcgtcatatccaagagagtaagcggtggatgcttcttcgcttcggacttttag

SEQ ID NO: 84303 - DNA, 1944 bp, Glycine max
  Peptide Sequence Number=SeqID_201081
atgtttctgagggtacctgccatgaacaggagtttgaacagagagaatccagatattttgaatatgatgattgcagggaaacagataataaggggtgttgaggacgacaaaagagatcagagagaaagaaagatgggcccagtctattttcttactattgtggatcatacttctcttgaagtaaagcttttctggaagatcactgcaaaatcaagagtgatggagagtgatatgtacactgctgcactggacatttctgggcgagaggctacagtaatagatgaaatttcccaacattccgcctcaaatcctctcattcagtgctattcacttgaccttaacaaccaatcccacatcataagtggaatttcaatgctttctggagagcaaggtgaacccataaataatgtccatgctgatgcttgcttcattaatccttcaattattgctgactctagtccactagttatatcacaaggaaagactattgtggcagtgggagatgcctcaaatcctatggagaacactgagcttcaagagcatttagctggaggaatgccaatcactccctcttcacttgctgccattcttgctgctagaactggtcttgaagaaaatttggggaactcatcatcagccttgcctccctccctctgctcaatgggggcactgggggcattcttcaacaatttgcaaggtacttcaaattcaaaccctttgtctgcaacttttgaggactgtggttacaatgaagtttctagtaagtggaatgctaacaagtttcctaaagctccagagattgatggaacttgtcagccttatccttttatagcaaatctggatcaaaatgaatggccatcatcaaatgtcgcaaacatggccaatcatgcttaccattcctcacactttagtaaggaactttctctaagtctcgcaacatcgacaaccgcgggaatgtgctcggaggtgagttgctctaatgtgaccccatgcatgaatggaaccatgtcagggttggagcaagcctcttgcagtagtagtagggaactttctatgaatttgggtggtaataagtatgtagagttttcaccagaagtactggaatcaagatatctcgttgggattcaagagatacttgctcaaattggaagatattcatttgaaaatctagaacagttgaattattctgctggtaaccatagatcaggtggaaacaagtcaagttcagccttcccacccaagagaaggatattgatagatcacaatgcaaattctacatatgaagctcatgcagagtctccattgcaaaggcatgctgctgaatcaaagaaatcccaactcctgacacttctacaactggtggacaatcgatatagccaatgcttggatgagatacacactgttgtatctgcattccaggccgctacggagctggaccctcaaatacatgcacattttgctcttcaaaccatctctatcctttacagggacctaagagagaggatcagcaattacattctagccatgggatcaaatttcaacaactcgtgctcagaagagaatgaatggtccgttgaaacttcattccttcaaaagcaatgggctctccagcagttgaaaagaaaagatcagttgtggaggccccaaagagggttgccagaaagatccgtctcggttctacgggcttggatgtttcagaatttcctgcacccgtatcctaaagatgcagagaagcatttacttgcagtaaaaagtgggttgacgagaagtcaggtatccaattggtttataaatgctcgtgttcggctgtggaaacctatgattgaagagatgtatgctgaaatgaataaaagaaaggcctgtcgaaatgaagaaggaatgcagagcaaccacggaactaggataagcacgaccaatgaaaggtttaatcagtgtcaactatag

SEQ ID NO: 84304 - DNA, 591 bp, Glycine max
  Peptide Sequence Number=SeqID_201082
atggcagtgatggaggaacaaattaatattatgtactacttaagaaaaagaaacacatccttagttggtagccatagcgacctcgccgagtttctgaaggttaagcttaacgacagtgtcaacaaacatcttagtatcaacaccggtgtttccttcgggtatgtcgacgacgtaagactccaacacaatggtgtaaaccttaccgttgtcgggtctcttgaactcgttgacggaggtgacggagcgatagttgtggaggcggtgctcgccgccgacgacgcggaagctgaggaggtggttgtcgtcgtcgaggatctcgaggcgctcggtgctggtggaggcggggaggcccgagacgacggtgacttccctgatgctgccgacgccgccgtcgccggagcgcatgttgcagctcttgacgaagtgcttgtacttctgcgggttctcgaagctccggacgaggggccagaccgtgtgcgccggcgcgtcgatgcgctgcgctatgatggagctgcagatttcaggggaagcctcgaacttgtggtgcgtgttgatggtgctttcgagttcggtgaattcctctggggttag

SEQ ID NO: 84305 - DNA, 1032 bp, Glycine max
  Peptide Sequence Number=SeqID_201083
atgacgaactcaagttgcggaggcgcggagttggagctatgccgagatgaatcagccgcattggttctcaagttcgtcgccatcgcttccattctcctctccggcatggccgggatcgccatcccgctcatcggaaaacaccgccgcttcctccgcaccgacggcaacctcttcgtcgctgccaaggccttcgccgccggcgtcattctcgccaccggattcgtgcacatgctctccgacgccaccaaggcacttcgccacccgtgcctgccagcgttcccgtggtccaagtttcccttcaccggtttcttcgccatgttggccgcgctcctcacgctcctcctagatttcgtgggaacgcaatactacgagcgcaagcaggggatgaaccgcgccccctccgaagaaccagtacgggtcggctcatccgaacccggtgggaatgggaaggtgtttggggaagaagaaagcggcggaatgcacatcgtggggatgcatgcacatgctgcacatcatagacataaccatcctcatggcaatgatgcatgtcatggcattggcaacatcaaggaacaggtgttggagcttgggattgtatcacattctgttataattgggttgtccttaggagtttcgcaaagtccttgtaccataaggccattaattgcggcgttatcttttcatcagttttttgaagggtttgcgcttggaggttgcatttcccaagcgcagtttaaagcctcgtcagcaactataatggcttgtttttttgcactgactacacccttgggtgttgggattggaatggctatctcttcggggtataacccttacagccccggtgcactcatcgccgaaggtatcttggattccttgtcgtcggggattttggtttatatggctttggtagatttgatcgctgcggattttcttagcaagaggatgagttgtaactttaggctgcagatactgtcttactgcatgcttttccttggggctggattgatgtcttcgctcgcaatttgggcatga

SEQ ID NO: 84306 - DNA, 690 bp, Glycine max
  Peptide Sequence Number=SeqID_201084
atgggaatagcaaggaaatgttcatattgtggtaacttaggtcacaatgcaaggacttgtaaaagtactcccggtcaaggacaactaaagctcttcggagtgcaactagatgtttcttcttcttcatcatcctcgaattctttttcatcatcatcaccttcatattctggcatgaaaagaagttttagcacgaattacttgttgtcttcatgggcatcttcatctgtaccctcctccttttcctcgccttccctgcttggtgcaaatgaaaattcagatagttacttactcaatgccaatagcctcatatcaacaattcaagacacaaaaaaaggtgtcccgtggacagaggaggagcatcggatatttcttatagggcttgagaagctggggaagggaaactggagaggcatatctaaaagttttgtgacaacaagaacacctacccaagtggctagtcatgcacaaaaatattttctccgtcaatctcagaatagcttcaataaaagaaaacaccgccctagtcccaacctgttcgataattggctttcgcatcgtcctcattcattgctgaactgggttaccactttaacttcaactaataattgcactgttcagagcgcgagcccagatttagaactcaaacttgcaactcccacgccattggagctatcagtagcagatgcatag

SEQ ID NO: 84307 - DNA, 186 bp, Glycine max
  Peptide Sequence Number=SeqID_201085
atgagagggacagagaaagagaaacactgttatagttattatagccttatagctgtgtcctttcttggtggtggccagacacagaggagattaattcattcattcaaggctgatgtggttccaaatatatttgcaaagatatgggatgaatgtggatgtaaaatggaccagattcaaaataactaa

SEQ ID NO: 84308 - DNA, 2055 bp, Glycine max
  Peptide Sequence Number=SeqID_201086
atgctagatgtaacaagtaatgtgataggaaaggaaaaaagtaacgggaacaaaatggagtggaaacatagaagagaaagttctgttgggaatggacttgtccttgtgttaggtcattccgggaaccatgttttggtcttgtttgagttggcactgcttgcaaacatggctgctatgtatgctgtatatcatggacccgaaggacttaaaaccattgcccaacgggttcatggtcttgccggggtgtttgctcagggattaaaaaaacttggaaccgtggaagttcaggaccatccattctttgacactgtgaaaattaagactgccaatgcccatgcaattgctgatgctgctcgcaagaatgaaatcaatttgcgggttgttgatgggaacactatcactgttgccttcgatgaaacaaccaccttggaggatgttgataatcttttcaaagttttttctgatggcaagcctgtctccttcacagctgcatctcttgccccagaagttcagactgcagttccttctggacttactagaaacagtccttatctgacacaccctatctttaacacgtaccacactgagcatgaggttctcaggtacattcataggcttcaatcaaaagatctttcattgtgccacagtatgatcccgctgggatcttgtacaatgaagctgaatgctacaactgaaatgatgcctgtgacatggcctagctttgctaacattcacccttttgcaccaattgaacaggctcaaggttatcaggaaatgtttgaaaatttgggtaaactgttgtgtacaatcaccgggtttgactccttctctttgcaacctaatgctggtgctgctggagaatatgctggactgatggttattcgtgcatatcatttggcaagaggagaccaccatcgcaatgtctgcattatacccgtctcagcacatggtacaaatcctgccagtgctgctatgtgtgcaatgaaaattgtatctgttggaactgatgccaagggaaacatcaatattgaagagttgaggaaggctgctgaaacacataaggacaacctagctgctcttatggtaacatatccttcaacccatggtgtttatgaagaaggtattgatgagatatgcaaggttattcatgataacggaggtcaagtatatatggatggtgctaacatgaatgcacaggtgggacttacaagcccaggttggattggagcagatgtttgccatctgaatctccataagacattttgcatccctcatggaggaggtggccctggcatgggtcctattggagtaaagaaacacttggcaccatttttaccatcacatccagtggtttccactggtggcattcctgcccccggcaagtcacaaccacttggtaccatttctgctgcaccatggggctcagcactgatattgcctatctcatactcttacatagccatgatgggttctaaaggactcaccgaagcatcaaaaacagccattttgaatgcaaactatatggcaaaacgattggagaatcattaccctgttcttttccgtggggtcaatggaacagttgctcatgagttcattgttgacttaagaggctttaagaatactgctgggatagagcctgaagatgttgcaaagcgtcttatggactatggcttccatagtccgacaatgtcatttcctgtgcccggcacactcatgattgaaccaactgaaagtgaaagcaagtccgagttagacaggttttgtgatgctcttatttccattcgacaagaaattgctgagattgagaaaggaaaggctgacattaacaacaatgttctaaagtgtgctcctcatccaccaccagtgctcatgggagatgcatggacaaaaccatactctcgagaatatgcagccttcccagcttcctggctccgtgtttctaagttctggccttccacaggacgtattgataatgtgtacggtgatcgcaacctcgtttgcacacttctcccaacatcacaggctgttgaagaacaagctgctgcaacggcctaa

SEQ ID NO: 84309 - DNA, 441 bp, Glycine max
  Peptide Sequence Number=SeqID_201087
atgggtcgcgatctccatcggtggcaacaatttgatcacgtgcaaagctcaaaaccacagggttgcaaccttagagctcaagtcttagttgcctctgacttagagagagaaaatggctttgatatggaagagaatgcttcctccaccgaagctctcaccagaaagctggacgagattctgaccgagacggagaatgatgccggacaattctgtttcaaagaagaaacggtagaaaagttcatgcaagagctttacaaagagatcatcgcatccccaccaacgccgtcaaatgcggtgcaggtgcaaaatgactctgtggggcttcaagttgttatcggtgaagacaagacagatgaagggcatttcgacgaggatgactggcttgcaagggtgcttcgttggggtcaggtcctccacactagtcactgcttttgcttttga

SEQ ID NO: 84310 - DNA, 840 bp, Glycine max
  Peptide Sequence Number=SeqID_201088
atgatgggtttaggttgggtggcgaagccgaataatcgacaatgcagaaggtggacgacaagtcgcatatggggagcaacgtttctttgttgcatgtgcttaatcttcttcactcccagaatccctcgctctcccaagcaccaccaattcgttgacatgcgcaatcttctcgattctccaggagtacccaacacgttgaatgtgatgacaaatttcccgtttttagttgtgggtgttctgggccttgtgcttgccctggaaggaggtgtcttcaacataagttcccaaggagaggtttggacatgggcactgttctatgctggaatagcaggtgtggcttttggctctgcttattaccatttgaagcccgatgaccatcgtgtgttgtgggacactttaccgatgatggtggccttctcctcacttttgtctagcttggttgttgagagattgggccagaggattggactgtgttgtatgtttgcactcaatcttgctgcctttctatgtgtagtttatgaacgaatttataatgatattcggttctgcatgatgttccagttgactctgcctctagctattccagtaatagcagtcttgtaccgctccaaatatactcactcaagatattggtttatttctacaggtttcagggcatgccaacaccatattgatgctctgtccacttttatagttttaaagataatcatttatgaagtgcaacttccatggttacatatttttggaagccaccattttcagtgtatccattatacttttatctctaattggaaatgccgtgctttgattatattggacaaagttcaccattatacttga

SEQ ID NO: 84311 - DNA, 585 bp, Glycine max
  Peptide Sequence Number=SeqID_201089
atggagcaggctttgaagcagttacctagagaaaagatccatgtagccacgaaatttggcattacagtagcaaaatttcctaattttcaaatcaaagggacaccaaagtgggtgaacttaagaaacttgtggaagaggcatatagccttgttggtcgaggcttttttggtgccaaaggttgagcggactgagtatgtagcttcaaagcaaaattcttcatttggaccaatgttcacaggagcaacatttgtgcagccaaacaaaccaggattcaagatcaatggccactctatcagactgaatgaattcaaggccatgagaaaaaacaataccaagaagatcgagataaggctggacctaagtgtggtggggaacttggagatagagaggtcgagggagaatgagaacgcacaaagaacagttgcagagaggattgccagcaacgtacattctaagatggtttctaataaccgccttagaatgtcagtcgtaaaaagcatttttcatttcactaattacaaaattaccaccgcgatactttctaagacggttccacagagaaccgccttagaaacagtgtcgtaa

SEQ ID NO: 84312 - DNA, 1299 bp, Glycine max
  Peptide Sequence Number=SeqID_201090
atggcagaagctgcaaatggttttgctccttccgtgaattcatcttctccaaagaccagagtgcataacaaggaaaagaagtctcgtgcaaaccattttgcacgattcaggaataagtgcaaggcaaacactagtactagtactgctgcaggaacatctcaggcgattctgaagaggctaatttctacggcgggggataattcccattcccttttaagacccaaaccagagaactcgatcttaggaagcaacagaaaactctcacactatgtcccatctcgatccatttccctggcagcactcaagccgagcgattcattccctcggcgccacaactccgccacctccgaggaacaaaccaagatggcccagacatgcggcttcgacaccctcgactccctcatcgacgccaccgtccccaaatcaatccgtctgagcgacatgtcgttcagcgtcttcaacgaggggctaacggagtccgaaatgatgtcgcacatgaacagcctagcgtcgaagaacaagtgcttcaagtcgtacatcgggatgggatactacaacacgcacgtgccgcccgtgatccttcgcaacatcatggagaaccccgcgtggtacactcagtatactccttaccaggccgagatatctcagggccgtctcgagtccctcatgaatttccaaaccgtgatctcagatctctccgctcttccaatgtccaacgcttcgttactcgacgaaggaactgcggccgctgaagcaatgtccatgtgtaacaacattcacaagggaaaaagaaagacttttatcattgccaataattgtcaccctcaaaccgttgatgtttgcgtcaccagagctgctggttttggtattaaggttgttaccgtggatgttaaggatgtggattataaatccggtgatgtttgtggggtgcttgttcagtatccggggactgagggtgaggttttggactacggggagtttgtgaaggaggctcatgcgtatggagtcaaggttgttatggcgacggatttgttggctctgactgtgctgaagcctccaggggaaatgggggtggatattgttgttgggtctgctcagaggtttggggttcccatggggtatgggggtccacacgccgcgttcctcgccacgtcgcaagagtataagaggatgatgcctgggaggatcattggggtaagtgttgattctggtggaaagccagctttgagaatggcaatgcaaactagggagcaacatatccggagggacaaggccaccagcaacatttgcactgctcag

SEQ ID NO: 84313 - DNA, 523 bp, Glycine max
  Peptide Sequence Number=SeqID_201091
atggaatttgagaatggtgtgtatttagggggaggtgacccttcctttgtagtacagctttgggtcttgagaagtgttgttccttgtaacgacttaaccccagatgggacaagcaaaatgaaaaaggctataagatcatccctcatccctcacggtggtgctgttacggtggccggtgacgtggaggccgaccagggattcgaggccgccgatgcaggtgccgcctataaaggccgagggggcgctggtgtcggggagggcggcgatctcctggtcgtccaattcgatgacggtggggtggacgccgatggtggcgaggagcttcttcatgacgtggcacatgcagcaggaggatcgggtgaagatgatgaccggcgaggaggaggagttgctcatagtgggactcagctccagctgccctacgacgtcgttttggaagcagcctatgcctatgcctatgccttgcatcccctcctcagtactgttcattctctgttgttgctggtgcagcagaagaaagaga

SEQ ID NO: 84314 - DNA, 954 bp, Glycine max
  Peptide Sequence Number=SeqID_201092
atgacctatttttttcaacaggatctatacaaaagcatgctaagaggtggaaactctagtgacaatcttttgccaggtgccactgctaattttgctgcgggggctgctgccggctgtaccacgcttgtgatggtatacccccttgacatagcacacacgcgccttgccgccgacattggaaggagagaagtgcgccaatttcgaggcatttaccatttcttggctaccatattccacaaggatggcgttcgggggatctacaagggccttcctgcatctctacatgggatggtggtacacaggggcctttattttggaggctttgataccatgaaagagatcatgtctgaagaatcaaaacccgagttggcattgtggaagcgttgggtggtagctcaggcagtcacaacctctgctggcttgatatcttatccgttagacacggtccgtaggaggatgatgatgcagtctggcattgaacagccagtgtacaatagcaccctggactgctggaggaagatctatagaacagaagggttggcttcattttaccgtggtgcagtttctaatgtgtttaggagcacaggagcagcagctatcttagtcttgtatgatgaggcaatggaagatcagaaattcgatatgatgaaaggggattttgattgccaagaaagaattggtgaaataagaaccaaaaagctttgtaaagtgttgaactgcaaagtgagagagcaaccacacgtatgtggctcgaaaatagctgggcagaaggcaattggattggataggagcatgaagtctagcaaccgaatggaagagcttatagacataaataacagcaaagatgattctatattatcgcttgaaaatgttaatttaaccattttctgtttaagttgtaatttagtcaaaactagaaggagatggaatgtaccgaaaaagtatatggggtag

SEQ ID NO: 84315 - DNA, 366 bp, Glycine max
  Peptide Sequence Number=SeqID_201093
atggtattcatggattatttggaatggttgcttccaattccaagtgtcccttctgcttcagcaatgttcaccctgcttgctttaataggaggattgttggtttatctgtatgcaccctattggggtgtaaggaaggttccaggcccaccatctctgccccttgtgggacaccttcctttgttggctaagtatggtcctgatgtgttctcagtccttgccaaacaatatggtccgatttacaggaaaaaggttgttagtcttgattggatatcgatctttttgtttttatgtcctctcaaatgcctcaaactcctcttgaagaatgatatgatcttaggcagaatcacgatggcagataaattttga

SEQ ID NO: 84316 - DNA, 756 bp, Glycine max
  Peptide Sequence Number=SeqID_201094
gagaggcattcaggttgtggaggacgatggtgtctgggggatggaggaggaggtgctcgcgctagttacagacgttgtcgatttggaacccgaagaagagggccaaccagtccagaaggtggtcagacatggaggtggtcgaatgggtgggggtaatcgaacgctgccgccggagggaggtgggggaaaaggcagagaaagggattcacaatggtctatcatgcgaaacactatattatcaatgtaccagccatcatacttgtccagattagtgccaacaatgcagtccttcatagaatccgcgacccaaaacctcgactctcaaaaagaagacattatattttccaacttgtccctaagactagcaactgacgtgattggacatgcagcatttggtgttaactttggcctctctagtccccattcagtttgtgattccatcaagaatgttaatgttaacaataacaataacaatgcaagtgctagtagtagtaatagtaatgataatgaagtatcagatttcatcaaccaacacatatactctacaacacagcttaagatggacttgtctggttccttgtccattatcttgggtctgcttttgccaatacttcaagagccatttaggcagattctgaagagaattcctggcaccatggactggaagattgagcataccaaccagaaactaagtggtcgtcttgatgagatagtggagaagagaatgaaagacaagacacgaattcgaagatttct

SEQ ID NO: 84317 - DNA, 1035 bp, Glycine max
  Peptide Sequence Number=SeqID_201095
atggattcttcacaagggtctaccattgctggtttcgtggacaatgcatccattaagagaaatgagtctagttttgatggcgttcccgtgtatgttaaggaactaattgccggaggctttgctggtatcttggatctagaatcttctaggaacacaagggaagggggagagaattttaagtataatacttcatttatgatgtcgttgctttcgttgcaacttcagaatgctcttgagtgggtgtatcttacaaggacaccaggatttcattctcttggggtgtatcaatctatgaataagttactaaagcatgaaggttttctaggattatataagggaaatggagctagtgttatccgcattgttccgtatgcagccttgcattttatgacatatgagcgctacaaaagttggatcttgaataattatcctgtgttaggctctgctgcaggaggaacttcagttttatgtacctaccccttggatcttgctcgtaccaaacttgcttaccaggtggctgacacaagaggacttatcaaagatggtatgaaaggagttcaacctgcacataatggcattaaaggcgtgcttacaagtgtctataaggaagggggagttcgtggactttataggggtgcaggaccaacccttactggaattcttccatatgctggtttaaagttctacatgtatgagaaattgaagactcatgttcctgaagaacatcaaaagtccattatgatgcgtctttcttgtggagctctagctggattgtttgggcagactttaacataccctttagatgttgtcaagagacagatgcaggttggcagcctgcaaaatgctgcccatgaggatgtcagatacaaaaatacaattgatggacttaggactattgtttgtaatcaaggatggaagcagctgtttcatggcattgttccttcagctgcaattagtttcaccacatacgacatggtgaagtcttggcttggcataccacctcaacaaaagtctcaatcagtttcggcagcatga

SEQ ID NO: 84318 - DNA, 567 bp, Glycine max
  Peptide Sequence Number=SeqID_201096
atgggtttggtccagtggatcagataccaacttctcaagatcttcatgacaagtttccttatcttgatcaggtttgttcaaaatgaacacaaaatcttagacaagcttgatgttccaacatgcaagggcagagtgatcaaagaggccatgaggttttacactgtctccccattagttgcaagagaaacatcaaatgaagtagagattgggggctatcttcttccaaaggggacttgggtctggttagcacttggagttccagcaaaagaccccagaaactttcctgagccagacaagttcaaaccggagaggtttgaccccaactttgaagaaatgaaacgaagacatccttatgcttttataccatttggaattggtcctcgggcatgcattggtagacaattttccctgcaagagatcaagctttctctgattcatttatatcgaaaatacttgtttcggcattctcccaatatggaaaaccccttagaactccaatatgggatagtcctcaacttcaagcatggggtcaagctcagagccataaaaagaaaagaggcttgctaa

SEQ ID NO: 84319 - DNA, 633 bp, Glycine max
  Peptide Sequence Number=SeqID_201097
atgtgggaatcaattgttttgacggtggttgccactgccggcaacaacatcggcaaaatccttcagaagaagggcactgtcataagggcatatgctttgaacaaaacctggctcataggttttgtaatggatatatttggggcactgttgatgttaagggcattagctcttgctcctgtctccgtcatccaaccagtttctggctgtggattggcaattctctcagtcttttctcatttttatctcaaggaagttatgaatattgttgattgggtgggcattaccttggcaggttttggcacaataggagttggtgctggaggtgaggagcaagaggctgctgctctatctatatttcacataccgtggctggcatttgttgttttcatcttgtttgtagaaacaattgtacagataatgcttaatggatggcttcgcatattcaaacgcaatcgaagagaacaagagatggatggcatctgtaatatcaaagatggggtttctgttcttggagcaaggcttccccaagctgttggttcctatttgcatcatcataagtgtctgttcaagtggtacaggcttttactaccaggtattctgaaggcgtctttcatgccatttacttttgtgtga

SEQ ID NO: 84320 - DNA, 303 bp, Glycine max
  Peptide Sequence Number=SeqID_201098
atgaaaaatagtgagtttgtgagaggttattgtggggttagggtttctgaaactcgaagggttgtggttgtggttgtggttgtggctgtggctgtggctgtgagaggaggacgtaacagagaaggcgtcggagagagttcaaccctcttatgttgcatttggcattttgttttggttgcaagagagaaaaaggaaaacaaaagccagaaaacaacaaagacacctaatctcctcgagggaaacaagtacccatctcatccgcaaacaacaaatctctcaagccatccggaatgttttgaatga

SEQ ID NO: 84321 - DNA, 381 bp, Glycine max
  Peptide Sequence Number=SeqID_201099
atggaagagagggaaacttgtgtgcaaaaaggtgcaacaagtattctttgcataaattggcatcagaatcaatcttccaagactcaagtctctccacgaccatttgttgcatccggggtggagaagccttctctcatcgccaacagacttatggagagagatgaaggggagtgtttttatgattgtctattagcaaataagggaggtgcaaatagtaatatccgaaaaagaagtcgctttatctgttgctgccgtgggttattgaaaaaggttcggaattcgtggcagataaattatcttacggggaatcctttgtccgagtcaacagcaaaatcctcaagaattttaaaagagtacatcgtagacaatggaaaattctaa

SEQ ID NO: 84322 - DNA, 333 bp, Glycine max
  Peptide Sequence Number=SeqID_201100
atgaagttgtggctgtttacggatcacttgatccataagcctcttacggatcaagttgatccggaagagtcttacggatcaagcaacttcccgatggcggtttccgccatcgccggcaacaatggtggaagaagaagaaaggcgaaggagaaacgtacctcgaagaagaagcagaaactcgaagaagaagcagcaacgcaaagaagaagcttccacttgatcccgacaacaatggcggcaacgaagatgaggaagaagcagaaacgcgaagaagaagaccgaagaagaagaggcagcgcgaagaagaagaagaccgaagaagatgcagaatga

SEQ ID NO: 84323 - DNA, 942 bp, Glycine max
  misc_feature (83)..(83): n is a, c, g, or t
  misc_feature (151)..(151): n is a, c, g, or t
  Peptide Sequence Number=SeqID_201101
atggatcgccgcgctctcaccggcgcgccgagggatgtctggaagccgcggtggactacgcgaagagccgcacgatcttcggncgctgcgctcagcacgaggcagaacgcccagttcaccctcgcgcgcatgcgccccgggtgcacaccgnccgcctggcatggcaccacgccgcccggttgcgggacgcgggaagccgttcgcggaagccgccgccgtcgccaagctcgtcgccggagaggccgcgatggacaatgccagggacgcgacccagatcttcggcgggaacggcttcatgaacgagttccccgtcgcgcgtcactaccgggactcgaagatcctggagatcggcgagggcaccaccgaggtgcagctgctcgtgatcgcccgtggactcgggctggccgggtagcgttgccgcatgccgggccggatacgaccgaaggagtcgaagtgagcacacgtgacatcgtgcagcgggggctgtattacgaggagttcgagatcgacacccgctatctgcatcgaccaggtcgcacggcgaccgaagccgacaacgtgctcttcacgacgctcaccatgaacacccaggcgctgcatctggatgcggctttcgcggacgcacaggaacccttccgctcgcggctgatgaactccatgtggaccctgtcgacgatggtcggcgcatccgtcgcccagctcacccagggcactctcgtcgcccagctcgggttcggcgagatcgcgttcccgcatcccctgttcgccggcgacaccctctataccgacagcaccatcgtcgagaagaggctctcggcgtcccgaccgggacagggcatcctgacgatcgcgcacaccggacgcaaccaggacgacacggtcgtcgcgacggccgtgcgctccgtgctcgtgcactgcctcccggaaggatcggcgcgatga

SEQ ID NO: 84324 - DNA, 1656 bp, Glycine max
  Peptide Sequence Number=SeqID_201102
atgggcgcgttgccaagcgtggtgattggcctgatcgctggcgtgtggctggcgccgcacatcagtcgcgcgctgcccggcgtgatgctgctgccgctggtgctggccgccacgctgctggtgtgcggcgtgctcagtccgcgtttgccggcgcgctggcggcggcccggttttgaagtgctgctgctgatgccgctgctgttactggtgacgttactgacgctgtggctgccgacactgtggtggccgcagatgggcgaacagctggcgcactatgagcagcgtaacctgctggtggcggcgctggcgatgggctttgcgctggtgccgctgatctttaccctggcggaagatgcgctgtttagcgtgccggtggcactggggcagggctcgctggcgctgggcgcgacaccgtggcaaaccctgacgcgcgtggtgctgccgggcgcgtcggcaggtatttttgctgcattgatgatcggctttggtcgtgcggtgggcgaaaccatgattgtactgatggccaccggcaacacgccgggcgtcagggcgttctggccgcagccggtcgatcagtatcagttccagccgccgcagggggcaccgctgagggtgctgggtgaaacgctggatcgccagcagcagggcgatcgctggcgctacgtagtgaaaaccggtaaccgcgattttgccgcgccggatttccgcgtcatcgttagtcagggcgaagcgcaaacccgacgcccggcagaagcgctggtgctacagcgacgcagtggcggcaatgcctacggctggctggttgagctgcgtgaggacaacgaggtgctgaccgcgcgcgaccgcgatgcactgctgcagcagcggctgaagcaggtgcatgagcagctgcgccaggcgagcaacatccggcgtattgaaatggcgcgccttaacgcccagctggagagtctgcaacagcaggctgacgagcagcggcgcggtggtcacttcagcctgcaggatcagtcagaactggatgccaacagcgcggcgctgcataaacgcttcggcgcgctggcgcagcagctggcgcatctgcagcatgaaagccagcgcgatacgctggtgctgcgcgacgtgcagggcgacgatcatctgattccgctggcgcaggtggtggccgcctgtgattgtcatgccgctgggcgtggtggccgccgtctggctgcacgaatacgccgggcgcaacgcactcacccggctggtgcgcattgcggtggtgaatctggcgggcgtgccgtcgattgtgtatggcgtgtttggcctcggcttttttgtctggctgattggcggcaccctcgatcagctgttcttctcccgctcgctgcccaatcctaccttcggcacgcctggcctgctgtgggcggcgctgacgctggcgctgctgacgctgccggtagtgattgtcgccaccgaagaggggctgtcgcgtattccggacaatctgcgtcagggctcgctggcgctgggcgcaacccaggcagaaaccctgtggcgcgtggtgctgccgctggcggtaccggcgatgctcaccggcctgattctggcggtggcgcgcgccgccggcgaaaccgcaccgctgatgctggtgggcgtggtcaaaatggtgcctga

SEQ ID NO: 84325 - DNA, 345 bp, Glycine max
  Peptide Sequence Number=SeqID_201103
cagcagcaacaccggcgagataaaggcaaagctggagccaagataggccgggattttgcctttacagataaacagatacagcagcgtgccgacgccgttgaacagcagcacggtggccgggttgatgtggaacagaattggcaccagcacggtggcgccgaacatggcgaacaggtgctgcaggctgagcggaatggtttgaagaagcggtgggcgttcgctaacgcctatggctctgcgagtcatcatttatcccctatacgtttatttttatgctcgttcgtcaacgccgcaccttatcgtagtggcgcaattcattgcgccttgtccggatgggcaccatag

SEQ ID NO: 84326 - DNA, 1126 bp, Glycine max
  Peptide Sequence Number=SeqID_201104
atgggtggactgggtggctttggcgcgctgtgtgcgctgccgcagaaataccgcgagccggtgctggtctccggaactgatggcgtcggcaccaagctgcgtctggcgatggatctcaaacgccacgacagcatcggcatcgatctggtcgcgatgtgcgtgaacgatctggtggtacagggcgctgagccgctgttcttcctcgactattacgccaccggcaagctggatgtggataccgcctccgcggtgatcaccggtatcgccgaaggctgtctgcagtcgggctgtgcgctggtcggcggtgaaaccgctgaaatgccgggcatgtatcacggcgaagattacgacgtggccggtttctgcgtcggcgtggtggaaaagtctgagatcatcgacggcagcaaagtgcaggatggcgacgtgctgatcgcgctgggctccagcggtccgcactctaacggctactcgctggtgcgtaaaattcttgaagtcagccagaccgatcccaccaccaaacagctggaaggcaaaccgctggccgatcacctgctggcgccgacccgcatctacgtgaaaaatatcctcagcctgattgagcaggtggacgtgcatgccattgctcacctgaccggcggcggcttctgggaaaacattccgcgcgtcctgccggataacacccaggcggtgattgacgagaaaagctggcagtggccggcggtattcagctggctgcagcaggccggtaacgtcagccgtcacgagatgtaccgcacctttaactgcggcgtgggcatggtgattgcgctgagcccggccgatgccgacaaagcggtacagctgatgaccgcggctggcgagcaggcgtggaaaattggcgtaattaacgcgtctgatgccgaagagcgtgtgtccatcctcgacgcctgcgagagcgggcgtatcaacggcagcgtggctgccgttttcagtaataaagcctcggcctatggtctgacgcgggcgcagcaggccagcgtgcctgctcacgcgctgtccgcgcaggatttcaccgaccgcgacgcctttgaccgccagctgatgcagcagatcgacgcttatgcgccggatctggtggtgctggccg

SEQ ID NO: 84327 - DNA, 186 bp, Glycine max
  Peptide Sequence Number=SeqID_201105
atggagagcgtggagcctgccgtggtgcccatgtcgggcaaattgtcgctcagatcggcgcggacaccgaccgcaggcgtgagcagcagcgcaggaataagggccgccagcactgattttttcaaccggaaagtcatgccaatgttctgtggcggcgtttccttttcagccgcggctctatcttaa

SEQ ID NO: 84328 - DNA, 1491 bp, Glycine max
  Peptide Sequence Number=SeqID_201106
atgaatggtcaggttttgctcactggtcaactggcgacgcgcgatgacagtattaacccgcacgatgaggcgctgtcatttgctgtgcatccctctgcctgtgcatgccggagagtttctatgcgttctgttgtttcctatgccctgattgccatcgtgggtgggatggtcggtgccgccgtaatcaaaagcgatgacctgtatcagcgcatcgcgggccatttttccgctgaacctgccgatccggacgggttctggagcacgccggcggtcgcgggctacggcaaaattcattatgaagccgacgccgcgtttaaaccggcggtggggctgagcaacaaagtggtgttccagctgacccgcaatgaaggcgatatcaaacggcctaacctcgggctggagcgcgtggcgcgcgtggtcaatctgtacatcgccgctggcgtaccggccgaacagctgcagtttgtggtgtcgatgaccggcgatgccacgcccgccacgctggataacgcgcattttaagcagttttacggcgtcgataaccccaacctcgcgctgattggcgcgctgaacaagctgggcgtcaaagtctcggtgtgcgatcagtcggtggcgttccatcactatccgcgcgactggatcgaccggagaagtgtcatgcgtccagcatcctatattgttatcgccgcgctggcgggctttgtcggtggaaatatgctgcagctgccggaactggtggataaagtcagcgggaaattcgctgaccagaaaaccgaaccggcggatttctggagcacgccggcgattgccggttacggtaaaattcactttgttaacacgccggattacaacccggccaacacgcccgggctgagcaataagattgtgtttcagatcaaccgcagcgaaggggatatccatcagccgaacctcggccttgagcgcgtggcacgcgtcactaacctctattacgcggccggcgtgccgcttaatcagctcaactttgtggtgtcgatcaacagcgatgcggtgccggccgcgctcaataacgatcagttccgtaaagcatacggcagcgataaccctaacctgaagctgattgatgagctgaagaaagccggggtgaaagtgaccatttgcgaccagtcggtggccttccatcagctagagcgcgactggattgatacccgcgtcacgcatacgctctccagcggcaccaccgtcgcgtcgctgcaaaacgaagggctgctgtcatcttttcgtcatcccttcgcgatgtcactgtcacagttcgccgttagtttaggcgccaatgagatcgatctcatcggcactttacgaggcgaacatgtccgacttactcacggtggcaaagctggcaggcgtttcacgcgccacggccgcgcgcgccttttccgatccccatctgctgcggaacgacacgctggagagagtgctggcggcgtcggagcagctcggctttcgtcctaa

SEQ ID NO: 84329 - DNA, 215 bp, Glycine max
  Peptide Sequence Number=SeqID_201107
tggacccggagaagtccaacagggtcttggggtttctagctctgattacgggcttttgtcagttctacggagtgcctgtcacccccggtaaggtcatcaggtcccctactaatcaagctttcatcaagaattcatctcagctcatccacaataaggttagagcattgcctacgacacatggccgaccaataggcgaccatagtccaaagccaaag

SEQ ID NO: 84330 - DNA, 285 bp, Glycine max
  Peptide Sequence Number=SeqID_201108
atggcgaagggcacgatggacgtggcagctttggcaaagaagttgtcggagaagtttaagaggaagattgaggttgtccttcccaagaaggagaaagagaaggggaaggaaaaggaaagtgagaaagagggtggtggcaaaggagagaatgactcagccaaaaagaagaaaatgggtggcaatggtggtggccgcgaaggacacaatgataagggtaatgagggtggtggtggtaatggccagaggaaaacggagcagatcgaacattgtcaactattatggtga

SEQ ID NO: 84331 - DNA, 351 bp, Glycine max
  Peptide Sequence Number=SeqID_201109
atgccttatgaatcgtcctgtgctcatgccacggatgcctgggaggggcagcatgacgattccgagaagagggaacgggttgtctactacttgagcaaaaagttcaccgcttgtgagatgaattactctttgcttggaaggatgtgttgtgccttggtgtgggcagcccattgtctaaggcagtacatgctaagccacaccacttggttggcaataaagggaagcgccttggcagactatctagctcaggagcccctcaatgactaccaacccaggcatccggaattcccggatgaggacatcatggccttgtttgaggaagaagtggaggatgaagatagggataagtaa

SEQ ID NO: 84332 - DNA, 701 bp, Glycine max
  misc_feature (5)..(5): n is a, c, g, or t
  Peptide Sequence Number=SeqID_201110
ggggncggagcatatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccgtggtggcggtggcggtggcggaggtgaaagctggggagttggtgggtgtgagtgcttgtgtattaggtgacatggcttcaaggcctaattttgggttgaatgaacttgactttgtcttttcaactttggtggttggggcaatcctcaatttcactctcatgtatctattggcacctaccatgacatcatcagcagcatcaaatctacccgccctatttgcttcatgccccaagagtcacatgtttgagcctggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 84333 - DNA, 219 bp, Glycine max
  Peptide Sequence Number=SeqID_201111
atgtcaagccatcaggaacgtagagagaggcataaagaaaggtctaaagaagtgaaatcttatttttatcctcttccaaggaaatcaaagcataccggagagaagtcttcctatagagaaaggtacaagtcttcctacggagagaggtacccagtatctgtttatttgttatttgtgagaatcatagatttcaagatcctgttggtttcctataattga

SEQ ID NO: 84334 - DNA, 165 bp, Glycine max
  Peptide Sequence Number=SeqID_201112
atggtgatgatggtggttgacaatagtgacaatagtgttgatggtatctataacagcgatagtggtgcagtgctagcagcagcgacaatggcaacgactgttgtcaaatacatccgccatggttattttttggccaacatctgttactttctttttcaacattga

SEQ ID NO: 84335 - DNA, 578 bp, Glycine max
  misc_feature (52)..(52): n is a, c, g, or t
  Peptide Sequence Number=SeqID_201113
cgaggaaccggaagagcgcccaatacgcaaaccgcctctccccgcgcgttgnccgattcattaatgcagctggcacgacaggtttcccgactggaaagcggccagtgagcgcaacgcaattaatctatgaccatgattacgaattcgagctcggtacccttgtgaacgcctcagattcgggcttctatgggattcttctcagcggtgcctcttcgtggcacaagctctgcatatctcgtgggagacggagatccaacaagagcacaagatcgaagaagtcgtactgcgatgtgcgacagtggcaaatgtgggagaacctcgtggtgaacataagggacttcacgcggcaagggatgagatatcgaagttacattaatgacaacctagctatatccattgattactccataacgacaagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 84336 - DNA, 324 bp, Glycine max
  Peptide Sequence Number=SeqID_201114
atgccgatctccctctacggaagtatcagttggtctgtgtcgtcccgacatagggatcgcgaccacaaggcaccctgtggacctggaggagtccgacagggccctggggtttccagctctggttacgggcctctgtcagtcctacaggatgcccatacccccagtaaggtcatgccatcgtggcatagggatcacgcccacaagacacctagtggacccggagaagtccaacagggccctggggtttccagctctggttacgggcctctgttagtactacagggtgcccgttccccccagcaaggtcacgccatcatgacatag

SEQ ID NO: 84337 - DNA, 755 bp, Glycine max
  misc_feature (10)..(10): n is a, c, g, or t
  Peptide Sequence Number=SeqID_201115
cggatgccgngagcagacaagcccgtcagggcgcgtcagcgggtgttgccgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccaaagactggctgagagaataacatccttgtcgagattcttaccaaggattgtcaaaaaggctaggctcattatgaacctccttataaaggccaaaatctttgtatgggatgaagactgcaaagaggtctttcggcaactaaaagaaacactggcgacaccgcccattctatcaaagctagacaccaccaagaaattgatcgtttatctttcaatcatggtcaaggccataagtttggttctggttcaaaaagaagggataggggcacaagttttggccgacttcattaatgaattccatcccccaccactacattttgagcaagaatggtggaccatgcgtgtgggcgacttctctaacggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcaagctcactcaaaggcg

SEQ ID NO: 84338 - DNA, 540 bp, Glycine max
  Peptide Sequence Number=SeqID_201116
atgaacaaggccaaggatcccaagtgccctacgctgcagccatatctgcaacataatgtgtccagaacgacatccataagtgtggcagcaggcgtatcctcaggagttcctctggtgtctcacccggtgttgcctccggctctggctgcggctcctgggctgcataagccacggtggaggctctgtagcatcaacatgatcgcgtctgtgctcaaagtggaggtgccaaagggcgctgtgggaactagagcaggtgcaggtgcaggtgcaggtgcaggtgttggtgctagtgctgaagtagatgctggggtagaagtaggagcagaggtggaagcatcagaaggttcccaagccctagtcttgtgggtccccgaaaaagtgatcatgggatcatccgggttccagcaattctttcgaataaaagccaaattaatggcagggcttagagactcaaaggtgagagagtctgggaccactcctctggcgatgcataaggcaatgatcatggcagggaagccaagtcgagaggagttggactag

SEQ ID NO: 84339 - DNA, 441 bp, Glycine max
  Peptide Sequence Number=SeqID_201117
atgagaaaaaagacggataataaggaagagaaaaagactaagagtgagttggccagagagaaaaataaggaggctattcccagtacagggaaggtggctagggaatggcctccagaaagagaaaaacatccacttcccgacctcaagaaccataagacactgcaagattcgtatctgaggttgcttgggagcgatatgaacagatatgatgagtaccaaaaggagcttgagaggaggaggtggcataaggccttgaccaggcagcctgataaccacatagatatggccttggtcaaggagttctatgtgaatttatatgatcctgaagacaagtcccctaggcaagtgcggggaaaattgattaagtttgatgttaagacgcttaacacattcctggagacccccgtggttttggagctaggggagaagtattcagcttag

SEQ ID NO: 84340 - DNA, 522 bp, Glycine max
  Peptide Sequence Number=SeqID_201118
atgctccaaccatatgagatcagcataggcttaaaggagcactcaaacccggtgacccccaaggcctacactccgaagagtccgtcagggcctctccctcctgattcagttattcctccgactgctccgatagaattcccaaacgtcagagagacggagaagagattgaaacctccacttataatgtcttcatgcgattcctttttctccctccatgaatgttatctcgcaaatcccaacggtggaagcttttaccaagacagctctgggtttctgcgggaaagaaaaagactacaatgcgaagggtgtttctctcagttcagagatgatatcgaaattcccaacggtgagaattctcggaattctgttgcgaacatgatactcaaatttcacgacgatacaacggtgaacgggttcgagatcgtcgtttttctgagactggtttggtgggctgcgggaaaaagaaagggttttgagaggagaaggggaaaaacgaaaatgaggccaaaaggaggcagctga

SEQ ID NO: 84341 - DNA, 961 bp, Glycine max
  Peptide Sequence Number=SeqID_201119
atgggagaaaatgaagaagctacgacgactgacatgttgcagaggcttcactttctgaagcagccgttaaacatggagcaacttagcatcccgcaattcaacccctcgcaaatgcgcgcgaggcatcatcatcagaatcagaaccagttcgacggtgggaacagtaacaagcgcgccggtataccaccctcgcacccacaccagatcccacccatttcgccgtactctcagatcccattgtcgcgtcagcacagcaacatcaacagcaacagcaacatttcccctacacccacccacacccgatcactctcgcagccctcgtttttctccctcgactccctccctccacttagcccctctcccttccgtgactcctcctcgacttccgtgtccgaagctgctgacgtgtccatggaagatcgcgacgtgagttctcattccctgttgccaccctcacctttctccagaacactcaacaccaacaacagtaatttaccattacctcctcggaaagcgcatagacgctctaacagtgatattccgtttgggttttccaccgttttgcaatcttctccgccgcttatccctcttcggaaccccgtttcagcgaaacctgctcagttggtgaaacgggaaacaccgtgggacagggttgttgagcataatactaatactaataataataataatgtagagggatccggggagaagaaatctcctgaaggggaagtggtggatgatcttttctctgcttacatgaatttggatagctttgatgctttgaactcttctggaaccgatgataaaaatggaggcgaaaatcgcgatgatttggatagtagagccagtggaactaagaccaatggtggagacagtagtgataatgaagctgagagtagtgttaatgagagtgggcatggagggagtgagaagagggaagggatgaaaaggagtgctgggg

SEQ ID NO: 84342 - DNA, 1758 bp, Glycine max
  Peptide Sequence Number=SeqID_201120
gaaacagggtacctcacggaatgcggtaaacctaggaaaaaacaaacccctacaaatgatgttcaacatagtctgaagcaagagattctacagttagagaaaaggctacaagaccaatttgaggttagatgcacgttagaaaaggcacttggatacaggcctacatctcttgttaattcaaatgaaacgatactgcccaagccaacgtccaaattaattaaagaaattgcagtgttagagttagaagttatgcatttggaacaatatcttctctccttgtatcgtaaagcatttgatcaacaattaccctctgtagctccattcaccaaggaggaaaaagtgaagtcgcttccatcaacacctagagcaagattcgttgaagtttctaagcctgaggtgttaatcaaaagaggaagctctgcagtacaatctattgaccatgagcttgatactatgcaaaaggaatataatggatatgaacctgagacactagggaaagaatacaatgtacatcaaccagaaggaaagcatttagacgcaggtgtatatcgttgccactcctcattatcccagtgtacaacatttacaacaagagcatctgctccagtggcagaagtattaactgaatctcttcgtgcctgtcattcccaaccattgttcatgatggagtatgcccaaaatgttgatgcttcatcaagaataatcagcctggcggaacatcttggtacccgaatatctgatcatattccagatacaccaaataggctttctgaggatatggtcaaatgtatatcagctatatattgcaaactcgcggatccatctatgacaaatccaggcctttcatctcccagttcatccttgtcttcaactagtgccttttctattggagatcaaggagacatgtggagtccaggtttgaggaataattcctcattcgatgtacggttagacaatcctttccatgtggaaggactcaaggagtttagtggaccatacagcaccatggttgaggtatcatggatttacagagaaaatcagaaattgggtgatactgagcagttactcaagaatttcagatcacttatttctcaattagaagaagtagatcctgggaagttgaaacatgaggagaagttagctttctggatcaacatacacaatgctttggtgatgcatgcatttttggcttatggaattccacaaaacaatgtgaaaagggtcttccttctgttaaaggctgcatataacattgggggtcatacaatcagtgcagacacaatacagaacactatacttgggtgccggttgcctcgccctgggcagtggttccgcttgttcttttctccaaggacaaaattcaaagctggagatggacgacgagcatacccgatcgagcgtcctgagcctcttctactctttgcactctgttcaggaaaccattctgaccctgcggtacgtgtatatacacccaagagagtgcttcaagaactagaagttgcaaaggaagagtacattcgagctacctttggggtacgcaaggaccagaaaatactttttcccaagcttgtagagtctttcgcgaaggactcgggtttgtgctctgctggtaccatggagatgattcaacagtctctacctgaatctctaagaaagaatgttaagaaatgtgaccttgcaaaacccaagaagaacatagaatggattccacataactttacttttcgatacctcattcctaaggagctgataaaataa

SEQ ID NO: 84343 - DNA, 144 bp, Glycine max
  Peptide Sequence Number=SeqID_201121
atggcaactactacatacaaggctcttttagggtggtacgtagctggtttgaggatgacagctactcttcgtgatggcaagggcgacacagtgaggatgacagttactcttcgtgtctcagcggcgacgagggagagtgagtga

SEQ ID NO: 84344 - DNA, 2715 bp, Glycine max
  Peptide Sequence Number=SeqID_201122
atgggaattgttggctttgaaattaatgcgaattctgcttctgcttctgctttgcattattatggtgctaattcgttctcttcccacacggttcctttttctctgagaccctttttcgggaatgctctgaacgtgaacacgagggttgcagggaagattcgggcctctcatgctagaaagcccaaattcggagcagttattgttgcttcactgagtggtggctctaataatgctgggttgattagtgacgctgttcttcccaaagactcagaatttaagccatccttcgacgaatatttgaaggccatgtctgtcagaactgtaagggtcaagaagcgtgctgccactactcaaaaacacaagaagacggaaaacggtgataataataaaattgatagagaagatgaagttggtgtgtacaaagaaggttgctccaccagaagtaataataatggtaaggtcagaagaacagcaactaaaggattcacaagtgaaaatgatggcaaccttgatgatgtaaaggcaaagcagaagaaaagtggagcaaatgtaagacaaaatgggccgttgaaacgccgaagtcggagtttagagccagaatcatatgatggcagtgagattggcaaaagtggaagtggaaggatgagcaagagcatagttaggtctagtttgaatggtagccatgggagtgtcagagagagaggagtgactcatgatttgtattcttcaaagatgttgggagaaaagattgttagtaacagacaaagggattacaatacacagggtaaacccccccctggtggaaataaaattgttgctaggcaacaacaagttcaggatagagggcttgatagaaaaagacatactgaaaatggaagtttggcttatagaaatggaagccgtaagcgtttcattgataggggttatgattctgacaatttggaggtcgaacgagcagcatttgagaatcttgaggacccaaacaatgttatcagaaagtcacagttttcacataaggaaatggaggagaaaatccaaaagctagccaattcgttaaatggtgcagatatcaatttacctgaatggatgttttctaagatgatcagaagtgcaaggcttaaatttaatgactatgccataacaaggattatcataatcttgggaaaactaggaaactggcggcgagtgatacaagtgattgaatggcttcaaaagcgtgaacgtttcaagtcccataaactaaggcatatatataccgctgctcttgatgcacttggaaagtcgaggagacctgtagaggcactaaatatatttcatgcaatgcagcaacaaatgtcctcatatcctgatttagtagcttatcatagtattgctgtgactcttgggcaagcagggcacatgaaggaactttttgatgtgattgatattatgcgatcaccacccaagaagaagttcaaaacagggatatttgagaactgggacccaaggctggaaccggatattgtagtctatcatgctgtccttaatgcttgtgttaggcggaaacaatgggaaggagccttttgggttttgcagcagttaaagaagcaaggacagccgccttctgccacaacttacggcctagttatggaggtgatgctttcatgtggcaagtataacttggttcatgaatttttcagaaaacttcagaagtctttcagtcccaattcattgacatatagagttcttgtaaatacactttggcaagagggaaaacctgatgaggctatactggctgtccaagaaatggaaagacgtggaattgtaggttctgcttctctttattatgatctagctcgatgcctcagtgcagcaggaagaagtcatgaggcactaaagcagatagacaagatatgtaaagttgcaaataaaccactggtagtgacctacactggcttgatgcaagcaagtctagacgctggaaacattcaagatggggcttatatttttgagaaaatgaaggaaatttgtgctccaaatctggttacttgtaacataattctgaaagcttacttggaacatggcatgtttcaagaagctaaagtgttgtttgagcagatgtcagaaaatgcaaatcgtctgaggggaaatactgattacaaaatgctggtggtaccagatacatactcattcaacaccatgctagatgcatgtgttgcagagaagagatgggattattttgatcatgtgtatcaaaggatgctgtaccatggttatcacttcaatccaaaacgtcatcttcgaatgatattggaggcttcaaaagctggaaaggaacggcctttggagataacatggaagcacttaaccgatacagatcgtattccacctgctcctctgatcaaggagaggttctgtgcaaagcttgagaaagatgactatgttgctgctctcacatgtatcatcaacaatccccctaaagacttgcagccattttccaaatcgtcttggttgaaactattcaaagaaaattctcagcgatttcagaaggatacgattgttggactaatgaacgaggccagcaatatagtttccaataatagttttccaaatccaacacttgagtatttaattcaatcatgcaaagaatttctttttgctactgtcctcagtacagctgacatggattcagggttctacttccatgcaagttccacaggaaacagtcccaaatag

SEQ ID NO: 84345 - DNA, 147 bp, Glycine max
  Peptide Sequence Number=SeqID_201123
atgactttggttttggatggctttttaggcagggggtttgaagggttggtgccaaggcacaagcgttctaagagctttcctgataagaaaagagacgaggatgataatccagataatcatcttgaggcctcagatcgaacaaagctg

SEQ ID NO: 84346 - DNA, 777 bp, Glycine max
  Peptide Sequence Number=SeqID_201124
atggatatatccctccgagattcaacaacttcgcattccaccttctccggaagcaatgtttcttcattaacggaaaacaattttattgctgctgctgttacagctggagtctgcctgatgagaaatgcatggaaagaggaccaacatccatcgttcatcaattttatctccactttcctctctgctaattcctttcgcctaaattttgtcccaatcgccccggattttatattcaattgtgggggtttgtctgtggccttcatttttgtgacaaactgggactgcaacaatgttgctccaatcttcaacagagttaagaaactgaagatgcaatttgcacgtttttacgtggttatcacactcccggcaaaagagcaatttgattcacttattcagtcatatttcaaatttgggatggtgattggcaagcctacatttgtgccagttcaggactcagagatggggtttgaaaagatggtaaaaatagctcattcttctggagtatacaagcaggagagaattggggaaaaattgaaagctgagaggaagcagttagtgcaaggaatgaacttttaccttaaggtgcttacatccatcccaggcattgacaatcacgatgcaaattcgcttagtcaagctattggttctgtccaagcaattgccaaggcgtcaaaagagcaaattctagagaacacagatctttctactgacaaggcagagatggtttcaaggtttctcagggacccaaagttttacttgtgtcccaagatcaactga

SEQ ID NO: 84347 - DNA, 174 bp, Glycine max
  Peptide Sequence Number=SeqID_201125
atgacgtttgaaagctggagattttgcagccagagaaagatcagtgttgcatttcatgaatccacttggaggagggttccaattcgtgccatgacaagtttctggagattacagcgtgtgcttggaccagcaggtggcattatttctccattcagaatattgctgccacgttaa

SEQ ID NO: 84348 - DNA, 447 bp, Glycine max
  Peptide Sequence Number=SeqID_201126
atgattgggctggctgtggagatgtttgagctaattgggctgactgaggagatgggtgagctaattgggtcggctgaggtgatggttgacttgtctaggctgacacatttgtttgaggagtggcttgattgtgaagatgatggatcacgtgaggagaaagtccatcatttaggaaatcataagtggaggaagttggacctcggtgatttgatgggtaacctagaaagacacaaggtgtggaacgaggttgggtgtggcaacattaaatgttgcctgctatggcttagatccaaggagaccaggttgttctggcctgagttgcattgggcctggcccaactatatgtgggatatggacatggcgacacaatccaaggagcaccttgctgccacacccactgttaaggagcctgccattgctgctgctgtccacggttaccaccgctaa

SEQ ID NO: 84349 - DNA, 611 bp, Glycine max
  Peptide Sequence Number=SeqID_201127
tgagttactgttccttctatgggaagaaggtggaccctgagccaggacgatgcaggaggactgatggaaaaaagtggaggtgctccaaggaagcatacccagactccaagtactgcgagcgccacatgcaccgtggccgcaaccgttcaagaaagcctgtggaatcacaaactatgactcactcatcttcaactgtcacatcactcactgtcactgggggtagtggtgccagcaaaggaactgtaaatttccaaaacctttctacaaatacctttggtaatctccagggtaccgattctggaactgaccacaccaattatcatctagattccattccctatgcgattccaagtaaagaatacagcttctggaagcaacaaggttctccaaatggagtcacagctggaaaacacatggcctttgatgtcaaccagagttgcctctttttctacgtcaaaatcaaggagtcatggtctggtctagaagatgagagatccaaccaaacagccttctccacaactcaactctcaatatccattcctatgtcttccaatttctctgcaacgagctctcagtccccacatggtgaagatgagattcaatttaggtaa

SEQ ID NO: 84350 - DNA, 2727 bp, Glycine max
  Peptide Sequence Number=SeqID_201128
atgggagctattgctggagaagagctgctgaaatgggagaagatgcaaggagtgagtagtcgcgaagagaagattctggtgtcaataagactgaggcctctgaatgagaaggaaattgctgctaatgaatcagcagactgggaatgcattaatgatactaccatcttgtaccggaacacactgcgtgagggttccacatttccaagcgcctacacatttgacagagtatttcggggtgattgtgtcacgaggcaggtatatgaggaaggagccaaagaagttgctctttcagttgtcagtggaattaactcaagtatttttgcatatgggcaaacaagtagtggaaagacatacacgatggttggaataactgaatacgctgttgcagatatttttgactatatagagaggcatgaagaaagagcatttatattgaagttctcagcaattgaaatttacaatgaagttgttagagacctcctcagcactgacaacaacactccacttagactacgtgatgatcctgagaaagggcccattttagagaaactcacagaggagactctacgggactgggagcatttaaaagagcttctagccttcagtgaagctcagagacaggtgggagagacatacctaaatgaaaagagttctagatctcaccaaatcatcagattgacttccattaatggagttgcaatctttcagacaatggagagttctgccagggaattcctgggcaaaggcaactcagccaccctaatagctagtgtgaatttagttgatttggcagggagtgagcgcgcatctcaggcatcatcagctgggatgagattaaaagaaggttgtcatataaaccggagcttactgactcttggaacagttattcgtaagcttagcaacggaagacatggacacatcaattacagagattccaagttgacacgcatactgcagccttgtttgggtggaaatgctagaacagctatcatttgcactttgagccctgcacgaagccatgttgagcaaaccagaaacacacttctttttgcttgttgtgcaaaagaagtgaccactaaagcacaggttaatgtcgtgatgtctgataaggcgctggttaagcatttgcaaaaagaggtggctagattggagagtgagttgaaaactcctggtcctgtaccctccaattgtgattatgcagcattgttgagaaagaaagatgtccagatagaaaagatggagaaggagattagggagctaactaagcaacgtgaccttgctcaatcaagggttgaggatttgcttcgcatggttggaaaggagcagatatctggaaaagctagcattaataatcatctgaatctgcaggaaggggaagatatctgggaagatgactgttcagtatcagagtcatcaagcatttgtggtcctcatcgtcctaatacacacattagagagttcaacaatcctcattataatgatgaagacagtgatcctgatgacgaccctgatgattattgcaaagaagttcgatgtgttgagaatggggagttagctttaccaatatctggagaggaaagtggaacaagccaagaaatatcttcacatttgaatgaagataccggagacagtcagatccaagaaaattcaacattgctggagcagagattgcatgttgtacagtcaaccattgattctcttgtatgtccttcccctgatgaacactctccacaggtcatgtcagaaaataataagaatcttagattaactagaagctggagttgtacggaacatcacatggctggttctcccaagtcaggcggaggagtacagaggactccagccaatggatatgaaaaaggattccctggaagaccagatggtttgcagagaaagtttcctccattaaattatgatggttcaacaagattgttaaggaatggttctcagtcttccatgggaagtctttctgtggatgatcttagagccagcagcatcagaacatctgctgatgaggatattactagcatccagacttttgttgctgggatgaaagaaatggtcaaacaagaatatgagaaacagcttgttgatggtcaggatcaggagacaggaagaaagaacgtgaaagatgtaggtgtggatccgatgttggaggcacctggaggaactccattagattggtctctgcaattcaagagacatcaaaaagagataattgaactgtggcaatcttgctgtgtaccattgacccacaggacctacttctttcttttgttcaggggtgatccatcagactccatttacatggaggtagaacttagaagattgtccttcctcaaagaatcattttctgatggaaacaagtctgtgagagatagtcagacaatcacactagcttcaagcgtgaaagcacttcggcgagaaagaggaatgcttgtgaagcttatgcagaggaggctttccgagaaggagagaagaaggctatacgaggagtgtggcattgcattggattcaaagcgcaggagggtacaactagcgaacagtttatggagcgaaaatgatatgaaccacgtaatgcaaagtgctacaatagttgccaagttagtgaggttttgggaacgaggcaaggccctcaaggagatgtttggccttagcttcacaccccaactcacagggcgaagatcctcttatccatggaaaaatagctcagcatctcttttatag

SEQ ID NO: 84351 - DNA, 342 bp, Glycine max
  Peptide Sequence Number=SeqID_201129
atgacgccggagaagcagatattgctggggcttttgcttgcgaagcatgtttcattagaatcagatgcaaacacgagcacaaacacaacaacctctctcacggtggaggatcggaccttgttggtaaaagaggcggtggcacaaggattgaagggggagaggagttttgcttcggttaatttgccattttcttcacggacaaacgataatagcaagccaccacgagcacaggctggtagttatacaacatgtggctgtgaatggatgaacggttactttcatattactactcaccttcgaatctttgtggttccagcatgctctatcatctacttttgttga

SEQ ID NO: 84352 - DNA, 381 bp, Glycine max
  Peptide Sequence Number=SeqID_201130
atggtcattttctggaactttcaagacctaaactctcctagggcagcagtttgcttgcctgggccatgggaaagcttcaaccttaagcaaccagctcgcctaggcgagatccagctcacctgggcaagatccagctcacctaggcgagctgataccttcaagcctaagcaactggcttgcatgggcgagcttcccctgcaccaaatggccttttcctataaatatccatgcaggggaagggtttcaagggttggaaaattgaggaaagaaaggaaaaacacaaagaggagaaagaaaagaagaaacaaagaaaagtcaaggagttgccaaatcaaaccgtggatcgtttcctacatttctcttgctagccttgtaccctaa

SEQ ID NO: 84353 - DNA, 360 bp, Glycine max
  Peptide Sequence Number=SeqID_201131
atggcaagtgcgttgggtagcagagttgaatctgttcgaaactctcacttactaagcttttcgctcaactccattagatccttgagttcttcttcttcatccgccgtttcttctgctcagaaccctaagactaagaaatcgaagcgaagaaagaagaacttgttcgatgtggctcagttcttacctaactggggaatcggctaccacatggccaagactcactggaatgaagtttcttacgaaatcactaaaatcaatctctacaaggatggaagacatggaaaagcatggggggttgcttttaaaaatggtactggtaatcatgctgcactgctattcttcaatgagattgtcggctag

SEQ ID NO: 84354 - DNA, 613 bp, Glycine max
  Peptide Sequence Number=SeqID_201132
atggttgatgtccataagttgatttgccaaacctgtaacaacgtgggtgttggtgatggttctgatggctttttctactgccttcgctgtggttctcaatgcgaggatgtgatggacaccgctgttgatgacgatgatctcttcaacaagagtgctgtctacttgcctagtcaccaacgccagcgatctgttgcaatcaaagccgagcccatctctcagtatgactccttttacgattcccactccaatttcattaggaatctgggtttagaagatgaaaatcctcaacgaaatgatcatgttcaagttaaaagagaggaggaatttgacgctgcccagtttgatgaggcaagtccttctgttcctgctgattttggtggctcccaagttgcatgctttgaagactaccacaatgagataaggatgcggtatgtgatggggttgcagatgatgattgagcttcagtgtgaagcgctggtgaaggagtttaaggtgacccctttaatttgtggcttggttggcccaatttggttgaggtttgtctccaagactggcattttcggtgatgactgggctgataaagtaatccatgactctgaaacgcagaatgaag

SEQ ID NO: 84355 - DNA, 2073 bp, Glycine max
  Peptide Sequence Number=SeqID_201133
atggctctcaacctcacaccttcttcttactttcatcaccctttcatttcacaccaaattcactttcatacactttcaaaacctttctctctcacacactccaaaacctcaaccttctcagtctccaaaaccctatgtctttgtgcatcaccatccaacacccccattttcctcccatatctccgacaactagaaccagaaaatcatgaacaaggagagggcatagaaacaatagtagaagaacaagagtatgacccagatgatccaatctacaaattcttcaaaacccgcactcggttttcttcccaagaccctggaaaagaaggaaaattgtcccttcagaagaaccgtcgcatttcatggcaccttgcttctgaccttattgaagaagaagaagaacctgaaatgggtttgattgaagagaaggaaaaaacggtgtttcagaagaaggctttgcctttgcctgagggcattgtgggagagattgttcagcttgcaaggaacttgccacaaaatctaactctggaggaggctttggctgagtatgaaggaagaagggttagtgagaaagagtgttgggaggttttgaaattacttggggatgagcaacttctggaaccgtcacttgttactcctcgggcttgcactgtgttgtttcctttgttggggaaagcaaagatgggtgataagttgatggttttgttcacaaacttgccatctagcagggagtttagagattctcatgtttataatgctgcaatttcaggccttctttctagtgccaggtatgaagatgcttggaaggtgtatgagtcaatggaagcagataatgttcttccagatcatgtgacatgttctattatggttatcgttatgagaaaacttggccatagtgcaaaggatgcatggcaattttttgagaaaatgaatggaaaaggagtcaaatggggtgaagaagtcctaggtgcactaataaagtcattttgtgttgagggtttgatgagtgaagctctcatcatcctatctgaactggagaagaaaggggtttcttcaaatacaattgtgtacaacaccctgatggatgcatattgtaaatccaaccgtgtagaagaagctgaaggcctctttgttgagatgaaaactaaagggattaagcccactgaagctacattcaacattctaatgtatgcatacagcagaaaaatgcaacctgagattgtagagaagctgatggctgaaatgcaggaaactggcttgaagccaaatgccaaatcatatacttgtataatcagtgcatatgggaagcagaaaaatatgagtgacatggctgcagatgcattcttgaagatgaagaaagacggtattaaacccacttcacattcttatacagctctgatccatgcatattcagttagtggctggcatgagaaagcttatgcagcatttgaaaacatgcaaagggaaggcattaaaccttccatagaaacctacactgctttactagatgcatttagacgtgccggtgacacccaaacattgatgaaaatatggaagttgatgaggagggaaaaagttgaaggaacacgtgtcacattcaacactcttgttgatggttttgctaaacatggttactacaaggaagcaagagatgtaatatctaaatttgcaaatgttggattgcacccaacagtgatgacatacaatatgctgatgaatgcatatgcacgaggagggcgacactcaaagctgccagagttgttggaagagatggcagctcataacttgaagccagattctgtaacttattcaactatgatatatgcatttctccgtgttcgagattttagccaggcatttttttatcaccaggagatggtcaagagtgggcaggtgatggatgtcgattcataccagaagcttcgggcagttctggatgctaaagctgcaattaaaaacagaaaggataggagatccatgattggtgtagttagaaataagatgggcgttgtgaaaccgaagagaaaaaaggatgagttatggaagtacaggaaaagacatgtgaaacaaaagtag

SEQ ID NO: 84356 - DNA, 376 bp, Glycine max
  Peptide Sequence Number=SeqID_201134
tcccacgcccggtcgtactcataaccgcatcaggtctccaaggggaacagcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgcgaaaccacagccaagggaacgggcttggcggaatcagcggggaaagaagaccctgttgagcttgactctagtccgactttgtga

SEQ ID NO: 84357 - DNA, 819 bp, Glycine max
  Peptide Sequence Number=SeqID_201135
atgaatgtggcgcagcctgacattgctgctcctggggttaatattctggcggcttggtcacctgcttcctctgcccgtttggtatctgatgctgaaaatgaagatgagacagagttacatccccttaacttcaacattgaatcaggaacttccatggcatgcccccacataactggtattgttgcacttataaagactatccatccaacttggagcccggcagcaattaagtctgcccttgtcacaacagcttctctgaaaaatgaatacaaggaatatatttgggccgagggagcaccacataaacaagctgacccatttgactacggtggtggtcatgttgatcctaacaaagtcacagatcctggtcttgtatatgacatgaaaaactcagactacattcgtttcctctgttctatgggctacaacaacaccgccataagcatattgacagggtttcctaccaaatgccataaatcacacaagttcctcttaaacatgaacctgccttctattaccattccagagctaaagcaacccctcacggtatcaagaacagtcactaatgttggtccagttaaatcaaactacactgctcgtgttgttgctccaattggaatatcagttatagttgagccatcaaccttagcatttagttccaaaagaaagaaaatgaaattcaaggtaactttttcttccaagctacgagttcaaagcagattctcatttggatacctgttatgggaagatgggttgcatgaagtcagaatacccttggcagttcgctctgcagtacatgaattttgtggacaaatataa

SEQ ID NO: 84358 - DNA, 489 bp, Glycine max
  Peptide Sequence Number=SeqID_201136
atggaggtcaccaaagacgaagctgcaaccccaggagcaggaggtgctcaacctcgcaatccaaatccaaatccaaatccaactccaaatccaaaccctaaccctaaccctcctcacaccaccagaggatctaaaggaaaatcgtgtaagggatgcacctactactcatcgcttcataaagccaagtccaaaaaccccacatgcgttggtttctccagaacactccagcaagaatctgagttggaagcttccaaagagggccgcagccttaccaatttcaagtatgcatgtgttggatactctgtctacttagacaacaaagattcttcagctgactcgcaggataaaacagcaaaattgcccttttgcgttggtcttgaggtggtcttagaggagaaagcttcaaattcacatgcaggccatgttcctgctactcataaaactgaaggtattgaaattcttggtttttatttttatttacagttctag

SEQ ID NO: 84359 - DNA, 1269 bp, Glycine max
  Peptide Sequence Number=SeqID_201137
atggatacagccaggactacgtatgctgttgatgcaccaaacgcggcttccgatgtcgccggtgaaacagccgccgctctagccgccgcatccatggcattccggtcatcggacccgggttactcggagacattgcgtcgtaatgctattacagccttccaatttgcagataactacaggggtgcttacagtgacaatgataatgttaagtataatgcctgcccatattactgcgattttgatggctatcagggagagtctctgggtgttgtgttggagtcaaaataccaagggtggcaagggttggaagggttgggtgggagagttgatgatttaaaaatagtgtgtggacaacatttttggcaacacacatcgggtttccgcggagtgtgggttcaaactcgatggccggagatagcatattatgctcacggggtacattttggggcatgcattgaaaaattctggaagttgaatcttctggatgagttgttatggggagccgcatggctaaggagggcgacgcaggacgataatttcctcaactacattcaaaccaatggcaaaactcttggtgccgacgacaacatcaatgagtttggttgggacaacaaacatgctggcctcaacgtacttgtctctaaggaagtcatagaaggaaacatgtactctcttgagtcctacaagtcctcagcagagagcttcatttgcaccctcatacccgaatcaccaagctcacacatagagtacacgccaggtggacttgtgtacagacccggaggcagcaacttgcaacatgcaacttcaattgctttccttgaattggtctatgccaattacctaacacacgcttcacaagccatcaattgtggcaatgtctatgttagtgcacaaacacttcgccaacatgctaagaggcaagttgattacattttgggtgataacccaatgggattatcctacatggttggctatagcaactactatccacaacgtattcatcaccgtggatcttccttaccctccatcaaggatcatcctcagttcattgcatgcaaagaaggttcaatttattacaattccaccaatcccaatcctaatgttcttgttggtgccattgttggaggacctgacgaaaatgatgattatgtggatgatcgagttgattttaggaaatccgagccaaccacatacattaacgcaccatttgttgggatatacgccgaagatgtttctcatcttgagaaaatcaagagggtagaggcttga

SEQ ID NO: 84360 - DNA, 1547 bp, Glycine max
  Peptide Sequence Number=SeqID_201138
atgaaccagaagattacaagttacgtgctaaatacagaacagagccccacaatatgtttggcaagcgagctgtcatgatatggtttaggtctttaaagaaaaggattccactaccttgtactgttgctgtttcatttctggcatgtcatgtagccagggaagctgtcctgccatctgacatgatgaagtggacacttgaagggaagcttccatatttttctgcttttgttgaaattgaaaagcgcatgggacaaccaacaagtgcatgtcctattagttcaagtgttatgttcaggccccaacaagctattccagtacagaagctagagtcatttgctgcatccattgctcagttcataggcttggagttacctcccgtgaacttttatgctatagcttatctttttcttcaaaagttatcactgcctgttgaaaagattcttccttatgcatgccgcatatatgaatggtcgatgcctcctgatttgtggttatccttatccagtaattattttaggctacctactcatgtatgcgttatgtcaattctggtagtagcaataaggatattgtataacataaatggctttggagagtgggagaagagtttgtctcgtgatgatgatgccaaagacaacagtgaaatgggtaatgcttttgcctctgataatggacatgattttggtaaagaatctaaagattcagctgaagatcaagtaggatctcagaaacacgaattggattctgcctggcttctccaacatcttcaagcaagatataatgagattgcagatacctatgggtattcaaaggacttggctacatatctcaaatactgtagggatgttgtctttgctggatcagaaccatcttatggtaatcacgaggaagaaaaaatgatagaatacctatggaaattttatcagaatgaagaggatacaaaaccatcagaaaatgtagagcagtcaaatacttctttcaaccaaacgagttccagggataaaggatgcattggcaagatatccaaggaggaaaagattagaaaaaaaggttttaatgaactctttcctgatgatgacaccagccttgaagatgtgagcaacaataattcccatgagagtttgtcagacagtgaagactcagattcccaagagcacagttcaggaaaatctcatgtcaaggaagccattagacagatgaaattagagatggaggagaacagattttattatataccacctagtgtcaagcgaaaaagacttgattatattcactatgtgagaaagagggacgaaggtgcgctgacttatgttgctcatgctgattattacattttgcttcgggcttgtgccaggattgcacaagttgacattcggattttgcatattggtgtgttgagacttgagagaagacttgcttggttggaaaaacggattgatcaatgcttacattccaaaccaactagcatttcttgtcaattttgttgtaataaggccacggaaaatggatctgatggtcttcctggattatcaaatttgaatatttga

SEQ ID NO: 84361 - DNA, 1371 bp, Glycine max
  Peptide Sequence Number=SeqID_201139
atgctggcagtggtggtggagcaggttcatattgtgtatatgggtgacagaatgagccagagtgagcaacagttagttgaagactctcaccttgacatactattacgtattctcggaagcaaagttgctgctaggaggtccatcctgtatagctataagcatggcttttctggattcgctgcagttttaagtcagcctcaagctaagctcattgcagatttcccaggggttgtccgtgtgattcctaataaaattcttagtcttcacacaacaagaagttgggacttcttgcacgtaaagcaagatatagtaaccggtgctctttctaggggtcaatctggaagaggcaccatcatcggcatcatggacactggtatttggcctgagtcagagagctttagagatgagcacatggacaatcctcctctacattggcgtggtatatgccaggaaggtgaaagctttgaccactcccattgcaacagtaaaattattggtgcacgttggtatattaaaggatatgaagctgaaattggcaaactaaatacaagtgatggggtagagtacttatctcctagagatgcatcaggccatggcactcacacttcatctactgcagccggcgttgcagtagaaaatgcaagctttatgggactagctaaaggattggcaagaggtggtgctccatcagcttggttagccatctacaagatttgttggtctactggaggatgcagctctgctgacattcttgcggcatttgatgacgcgatatttgatggggttgacattctttcagcatctcttggctctgatcctccacttcctacttatgttgaggacgcactagccattggttctttccatgctgtagccaaaggaatttctgtggtatgctctggtggcaattctggtccatatccccaaactgtcataaacactgctccttggcttgttaccgttgctgccagtaccattgatagagaattttcatctaggattatcttgggaaacaatcaaactctacagggtcagagtttatatacagggaaagatttgagcaagttttatcctattgtgtttggagaagacatagcagcttcagattctgatgaagaaagtgcaaggagctgcaattctgggagcctgaattcaaccttagcaaaaggaaaagcaattctgtgtttccagtctcggtcacagaggtcagccacagttgctataagaacagtaacagaagctggaggcgctggtctcatatttgctcagtttccaactaaagatgttgatacatcgtggagtaaaccctgtgtccaagttgactttattacgggaacaactattctatcatacatggaagcaactaggtga

SEQ ID NO: 84362 - DNA, 1476 bp, Glycine max
  Peptide Sequence Number=SeqID_201140
atggctttcaaactgaaatcactacctctcctttgctctcttcactccccttcccgccaaaaccctaattcaacactctcaaaccatcacttttctcgtcgcttcttcgcaccttccattcctcccaccctgtgcctatccggcgcagcctcagcgtccacctttcatcgccatcgcttcttcgtaaccgctcgaagccaagacgaagaccagatcactgaggctcttgaacaagaagaagagaaagacaacgaagaaatatcgaggcagggtgagaaaaaggaactcgcgaagcaaggcatatgggatcagataaaggaaattgtgatgttcacaggaccagcaactggactttggatatgtggaccacttatgagtctcatcgatactgcagttattggtcagagaagttcaattgagcttgctgctttaggtcctgctacagttgtttgtgattacatgtgctacgtgttcatgtttctatcaattgctacttccaatatggttgctactgcccttgccaaacaggacaaagaagaagtacaacatcacatatctgtattgctttttgttgggttatcttgtggcattgcgatgcttttgttcacaaggctatttggtgctgctataataactggtattgaaaatgctttcactggaccaaagaatgtacacgtagtacctgcagctagcaattatgtaaagattcgaggcttggcatcacctgctttacttgttggatgggtagctcagagtgcaagtcttggtatgaaagattccttgggacccttgaaagctttagctgctgctacagttataaatgtcgctggttgtgtacttttgtgcacctatttaggttatggaattgtaggggctgcgtgggctacaatggtttcacaaggatataatgcacttgccttctccattccttcagggaaggaacttctgacgatatttgggcttgctgctcctgtttttataacattgatgtcaaaggtggctttttacgcactacttatatattttgctacatcaatgggtacacatacaatggctgctcatcaagcccgaatgcttctaaggtctctcgtgataattggagctatacttggattgttgttagggattattggaacatcggttccttggttatttcccaatatttttacacctgatcggatggtcatccaggagacaataggacacatgttaactgctgcatttgttatgacgcagatgcataaggtgctgattccatactttatagccctggctgtaacaccccctactgtcagccttgagggaacgttgctggctttgagtagtagatacggtttgcttggctgctggttttccctcgcattatttcaatgggctcggttttcaatggccctccagcgccttctttctcccaaaggcatcttatactcggaagatacagaacagtataagctgctaaagctaaggactgcctag

SEQ ID NO: 84363 - DNA, 288 bp, Glycine max
  Peptide Sequence Number=SeqID_201141
atggcaatgaatgtgggttcatttagtgtagtaatttctgggtgtgctgcattggaaaactgtaattctacttcgcatgatgatttatcgaacttttttctgagaatgcaatgtgaagggtttaaggctgatgctttcacggttgcaagtttgttgcctttgtgttgtggcgatactgggaaatgggattatgggagggagtttcactgttatgttgtgaaaaatgggttggatttgaagatggattcagatgtgcatctggcccctcagaagttggccgtttgctaa

SEQ ID NO: 84364 - DNA, 522 bp, Glycine max
  Peptide Sequence Number=SeqID_201142
atggctttgaaactctcgtcactatctcttcactcctctctccgccaccagcaccctaattcgtcgcattcaaaccatcgcattccccttcgtttctttgcaccttcccttcctcccacttcgtgtctctccggcgcagcctcagtctccacatttcatcgcactctcttcgccgtaaccgttcgcgcatttcaaagccaagacgaaagcaaaagcagtgatgtttttgaagaagaagaaaaagacgaagaaatatcgaggcagggtgagaaaaaggaactcgcgaagcaaagcatatggagtcagataaaggaaattgtgatgtttacaggaccagcaacgggtctttggatttgtggaccgcttatgagtctcatcgatactgcagttattggtcagagaagctcaattgagcttgctgctttaggtcctgctacagttgtttgcgactacatgagctacgtgttcatgtttctatcaattgctacttccaatatggttgctactgcccttgccaagcag

SEQ ID NO: 84365 - DNA, 927 bp, Glycine max
  Peptide Sequence Number=SeqID_201143
atggagagtgctttaggcatttttgttcttcaacacattttggataacaataattcacttgtactgaaagggtctttcactgggccaaagaatgcacacgtagtacctgcagctagcaattatgtgaagacgaagattcgaggcttggcatggcctgctttacttgttggatgggttgctcagagtgcaagtcttggtatgaaagattccttgggacccttgaaagctttggctgctgctacagttataaatttcgctggttgtatacttttgtgcacctatttaggctatggaattgtaggggctgcgtgggctacaatggttgcccaagttgttgccgcttacatgatgattcaaaatctaaacatgaagggatataatgcacttgccttctccattcctacagggaaggaaattctgatgatacttgggcttgctgctcctgtttttttgacactgatgtcaaaggttgtctcaatatggggtgaacctctctcccaaactgctcaatcatttatgcctgaattgatatatggagtaaataggagtttgtcaaaggcccgattgcttctaaagtctcttgtgacaattggagctatgcttggattattgttagggattgttggaacatcagtaccttggttatttccctatgtttttactcctgatcggatggtgattcaggagatgcataaggtgctgattccatactttatagcgctggctataacaccccctactcacagcctcgagggaacgttgctggctttgagtagtagattcggtttgctaggctgctggttttccctcgcattatttcaatgggctcggttttcaattgccctccggcgccttctttctcccaagggcattttatactcggaagatacagatcagtataagctgcgaaagctaaggactgcctaa

SEQ ID NO: 84366 - DNA, 353 bp, Glycine max
  Peptide Sequence Number=SeqID_201144
atgtcattgcctagcgctgttcatgtgtcctccattatcaagcgtggagcctctggtgactgggaaatcaaaaaagaaggagcagagacgagaatcgtcatcacggaaagggcaggatggacgatatcagtgtcttatctttgctttcctcttatctccgatgtgaggtcccgagacgtgccgaaaatcaaaaggaagcaggcttacgcaatccgtgaaaattccgtgatgcgacagaaatcgaaaggagggagggtacaaatagcaatcaggcccacttgggccttcgagattcttcctccagaaggctgttgcttttggaggaagcaacctggctcgcctgcgcgagctgg

SEQ ID NO: 84367 - DNA, 1027 bp, Glycine max
  Peptide Sequence Number=SeqID_201145
aagacttctcgtcttcagagggctgcacgccctcaccttcagagggctacacgccctcccttttagaggactagacgtcctcgactgtagaggaatagacgtcctcaccttaagaggactagaagtcctcgccatcagagtgctgcacgccctcgccttcaaaggactacacatcctcctctttagaggactgcacgtcctcgtcttcagagggctgcatgccctcactttcagaggactacacatcctcgccatcagagggttgcatgccctcaccatcagaggactactcgtcctcgcctttagaggactacacgtcctcgtcttcagagggctgcacgccctcacctgcagagggctacacgccctcccctttagaggacttgacttcctcgcctgtagaggaatagacgtccttaccttaagaggactagaagtcctcgccattagagtgctgcacgccctcgccttcagaggactacacggcctcgtctttagaggactgcacgtccttgtcttcagagggctgcatgccctcaccttcagaggactacacgtcctcgccatcagagggctgcatgccatcaccttcagaggactacacgtcctcgactttagagtactgcacgtcctctacttcagagggctgcacgccctcaccttcagagggctacacgccctcgcctttagaggactacatgtcctcgcctatagaggactgcacgtcctcatcttcaaagggctgcacgccctcaccttcagaggagtacacgtcctctccattagaggactacacgtcctcaccttcagagagctacacatcctcaccttcagagggttgcacgcccgctcgtttagaggactagacgtccttgcctgtagaggactagacgtcctcttcttcagagggctggaagtcctcaccatcagagggctgcacaccctcacctttagaggactgcatgtcctcgccatcagaagggcgacacaccctcaccttaagagtactacacatcctcgccattag

SEQ ID NO: 84368 - DNA, 259 bp, Glycine max
  Peptide Sequence Number=SeqID_201146
ggactgccgggacccgtgggaacggggacggaaaaaaattcccagcggcagggtttggggatggggaccagggggtagctgggggcggagacggggagccaggaagtactccccgccagggaccaacgaggagatcgacgatttgtacaatgccagggacgtggtgatgaagaggatggtgaaggacgagtacttcaacatggatgataaaaagtgggatgacattgttgaggacgggatcaagcacagtagggtttag

SEQ ID NO: 84369 - DNA, 165 bp, Glycine max
  Peptide Sequence Number=SeqID_201147
atgatcgaaatcactctcgatgagaaagtcataccatggttgaagaacgctcctatcaccaatgccagggggttgagggacaccaagtatgcattgagttatgtcaatagtccagatgtgctggctcgatgtatgtcgtggtctggcacatgtctgttgatctag

SEQ ID NO: 84370 - DNA, 813 bp, Glycine max
  Peptide Sequence Number=SeqID_201148
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcgagttgcaacccgtgagcaggaactgattaaatatgccaaagctttacgtgatcgtgagggcgattggatgaaagagaaagagatgcgaatgaaaatagaagttaaagcactcaagctagaagaaactcttgctgatcggaacgcagatgccaaaagagtcaatgaactattggaaaaaaaacaggcggaaattgaagaattgtccaagataagaatgctattgagtgaggctaaacgcgagattgaggacttgtctcgtagggaaaagacacacttggcagagattgatcaaatcactactcgcgaaagaagactatttgctgaggttgaagatttaaattcactacaacgcaagaacactgcagagatttctcgtctgaatgcacgtcaggcaacgctattgcaagatttggagacgacgagaatcacagaatctaaacagagacaggagcttgaagacatgacacaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagg

SEQ ID NO: 84371 - DNA, 408 bp, Glycine max
  Peptide Sequence Number=SeqID_201149
atgccgaagaggtatgaagcatctatagtctcattggagaacacaaaggatctatctaagatcacattggcagaagtggtgcacttcaagccaagcatcatgactctgagaacagcagaaagaaaaatttcaagaagaaccagccagcaagcaatgaaaatggtgcaaacaaccaaaataaaggtaaggaaaaaaggaaaaattacccaccttgtcaacattgcggaaaattgggtcacccaccattcaagtgttggagaaaaccatatgcaaagtacacaacctaaagccaatgcccaagttgtggagcaagatgaagaagattatatttttgctgcaacatgttattcgatgaggagcacttctgaatgttggttgattgatagtggttgtatgaaccacgtatga

SEQ ID NO: 84372 - DNA, 360 bp, Glycine max
  Peptide Sequence Number=SeqID_201150
atggggagaggaaagatcgtgattcgaaggattgacaattccactagccggcaagtgacgttttccaagagaagaaatgggttagtgaagaaagctagagagctatctattctgtgtgatgcagaagttggattgattgtgttctccagcactggcaagctttatgactatgcaagcaccagggatgcgtttgaaattaaggaatattattgtggtatatatttgaaacttgctaggaaaaccctcccaacatggtgtggggatacatttatctgggaatctatgaattttataaacactggaatgctgaaacattttcctttgatactcttcaagaggccaggatacattttattataa

SEQ ID NO: 84373 - DNA, 269 bp, Glycine max
  Peptide Sequence Number=SeqID_201151
gctggatggatattgactatgttattaggaaagatgagccgccaggcattactgaaactagcgcagttgatctttatgaaaagtgggagagatctaattgtatgtccgtaatgttcataaagactaatatttttgctagtatccgtagttccgtcgatcagcatgaaaaggtcaaggatcttttgaaggccattgatgatcagtttattacatctgataaggcccttgccagcacccttataatgcagttctcatccttaaagctctaa

SEQ ID NO: 84374 - DNA, 363 bp, Glycine max
  Peptide Sequence Number=SeqID_201152
ctttggcagagagaagtagcaagcttgcggcaacaagtgcagtacatgcaagaatgtcacaggcaaatgatgggccaagagctttctggattgggtatcgaagagttaggaaatctggaaaagcgactggagatgagtttaaagggtgttcgcatgaagaagggaagccttgctcatcaagaaaatgtagaacttaatagaaagataaatctcatccgcaaggaaaatgaagaactacaaaaggttattgaagctaagtgtagaaaaggtgttgcagcatccaatcctccattcactatcaactatggatgtaatatgcttgctcctatcagtctccagctaagcctgccagagtcaacgtag

SEQ ID NO: 84375 - DNA, 474 bp, Glycine max
  Peptide Sequence Number=SeqID_201153
atgcataaagcattgcggtctagtgcacctctaccttaccctcagcttgtgactttatttattcaccattttgaaattcccttgaattctgagtcctttgtgcaaattaaacgttcctttgctattggtgtcggtgcggtaacctccttcagctaccgtaaggacaaggatgggcaatggttgaaaaaggatgcgcaacctccgcaagacgaacgtactccctctcctctatctcaacgagatgactcctcaaccctcatgcatgaagttctttcggagttacgaggcctccgcacctatgttggtgagcgctttgattccttggatggtcgtatcgatgttgtcgcaacgtgccctttgcgggcgagcgaaggcgaggctcacgggtgcgctttccaaaggaggaaaggtcgacaaaagcggggcttttgctcctacgtaccctccatcgaagaggaaatcagacctacgtag

SEQ ID NO: 84376 - DNA, 697 bp, Glycine max
  Peptide Sequence Number=SeqID_201154
ctacgttgaaggtgacgtggatctggtgtccggtcgcggcgcggtggtattcgaaaacaccgatttccgcgtggtgaactcgcgcactcagcaggaaggttacgtgtttgcgccagcaacacagtctaacctgttctacggcttcctggccgttaacagccgctttaacgctgccggcgacggcgtggcacagctgggtcgctccctggatgtggactctgccactaacggtcaggtcgtgatccgcgacagcgtgatcaacgaaggctttaacatggcgaagccgtgggctgatgccgcgatctccaaacgtccgttctccggcaataccggtgcggtggatgataaagggaacgtccagcgcaatctgaacgacgcgaacttcaaccgcatgtgggaatacaacaaccgcggtctgggtagcaaggtggttgcagagccgaagcagtgcgttggctacactcgttcaccgcgtgactcggcctgtggcctcgctccttcggagccagcgcaagcgctgagcacttctcctctgatttacctttccgctgcctgtcaccagaggtgtgttggttacttttcgatgtgctccacagttaaggcactgtcggcaccacccgacagccaggacttgaaacggatcctgaattgcggaactgcagcacatcgaaccaacaaagagaagtatatcaactga

SEQ ID NO: 84377 - DNA, 375 bp, Glycine max
  Peptide Sequence Number=SeqID_201155
atgtcaggatttacatgcgattctcctcaaatttcagccagcccatatcaattagaccttgcaccttacgcttcagagccctacaatgctcaatggaacgccccggggcttctccgtgacaagcacatgttgcgttcgagtcgtattctcgaagaaatggaggttgatgaaccttggttggggttattgctaccattgaattatcaagtagacatgggagcaagctttctcgctgcaaaattcatttcttggttggtgtttttggattgtgctaaagggatggcctttgtggataactgggcggtgggtaaggagaaggtttgttattggctgagtaatgacattgttgggttggtgggaaacttggctgtatag

SEQ ID NO: 84378 - DNA, 552 bp, Glycine max
  Peptide Sequence Number=SeqID_201156
cagtacccgggtatcgaactggagctcagcagcagcgatcggctggtggatgtgatccgtgaagggtttgactgcgtggtgcgtgtgggcacgctgaaggattcggggctgatcgcccgtccgctgggcaagctgtcggtgattaactgcgccagcccggattatctggcgcgtttcggctatccggaaacgctggatgatttaggctcccatgcggtgattcactacgctgcgatgctgggaacccgcccgcagggctttgagttttataacggcagtaccacccagtggattaaaacgggcggggtattaaccgttaacagtacagaaacctaccaggcggcctgtctggccgggctggggattattcaggtgccgcgcgtcggggtgcgtgattctctgcgggcgaagaagcttatcgagatcctcccgcagtaccgggctgagccgatgccggtctccctgatttatccccaccgccgcaacctctcccgccgtgtacatctgtttatggagtggcttactgaactcacaaaagcttacgtggattag

SEQ ID NO: 84379 - DNA, 828 bp, Glycine max
  Peptide Sequence Number=SeqID_201157
ggtcatcacagaggcggcatacagcgcgcgaaagctctcattcaccggggtaaattcaccgggtgctgccactgcatgacgatgaaccagttttacgccgttcacttcgctggtgaccagggtgtcatccgtcacgggcggtggaggcgctttacatcccgccagccggctggcgtgcggcgcgacatttgccccctgatggtgcttaagggaattgccgcgtcattaacccagccagtccggcacggcttttgcttggctgcgccacttaacccgtattgcgcagcaaaggtcgcggaaccgttcgctggtgattggcccgcaccaggggcagattccgcgttcgcgcgagctgacttcggtactgatgctgctggccgggctgctgatcatctggctgggcggccacaatatggcgcaacggctggccagcatggtggccaccggcttccgcttcgaccacggcatggcggtgatcgcgctgctgccgctgatggccgggctggtgatcgttgccatcgccgcgccgatgattctgggcggaatcaacatcagcggaaaatccatcaaattcgatttcaaaaagctcaacccgttaccgggcattgcgcgcatgttctccggtcagacgtgggcggaactggtgaaggcgatcctcaaagcggtgctggtggcgctggtggctggctggtatctgtggagtcactggcaggagatgctgcgtctgatgagcgaatcgccggtgaatgcgctgcagcatggcctgtcgatgaccgccatcagctgcgcgctggtgatgctgggtctgatcccgatggttggctttga

SEQ ID NO: 84380 - DNA, 918 bp, Glycine max
  Peptide Sequence Number=SeqID_201158
atgtgcccgccaaaaccgtcgcgtttagcccgcctggcgggaccattggccgcagccaggataacgacctggtgctgcccgacgaatcgcgcgctattcgcgcatgcaggcgctggtgcacctgtcgccagacggcgagtgccgcctgaccaaccagggcagcgtcacttcagtggtgctgaacggcgtggcgctacagcgcggctcgcagtgtgtgacccggcgtgtcagaacgcaccgcaggatgatccactggcgttttttgctgacagcgccgccgatccgctgggtatgcagcaggacgaaagcgtgccggaaccggaagtcctgccgcagagtgacagtccgcgtcacgaacgccgcccggacgcgcgcctggcgatcgatccgcaaagcgatgcgcccgtgatgccagccgtgctgccgggcgccgatcaggacaaactgatcgccgcgctgctggaaggtatgggcctgaataatggtcaccagacgccgatcaccgaagagcagatgcgcgtcaccggccgtatgctcagcctgttttcgcaggatgtaccagagccagatgcctggctttatgccaccggaagcagcggtgcgcgatgcgctggtggattacaggcgcatcagctggggatgattgccggcattcgcgccatcattgccgcgatgctgcagtcgtttaatccgcagcgtctggaagaggaagcgcgcaaagacggcgtgctgcctaagatgccgttcagcggcggacgtaaagcggcgctgtgggactattttctccgtcactatcagcgcactgcgggcgagattgaagatgacttccacaccctgtttggtgaagcctttctgcatgcctacgacatggaagtgaatcagtacaaagattcccagacgcggaccgaagacgcatga

SEQ ID NO: 84381 - DNA, 432 bp, Glycine max
  Peptide Sequence Number=SeqID_201159
atggcaatgaatcatgctgccgccgcgattgaaccggtgacgccacgcaatgtgcgccgtttgtcgcctgccttgttcgccgccgctgccgtgtccttgcttgccgtggtggtcgtagtgtggaaagccaatcgcccgagcgacgcaccgccggtggcggccagcagcgtcccggcggcgacgccatcagcgggcagcgcgcccgccagcagcgcaccaaccatggcgacggtttatccgcagttgcaggcaggggaaaatatcgtgctgaacggcgaagcgaaggatgtgaaacccgccagcagcggtttagcctcgatgaatctggcggcaggcagctatcgtattgaattgcatcacggcagccaggtgcgcagccagatgctgacgattaaccagccgggcacctggctgattaatccgggtaattga

SEQ ID NO: 84382 - DNA, 628 bp, Glycine max
  Peptide Sequence Number=SeqID_201160
atggctggacatgagaagacccgacacagcgagtattcgctgattttcccgattctggcgctggcggtgctgagcttttttggcggccagacagcgcttctgccggtaatcggcatcaatctgctggcgctggtagcgattttaagcagcgccttcagcgtagtacgtcacgccgacgttctggcgcaccggttaggtgaaccctacggctcgctgatcctcagcctgtcagtggtcattctggaagtgagcctgatttcggcgctgatggcgaccggcgatgcagcgcccgcgctgatgcgcgatacgctctactccatcatcatgatcgttaccgccggactggtgggctgtgccctgctgctaggcgggcgtaaatttgccacccagtacgttaacctggccggcgtgaagcagtacatgatcgccattttcccgctggcgattctggtgctggtgtttcctaatgccctgcccggcggcaatttcaccaccgcgcaggcgctgatcattgcggcgatctctgcggcgatgtacggcgtgttcctgctgattcagaccaaaacccaccagagcctgtttgtttacgagcatgaagacgagagcgatgatggcgacccgcaccacg

SEQ ID NO: 84383 - DNA, 885 bp, Glycine max
  Peptide Sequence Number=SeqID_201161
atgccttattcatcgaaccgggaactgccggacagcgtgcgccacgtgctgccgggccatgcgcaaaccatctaccaaaaggcgtttaacagcgcctgggatcagtataaagatgaagacgatcgtcgcgtcgacgccgcgggcgccgcctgtaaaatcgcagattcagggagctatatcgacaggaaggtcagcgcagtagaggagatcgcagtgttaacccgggaattcttactaaaagcggattgcaaaacttcatttggtgatattgacgaagcgctgctgtggagctgtgagaagcgcgccgcgtcgctctgcgccacacttgcctgtcgtcccgatcaaagcccggtgtggatcttcggctacggttccctgatgtggaacccggtctttgaagcggaagaggtggcgaccggacggcttgagggctggcaccgtgctttttgcctgcggctgaccgccggacgcggcaccgttgccgcaccgggacggatgctggcgctgaaagagggcggttctaccagcggtctggcgtttcgcctgccggaagcgcgcctgcatgaagagcttgagctgctgtggaaacgggaaatgatcaccggctgctatctgcccacctggtgtgaactgacgctggaggatggccgcacggttacggcgctggtgtttatcatggatccgcgtcatccgctgtatgaagccgactcctgccgcagcaccattgctccgctgatcgctcaggccagtggtccgcttggcagcaacgcgcagtatctgttctcgctggaacaggagctgggcaaacgcggcatgcaggaagaggcgttaacgcgccttgcggccgaagtgcgcgcgctgcagcagagccccgcgcgcggctaa

SEQ ID NO: 84384 - DNA, 2554 bp, Glycine max
  Peptide Sequence Number=SeqID_201162
ccgattgcgcatctggtgggcgaacgcgagttctggtcgctgccgctgcgcgtcagtgatgccacgctgattccgcgtccggataccgaagtgctggtggagcaggcgctgctgcggctgcccgcgacgccctccgcggtgctcgatctcggtaccggcaccggcgccattgcgctggcgctggccagcgagcggcccgattgtcagatcaccggctgcgaccgcatcgccgccgcggttgcgctggcgcaggacaacgcccagcgcctgcacctcaccaacgccggatttgtgcgcagccactggttcgacgatctgcccgcccaacgtttcgatctgattgtcagcaatccgccttacattgatgccgccgatgaacatctgcagcaggggttggctgctgctggaacacggctggcagcagggggaggctgtacgcgcgctgctgatccatcacgtcgcgatcaccatcacgctgtttctgctgcgtttttactggctgaccaccggatctgccctgctgcagcgccgctgggtgcgcattgcgccgcacatcaacgatacattcctgctgctcagcggtgcactgctggtgctgattacccacttttatccgtttaccccacaaggaagctggctgacggagaagctgttagcggttatcatctacatcgccttaggttccgtggcattgagtcgtcgcccgcgcagcatggcgacccgctgggtcgcctgtttagtcgccgtggtcgcattgttgctgtgcaacttgattacagtgagacaccgttaagtgaagcggtgattggcgcgacctgcgccatacgcaatgatttttccgcgccttccgtccagcagcagctggctgacctggttgaagaggcgcggcgctatgtcagtagcgaacaggatgcggatctgcagctggagaagctgctcgatctgttttaccagcagtggggctttggcggtgccagcggcgtctacaatctgtcagacgcgctgtggatcgataaagtgctgaagagccggcaggggacggcggtatcactcggcgtgattctgctgcacattgcggatgagctagagctgccgctgatgccggtgattttcccgacgcagctgatcctgcgtgccgactggctcgacggtgaaatgtggctgatcaatccgtttaacggtgagacgctcgacacccatacgctggaagtgtggctgaagggcaacatcagcccgacggcaaagctctactctgacgacctcgacgaagcgaaaaccgtcagcgtgatgcgcaaaatgctcgacacgctgaaagcggcgctgatggatgagaagcagatggagctggcgctcaatgtcagccaggtgctgctgcaaatcgacccggacgatccctatgagattcgcgaccgcggtttgatttacgcccagctggagtgcgagcatatcgcactgaccgatttgacctatttcgttgaacagtgtcctgaagacccggtcagcgagatgattaaagtgcagatccacgcaattgaacagaaacaggtcgcaaacgatctgccatttgttctcttcggcggcatgaacgtgctggaatcccaggatctcgccatgcgcatctgcgaacattacgtgaaggtaaccgacaagctcggcattccgtatgtgttcaaagcctcttttgacaaagccaaccgctcttccatcaagtcttaccgtggtcctggcctcgacgaaggcatgaaaattttccaggcgctgaagcaggcgttcggcgtgaaaattatcactgacgtgcacgaaagctggcaggcgcagccggttgccgacgtggtggacgtgattcagctgccggccttcctggcgcgtcagaccgacttggtggaagcgatggcgaaaaccggtgccgtgatcaacgtgaagaagccgcagttcgtcagcccgggccagatgggcaatatcgtcgataagtttgccgaaggcggcaacgacaaggtgattctgtgcgatcgcggcagcaacttcgggtatgacaacctggtggttgatatgctcggtttcaacgtgatgaagaaagtcactaacaacagcccggtgatttttgacgttacccatgcgctgcagacgcgcgatccgtttggcgcggcttccggcggtcgtcgtgcacaggttgccgaactggcgcgtgcgggcatggcggtaggcatcgccggtctgttcatcgaagcacacccggaaccgaacagcgccaaatgcgacggcccgtccgcgctgccgcttgataagctggaaccgttcctggcgcagatgaaagcgattgacgatctggtgcgcataaatgcgcaccctacattgtacggtcgccgttcatggcgaccacttcatttaacatcacagcataatcgtcagcagatagccggcaaacagggccagatgcgctgcgccgttgagcacgttggtgcggccagtggagaacgagatgtggcacaaaatcagcaccgcgctcatcaccaccatatgcggcggctcaaggccgaaaatcaattgctgaccg

SEQ ID NO: 84385 - DNA, 615 bp, Glycine max
  Peptide Sequence Number=SeqID_201163
atggccatagcgatcgttaatgcttttgaaatgatcgaggtcgaacagcactgcactgtaaatatagggctgcggcaaacgtgcgtggcgcagcagcagtttttctgcggcctcaaacaatgcgcgccggttccagacgccggtaagcggatcgtgcagcgacgccagcttatgggcgatctgcgtacgctcattgaccatcgccaggatagtgaaggtcaggccgatgacgaagaggatcgactccagaatcacatacaccgaaaagccggaaccgccaatggcacccggtacgggtgtggccaccgcatcgtcaaggaaaatgcgcgccagcagacgaatcagcgcggcggtaaagataatgcacagcaggcacatgaccagcacgcgtttcggctggccatgatagaactgcggaaaggcacaaagcagggcccacagcagcgcgccagtgatccagcaaaaaccgagtggaaggcggcaaaaagtacgaaaggcgttgagcagggtgccgtaggccagcagcatgatgacattcccgatcgccaccggcaaaaagtgcaaaccggcgctgcgcaggctgctgagcagcacggcggcaagcgtcagtattag

SEQ ID NO: 84386 - DNA, 381 bp, Glycine max
  Peptide Sequence Number=SeqID_201164
atgccggttgagggtcagtttgcccggctgggcggtgaggagtttgccgcgttgcttcctggcgacagtgagcaggcgcagcgcatatgtgagcgtatccggctggcgacacagctgtcgctacccaacgacatcggttatacggtgagcattggctttgccactgccagccagcggcatcaggcgtttcccgccctgctggcgctggctgatgaagccttgtatcgcgctaaagccgccggacgtaaccgcgtcgaaggttatcagacgccgcaggcggcaatggctgaagccgcgtttgtcgccgtagtgacgcagccagtaatagcggtcttccaccctctcccgcccgctgacgcgtgcgccgaccagccacagtag

SEQ ID NO: 84387 - DNA, 666 bp, Glycine max
  Peptide Sequence Number=SeqID_201165
atgcagagtgggtcccagtctgaaccgtttgatgtagaaatgggagattgcttagatatgattcgtgatcttggacaagagtcttttcagcaagcacatgcccctatgtatggtacattgcaaactgattcaaagaagcctttgtatctggggtgcaacaattccttgacgttgttgtcaacggtgttaagtctaattaatgtgaaggtcaaatatgggtggagtgataaaagttttagctcactgcttcaagtagtgtacaatatgcttccagatgaaaacacgttgccaaaaagttactatcaggccaagaagatattgtgtccgatgggtatggagtatcagaagattcatgcttccccaatgattgcatactgtacaaacatgagtttgaagaaatgcacaaatgccctaggtgtggggtatcacgaccttacatggcatgcaaatgggaaaaactacgaaatgctccgtcatctggctgattcctcccagtggaagaagattgattgtttgtatccggatttttgcaaagaggcaagaaatcttaggcttggacttgccactgatggaatgaatccatatgacagtttaagcactcaacacagttcgtggcccgttttgctagtaatttacaacttgcctccttggttgtgcatgaagtga

SEQ ID NO: 84388 - DNA, 291 bp, Glycine max
  Peptide Sequence Number=SeqID_201166
atggattactcttcgttaattagcctaacccgcatatctttcccccaatgtagaaatttccaggatgtcacaatgaccgggctcaggcgctcaaaaagcgggaacccaagtctagaagtgttagactgggctatagaggtcatctggccagagatcaacgctcctatgttcatattcatgcgagagactaggccaaagatcagcctagctctatccactgtcaagtcagaagtgtgtgatgtggggccaagttggagtatgagaggacactccacacctaagctaatgtag

SEQ ID NO: 84389 - DNA, 192 bp, Glycine max
  Peptide Sequence Number=SeqID_201167
atgctcaaggagaaggagaaggagaggctgttcctttggatctgcaagttcgccggccgcaagaaggtcggaatgctcttcctttgcctcatctccgccgcggttttcgtctggcaccaacccgagttgggtctagcggaagggactagtttccgtaatgtggcgaatcaaggtttgaataatgctggttag

SEQ ID NO: 84390 - DNA, 711 bp, Glycine max
  Peptide Sequence Number=SeqID_201168
atgtcaccgcagaccaatcgttatggacaacccatcggcccggcgctggaggcgtggcagccgcgcccgctgccgcaggggcagattttcaccggccagtattgccggctggagccgctggatgccgcacgtcacggtcgcgagctgtatgcggcttatgcgctggcggaagatgaccgcgactggacctggctgccggtcgggcgctttgacgatgaagcgtcttatctggcatttgcgcagcagtgccagcagagtccggattacctgcacttcgcggttattgaccggcagagcgggcgggcggtcggctcgctggcgctgatgcgcattgaaccgcagcacggtgtgatggaagtcggctttgtggtgttctctccgctgctgaagcaaacccgcatggccaccgaagcccattatctgctgatgcgttacgccttcgaacaactcggctatcgtcgctacgagtggaaatgcgacagctgtaaccagccgtcgtacaacgccgcactgcggctgggcttccgttatgaaggcacgtttcgtcaggtggtggtgtataaaaatcgcagccgggataccgcctggttctctatcatcgacagcgaatggccgcaggtgaagctgggatttgagcgctggctggcggcagacaatttcgacgctcgcgggcaacaacgcgccaggctggagacattacgtcaggcctga

SEQ ID NO: 84391 - DNA, 660 bp, Glycine max
  Peptide Sequence Number=SeqID_201169
atgatgaacacccataaggcattcaaagcgctgcagcaggcgggcgtggccgatcaccaggccgaagtgatggtcgacatttttgccgaaatgcagcaggaaaacagcctgactaaaacgcacctttcgcaggccatggaaggcgtgatgcgggcaaatcacgccaccgcgcaacgtgtcgataaactggcacagagcctcaggcattttgaaaatgaggtccgccatacgtttaaagccattgagctacggtttgataacgtcgatgagcaattccggaaaattgatcaacgattcaaaaaagtggatgagcaattcaggctaatcgatcaacgctttgaaaaagtagatgcacaattcagagaaatcgataaacgctttgaaaaggtagatgcgcaattcaggacaatcgctcaacgttttgagcaaatcgatgaacaattcaggaaaatcgatcagcgttttgaacaaatcgatgagcgattcaggcaaattgataaacgctttgaaaaagtggatgagcgtctgctggatctcgaccatcgcatgcagctcggtttcaatgagctcaaacgcgataatctctggcatcggcggctgatgatggcgatggccagtgcctttgtgttgtcagccgccaaatatatttttgccggttag

SEQ ID NO: 84392 - DNA, 360 bp, Glycine max
  Peptide Sequence Number=SeqID_201170
atgcagaattcaaaacgggatgtgtacctaggagcctacctgaatggtgcatattggcaaatggtcgtcattttgcctaaggaaaatcttgtcgtctggttttgttcgttgcataataggccagacaactacctgaaaggaataattaatagttctttgaaaggacttgacgatactccacaacctaattccgaggctggtgctagacaaaaaggaaacactgagtctggttattacgtgatgcactggatgtcaactataatcttaggaagtttcaagaataaattgggaaatgagagattgaaggcgctttgcatccaatgggcaaagtattatttgaaagttagaaatgaaacttag

SEQ ID NO: 84393 - DNA, 156 bp, Glycine max
  Peptide Sequence Number=SeqID_201171
atgcttcatcaaaggatatgctaccatagcagcccctctgattcatcccttgaccaaggaacacctcatctggtcaccggaggtcctactagcctttcatgcattacaagaggcagtcagctcagcaccagtgctatgcctaccagcaccccatag

SEQ ID NO: 84394 - DNA, 591 bp, Glycine max
  Peptide Sequence Number=SeqID_201172
atgccaaccaaaacctccactccaagttctcaatccccaaaactctctcatctccgccctcaatacattcccaaccacatccccgactcctcctacgtccgcatcttggacaccaccctccgcgacggcgaacaatccccgggagccaccatgacagcaaaggagaagctcgacatcgcacggcagctggtgaagctgggcgtggacatcatccagcccggcttcccttctgcgtcgaacagcgacttcatggccgtcaaaatgatagcacaagaggttggcaatgctgttgatgatgatggttatgtgcctgtcattgctggcttctgtcggtgcgttgagaaggacatttctactgcatgggaggctgtgaagtatgctaagaggccacggctttgtacttccatagctacgagccctattcacatggagcacaagctgagaaagagtaaagatcaggtgattcagattgccagggatatggtcaagtttgcacggagtttgggttgcaatgatattcagttcggtgctgaagatgctactaggtacgagtctttcatttgtcttactctttttggatcacgtttttag

SEQ ID NO: 84395 - DNA, 1404 bp, Glycine max
  Peptide Sequence Number=SeqID_201173
atggctcaaactatccagacaccggagcaacagaagtatctcacgcgtttaatgggatatgattttatcatacaatattgctttggccgctccaatgtgatcacaaatgccttatcttgtacctttgaccattccaagggaatggtcctcactttgttaatgccacatttcttttttatagatgaactaaaaggagagctagctgataaccccgagtttaatgctctacgacaagacttacaagagaacccaaccaatcgtcctactctaacttacagtgatgggttggtcttacaaaatggtcgcatttggctgcccaacaaactgaacttcatcaggcttttgttgcataaattccactccacacccacaggcagtcatatgggtgtcacaaaagctttggccagactacaggacaacttcacctggaattctattcgacaggacgttcatgattttgttgcacagtgcctcaattgtcgacacaccaaatatgtgaccaggaaaccagcagattgtatctccactaccttttcctactcagccataggagaacttatcactcgattttcattgtcgaattaccgatatataaaggaaacaccacaatactggttgttgtatatcgattctccaaagcttcgtggcatgcctcggagcttagtctccgacagagaccccttgtttattagtaagttctggcaagaactgtttaagctatctggcacaaagttacacttaagcttgacttatcatcctcaatctaatggtcaaaccgaggttatgaaccgcataattgagcaatttatgtgtgccttcgttcatcatcgcccatcgccatgggtggacacattactcaccacatgggaggcagtttttgatagcttacgtcataaattgttaaaagcgcaagctcaaatgaaacattttgcaaacaataaccatccaaaagtacactatgcaaaaggtgactgggctttggtcaaactccgtcctcaacgtcagtcgtccctaacgggccccaacaagaccaagctcgctaaacgtttttatggccccttcaagccattccggcatgatgcaagaaataaacccagctcacttccattacctggaaaggacttcgacaaccgtcctctcatcacccctctaactatcctcaatactcgttgggtagacacaaacaatggacctcgtttacatgtgctagtgcaaagggccagtttaccagttgacgacacatcttgggaatattgggcttcattaaaggaggaatatcaccttgaggacaaggtgatttttgaagggatcaggaatgatagaccagtcaacatgcatgaagcccagcatggaaggcctcagaggaaggtcacacctcctcaacgtttttgcgattacgtttaa

SEQ ID NO: 84396 - DNA, 416 bp, Glycine max
  Peptide Sequence Number=SeqID_201174
ggaaggtacaacactgaagcaataccttgatgagataaacattgttctaatggagctacatgacattgatgtcaagatgaaagacgaagatctgacaatcattttgttagcctttgttcctccctcctacgataattttgtgagttctcttagtgcaggcaaggactccattgcacttgaagaaaagaagaagaaaggaaaagatgacaagaagagcaaagttgatcctaaggacatctataattactacaaagaactaggtcattggaaggaagactatccaaagaaagcaaagaaagattttgttgttgctcttgttcaaaatgactcctcattggaaaacaatttggttatggctattgacagacattggtttgtggcatatgagaagaagtttggtggtaacgttctcatag

SEQ ID NO: 84397 - DNA, 327 bp, Glycine max
  Peptide Sequence Number=SeqID_201175
atggcaaaatcaccctgctttacagcaaacacagagaaaaatcctaaagaagagtgtaaagctgtgatgattagaagcaaaatggtgattcaagtagaggaaagtagagcttatcagaaggtggagggatttaaacaacagctggctgatcaattggcattggaaccggttgatgatttagttgaacttaaagaaattgttgaggaagcagaaggtgatgaagaaggggagacaccaataagagactgtcaagagaaaataaagaagaaggaagaaaaagaaaaagaagaagaaacaaaagaaaaagaagaaaaagttgaaaaatga

SEQ ID NO: 84398 - DNA, 255 bp, Glycine max
  Peptide Sequence Number=SeqID_201176
atgtctttagaatactttccattggatttaatggtgaaatttgttcaatttcagctcaccatttgggctcagcgcgcatccatcgataagcgcagcttcagcacacttagagcaactgaagaatctggcaaagcatcaacatcaaggtcgcacgctaagtgcgaaatcagtgcgctaagtgcagcggttgtcttcagccaggctcaacgcatgattggcactaagctcaaatccacttactcacgcgaagcgtga

SEQ ID NO: 84399 - DNA, 1641 bp, Glycine max
  Peptide Sequence Number=SeqID_201177
atgattctggaacatatcgatatacacggctttcgcggcattaaccggttgtcgctgccgctgaccgacaccaacctgctgattggggaaaacgcgtggggtaaatccagtttgctagatgcgctaacgctgctgctggcaccggccgctgagccctatatgttcaccgaacaggacttccattttccgcccggtgaggtggaagcacgcctacataagttgcagctggtgtttcgctttcgcgcgcagggcgatgagcatgaagcgctgtttgcgccgttctggcagcaggatgacgcggggtgctacctgcgcttcagtacgctggcgacgcggcagggtaacgaggtcaaaacccgctggcgctttattgacgcgcatggcgaggtgctgccgctggcgggtaccgacgccgcgctggcgcagttgcgcgcgtactatccggtgctgcgcctgcgtgatgcgcgctttggccggcggtcgcgccatagcgacaatgacacgcagcggcgcgctgatacgctgagcgcgctggcgcaggagatgcatagcctgacgcgcgatctggtggcgcggccgcaaaccctgagcgacgagctgttgcgccagggattgcataccatgcagcagctgatggcgcactattttctggtccagcaaccggacacgggcgccgcgcgggttgcgccggagctgcgtgatggcagtcagggctggcgttcgctcgatcagctcaatcagctgatcgccggtaccgaatcgcgcagtcgccaggtgattctgctgcgcatgttctcgctcctgctgcaggcgcacggcagcgatgcgctgcccgcaggcgcacgccccttgctgctggtagaggacccggaaacgcggctgcatcccatcatgctgtcggtggcgtggaatctgctggcgctgatgccgctgcaaaaaatcgccactactaactccggcgagctgctgtcacaggtggcgctggagcaaatctgccgactggtgcgcgaacccgatcgcgtggcggcgtggcgtatcgggccggaaggattaagtgccgaagaggcgcgccgtatcggctttcatatccgcgtcaaccgtccgtcggcgctgtttgcccgctgctggttgctggtagagggtgaaaccgaagtgtggatcatcaatgagctggcgcggcagcgcggctaccattttgccgcggaaggcgtgaaggtgattgagtttgcgcagtccggactcaagccgctgctgaaatatgcgcgccgcatgggcattgcctggcacgtgctgactgacggcgacgaggccgggaaaaaatatgccgccaccgcgcgcagccagctacagccgcatgagcaggagagcgaccatctcacgcagttcccggcgcccgacatcgaacacttcctttataagcagggctttagtgatgtctatcaccagatggcgcacctgccgttaaacgtgccgatgaacgcgcggcgtattattaccaaagccattcatcacagctcgaagccggaactggcgattgcggtggcgatggcagcggccgaacgcgggccgcaggcgattccgccgttgctcgatcagctgtttggccgcgtgatgtggctggcgcgcggtcgggcagagtaa

SEQ ID NO: 84400 - DNA, 309 bp, Glycine max
  Peptide Sequence Number=SeqID_201178
atggagttgttgagaggaaaaatagataatctaggaaaatttgatgcaaaatctgatgaaggcatctttcttggatattcattgcaaagcaaagcatatagaatatataacaaaagaactatgaatattgaggaatccattcatgttacttttgatgaatctaatggtatcttgtcaagaaagaatatgctaggtgatattgcagaacctttagaacaaattcatattcatggacaagattctaaaggaaaagggaaaggaagcaatgaagatcctccagaagaagccaaatcaaataatgaactttaa

SEQ ID NO: 84401 - DNA, 279 bp, Glycine max
  Peptide Sequence Number=SeqID_201179
atggtgtcagaacctactcttcggcgggagggcaacgcaaggctcacgggtgtgtcttccaagggaggaaggcatgcggagtcgccatcaacatttattcgaggaaaacgtcggaaaaacaagaacgtgtggtctacgaacttgaatcgtgaaaggttcgagagttgtttttacgcatggagaaggagagaaatgttaaggcgttggaccattaacggtctcttgggggtggtcgacaaaaacgaggcttttgctcctacgtatcctcaattgcgatga

SEQ ID NO: 84402 - DNA, 1605 bp, Glycine max
  Peptide Sequence Number=SeqID_201180
gccgacgctggcggggcggtcgggcaccagccaccaggccaccggcaccagcgcggcggcggcgcccgccacggtccaaaccacccgggtccagtcgccggactacgccagcgccgcgaggatgggcaggaagatcagcgtgccggtggcggtgctggcggtcagcaagcccatcatcaggccgcgatgcttcgtgaaccagcggttgaccaccgtggcgcccatgaccacggcgaccgcgcccgagccgacgccggagaacacgccccacgtcagcagcaggtgccacggctgggtcatgtaggcgctggcggcggtcgagagggacatcaccgacagcgccgcgatcagcacgcggcgcacgccgaagcgttccatcgcggccgccgcgaacggccccaccagtccatacaggaagatgccgacggcggccgagaacgaagtggtgctgcgattccagccaaagctttgctccagcggcaccagcagcacgctgggagacgcgcgcaggccggccgagaccaggagcgccaggaagatcacgccgacgaccacgaaagcgtacttctgtcccgcgcggcggaaggggatgggagggtgggctatactcatgttactgaccgcaaatcccccgcgggcggcaacgacgtcaaatctgccgccacacccgccgccaagccgcccctggcggccgaccgcatccgccagacggcgcgcgagatgttctaccgcgacggcatccgcgcggtgggggtggacgccatcgtcaaccaggccggcgtcaccaagcccagcctgtatcgcagcttctcgtccaaggacgagttggcggcggcctatctgcgcgaatacgacgccgaattctgggcgcgcgcaactgcgcgcctacctgtcgggcctgagcgtgcgggcggtgcaaagcggctatcggggctgcggcctgaccaacgcggcggtcgagtatccggaggccggccatccggcgcgggaagtcgccgtcgcgcacaagctggaactgcgccggcgcctgaccgcgatggcggccgaaatgggcgcgcccgatgcccaggccctgggcgacggcttgctgctcctgatcgaaggcgccttcgtgtcgagccagttgttcggcgagggtgggccggccggccgggtggcggacatggcggacatgatgatcgacgctcatctcggccgccgttgattgttgcgatgcacaataatggtgccggatacggtgccggatgcaccgatgtggtggagagaatcatgagcgataccgcgttgaaaaatgcccgcatgtcggatgcgctggagcagtccttgatccgcgaggccatcaaggcggaaaccctgtccgggccgttctcgcgctcgggctggcgccggctcaagctgcgcatgcgccggttcggcggcgccatcggtgaagtgctgcacgacatggacgccggccgccgccagcatcctacggctcgctgcgtgagtgaagggtgccgcccagaaaactccagggtcatttggtcttgcatgcatttgagcgcgtcagatggctttgggctttcagacggacttcccttctctcctgaatgcggcctggaatag

SEQ ID NO: 84403 - DNA, 726 bp, Glycine max
  Peptide Sequence Number=SeqID_201181
atggcttcctatggtagtgagcttattcttgactcatcttctccttcaagtggcaactccaatcacctttcctccttctccatttcattgtcattccacttcaagaggcaaaggactccattgatgaagaagatccaaggcctacaagctctacttggagctacattaggttgtgtagtttttgaggggtcgacaactgtccacaacgtctctttgggcaatgatcaggataaacagggactagcaaaacctatagataggctggaacctaatgatgatcccctataccagatgacattgacgatcctacagctttttctcaagcctattcaagtgacgtgggattcaactgtgtttagggtgtataatgatgacatcctcttgtacataaagcatgaagatatttttgaaataacgcatggtggccaatgtctcaacatctctattatacaattgttgattcttttgcgatcaggaaatgcctctgtgtatggattccttgatccacagtccatacaaaggttgaggcaatcgcaatttgaacccgatgattatattaagaaatggatgttgaattcgcagagagatgtttacctaagagtatacttgaatggatcaatggcagcggaatggagaaggaagaaagatgattggagacaccacttcaaggagaagatgagtcaagaacaagctcaccaccataggaagccatggataagagcttga

SEQ ID NO: 84404 - DNA, 954 bp, Glycine max
  Peptide Sequence Number=SeqID_201182
atgagaattcagatcagtggtggtaaaatgcttccaaataaatttgtggagaaatacggagaaggcttaccaaatactctatttcttaaggctccaaatggtgcagaatggaagttgactttagaaaaacgcgatgataaaatgtggtttcaaaagggttggagagaatttgccaaacatcactctctagatcatggccatcttttgctttttagatatcaaagaacatcccatttccaggtacacatctttgatggtagtggcttagagatagaataccctcttgggaaagtagaaggtaaaatgacctccaattatcaaaaaaataaacgtccaaatggtgaaaaattggaatatgaattccttcaaccatgtatgggaagtcgcaaatgtgttaaggttgataataccatgaagccaaagctaggttgctccgcatgcgcatcatatcgacagaaagggcaaaggaaaactaaaatgactactactgagcatgttacggcttttgatagagcaagttatttcagaccttgtaatccatccttcctcgttgtcatctatccatcaaacgcccgttcacgaggtcctttgaattttccatctaagttttgtaagaaacacattgatttgcgcaagaacagaggagatatcaatcttgaggtgttaaacgggagagtttggcatgcaagataccgaataaggacagccgaaactagaagaagatttgaactgtcaagtggatggaagacatttgccgaggacaataacttgaaagttggtgatgtttgcacctttgagctcattcctgcaacaaaactcaccttccagactctcgtcaaatatagcagtttatcaaagaccgagaaaagaaatgaaaatcgtcactactaccaactcgtcaccctcaaagagtttcagttcttttgtatcaaactttacgtcgggtataattaa

SEQ ID NO: 84405 - DNA, 615 bp, Glycine max
  Peptide Sequence Number=SeqID_201183
atggagtatggtgatttggttgaattagacttggagattgaagcaacttgcaaaagaaacaacacagaaaggagaagaaaaatcttgcaggacaggacaatatcgccaattttagaggaaccgcgttcatctgagtcagcttctattttccaacaaacaagggaatctgatataggtgcatctgaagcacacggaatgggtgaagatcaacctcgtagagtcacccttgaagactattctagttttactgtgccgcaattctttaaaagcatagcgcggctagaggttcaggcacataacatcacttaccctcattctttgattcagttaaggcagagcaatttatttcatggtctacctaatgatgacccatatgcagatctggcaacaaacattgagatatgcaatactgtcaaggttgctggtgtgccggaagacgcagttaggctgagtttgttttcattttcactatttggagaagccaagagatggctacattcattcaagggaaacagtttgaagacttgggatgaaattgttgaaaaatttctaaagaagtattttcctgagtcaaaaactgcagaaggaaaagctgccatctcttcattccattaa

SEQ ID NO: 84406 - DNA, 249 bp, Glycine max
  Peptide Sequence Number=SeqID_201184
atgtggggaccttcggccttcccggtagcaggatcaacatgcaccacttgtctctcagcaccaggtggtctagtggacaacgatcgtagacgtgaggctttgcgtgtccgcttcacggcagacggcgaagccgatgcgtccgaaggaggaggaggaggtgaaggaggaggaggaggaggaggaggagtagaggcagaaaacaaagaggggaatgagcaacaatttgaaggttgtacattcaggaactaa

SEQ ID NO: 84407 - DNA, 627 bp, Glycine max
  Peptide Sequence Number=SeqID_201185
tattatcgggccggatgtcaggacatcgtatccgacatcgtggatcctgcagcttcactacttgacttttatcttgcattgtacagcaactccagtattctcgggcaggatgtcctggacattgtatccgacatcgtgaatcctgcagctacaattcttcatttgacatttcatcttgccttgtgcatttttagtgcttggcactatggtccatatgcattgttctggggaactacaaggcaagaaggagtcaacatcagagattgggagaaggatatcacccaagagactgttgacatcatgctctatggtcgtgctcgaccaatcacaaaggatagagttgagctcatcaaattcttaaggaccgtatatctctcttacatctgtagactcatccacaactttatgtttaacatggttatacccagacttgggttcaaagactatgttaattaccaggatagattttgcatgaacaaaattatgttgcaagctttaaaggatatgttcaaccttaaggtaaagaagaaccatgccccttatggtatgttattcactcaaatcatgagaaactctagcgttgatgtgtctggcatggcaccgtctggaggagcaacacaactttaa

SEQ ID NO: 84408 - DNA, 264 bp, Glycine max
  Peptide Sequence Number=SeqID_201186
atggtgattgaaaatgatccatcaactttagtgccagccttgatatcatacatcaaaagcgctgaaggatacactaccacataccaaaaagcatgttttagatcgtgtatcgatgggtttcaatattgcaagctcgtggttcaagtcaatggaacatggttgtacagtaagtacaaggggactctccttatggtagttgcacaagatggcaacaataaaatccttccgatagcctttgttgttattgagggcgaaatagcataa

SEQ ID NO: 84409 - DNA, 357 bp, Glycine max
  Peptide Sequence Number=SeqID_201187
atgagtcacataggctgtttctttgagaaaacaaacttgcccaggaaaaagaacactaggagctgcaagttcaggcttccttggcagtctgagttttcccccattgagtttctgaaggatgttgcagataaagtgacaaaagctatatgcttgaggtctgcaagaaaatcttcaaaccgaggcccgtcttgcatgggaagatcaaaaccaattggggtatctgttgattattataggacagcagcagttgaggactgcattgagttcatccactcctccttttctagatcaaattctgtaaccgcaacaccaggagaagaatttccacatacttttttacgaaactttgaatcatag

SEQ ID NO: 84410 - DNA, 207 bp, Glycine max
  Peptide Sequence Number=SeqID_201188
atggccttgacatttagccaactatgcaattatgcaatgttgaagctttgctcctgggatgatgttttcaaggtttcagttgggttgtatttggttggaactgtggcttttgtgcctcacagaatggtaaattttgtggatagaggagcattggagcatatagatcagagggatgacaatgtgtccttgaaagaggaattggcataa

SEQ ID NO: 84411 - DNA, 315 bp, Glycine max
  Peptide Sequence Number=SeqID_201189
atgtggggctatgttgatggaacttttgccaagcctctagatgagcagaatgcaaaatctacaaaggagttggaaacttgggaagtcaacaactcaaagatagggatgcaacttgcaaagtatggtttgactaaggatgttcaaaactatttgaaaatggtgaaagcacaatgtccaaaattgttgaagtcacaacaacaatctcaatggcgtcctcctcacaatgatggtattggtagtggtgacaacaatgatgatggttggggtgaccgtggtggtgatggtaataacagctgtgacagtaaaaagttttga

SEQ ID NO: 84412 - DNA, 1557 bp, Glycine max
  Peptide Sequence Number=SeqID_201190
atggatacactccatcttctcttcaccctagctgctcttttatccgcatatttcgtttggttccatctcttggctcgaaccctaaccggtccaaaagtatggcccttggttggtagccttccaagcatgatcgtgaaccgcaatcgggttcacgactggatggctgccaacctccgccaaatcgagggatcggccacctaccaaacctgcaccctcaccctccccttctttgcttgcaagcaggctttctttaccgtcactagcaatcctagaaacatagaacacatcctccgaacccggtttgacaactaccccaagggaccccactggcaggcagccttccacgacctcctaggccaaggaatcttcaacagcgacggtgacacgtggctgatgcaacgtaaaaccgctgccctagagttcaccacccgaaccctaagacaagccatggctcgctgggtgaaccggaccataaaaaaccgtctttggtgcattttggataaagctgctaaggaaaatgtctcggtagatttgcaagaccttcttttgcgtttaacctttgataatatttgtggactcaccttcggtaaagaccccgaaactctctcgccggaactacccgaaaaccccttcactgttgcctttgacactgccacagaaatcaccttgcaaaggcttctgtaccctggcataatatggagattcgagaagcttcttggcatcggtaaggagaagaaaatacatcagagtttgaagatcgtcgaaacttacatgaacgacgccgtttcagctcgtgagaaatcgccttccgacgacttgctatcaaggttcataaagaagcgtgacggtgccggaaaaacactgagtgctgccgctctgcgacaaatcgcgttgaacttcctcctcgccggcagggacacgtcgtcggtggcgttaagctggttcttctggctcgtcatgaaccaccccgacgtggaagagaagattctcgacgaactaacggcggtgcttacttccacacgcggcagcgaccagcggtgctggacagaggaagcagtggacttcgaagaagcggagaaactggtttacttaaaagcagccttagctgagacactgcgtttgtatccgtcggtgccggaggatttcaagcacgcgatcgccgacgatgtgttgccggacggcacggcggttccggcaggttcaacggtgacgtattcgatttacgcaatggggagaatgaagagcgtgtggggcgaggattgcatggagtttaaaccggagcggtttttatcggttcagggagaccggttcgaactgccaaaagacggttacaagttcgttgcgtttaacgctggaccgagaacctgtttggggaaggacttagcttaccttcagatgaagtctgtggcttccgctgtgcttctgcgttaccggctgtcgccggttcccggtcaccgggtgcagcagaagatgtcgctcactctcttcatgaagcatgggctccgcgtgttcttgcagacacgtcagcttcaaccgcaggccaccacgtctgcatag

SEQ ID NO: 84413 - DNA, 918 bp, Glycine max
  Peptide Sequence Number=SeqID_201191
atgacgtcacatctccagttctgcaagatttcctttcaaattatgagacttcaaggattgctttattctgttttgacgatttcatccataaatacccttgttggtagcgtgtgtcctccacactttctccacataccctcctcctcttcttcttcttcttcttcttccccatcatcatcttcatcatcctctattaattgctcaatctttctcatcatgtcatcaaatcaagcatcccttaaccttaaccaagccaaatttgcccttccaaccaatgacgaccttgagcaacaacaacaacaagcaacaacaactctagagattgaatctgatgaggacacctttgactactcaaaaagatctcaatggctccgcgccgctgttctgggagccaatgatgggttggtctcaacagcatcaatcatgatgggtgttggagcagtgaagcatgacatcaaggccatgatcctatcagggtttgcagggttggtggcaggggcatgtagcatggccataggtgagtttgtgtctgtttactcacaactagacattgaggttgctcaaaggaagagggagaaggaaaggggccaaagaagagtgagagatccagaggaagacaccaatgaagagaaagagagtttgccaaaccctttgcaagcagcagcagcctcagctttggccttttctgttggtgcaatggtgccattgcttgcagcgtcatttataagggaatataaggtgaggcttggagtgattgttgctgctgtgacttttgctttggtggtgtttggttggttaggggctgtgttgggtaaggctccagtgttgaggtctgctttgagggtcttgtttgggggttggatggccatggcaatcacttttgggttaaccaagttgattggatcaagtgcactttag

SEQ ID NO: 84414 - DNA, 480 bp, Glycine max
  Peptide Sequence Number=SeqID_201192
atggtttttcataggaacaagctttgccacctctgtttagcatatgctagggtggaagagactgttgatttgcgaaccaatgtggagttggtgagatcagtctctgataagcatcatgatcttttaaggccatctgctcggaactattcaagaggacaatcaacagatacaactggccgtggaaagggaaagtatgccttaattagagacccagaggacttccaaatgggagtttatgataagccccttccatgttttggatgtggaatcggatggttctcatttctttttggatttctatgccctcctatgtggttctatgctacaattctctattttggaaatcactatcggaaggatcctagggagcgagcagggctgggagcctctgcaattgctgtaatctccctcctctttctctttgctcgtttggtctatctgtgtgtgtctgtttgctcatgcatacactttcatatgtaa

SEQ ID NO: 84415 - DNA, 699 bp, Glycine max
  Peptide Sequence Number=SeqID_201193
atgagggcgacgcgtggccttcacgcgccaaatctggcgcgagactgtgtgctgcacgtgacggcgcgtggaagggatctctgcaatacgaaagctacaagtaagcaaacacttcttctccatgcggatggaaagaaacacagggcaaaggctagagcattccatgcttcaaagcaaccaccagtcgaggcagacaaatctgccactgatgcaaaggttgctgtggagattgctcctaatgatgaggtgagagatgacaaaattggagagctgccaaaactgcaagaatcttctaaacaaaataactcaaaaccagggaatgaaatttcatcagcaaagaaaaagaggaaacttgaagcattggaggatgaccttattaagaaaaccaagaatgacacttcagttgacatgggaaatggagaagtaattcagggtgaagagagcaatttcaagaaagaagggagtgctgtcaaaaataaaattaaatggaagaagttcattaaatcagccttgaaatctcatcctgatggaattttgaagatgaagaaactgagaaaagttgtcctcaaagcactgcaggaatctggcattgcagtggatgatgaagctgaattgagtgaggcgcttgagcagaagatcaattccagctccagatttgcagttgagaacaagtatgtgcgactgctggccaaagattga

SEQ ID NO: 84416 - DNA, 5781 bp, Glycine max
  Peptide Sequence Number=SeqID_201194
atggcaacatctagcaagtttgatccatcttccagtagcccagatagaccattgtaccctgggcaacgtggatcccacatagctgcttcattagatagatcaggtagctttcaggaaagcatggaaaatccaattctgtcttctcttcctaacatgttaagaagcagttctccagcaacacatggagatgtggagagcttcttcaattatgtacgctttgatccaaagttgttaacgctagagcataagtctaatcgtcaaatggattttaagcgacatgttaatgctgctcttggaatttcacctgatgaatctccatctagttcttcaaaaggcaagctactgccatcacctgtaccagaagacatgaaacgggtgaaggatgctttgggtgcaaacattgtgaaggcaagggaacgtgtgaaaatgtttagtgaggctttatctgtattccatgaagttttcccagctataacttcaaagaaaagatctcgagctgaaggtttttctaatgatcgttctaatgccatgttaagtgatcgaccagtcttggggccaagcataggtaaggttggagttcaaggtcatcctgtcacaggtggttttgaacttgagcaccaaaagtctgaagaacgtaccaaaaatgttgttccaaacaagcgcactcgaacttctatggttgatgtaaggatggatgtgcggactaattctctcgtcaggccatcagggacagttgacagagataaggaaaagctacggattgccaacaatggtgtggttcagagtgaagaacgaactttacctattggaggcgatggttgggaaaagtcaaaaatgaagaagaagcgttcctgtatcaaactagatggttctccaagtacaacattgactaaacctgttaacaccttccaagaaactaaacagggaatgcaacaaagacttgctactgattcgcgatcaaaattgagtaatgattctcattctttcagagtcttaatggtgaaaggattttcttcaaagaaagagaatacagttgtgagggattttgctgatattaagggagtttctaatggaactgttggagctggaaaatcagatggtatctctcgacaaactgggttgggcatacgagcctctacccctagaaacaaccaagataatatttcccttgtcaatgataggaggggtcgtcctgttagttcagacaaggaaagggtgaacttcagagctgtaaacaaggcaactgcacgtgatgaatttaattcagctagccctacctcaggtgcaaaaatgaacactgctattcgggctcctcggtcaggttctggagttgcccccaagttgtcaccagttgtccatagagcaggtgtttctaatgattgggaactgtctcactcttccccaaagccccctgctgctggtggtactagcaatcgtaaacgtgtagcatcagcacggtcatcttccccacctgttgtcccctggcagaggccacaaaagagctctcgcactgctagaagaacaaatttcatgcctattgtttcaaatagtgatgaagctccagctttggatactgcatctgatgtggctggtaatgatcttgggttaggatttgccagacgcttggctggcagttctcctcagcaaattaaactaaaaggtgatccttcatcttcagctgccttatctgaaagtgaagagtcaggggtggctgatgttaaaccaaaagaaaagggtaggaaagcagaagagatagaccagaaatctggacaaaatgttcaaaaggtgtctaatatggtattgccaacaagaaagaataagcttgtttctggggaagaacatggagatggtgttcggaggcaagggaggacaggacgcaatcttgctgccacaaggtcaatgattccaatgacatctgagaagcttgggaatataggaactgcaaaacaacttagaagtgcaagactaggatctgataagaatgaaagcaaggcaggtcgtccaccatccaggaaactttctgatcgcaaggcctatgcacgtcaaaagcctgctattaatgcagcggcagatttttttgttgagtcagaagatggacatgaagagctgctggctgctgtaaagggtgttatcaactctgctcatgcattctccagccccttctggaggcagatggagcctttcttcagtttgataactgaggaggatattgcttattggaaacaaaaggtaaatcttgaatcaagcactctgacaccaactcccattccttcaaatattgatggcgttgaaaccattgttaatggatatgggttaatgggatgtgaaagagatgctggatttgatgctcaatggaatgctggaattgttgcagaacagttgcaactatctaagggagatcataatgtgattcctctctgtcaaaggcttatagctgctttaatctcagaggaggagtgtggtggtggaagtgaacacttcaagtttgatgcatatgatactgagtttgagcctgatggggaaccagaattgaatggtttggatcaccactcaggaacaaattttcagtttccttgtcattctgcctataatggttttaggattatggacaaaccagaacatgatgaaactgaaagggatatatttggtattcctccaactgggttgaattctagctttggtaaatccataaatggttttcttcgtgataaagcaatgtctagcttcacctgttcagagttgcaatatgatagcttggatataaatgataagcttctcttggagcttaaaagtattggaatttccccagcaccagtacctgatatgttgcaaacagatgatgaaggaatatcagaggatattactaggttggaggagctttacctgggacagatttccaagaagaaaagcttactagatggattgttcaaatctgcctcagtggataaagaacttcaagaaaaggattttgagcaacgtgctctagataaacttgttgtgatggcttatgagaaatacatggcttgttggggtcctagtccttctggtgggaaaaatacaagcaacaaaatggccaagcaagctgcactgggatttgtcaaacggacattggagcgatgccatcaatttaaagatactggcaagagctgcttcagtgatcccttattcaaggatatgttccttgctgaatcctccaaaccttatgcctcttccctttctgtggaagcaagaacagcttccatgggttcactgcagagcccatcacagtttagtcagaatatggataatcatgatctcaattcatcagatgtgcttcctgctttaaataactcatctgagcaaactagtgggaaggaagatctctggtcaaacagagtgaagaagagggaattgtcccttgatgatgttggtggtactccaggtatttctagtgctccaggcatcgaaagttctgcaacaagcagtgcaaaaggaaagagaagtgagagagacggaaaggggcacagcagggaggtacaatcccgaaatggaactactaaagttggtaggccagcatcatccagtgctaagggagatagaaaatctaaaacaaagcctaagcagaaagcaactcagaattctgtttctgtgaatggcctcctcgggaagctatcagagcaaccaaaaccagcattgccttctgttccaaagtctaatgaaatgcctacaaatagcaatgcaaaggaaaaggatgagtttggcttgggtggattggatgaccacgagcctattgacttgtccaacctgcagttacctggaatggatgtacttggtgttggtgatgaccaaggtcaggatcttggttcgtggttaaatattgatgacgatggattacaggatcatgatgactttatgggcggccttgaaatcccaatggatgatctatcagacttgaatatgatgggatcgatcataaggaggaagaaatacaaggttttgggacctcttctcttggcttataaaaagtccaaaacaggtgaattcagaaaggatcttgagccttcttggtgttttagaaaggaggaggcttgggggaaaagggtggagaaaaaagtggttaaagggacagcaacttattggatactggaggataagaagactattgctacaaggcaaagtaaaccaatggaggaaatatcttctagtgttgcagtaccttttacacttggtgttggaaatttgattcaaaaggagtccgcggtgacgactcacatggagataactgggctgaagctcatggcaaatacagcagcggctgctttaatgttaaatcctgcagtggagtgtttaaaggagaatcaagttggagctgctgctcttgtctcagaaatggttattgaatgtgagagtaattgggtcttgaatgaaagccataaccaggcaataaaggaagatgaattgatgttagcagtggattttcagtctctgcatagttcaagctctcaatctgtggctaatggcaaaagtgatccttgtagggaggaagctgcagcattgaagagtagtttttctgaaatagattcaccaatcatgatcaaggttgatgatgatgttgatggtaagtccggaataagcgagctgtgtccatcaatgaagccgccagtggaggaaacagtttctgttgctatggatattactagtgaggatcaaagtggatcagatgagtctgatcctaaaccatctgctgtgcttcttgatcagttgccaggggagagtaaaacatggagaacaggcaacccaaatgctttggaattgaatagtggacctctctggggttgttcatcaatttgtggaatgaggcaggagatggaagatgctatttctgttaagcctcgactttttcaagtttcttcacagatgctagtgaatgaccatgtgaatgagaacgaaaaacagtcactagcccacttttttgctgtctatgatggacatgggggccttcaggttgccaattactgccaggaacgtcttcattcaaaattgattgaggagatagagactgcacaatcaacttcggctgaaacaaatgggagaggtgattggcaggaccaatggaagaaagcatttatcaattgttttcagaaaatggatgatgatgtgggaggaattggtgcaagtaacaggggaaacaacagtggtgggtctgagtctaatattaaaactgttgctcctgagactgctggctccactgcagtggttgccattttaagccaaacccacatcatagttgcaaactgtggagattcaagaactgtcttataccgtggaaaagaagccatgccattgtcttctgaccacaaaccaaatagagaggacgagtgggctaggatagaagctgcgggaggaagagtcatacattggaaaggatatcgagttcttggtgtcttggcaatgtcaaggtccataggtgatagatacctgaaaccatgggtaattccagaacccgaagtcaatattgtgcgtcgagagaaaaacgatgagtgtctcattctagcaagtgatggtttatgggatgtaatgacaaatgaagaagcatgtgaggttgcaaataagcgaatccttctttggcacaagaagtttggtgacaatggcccaacaggacgcagtgaaggagctgatcctgcagctcagtccgccgcagagtatctaactaagcttgccatccacaggggaagccaagataacatctctgtaattgtgatagacttaaaggctcaaagaaaaattaagagaaagccataa

SEQ ID NO: 84417 - DNA, 249 bp, Glycine max
  Peptide Sequence Number=SeqID_201195
atgtctcccaatccattgtcgtgcattgactgtggggaaatatttgggcgtgataccgttcaggatcacacgcagtgtatcacagaagcggagaaatatggaccaaaaggccaaggaaaaacttttaacgttgcaactgccaagcctaataaggatagcaagcaaaggcctgaagttgatattaatgtggggttatctgatcggcctccttggttctgtagggtatgggacttgagtcccacattgtaa

SEQ ID NO: 84418 - DNA, 423 bp, Glycine max
  Peptide Sequence Number=SeqID_201196
atgaagctgggtggactgaaatcggtggagaacgcgcacgatgattcggtgtgggcggtcacctgggtacccgcaaccgccaaccgaccaccgctcctcctaaccggttccctcgacgagaccgtcaggctctggcgctccgacgacctcgttttggaccgcaccaacaccggccactgcctcggcgtcgcctccgtcgccgcccaccccctcggctctgtcgccgcctcctcctccctcgacagcttcgtccgcgtcttcgatgtcgattccaacgccaccatcgccaccctcgaggctcctccctctgaagtttggcaaatgcgcttcgatcccaagttttctcgagaggttttgcttcctacactgccactttttaagatattttgtgggaatgggcttattaaagttcaaaacaagtag

SEQ ID NO: 84419 - DNA, 741 bp, Glycine max
  Peptide Sequence Number=SeqID_201197
atgcggatatctatatggcttgacgttaacaaggtcagtgttagggaagaggtggatatggcgttggatggtgcggtggggagggaggaagacgactctggttgggccaacactggagctatgtggaatagggccgaaatgctttgggcattgtactcccaacactatatctgcaccgcaaagaggaagatgaaacaaatcaagggtaaaagaattgccctgaatcaagagggaaacctagtgcgaaactgtgtcacaatccaatgtgttgtcattgccaaccatcatgcggaggggtgtggttggcgaagaaggaagagcaaggaatcaagccattcgcgactggataaagttatgcgtgctgtcgccatccacaagaatgacgagttgctgatggcgaatcgaaccgaggaggcgaaaggtctgaggggcgaaggtaccctccatggcattgaggctaatttgggaaatcatcgaagggtctatggtgggagaagaagggggttcgatctcatcagcggtggccgggagaccacttgtcctcgcagtggtagcacaacccctggtcgcggcgaacaacgagttcctctgcctaaggcgcttgactggaagtttagaggccgtggcggcagtccaaccatttttcctcctgaagacgtgcgagttccaccgcttggggaagggaaatcgaccgtagtgcctgaacttcctagcgaagttcagggatcaaaccggagatga

SEQ ID NO: 84420 - DNA, 378 bp, Glycine max
  Peptide Sequence Number=SeqID_201198
atgttggaacaccacacccgacaggtgactaccgataagctggaggaagcagttcatcgtctaacccaaggtcaagcttccttgactaaaagtcatgcctccctatctcaaggccatcactctctcaacactaaaattgattccgtccacccatttctcacctccaagatcgattcactattcgatcgtctagcagccatctccgtcacaccaccttcacctacatctcctacacaccaacccccctcaccagcttcccgtcatcatcacatgaaattggatgtacctcgctttgatggccacgatgcacttgggatcccagatcaggagcgcctcacgatcgcatccttttacatggatggtcctgccctgtcctag

SEQ ID NO: 84421 - DNA, 276 bp, Glycine max
  Peptide Sequence Number=SeqID_201199
atgggcttcaagctaagtgtagaacttctcaagctaagtgtgagagaggaagtaaagggcttgagcattctaagcttgaagctaaacgatattacagcattggctaaggggtgtttggattatgggaaaattattggtttgatgcactggtgtggggttggatttggaatattgtgggtttgcaggattcttgctaataggcaatcttctgtacgtcccattaaaggagatgaagattcgttacataattctgtggaagagggtgcagaagcttaa

SEQ ID NO: 84422 - DNA, 837 bp, Glycine max
  Peptide Sequence Number=SeqID_201200
atgggaatagggataggaagcaagaggatggaaacagaagaatggttgaagatgcaaatactcaaggacatgcaacaatacttggagggaactcttttattgtcgatcatgtatgaagttgcagacagcgtctctccgagatttaccgatgtttttgctgccatgactgctgccgttaacaccgagtttcctcaaatcattgctctggagctactcacggttttactcgagaaacctattgatgacagtgtagaagtagcgcgttataaagagttgaagaaatcaatgctgggtgaggaatctgaggatgatgatgaggaaggcttggatgctgatgagtcagacaatgacaacgaagaggaagaagaacatatgcagataaaagatgaaatggagacaaatcttgtcaatcttcgaaagacaaaatactcagcaattatgtctagtgttgatttagaggaagctggtcataagcttctggaaattaagctagagcctggccaagagatggaattatgtggcaaagttatgattttggaatgttgcacgatcaacaaagtacaccaagaaaatctcgaaaagtgctttttgcagcagtactcaatgattaaccgacttgaaacaaataaactgcataacgtggcaaagtttttcgcttgtttatttggcacagatgctctaccttggcataatatgccgtgtcttatcaagcaacaacagaaagatgagtcaggtagttctgattcatcagattcagatgcagaatcagcaagttcggatcaaagtgacactgagaatgacagaagcggaagaaagcggccggaggacaaagggtga

SEQ ID NO: 84423 - DNA, 1061 bp, Glycine max
  Peptide Sequence Number=SeqID_201201
atggatgcacaagccaagaaaaaagcattgtttcgtgctaaattgaatgcccagaagaaggaaaaacgcatagaatctccccttgtaaggtataatgaatttgatcaacctgtttgccgggtttgtgatgttgttctaaagtctgagtctttatgggatgcacaccaagtttctcgtaagcatcgtgaggcaataagtaatctgaaagcgaatgcagctggattaactcagcataacaatgcaaagcctgttgctgattccagcttttccaaggctaaaccagaacattctttggactcacaattcaaaccgccagaagcttcacaactagtttctaaacctcaatcatcatcggtgcttccaccaggattttttgatgacagcgattcaggaaaaacaagatctggtagaaaagctggggtttctgctaaaagtcaggtgtcaaacttggagaaggataaaggtcaatttgatgacaataatgttgcaaagtcaaatgttagccaagccacaacggatagtaggcagacatcagtcaagactactgatacagagatccagcaagtaaaagggattctgcctgaaggattttttgacaataaggaagccgatttgcgtgctcgtggcataaagcttgttaagccagatgtcaatgagggatgcacttttgagggtataatgcaacctttgatcgagaatactcccgccaatagtgtactttatggatgcacccctcactctagaggagtcaagcctaatggagacgagtacaaggaatttgagaagttgattcaagaagacttgcaggaggtggatgaccggttggaagaagaagagattgatgcggccgaaatgatagaagaggaggaagttgtagagcaaaagatgcttagcgagaaagtggaaatgttgaagaagaggagattggagctaaaagctgctaatgctgcaaagcgtagtaaatcatctgagattgtagccaaggagtctagacaagaagagtcatccagtgatgatgaaagtgaagagaattttgccgtggactggagagcacaacactt

SEQ ID NO: 84424 - DNA, 1392 bp, Glycine max
  Peptide Sequence Number=SeqID_201202
atggagctgatcattttgctgctctcgttgatcctttcctcgttagtgttaatggttctcttcttgttgtgtgttactcgttctcctaaagcaatggaaggcatccctggcagccttggttggcctattgtgggagagagtttctcattcctctctgatttttcaagtccctccggaatctttagcttcatgaacaagaggcaaaagagatatggaaaggttttcaagagctttgtgctggggagattcactgtcttcatgactgggagagaagcaagtaagattttgttaactggaaaagatgggattgtgagtttgaatctgttttacactggccagcaagttctgggccccaccagtttgctgcaaaccactggagaggcacacaaaaggctaagaaggctgattggtgaacctttatcaatagatggactgaaaaaatatttccattttatcaatactcaggcaatggaaacattagatcaatggcaaggaaggaaagtcctgtttactctaaaagtgattggacatatgatcatgagtttagagccttctggtgaggaacaggaaaagttcaggtcaaattttaagattatctcttcctcatttgcctctttgccatttaaacttccagggacagcatttcatcgtggtatcaaggctcgggataggatgtatgagatgttggattctacaatttcgcggaggagaagtggccaagaatttcaacaggatttcttaggatccttagttatgaaacatagcaaagaggatggagaagaagatgaaaataaactcacagataagcaattgaaggataatatattaactctgctggttgcaggccatgataccacaacagctgctcttacatggctcatcaaatttcttggtgaaaatccaattgttttggaacaattgagagaggaacacagacaaatagtcgccaacagaaagagtggaacagatcttacttgggctgaagttaataacatgccttacacagctaaagtgagcaacaataattttagcttgcaagtgatcagcgaaactcttcgaagagccacaatactaccttggttttcaagaaaggcatcccaggattttgaaattgatggttataaaattaagaaaggttggtctgtcaacctagatgttgtttctatacaccatgaccccgaagttttctcagatcctgaaaagtttgatccctctagatttgatgaaaccctgaggcctttcagttttcttggatttggtagtggaccacgtatgtgtcctggaatgaaccttgccaagctagaaatttgtgttttcatccatcaccttgtcaacagatacaagaaacatgatttcagaggagaggaagagagaaaaactgagagaaactga

SEQ ID NO: 84425 - DNA, 210 bp, Glycine max
  Peptide Sequence Number=SeqID_201203
atggcgattaatgcggcgcgatcttccggtctaactcatccgagtcgagcagagaaagcaactcagtggggcccgccagtgagaaggagagggtataggctgaggctggacattttcgtggtctgcactacgttgccgattttagctctacgatcaatgaaaaatgtctttcgcagtttctctaggttattaatgagaaattggaaataa

SEQ ID NO: 84426 - DNA, 153 bp, Glycine max
  Peptide Sequence Number=SeqID_201204
atgaatcaggtgggagcgacgacgtcatcaacagtactgagtgatggtggtggtgagcggagccagcactggactggtggtgctgagaatcaccaccccaagcaagagcaacacaaatgcgtttacagaacaagtactcatgttcgtgtctaa

SEQ ID NO: 84427 - DNA, 1092 bp, Glycine max
  Peptide Sequence Number=SeqID_201205
atggcgtacatgagcatgggggaagctcataggaggataacagagtatctgaatcgcttttccgacgcgatttcttgccaagacggagctacgttcaagtctctcttcgctctctcttctaattccccattccttctctctctgggcgacgcgctcaacctcttccaagacgccaacagactcatcaagcaatccgacaaccattcccagttcacagacatcctcgtccctctcttccgatccctccaaaattaccgccagaacaacttgctcgaagcctataacgctttcgaaaaaaccgccaatgcgtttatccaggagtttcgtaattgggaatccgcgtgggctatggaggctttgtacgtcattgtttacgatattagggttcttgccgagaaggctgataaagaattggtttccaatgggaaatcccctgagaagttgaaaggcgccggttccgtccttatgaaagtttttggcacccttgcgggaaaaggctctaagcgtgttggagcattatatgtaacttgtcagctattcaagatttactttaagcttggcacagttcacctttgccgtagtgtaataagaagcattgaaactgcacgcatatttgattttgaggaatttcccaaaagagacaaggtcacttacatgtactatactggtcgtcttgaagttttcaatgaaaattttcctgcttatagtaaaattgtacaagctctaagaaggggcgatcttcggcttcttcggtgtgcactgcaagatcatgaggaccggttcttgagatcaggtgtatatcttgtcctagagaagttagaacttcaagtataccagagattagtaaagaagatttacatcattcaaaagcagagggacccaagcagagctcatcaggtgaagttagaagttattgttaaagcattgaaatggcttgtaattgatatggacgtggatgaggtagagtgtatagtggccatactgatatataagaatcttatgaaaggttactttgcccacaaaagcaaagttgttgtattgagcaagcaagaccccttccctaaattaaatggaaaacctgtcaattcttag

SEQ ID NO: 84428 - DNA, 354 bp, Glycine max
  Peptide Sequence Number=SeqID_201206
atggattgctggcacaaaatcactaagacttggacttcactctctactcgtttcaaacatcatcgcaaatctagtggtcgagttggtggtgccgctcaatactctgccgattgtgacggaatcagtgccggtttgctcaagcttcgagatgatgtgcaaatgtgcggctacagagatgttcaggtcatgtggaacatgttgaacgtaagtttgcaacatgaccaaatgccaatggaagcagccagaagaagctccaacaacgctaaatttcgcaagcgtggctgcagcaagcagagatcaatttcgagggtcttgttttggactaaccgtgacaacctcgtgaatgtacagtaa

SEQ ID NO: 84429 - DNA, 549 bp, Glycine max
  Peptide Sequence Number=SeqID_201207
atgagccacttggaataccaatgctttctcttacaagttgagagagtgtttgtcccaccaaagcaaaagatttacaggcatgtctctgaagcgggaaaaaataatcatgagtgtgaaatagtagccaaggtggagatgaaggccaacaaagaagagaaaaattctgaagaggaagccattcatcagttcagaattacagaagtacatgttgcaggtctgaagactgagcctctcaaaaagaagttttggggcacttcaagacgacaacaacagcaacagtctggttctcgctggttgattgctaatggaatggggaagaacaataagaattcattggtgaagtcaaaggttgtatctaaatcaagtgctccaatcaccaccgcaaacgtgcaacccggtgacacattgtggagcatatcacctcgtatttatggtactggaacaagatggaaggaattgaaagagctaaatccacatataagaaatcccaatatcaaaataccaaataaaactagtacgtggagtgcacgattcaattttttgctataa

SEQ ID NO: 84430 - DNA, 951 bp, Glycine max
  Peptide Sequence Number=SeqID_201208
atggacggtggtggagtgaactacaaccctcgcaccgtggaacaggttttccgggacttcaagggccgtagagctggcatgatcaaggctctcaccactgatgttgaagaatttttccagcagtgcgatcctgaaaaggataatctttgtctgtacggattccctaatgagcaatgggaagttaatttacctgcggaagaagttcctccggagcttcctgagcctgcattgggcataaactttgctagggatgggatgcaagacaaggactggctgtctttggttgccgttcacagcgatgcatggttacttgcagtggctttctactttggggcacgatttggttttgataatgctgacagtatttcatttcttggtggtggtaggctagaatatctagattgtttgttatgcaaaaagtccaatgaacctgagccaaaccaatcttcagaagaggttgacgatttatccgattcttattcccatggcttctccagatctgcatccgcatccacatcactgcaccacattggtgtcatgagcattgtgtgttggatttttggtttgggtgggtggaggcttcacctgtctctattgtttgatggatcaggagccaagcggcggtttcagcaaatgagatcagaatccctcaaccacctgggaagccaagtgatggtttcagcaactcctcgaggatctgaatcagggaagtattcaaaggaaacaaaggacgaggaggaagaggtactggatgaagaagatgacgaggagcatgaggagaccttgtgtggggcatgtggggagcactatgcatccgatgagttctggatttgttgcgacatatgtgagaagtggttccatggcaagtgtgtgaagatcactccagccagggccgaacacatcaagcagtataagtgcccctcatgcagcaataagagagcacggccttga

SEQ ID NO: 84431 - DNA, 399 bp, Glycine max
  Peptide Sequence Number=SeqID_201209
atggataaaattgaagcactttcactggagggtttgagaatacaatccgggatgtcgaatgagggcgaaccatcaaacatcattgtgcaatcctttggggacgtttgtgctctccaacgaaagggggttagtattagtgctggattccttggcctggatggagctgctgccttgcaattgttggatacaaaagacagcagcaatgagggtgttgatgggataataggcttatcaataactcttgatgaatggatgagactagattctggtgagattgatgatgatgatatagataatatcagtgagcatacttcaaaacttcttgctgcacatcatgctaactctatggacatgattcgcaggagttcaaagggagagaggaaacaaggcaaaagctaa

SEQ ID NO: 84432 - DNA, 919 bp, Glycine max
  Peptide Sequence Number=SeqID_201210
atggtttcgtatgtgaacatcttgctgtacggcgtgggagggttggtggtggcggggatggcattgctggtggcgtttcaggagaagctggtctacgttcctgtcttgcctggtctcaccaagtcctacgccatcaacccctcccgcctcagactcacctacgaggacgtctggctccaatccgacgatggtgttcgccttcacgcttggttcatcaagctcttccctaattgccgagcaagtgacggctatccttctcaacatggaataactaaggatgctcaggctgcattggatcatctttcccaaaggtctgatattgacacatctagaatagttgtgtttggacgatcacttgggggtgcagttggagctgttgctgcactgatacttgaaaatacattcacgtctatattggatatggctggagttttgttaccttttttgaagtggtttattggaggaagctctacaaatggtcctaaagtactcaattttcttgtacgttctccatggagtactattgatgttgttggccagatcaaacaacctatcctttttctatctggattgcaagatgagatggtccccccatcacatatgcaaatgctatatgctaaggcagctgctcgtaataatcagtgtctctttgtggattttcctactggcatgcatatggatacttggctggctggtggtgatcagtactggagaacaattcagcagtttcttgaacagcatgccccagagcaaaaggaagacagatcatcccaaaatgcaaatgcactactgctagcgatgtcctctgttgctctttgcttacttgttgttttaatactgctgccagatattggggcgagtccgcaaaagcacactgtgagaagatgcttcctactgaaacatgctgcaccacgtcaag

SEQ ID NO: 84433 - DNA, 560 bp, Glycine max
  Peptide Sequence Number=SeqID_201211
atttccccggaaggggagtcatagaagccttgggttacgatttcgaagtcagcttcgacgaagttttcgttctcgtgaaactgttgtccgtaaaagaaattgacgacactctttatcttgcagaggaaaagccacctgcagacgaagaaacgataatgtcattgatagatgatatacgatattttagacataaaggcatagaggtcgaatttaagccaacgcacggcatagattatagaccatatcttcacgagtctcggcaccgccacgcattgaacagggttaggggatctgggggacgctttcttagcgccaaacagctgccacagtctaatgcagaactagtcactgatgcctatcaaaagaaagatgcatcagaggcagaaaatcatccctcaagcaccggtgaaaatgcatctatcacattcacagccatctctgccttaactagtatgtccagtaacagtgtcaatttccccaacatggctggatcatcgcaatgcagtgggggactcacctttggtgctggagctctccaatgtacttcagttggccgatga

SEQ ID NO: 84434 - DNA, 735 bp, Glycine max
  Peptide Sequence Number=SeqID_201212
gacttcactcgaagcgtggcagggagacgggtgcggatcatgctcactagcatgaccacactgacacagatttggatgacattgcagctcaacaacatcctccccagtgatcataattctgacctccccctgtcaaagtgccagctggtctatgccatcttgacccagatgagtgtttatgtggcccagttgatctcagatgccatatatcaatttgcaaggatcatgcctcctagacacccaatggacccagagaagtccaacagagcactaggatttccgactttgatcatgggcctctgccaattctatggggtgtcggtgactcccaccaagcctatctggcctcccattaacagggtcaggcacagcagcaacaggaggaggaccggcagtagccaaccgcagatgcaccgccatcgcctctacggcagccaccatctttggagtccatctctactcacctgcgaaggatggagctctagatgcatgcatatatgcagcatgggtcaggtgcagctacatgagagcttctaccggtacaccctgcaccagcagagccaggaccccaatcctttcccgtggcctacccccgagcagttcggggccacgattgcttggcctagagataggcccgattttcagacaggggcaggacccgtagggaccctcggagatgaaggaggagcacaggatgatgatgatatggctgatgtgatggactacttcctttga

SEQ ID NO: 84435 - DNA, 273 bp, Glycine max
  Peptide Sequence Number=SeqID_201213
atggctgacctcaacaaggtttgcaaagaccttaacctatctaggagttcgtccacccatccattctataggccttttcaccattggccaccatcgataacctctagtactaggttgaggatcttcttagcactctcaacttatgtgcctactcaaccaacaactaaacttagatttcttgaggtttttgagatctcaaggacccaagtttcacctttaacaacaattaatctcatatgcactgaaagggtcactaatctccctgggaagtag

SEQ ID NO: 84436 - DNA, 393 bp, Glycine max
  Peptide Sequence Number=SeqID_201214
atggatgctgcaaagcttggaatcacatcaccaccagcttatctgtcagtgtctcagaacgttgataccttactcaaagctgtaaactatgcatttggtggggtaggaattgtcaatgatactggactttactttattcaaagattatcttttgacgatcaaataaacaatttcaagaaaaccaaagaagtaattttggcaggcataggagaggcagctgccaataagcattgcaatgaagccacgtatttcattgggattggtaatacttcacactcacaaaatttgctttcaatggtttgcgagatggagagtgattgtattgaggacatggacattgaagtcctctcttcaatgtggcctgaagatgttggcactgatattggaaaatag

SEQ ID NO: 84437 - DNA, 192 bp, Glycine max
  Peptide Sequence Number=SeqID_201215
atggtgctttgttctaatgcacatagttcatatgatgacatcaggactagagagaatcgagagatgttcaataaatggcaagctcaaaggtggtgggcagagaactacgacaaggttatggaactttacaatgttcaaaggtttaaccgccaagcatttcctcttccaacgcctctaagatctgaagatgag

SEQ ID NO: 84438 - DNA, 663 bp, Glycine max
  Peptide Sequence Number=SeqID_201216
atgcttacgtgcatagctcgtccaaagaaacctgatgaatcggatccggacaacgcgacaagcgccgctaaatcgcaagccatcaaatcccttacttctcagataagggatatggcgttgaaggcttcgggagcgtacaagcattgcgcaccgtgcacggggccagcgacgcaggggcgagttcggagcaacgccaccgagttggacgcggattcggaccggttccggtggtcgtaccggagaacggggagctcgagctcgacgacgacaaggacgtgggggaaggagatggaggcgcggctgaaggggatttcgagcggggagggaacgccgaactccgccagcggacggagggcggagccggtggtgctgttcgttgaagagaacgagccgaaggagtgggttgcgcaggtggagcctggcgttttgattacgttcgtgtcgttgccacgtggcgggaacgatctcaagcgtatacggttcagtagcagtggtgtggttgttttcgttggcgttgggggtttggatcggacgacagtgatgatgacaatgagtgccttttgctacacctcactagtagggtcgctttcgcctctgcatacgcttcttagctatgtctggaatgaaacggcttctcacttggacttgcggcttcttaactga

SEQ ID NO: 84439 - DNA, 2040 bp, Glycine max
  Peptide Sequence Number=SeqID_201217
atgtcgtttttacgacggagaaaggcccctgcgaatccctcgccaaacgaggagaaagagaaggataagaaaaaggttattaaggagaagaagattatcaaaggcgaaaatataataataaagagatggtcgtgcgtggatagctgttgttggttcgttggactcatttgttcaatttggtggtttttgctctttctatacaatgcaatgccggcgtcgtttcctcagtacgtgacggaggcgataaccgggccgttgccggatcctcccggcgtgaagctcaggaaggagggcttgacggtgaagcacccggtggttttcgttcccggaattgttaccggcgggttggaactctgggagggtcgccagtgtgcggatgggttgttcaggaagaggttgtggggtggcacctttggggaattgtacaaaagaccattatgctgggttgagcacatgtcactagataatgaaacaggactagaccatccaggcattagagttaggcctgtgtctggacttgtagcagctgattattttgcacctggttattttgtctgggcagttctaattgctaatttagctcgcattgggtatgaggagaaaaacatgtatatggctgcttatgattggagaatttcatttcagaatacagagatgggcttttctcccccttcttcatttgaccaggtcagggatcaaactttgagcaggatgaaaagtaatatagaactcatggtggctactaatggtggtaataaggtggttgttattccacattcaatgggtgttttgtactttttgcattttatgaaatgggttgaggcaccagcaccaatgggtggagggggtgggtcagattggtgtgccaaacatattaaagcagtgatgaacattgggggaccttttcttggtgttccaaaatcagtcgcaggacttttctctatagaagccagggatattgctgttgccaggactttcgcaccaggtttttgggataaggatgtttttggtcttaaaactttacagcatctaatgcggatgacccgaacgtgggattcaaccatgtcaatgatacccaaaggtggggatactatatggggtggccttgattggtcagctgatgtatcctataactgcagtgtaaagaagaacaagaacaatgatacttacggtgcatttcaaaatggcaaagagaatcttgggtttatgaaaaatataaattatgggagactcatatcgtttgggaaagatatagctgatttgcactcctccaagcttgagaggttggattttaggggtgctcttaagggtaggaaccttgcaaacacatctaactgtgatgtgtggacagagtaccatgacatgggtgttgatggaatcaaagctgttacagattacaaagcttacacagctgattcaattttggatctacttcattttgttgcccccaagatgatgaagcgcggggatgctcatttttcttatgggattgctgataatttggatgatcagaaatacaaacattacaaatattggtctaaccccttggaaacaagattaccaaatgctccagatatggagatttactctatgtatggggttgggatccctacagaaagagcctatgtctacaagttaactcctcaatctgaatgccacattccatttcagattgacacctcagcagatggtggaaatgagtacacatgtctaagggatggagtttacagttctgatggtgatgaaactgttcctgttttaagtgctggtttcatgtgcgcaaaaggttggcggggaagaacccgctttaatccttcaggaatccagacattcataagggagtatgatcatgcccctccagctaatcttctagaaggtaggggaactcagagtggcgctcatgttgatatattgggtaactttgccttacttgaagatattatacgagtagcagctggagcctctggcaaggacttgggtggagatagagtgcactccgatattttcaaatggtctgaaaagatcaatttgaagctctag

SEQ ID NO: 84440 - DNA, 351 bp, Glycine max
  Peptide Sequence Number=SeqID_201218
atgtcgcaaaacgcaggagcaaataccggaaaatcattaggagaatacttggaatatgacgacaagaacagtaacaacccttggagatcattcatgagaattctggtaaggcttggaacaggaatggccactactctgtccgcacgacataccaccaccacctcatggataacatggtgcaaaatgactacacattccacccaagtgtgggaatctgtaggtttatgggacatcatttcagatcatattcttcaagttgagaacaaatcaggggttgtggaaccagaccgatgtccaaccagaaacatccgttcacttagcactccagctgcacaacgagtggaccaatga

SEQ ID NO: 84441 - DNA, 531 bp, Glycine max
  Peptide Sequence Number=SeqID_201219
agctcaaagcttgaatcagtagaagaaagccctgtaacacctccactgaacagtgagcggttacctcgtaatatgtaccgtccaacagggatgggaatgggttactcatcctcagattcctttgatcatcagtctatgcaatctcggcatttctatgactcaaatggtatgaactcaacaccaaaagtgtccaccattagtgcggccaagacagagatatcatcaatggaggcttctatcagaagtagctcatccagagaggctgatcgctcgggtgatttttcaatcagtaatgctagtgaattggagactgaatgggttgaacaggatgaacctggggtttacattacgatcagagcattgccaggtggtgcaagagagctcaaacgagtcaggttcagaagtctatggaatttatttcttggtgttctcatgtgttacatagccgagaaaagtttggggagatgcatgctagattatggtgggaagagaaccgtgccagaatacatgaacaatacttgtgagttgtga

SEQ ID NO: 84442 - DNA, 642 bp, Glycine max
  Peptide Sequence Number=SeqID_201220
atgctggacaaatcaattagagaaatagatcgagagagacaaggtttgcagtcacaggagaagaaactgatattggagataaagaaaagtgccaaacaaggccagatgggagctgttaaagtgatggcaaaagatcttgttagaacaaagcatcagattgaaaagttttataagctcaaatcacagctccagggtgtatccctcagaattcaaactttgaaatcaacacaagcaatgggggaggcaatgaaaggtgtgactaaggcaatgggacatatgaataggcagatgaacttgccatcattgcagaaaatcttacaagaatttgagacacagaatgagaggatggaattgattacagaggtgatgggagatgcaatagatgatgctttggaaggggatgaggaagaagaagaaacagaagacctagtgaaccaggttcttgatgagattggaattgacataaaccaagagctgacagttgtaactcttttgagtgcaccatcaactgcagttgctgcctcagctgcaaagactaaggtgcctcaagttgaaactgttgggaatgatgatgccacgatagatagcaatttgcaggcaagggattccagttatactgggaaaactggagctcatttgtga

SEQ ID NO: 84443 - DNA, 207 bp, Glycine max
  Peptide Sequence Number=SeqID_201221
atgtttagagacattgagaaaatgttgataaggctcgaggtagttaacatggactactacccaccatgtccaaataaagagctcacagtaggtgtcgggtgctacgcagacttgaattacatgatcaaagattacatgaaaaactactcagctaatgctcttgatcgaaagaagtcacttgattttgcaaggatcaactctgcctaa

SEQ ID NO: 84444 - DNA, 420 bp, Glycine max
  Peptide Sequence Number=SeqID_201222
atgctcgatcttatagcctttgcgcttttgatcttagcctgctcctactggaaactttctggtcagttactgaacgaagaaaacactgaaagggacttggaaaatgttgttagtggtgagaaacagggtgacttcgcaaacaaggaatcaattaaggtgtacaaggagaagattctcgtcattatggctggagatgaccccaatcttcctcaacctccaaagggttgcacgtttgtctcgtacttaaatgttcggccaaaagatctgattttgaagatggatctcgatgtggtggtgatggctaaggaggcgacgaggtcgacgacggttatgtggtggtcccatgattcgggcatggctgaagggaagggaaagcgagagaatgtggtggcgtcgtggttagggtttgtgagtgtgtga

SEQ ID NO: 84445 - DNA, 1227 bp, Glycine max
  Peptide Sequence Number=SeqID_201223
atgcacgagagatcgatgaaagaagctgctggcacgtgcccacaaaggagaagaaccccttccttctcctcttctcttctcgacgccatttaccgctccattgacgaatcaaaatccaaccttcacgacgatcaacaactgggtcaccaccaccaccacgatcaaaccttagccacacacagtttcacctctgaagaaaaaggtggcaaaaaggagagaatgaatcttcgccgagcagtgatgttggaagattggatggagaagtatggttcttcccgttccctcaatgctcagttgctaaactcgagttcaagctcctcagaatgcagctctgcagggggaatattctcctcttcagaaacagacacgacaacaacaaccttgaagaaacaaagaccagcaaggcccacatcggagaagaagaagaagaagaagaagaagcaggaccatataatgagttcagaaaaaaagaacaaagaaggtggttttgcaaggaccaagttgagggcgttgaaaatttacggtgaattgaaccagagagtgaagcaacccatttcaccagggagtagaatagctagcttccttagctccatcttcaactcacagaacgtgaagaaagccaaaatgtgttacgttggagccgttgaagatgttagcttcgagcacaaatcaaagtccccttgtttctcttccacgccttcttcgttttctagaaggtcttgcatgagcaaaacaccctcttcggctaaaaaacccaacaacaatggagtcaaaagatccgtgaggttttaccccgttagcgtaatcctaggtgaggattctgaaccgcaatctaatagtcatagtcataataagaaatgtaacaacatttatgagagtgaatctaatctcactgtgagaaagattactagaagttcttccataaaggagctgaagaagaacactgttcggggaaaagaaaatgcaaccgaagaagcagcagctaggggttttgtaaaaggttaccgaaattctggtaagggtgaatttgattttataggtttttatggtaatggtgagaatgagaatgatgaaaatgatgatgatgatgatgtgagttgttcaagttcagatttgtttgagctggatcatcttattggagctgcaaggtaccaagaagagcttcctgtctatgaaactaccaatttggaaacaaataaagccattgctagtggtctatgtttgtag

SEQ ID NO: 84446 - DNA, 456 bp, Glycine max
  Peptide Sequence Number=SeqID_201224
atggcttctaacaatgttccactagcaacacctcttatatttacagggaaaaaactacaaaatctaggctatgaagaagagagatctcacaatgagcaagtagctaaaagagcaaaggctcttaccatcttgcacccaattgtggatgatgatgcttttatgagaatttcaaacttggatacaacaaaggagattaaggagaagcttcaagatgagttctttggaaatgagaaagccaagaaaatgcaagttctcaaccttaagaggagtttgacgatgaatgaggctgaaaacataaaagatttcatgaccagattggtgaaggttatgaatcaaatcaaattacttaggggaaaatttctagagagtaggatagttgagaaagtcttggttgtcttaccagaaaggtttgaacccaagatttcttcattgaagagtcaaaggatctctccataa

SEQ ID NO: 84447 - DNA, 228 bp, Glycine max
  Peptide Sequence Number=SeqID_201225
atgataccgacccaggcaggtgaccagcctagagatgcaccagcagcagaccctgaggagtacatacagccgcctagcccccaggatgattacgatggctatgaggtgattgcacaaaggttggagcgtgtgctcaaccttaggatggattgcctgacgatcgccagagggggagccagtgctaatggaagtgtcagggctcgacagagacggcgcacagagcattga

SEQ ID NO: 84448 - DNA, 552 bp, Glycine max
  Peptide Sequence Number=SeqID_201226
atgggtgatttccaaggccccttcatagtgtcaccccctccttcactctcttcctcggataaatccagcacaaccatgctatactatgggctagtagtggtggggattgcagccatggcattagccctatataacttcatcatcatcaaacgaagtagaaggcgccatatgcaatcacaggctgcaggggcaaatgggttggtggagggggcggtgatggaaagtagtggaactgagaactgccaaaggaacaacttcaacatgctctcaagcttcaagtacaagaaagaaggaattggaaatgatggtgattatgattatgaatgcccagtttgcttatcgggttttgaagaaggtgaagaagtgaggaagctgccacggtgcaagcactggttccacgcaccgtgcatagacatgtggctctactctcatctcgattgcccaatttgtcgaacacctgttgggcaattctgtcaccgtttccattctggtctggggttactggaatccagtggtggtggtggcggtggcggtggcgtctcggtagtatga

SEQ ID NO: 84449 - DNA, 624 bp, Glycine max
  Peptide Sequence Number=SeqID_201227
atggctctaagtttcaacacttcaaattccttgtatgattttgtggtcagagagggcaatggtgttaaaggcgtggcagatttaggtttatcagagttgccagagaggtacataaaacccccagaggaacgaatggacaagcaagattcaaggacatgtgatgctccacccattgacctgtcaaagctcaatgtaccagagcatgagaaagtggtggtgaaccatggtgtgcctttggagttattggaatcacttaaagatgcagctcacacattcttcaacttgccaccagagaagaaagctgtgtaccgcgcagcaattaggccaatcctagtcacaaaacttgggactagctttgtgcctgagaaagtggacctgggaatggaaggactttatcaaggtatcgtcaaaatcttgattagtaagcttggggtgtcagcatatggctcaagaattgagcaaatcctgggtgtgaagatagttaacatgaacaattacccaccatgtccaaatccagagcttacagttggtgtagggcgtcactcagacttgggaactattacagtgttgctgcaagatggaattggtgacttatatgttaaaatggaagaagacaattgttga

SEQ ID NO: 84450 - DNA, 156 bp, Glycine max
  Peptide Sequence Number=SeqID_201228
atggaaactacaagagtgctgaacaccgaacaagaacaactagcaccaaagccaggggaagttgtaatgcaggattacactaaaaacttctttgagaatgctcatcaacgtaaaaagattcttgattttgtaacattccgtttattttttaaataa

SEQ ID NO: 84451 - DNA, 225 bp, Glycine max
  Peptide Sequence Number=SeqID_201229
atggtgcacgttaaaagtttctacgtcgagccgtcgcagagacgaaattggaagtactcgaacatgaatgaagctgaagctgctgggaggggtgtgaggtatttagcccaaatttgtttgcatttctgggctatatcttcagccccattttcagctgtgggttcgggctctccagaatccgtcgtagccagaagaatttattgcaccagcaattttcccacctaa

SEQ ID NO: 84452 - DNA, 402 bp, Glycine max
  Peptide Sequence Number=SeqID_201230
atgcaagtttctctatcaaatcacaagagcactaagtctgccattaggaatctaaaggtacaagtgggccaattagctaagcaattggttgaaacgtccatgaacagttttgggaccaacacaaaaaagaatcccaaggaaaagtgcaaggtagaggcaattgagcaagaagctgaccttgttgggtggcacctgaagtctgtgtttctagaagaagatgaagtcaagccagttgtgaatccagcagccccttccattgtcctcccgaggccaaggggagtcaaggcccaaactactccagacgctccaccaactccacctccgataatccttcctccaaccacctcttctacagccaacaagcctttttcctcctctttccaacaggagcatctagtctag

SEQ ID NO: 84453 - DNA, 255 bp, Glycine max
  Peptide Sequence Number=SeqID_201231
atgtcgcgagggagggcttcattgaggggaacttggaaagcgcttcgactccacctcacacgcacgtcgaagcagagctcttcactgagggaaggcaaagtggttgacggagggctgccaaggaagttcgagagagctcaagagggagactgtacggcagctagttttatggctgtgatttccactgagacatattctaaggagattttcaataaccgtcttataatgtgtgtcgcaaaaggtatttttcattag

SEQ ID NO: 84454 - DNA, 510 bp, Glycine max
  Peptide Sequence Number=SeqID_201232
atggcttctgggcaccgcaccttccatatgggttccatgagtgcacctctctattgctcttcattctggttgcagtcgccgatgccgtttcagagcgagttcaacgagtttctcaaggccaccgacactaaggtcgccatcgaagaggaggctctgaaatcaatgatggcatcgctagaagaagaaatggaagaaggagaagaagccaaatcgtcaccgattccaccggtgcaaaagaaagcacaaccgaagaagaaagcggttactagtgatgacgtggagatagtggaggtgcgaaagcttgtggagaagagaaacattccaaatattttgaatctcgaggatggtgagtttctgaaagagtctgggtgtttccttcttggtaggaagattaaggttgcagtttcaacgactagaagagtgaatagcctgggcatgcaatacttctcgatgaaagctctattaataggaggctggatgagcttggtgggggtgaccgacactccatag

SEQ ID NO: 84455 - DNA, 438 bp, Glycine max
  Peptide Sequence Number=SeqID_201233
agtgcggagcaccaacattggtttgaggccatcaaaggctggtcattcctcagagagagacgagtccaactaagggatgaagagtatgttgagttccaggaggagatagcccaaaggcaatgggctcagctcatatcacccatggctaagttcgatcctgaggactttgcccataccgtagcagggagacgggtgcggatcatgcgcactagcatgaccaccctcatgcaaatttggatgacgttgttgcttaacaacattctccccagtgaccataattcagaacttaccctaccaaagtgtgagtgtacatgttgcccaactgatttcagatgtcatttaccagttcgcagggattacgcctctgagacacctagtggacctggagaagtccaacagggccctaggtttcctgctctgatcacaggcctttgctag

SEQ ID NO: 84456 - DNA, 396 bp, Glycine max
  Peptide Sequence Number=SeqID_201234
atgggaatgggtgagactcccccacatcaacctgcacctgtgcctccaactgggttgctcatgaagcgctgcaagttcatttggcgccttcttttgctctctaatctcgcgcttggagcttatctatttgcaagtgcaaaaccaagagattcgatggagattaatagaagaacagcacaaaaatcgcataagggaaaagccagtgttgaagtttctcctgaacccaccacaagttcaattgatttcaattatgatgatttcttagtgcctgtcacaacacctgtgaaagtgcaggctcctattcctgaagaacaacaacgtgaaattttccagtggatgctggaagagaaaagaaaactgaaacctaagaaccctgtagagaaaaaaacaaactga

SEQ ID NO: 84457 - DNA, 276 bp, Glycine max
  Peptide Sequence Number=SeqID_201235
atgcaagaaaagatccaaggttattgcttacatagccaaccacatggaaggaatgaagaaagattaaaaggaagatccatatatccttggttgcgagtcacgttcttcaagttgaaggagggtgttggagaacacgttaaagatgaggttctaggggctataagaggaattcaacgtaagtttcagttcacttgcgggggaaatttctctcccgccagagccaaagggttcttcatagcttcccttgaagtttttcctggattaaatgaaccatga

SEQ ID NO: 84458 - DNA, 1272 bp, Glycine max
  Peptide Sequence Number=SeqID_201236
atggcgtcaactaaaacggtggagcacattgtcctgttcaaggtgaaggaggaaacggagccgtcaaaggtgagtgacatggtgaacggactcggctctctggtgtcgctggacccggttctccacctcagcgtgggcccactcctccgcaaccgatcctccgccctaaccttcactcacatgctccacagccgctacaagtccaaggaggatctcgaagcgtactcagcacaccctagccacgtcagcgtcgtcaagggatacgtgctccccatcatcgacgacatcatgtccgtcgattgggtcgccgatgacctcgccaccgccagtctcgttccgccgccggggtccgcggttcgagtcagcttcttgaaattgaaggaggacgcggataaggacacggtgttgggcgtggtgagaggaattccagagagttttaagcagattagtgagttcagtcttggggagaatttttcgccggggagagccaagggtttctcgattgcttcgctcgcggttttcccggggccgagggagttagaggcagtggattcgaacgaggagttggtgaattaccagaaggataaggttagggatcaaatcgagagtgtggtcgtggttgattatgtggtgccagcgcctcctcctgctcagagatggatgaaaccccttttcttcttcttaactacccaaccaatcttatatctccctggcctatgctttgtatatgtaaactgtttcgttatctatgcaagcacggacacctcagctccttgccgtgtctcgtgcgtccgtgttagtgtccgacaccgagcgtccgtgttagtgtccgacaccgatacgacatctgtactacgttctatattttggacattacaagtgtctgtgtcgtgtccggtgttcgtgtcggtgtccatgcttcatagtttgttatgcgattttaccagaataatgtctcttgagtgttgctatgatgctgtaaggctattagttcaaacaattacttgcaaatggtgtaagagagcaagagcaacttcatacacagttacacatttaaccctccctggaccttttcacacggctatcattggcaccccttctcttgttcttcattcaccgggcatattcactctccacgagtactttaaacacgcatggcctaaagaagctcaatctcattcactcctccacaagaggaatcctaacaagtccacaccaagcattccatttggaggtctctattttccttggacgtgtggcattagctcatag

SEQ ID NO: 84459 - DNA, 330 bp, Glycine max
  Peptide Sequence Number=SeqID_201237
atgagggttcatgatagtcaggcaagtccaagacctagcgtgacactcgttagacctccactccctatggctcactcagacccggtgtgtgagtggagaaacctagatgactacccaaccctacttgcaaaacaaccagaaaattcccagacagaagcaaagcttcatggtgaatcaaaggtgattcaaaggtgttttgatgataacaatgatgatgacaaaggtgatgacaaaaagctcaaagatcaatcaaagaacaactcaagtgaatcaaagatcaatcaaagaacaactaaagtgaatcaagaacaattcaagagttcaagataa

SEQ ID NO: 84460 - DNA, 375 bp, Glycine max
  Peptide Sequence Number=SeqID_201238
atggtgaaggtatctactcgcctaggcgagctgtgtattgacctagtttctagacagcaaaagaggtgtacatctttgggccattttgcatggcttcaagatgacacaggatacagttgtactcaccttatcatggaagtttattctgcagaagctgtcggattgatctcaaaacctgggttcatggatcatgcttgcttccttgccgtcagctgctattttagacatattcaaagaagtcagaaaactgttgcagattatgtttccaaggatgcgttgaggtgtgtgcagcaagtggtagtcttggaggatcctccttattacattgctgctagtttagctgttgatgtagatggcactttgcctctgctttag

SEQ ID NO: 84461 - DNA, 273 bp, Glycine max
  Peptide Sequence Number=SeqID_201239
atgacttcttcgcttaaagacgaagaccccatatttgatctaattgagtatctccctatttcgtcagttgaaaaatccaagcaaattttggaagagttcattgatatatggaaagaagtcgtgtctaaaaaatcattagctggtcagttcatgcatacagaaccaaattatgcagaatatgggctttctgacaattatacctctcagcatacagctgttcagtatgctgctgcgttggcccaactgattcaatctgcacagttacggaattag

SEQ ID NO: 84462 - DNA, 936 bp, Glycine max
  Peptide Sequence Number=SeqID_201240
atggcttcagggtctggaaaggacggtcctggcgtcccaaggaagcctaaatttaaaccaagagccccacctcgtcgagtgataaagcaagaagttaaagctgaagtggttgatgatgctgatgcagaacaggctgctaaggagaatctgctgaagcgtttcaatgagagggagagtgccatgaaggcaaagtacaaggttgagaaaaaagagaagcagaatgagggaattgttaagaatactagtgaagtgttagcttcacaaattgcttttggttatggtggtgaatcaacttctatgaaatcatacggtattcccaggggtgggagcagtatcaacatcaatctgagttcagcatctagtgggggaaaagagaaagaataccaagaaccatgggactattacagtaattatccagtaactcttcccttgaggaggccttattccggaaacccagctctccttgatgacgaagaatttgcggaggctgcacagtccagaacttatgaagaaaacgcatcaaattcaacaatggatcttggccttttggaggaaaacccagaggcaagtatgttcttgattaatttgcctacaaaattgcctatgattaaacaatcagctactgctggagacaaagatgttaatgagaaatctatacctcatgggggttcaaaaaacgtggaggagctctgtgagctgaacgagttatcatctggcttcatgggtaaaatgcttgtatacaaaagtggtgcaatcaagcttaagcttggcaataccctttatgatgtttcctcgggtatgaattgtgcatgtgcccaagatttggttgctgtcaatactgctcaaaaacattgttgcacgattggggagatcagcaagcacgttactataaccccggatgtagacgccataattgacaatttgtctgatttgtga

SEQ ID NO: 84463 - DNA, 1782 bp, Glycine max
  Peptide Sequence Number=SeqID_201241
atggctactcatctcttcagactttctctctcctcgcaacccaagctctgcttcaattacacgcctaatcatgcactccacttcatttctccgctgccggcaaaacgacgtggcagccgctgccgccaccgtcgtgaaattctccggtcaccgttcgccgtttcgaactctttcgggaccgagattggctcgccggatttggctcttctccaagaccggagagaggcaaaagactcgccggttctactcgacgtcaccggaatgatgtgcggcgcgtgcatctcccggaaccatatcctgtttctgtccggtgggtgccgccagccctcgcctcgtgataatgtcgcagagttactatttgatggcctaaacgcatttaagaaggggtcgcctaatatgaactctctctacttaaccccggcctggcattgggatgcatcattctttgatgaaccggtcatgcttcttggttttgtgcttctgggacgttctctggaagaaaaggcaaggattcaggcatctagcgatatgaatgaactgctttcactgatatctactcagtcaagacttgtgattacttcaacagaaggttcaccttctactgacactgtgctttcctctgatgcaatttgtgttgaagtcccaactgatgatattcgagtaggtgattctgtgttggtgttgcctggagaaactattcctatagatctaactaaagaaattcatgaacagggaatggtcatttcaggaagaagtgttgtagatgaatccatgcttacaggggaatcacttcctgtatttaaggagaaaggcctcacagtttcagaagggactataaattgggacggccctttaaggattgaagcttcttcaactggctccaacactatgatatcaaagattgtacgcatggttgaggatgctcaatcacgtgaagcacctgtacaaaggcttgcagattcaatagcagggccatttgtatacagtgtaatgactttgtcagcagcaacatttgcattttggtattctgttggatcacacatatttcctgaggttttgctcaacgatattgcgggcccagaaggagatcctttgctgttgagtttgaaactatctgtagatgtttttcttcagaatttgcaaactgtctttgatttggactcttcacattattcaaaactaaggcatgatgctgttgtttcttgtccatgtgcattgggtcttgctacgcccacagcaatcttagttggcacctcacttggggcaagaaaaggacttcttattaggggaggggatgtgctggaacgcttggctggaatacattatattgctctagacaagacaggaaccctgaccaaaggaaaaccagttgtgtcggccataagctctatcctgtatggagaatctgaaattcttcggcttgctgctgcagtggagaaaactgcatctcacccaatagcaaaagctattgtcaataaagctgagtcattagagttgatctttcctgtcacaaagggacagttagttgaaccaggttttggaactttagcagaagttgacggacatctgattgcagttggatctttagaatgggttcatgaacgcttccagacaagagggaacctgcctgatttgacaaatctggaacatagtttgatgaatcattcattgaatacaacatcttcaaagtattcgaaaactgttgtctacgtgaaggagaaggcatcattggtgctgttgccatatctgacactgtgcgtgaagatgctgaatctactataa

SEQ ID NO: 84464 - DNA, 1890 bp, Glycine max
  Peptide Sequence Number=SeqID_201242
atgccttgttcatttttttatgttgaaactgtactgggtgctgacaactcaacactttatgggtgttgtgtcttagttgaagaactagtgcaaaagccctctggattgctttctctgatttctgataagcagccttcttactcgtctttgagacggcatatattaaccactcagagatgttactgcatactttcaaggctcccagcttttgatttgctctttggtgtattgaatagcatcttcacacaagaaaggctagagcgtttgacaaaaggtgttggagatttaaatttagaatttgatgaaggtaaccataaggaagaaaacctagagggctactcagacagtgttttggtgagtgatgaaccaatagaagacagacttggtggaaatatggtaatttctcaatcaagagtaggaaagtctacacctgaaaatattgtggatgatggtcaaccagagcatctaatggttgatggggagctgcagccttataaggagagaatcaattatgatgatgtcttgcttactgatcctgtaaatgataggacaacagccaaagaagattctggccctgcaaattctgaaaatagtgatcactatggagatgcttttggaaccaacaaacaatcagaagacaaacatttacctaatgctattttgcccctcctgcgctattgccagtatgaaagctctgaatcttcctgcagttttcaaggctcgccttgtgaagaccgaaattttaggagtgatgttgatgataatgagacagaagaagcatctttctccggccaagaggatttaaacgacttaaatgatattcttgaatgggccaaggaaaataaccacggaccactacaaattgtaagcgagttttaccgtttaagttgccctgccaggggctcatcacttacatttcatcctttggagcacttgcatcccttggaatatcacagatcagctgagacagttctacgtcttgctggttcaacagttgatttgaaaacgtcaagtactggtctgggattagctgatgcacacattgctcttctggtggaagaggcaaatgcattatctgtatgggctgtagcttgcttgtgcggtacattgagacttgaaaatatttggcagcatcatttcaaggttgagcttatatgcagctatggcttctatattcaagatgaagatcttgtaggaatcgttaacttaatcacctctactgtgttaacattctttgcaggagttctactagagaagcagatagttgttgtctgttctaatttggttttaccaaatgacatgcttgagtttttagatgcacctgtcccttatgtagtcggtattaagaacaagaccagtgaacttcagtcaaagtttaccaatgttattctggttgatgctgatagaaaccagagaagatttgtagaagctcaagtaaggagagtaaataagatggaggtgaagtcaccaacaataccccaactgccaagacagaaagagctagtctcttctttacgtccttatcatgcaactcttgtaggagaaagttacttgggtaggagaagaccagtatatgaatgcacagaagtgcagattgaagctgcgaaggggttcctttcagtgttaagatcttacttggattctctttgctataacatccgttctcacacaatcaccaatgtacaatccaatgatgataaggtatcattgcttctgaaggagagtttcattgagtcgttcccatatcgtgatcagccttttatgaagttgagtgctactctaaaatctgcacttgggactaagctaggtctccctaatcagctgcagtattgcagagggttgggagtggttgtattgcactcagggtttgactttatattcaactgttga

SEQ ID NO: 84465 - DNA, 687 bp, Glycine max
  Peptide Sequence Number=SeqID_201243
atgcaagctccttgttgccgacgtgctccgcccttgaaatcgtcatggcggaagaggaaggagaatgtgagtctgtctcttccggcgagcatgcccatcagatgtattctgcattggcaaccgaaccaaggaagcgttgtgaacagccaagtcctgaatgagatctcgcagtgcgtcgaaagcctcaacggcgtcaaagaaggaagatgcaaagcctccctcactttctacagacccaatttacgagaccagtcggtgaccatcgatttcccgcgcgattttctggggatatcgatgctggagcagccgaacaaatactacttcatcattcgcggccagaagattgttctggaggccgattcttctatcttgcttatcatggagaaactccagtcctacaagtccaaagtcgcccttcatttcgagggagtgctgtataaattgggtgactttcagatgagagtcattaaagttgttcccagtcaagcagaaagtctcagaggaattatgattgagacattaaaaagaatgggggtgtgggaaattgtgactgcggggaaaaagtcacttgtcctgcatcccggtcacgaaactgtcatgtctgttgcagctgcaatagcagtttttgccggagcctcactgcaatggagtcgcaatagcggattggaggatttcgttatgctatag

SEQ ID NO: 84466 - DNA, 549 bp, Glycine max
  Peptide Sequence Number=SeqID_201244
atgcaaacagaagcaaagcaacaaaaattgttgaagggtaaatccccccttgatcatgatcccggtgaagcaaagaagagtgatcaaccctcacaattcctttgtggtttatgttttaatgacaaaccagtgtctcaaatgttcaaagaaggtaagtgtaaccaccccttttgtactcactgcatatccaaacacgtggctactcagatgcaccaaaacattctcaaggtgatgtgtccaaaccctaactgtcccgtggaattgaagcccgaatattttcacaacattttggccagtgaagtcattgttagatgggaaaccgtgaggtgtgagtctttgattgttgggttggagaagacctactgtcccttcaaggactgttctgttttgttggtgaatgatggagaaaaagatgtgatcagtgctgagtgcccctcttgtcataggctattttgcgcacggtgtaaggttccttggcatggaattatgagttgtgaagaattccaagagatagaaaggagcaaagatgaaatagtgttgaaaaactaa

SEQ ID NO: 84467 - DNA, 480 bp, Glycine max
  Peptide Sequence Number=SeqID_201245
atgtggatgctaaacaagctcagctccccctacgacgacaccgaccagaaactagcctcgtacttcctccaaaccttcttcagccacatcacccaagccggggatcgaacctacaaaaccttagcttcagcttcaaagaaaacatgctccttcaaatcaacccgcaaaacatgctccttcgtcaccgccggcaccaccgcacagaaggtcatgaaggaaatcaaagccagaatggagaaggaggctgatttggacattggattggaagggtttgagttcgtcaaagggtttgaagagtgtttgaggtggtttagggtttactttgaagccttggacaggatttttccgaggacgagcaacgagcatttgatgcttgagagggaggcggggagggcaatggtggacctggtggcgtgttctctggtagagtctgtagagaggtggggggtttgggttttttatggttccactggaggatag

SEQ ID NO: 84468 - DNA, 736 bp, Glycine max
  Peptide Sequence Number=SeqID_201246
atgcaaacctcatctccgcttgcgcgctatgagcaggcgctgtcgcagggcgagtttcgtccggacgatgtacaacgtgacgccatcacccgtttagatcgcattcagcaaggcctgattgcccgccagcagcagccgcagccggcagctaaagggctgtttggccgcttatcaaagctgatgaataaagcgccggagagccatgaagcgccggtgcgtggcctgtatatgtggggcggcgtcggacgcggtaaaacctgggtaatggatctgttttttcagtctattcctggcgatcgcaaactgcgtctgcattttcatcgcttcatgctgcgcgtgcatgaagagttaacgcagctgcagggccacagcgacccgctgctgattgtcgctgaccgtttcaaagcggaaaccgatattctctgtttcgacgagttttttgtctccgacattaccgacgcaatgctgcttggtaccctgatggaagcgctgtttgcccgtggcattacgctggtggcgacctccaacattccgccggatgagctataccgcaacggcctgcagcgggcgcgttttttgccggctatcgagcagatcaagcgccactgcgatgtgatgaatgtcgatgccggcattgattatcgcctgcgcaccctgacatcggcccatctgtggaatttcccgcttaacgacgcgacgcacgcggagatggagcgcatgttcagcgcgctgtccg

SEQ ID NO: 84469 - DNA, 1029 bp, Glycine max
  Peptide Sequence Number=SeqID_201247
atgtttcttaaacttttacgttctgtggtgatgggcctgatcgtggcaggtttactgcttgtcgcgatcccggcgctgcgaatgggcagcaacgtcacctttgatcacgacagcagcgccgatgaagcgcccttcagtttcaatcagggcgtgcgccgtgctgtgccggcggtggtcaatgtctataaccgcagcgcgcacggcaacaataatcgcggcattaccacgctcggttccggcgtcatcatgaacgcgaaaggctacatcctcaccaacaaacatgtcatcaataacgctgaccagattatcgtcgcgctgcaggacggacgcttttttgaagcgacgctggtgggctccgacgccatgaccgatctggcggtgttaaaaatcagcgcctctaatctgccggtaatcccgatcaacgccaaacgtgtcgcgcatattggtgatgtggtgatggcgattggcaacccgtacaacctcggccagacggtcacccagggcatcatcagcgccaccggtcgcatcggtctgagctcctccggtcggcagaacttcctgcaaaccgatgcctcgatcaaccaggggaactccggcggcgcgctgattaactcactgggcgaactgatgggcatcaacacgctgaccttcgacaaaagcaacgacggcgaaaccccggaaggcattggttttgccattccgaccgcgctggcgaccaaaattatggataagctgattcgcgatggccgggtgatccgcggttatatcggtattaccgggcgcgaactgccgccgctgcacggtcagggcagcaacctcgatcgggtgcagggcattattgttagtgaagtgacgccgggcggtccggcggatcgcgccggcattcaggccaatgatgtcctgctgcaggtgaacgcgctgtcgctgagccgcggccggggtgtgcaaaaacgcggcgtaactagctggcgatcgaccggggaaagcgattacctcactgagcggcatcggccttcagcggcagcataa

SEQ ID NO: 84470 - DNA, 530 bp, Glycine max
  Peptide Sequence Number=SeqID_201248
agtacggcaacatgatcgacttcggtatcctggatccaaccaaagtgacccgttctgcgctgcagtacgcgtcttctgtggccggtctgatgatcaccaccgaagcgatggtcaccgacctgccgaaaggcgacgcacctgacttaggtgctggcgctggcggcatgggtggcatgggcggtatgggcggcatgatcacctccaaccaactgagtgccgccggcgaacgtgtcacctttgttgatcaacagccaggcagccaatgtcagctgctgggcaatgttaccggctcgcagagcaactggctgaccggctcaggcggtgaaggcagttcactgcgcggtgcggccaacgacctgcgtaaccgcgcagcagagatgggcggcaacgtgatttatggtgccaccagcccgacgcagaacctgctgtctgcctttgccccgctcgacagcaaaatgtcgggtcagttccagcacggtcgccatcaatggcgacactacggtgatggcgccgccacaggaatactgtag

SEQ ID NO: 84471 - DNA, 639 bp, Glycine max
  Peptide Sequence Number=SeqID_201249
atggtcatgctgacccttcaattttgctgccccgcacgctgcgtggcggcgcgactcacaggagatatcgatctcaattttcatccaggtggcgcacgcgctcggcgtgctgctgaccatgctgctgagcccggcggcggagatgatcaaaagcgtgtcgctgatcatcgccggttttctgctgctgctgccgggcttctttaccgatttcctcggcctgctgctgttgctgccgccggtgcagaagcacctgacgctgaagctgatgccgcacctgcgcgtatggcgcggcccggggcagggcccggacagcggcgtcaccatggacggcgagagagctatcaaatgaaaattcgtccgttgcacgatcgcgttatcgtcaagcgtaaagaagttgaagccaaatctgctggcggtatcgttctgaccggctctgcagcaggcaaatcaacccgcggtgaagtactggctgttggcaatggccgcatcctggaaaacggcgacgtgaagccgctggacgtgaaagtgggtgatctggtgattttcagcgaaggctacggtgccaagactgagaaaatcgacaacgaagaagttctgatcatctctgaaagcgacattctggcgattgttgaagcgtaa

SEQ ID NO: 84472 - DNA, 264 bp, Glycine max
  Peptide Sequence Number=SeqID_201250
atggccgggaaatgtggtcggcccgctgctgggcggcgtgctgccaccgctgatcggtatccgccacactttctggctcaccggcgcggtgatttttcttcgcgtttctcgccaccactttttctgctgaaagaagcgccacgtgcggcgaagaaagccgcagccggggagggtgatgagccggaaggcgtcgatcaaccggccagtggtgcggctgatgtggctgtcgggcatgctgctgatttttgccaatatgtcgattga

SEQ ID NO: 84473 - DNA, 417 bp, Glycine max
  Peptide Sequence Number=SeqID_201251
atggcggccgctgcgctgggcagcattctctccgcgccgcgccttggccggctggccgatcgcatcggacatgcgcgcgtgctgatttatggcctgctggtctgcgcgctgctgctgattccgcaggcatttattagcgcggcgtggcagctggtgctgctgcgtttcctgatggggatggcgctgggcggcctgatgccctgcgtgacggcgttgattcgtcataatgtgccgcagcggcaggtcgggaaaatgctgggctatgcgacctcggctcagtatgtcggccaggtgagtggcccgctgttcggtggctttatcggcggcgcgtttggtatgcgcccggtgtttctcgccacctgcgtgattatggcgctgtgcgcgctattgaatgcgcgggtgctgcgtaaagcttaa

SEQ ID NO: 84474 - DNA, 411 bp, Glycine max
  Peptide Sequence Number=SeqID_201252
atggcggaaccatcaaaaaagcggaaaggaacttcgagtcggagtcagcgacattccaggtcacaggaagcaccaattcctccctccattccctctggatcattattctcatcagaggaacagcatatacggtacacaaacctcttttcctctcattccattgtagacccaaaattcatagatatggagttcttctcaaatgagaattttgaatgcttccaagcatttgaaaactccaatcttattccattcatgtctctgaaattacctcttgtaggcctaggatcttcttcatcaatggattcctttgcttcttggaagatgaatggcagcggaatggagaaaggaagagagagagaggagatgccacttcaaggagaagatgagtctagaagaagctcaccaccatag

SEQ ID NO: 84475 - DNA, 741 bp, Glycine max
  Peptide Sequence Number=SeqID_201253
atggaaaagaaagggttgggagagggggatatgatccaattggaagacatgggatttgagtctcacattggaagtgcgatattttgctgtgggatttataagttcctgggtgctctagctgcaaaggatatgcttgcatttacaggctgcagtcacaatttgactgcagaagaagatgaagaaatgagacagatgcgatatgaagtcagtcactggaaggaaaaggagattaatgggaccgagaggagattgcttggaggttgtccattaactccaagggaaacgtccctattacttagagcactgggttttccatcacacaccaggatttttctggtagctggagaagcatatggaagaggaagtatgaaatatcttgaggatgatttccccaacattttctctcattcctctctgtcctctgaagaagagttgaatcctttcaagaatcatcagaacatgttggctggtttagactatgttgttgcccttaagagtgatgtatttctctacacttatgatggaaatatggcaaaggccgtacaaggtcataggcgctttgaagacttcaagaaaaccatcaatccagacaagatgaattttgttaaacttgttgatcagttggatgaaggaaaaatttcatggaaaaagttcagctccaaggatgtatttgtgaaacaagatagtagtagagacttccctgaaggttgtctgtcttttgatggaatggccgagctgtaa

SEQ ID NO: 84476 - DNA, 771 bp, Glycine max
  Peptide Sequence Number=SeqID_201254
atgggtgcgaacgctaacgacttgtccactgagatagattgtactaagaaggtttccaattgttggggaaatggtcaaataccctttgcacttccttttctcacactccccaattccaacttcaccactctcctctcttcaccacctcaactactccacacatcattcaccactgccgctgacaattttttcagatttgtacactccctcgcttctcagaaccccttcctcaacaaagttctctctctccccgccgaatttcacaccttatgcgtgcaggagaggccttatgatattgttgatgtttgggttcagattcggaagcaaaggaacgtggggttggtgtctagtcataatttcgctgccgttttgcccgggggttcggtggcagggctagtggtggctaacggggttctcaatttcttgaacatttacaacactttgctcattgttaggcttgttttgacatggtttcccaacactcctccttccattgttagccccctcagcaccatatgtgacccatacctgaacatattccgtggacttattccccctctgggaggaaccctggatctctctcccattctagcattcttggtcctaaatgcattcaccagcactgctgctgcactccctgccgagcttccagtcacagaacaatcaaaacaaggtcttgcagcgccattgccctctactacttcacagaagaaatggatgagacggtttcaagggaacaggtcaaggacatctggtgatgatgctaaatag

SEQ ID NO: 84477 - DNA, 996 bp, Glycine max
  Peptide Sequence Number=SeqID_201255
atggcgatattctctgaatcgaatcaccatcacaacacttccgatggggtctcccagcgagtcaacagtccgcgtttctccggtccaatgactcgccgcgcccactccttcaaacgtaacaacagcagcaacaatagcaacaacaccgccaccaccacctcccacggcggcggcggaggcagtggcggcgtcgagattgagcttcaaatcaactcgcccagatcggaggaagcgtcggagggtgtgccggtggggaagcacagccaccatcacgtgacccagagagtgcacgtgagagggttgctgaagaagccccttgcgtccatcgttgaggatttggggttgagagaaaggaagaaaattgggcactggatgttcttagtgttctgtggggtgtgcttgttcatgggtgttctcaagatatgtgccactggttggcttggatctgctattgaaataactcaatccaataaggaactatctgactccattcctagtctaactctaatggacaaaagctcccttggttatgcatatagggggggagcaagtgatgttgaacgaacattaaaaacagtagcaacaggagtagacggcagccatactgccatgactgaagattcagggatctggtccaaacccaacagtgacaatttcaccaaatgcatagatcttccaaagctagatgcaaagaccaatggctacatttttgtaaatgcaaatggtggcctgaatcagatgagatttggggtcaggctgtgttcatttctgatgatatgtgatatggttgctgttgctaagattgtgaaggctacacttgttcttccttctcttgatcacacctcctactgggctgatgacagtggcttcaaggatttgtttgattggaagcattttattaatatgctgaaggatgatgtccacatagttgagaaattacctcccgcctatgctggaattgagcctttcccaaaaactccaatatcttggtcaaag

SEQ ID NO: 84478 - DNA, 2439 bp, Glycine max
  Peptide Sequence Number=SeqID_201256
atgaaggggtatccactcgctgattgtactgtttctccagcactgcagcatgtccttcatgaggctgctactcagaattcttccttgtgttcactgcaaacacaggaacttcccacagatgttgctttactgaacgtaattgatcaatttccaggggttttccaagccagaatggggctgcctcctcgtcgtgaccatgatcatggaatcacattgctgcctcacaccaaagcagtgagtgtgcacccatatcggtacgcttaccatcataaagacaaaattgagaaacaggtccaccaattgctggaagagggcgtcattcgtcattccataagtcctttttcaagcccagtgatattggctacagaggtggacaaatatccaattccgacgatccacaaacttttggatgagctccatggttccaccatattcaccaagatcgatctcacatcaggtttccatcaaattcgtatgaaggaagaggatgttcacaagaccaaattccgggcacatgacggccattacgaatatctcgtaatgcccctgccacctttcaatctaccatgtgtttcgtccatttttgcgcaaaagtgtaactttgggctcacctccatagactacttgggacatgtgatttcctcacatggtattcaaatggatccttcaaaggttcatgcggtgctcaaatggccaatcccacaaaccaccaagccagttcgcgggtttttgggtctcactggctactatcgctggttcatttgtgactatgcgtttgagcagcttaagaagtgcttggcatcgttttcagtgctagctttgccggattttaccaaggagttcattattgagtgtgacgcgtttggacgtggcattggctcagtcttgatgcaagaaggaaagcccattgcatacttcagcaaggctctttctcccacaaatgtttctaaatctgtgtatgaaaaagaaattatggcccttgctttgtcaattcagaagtggcaacattatcttttgggtaggagcttcacgatctttactgaccatacaagcctttgccacctgctgcagcaacgtctcacaaccccagaccaacagtgttggctctccaagctgatgggataccagtttgaggtgtggtataagtctggtcctgataacaaggccgctgatgaggtccagaaaatcaatagaagcagaatttggggccatttctgtcagcccctactggatagattttccaactattcgagacgagggagtgttgattacctaacactcactgccttgcaaaccgatcctaattctaaacctgactatatggcaagagaggggtggctattctttaagggaaaattgttgcttctagcatcttcatctctgattcccaccttgctcaaggattttcatgacactcccgctgggggccactcaggtatgaaaagggcaatcatggagtacatccggggctatgatatatgtcagaagaataagtatcaagcaatgttgcccacgggtctactgcaacccattcccattcccgaggttgaccgcctctcaaaatatgctcatttcatggcattgaaacatccatttatgactcgttttgttgctgaaagtttcgttcgtgagatagctaagcttcatggatttcccaaatccatcatcagcaatcgtgacccattattccttagtaagttctggcacgagctattccacttacaagggatggttctacgcatgagcacctcttaccacccacaaatggacaaccaaacagagttctggtacaacacatcttccaatgcttctactggaatgaccccttttgaggtggtctatgggcgcaagccgccttcccttctctgtttactggtgggcgagacccaagtcgagtcagtggccaatattctgttagatagagacgaagcattgcggcagcttaagtttcatctccaccccgcccaacaatcaatgaagcgttacgtggatgctcaccgccgtccacttgctttcgctgtggtgatagcaaaggttggagaagtggcctataagcttcaactccctgctacagccagagttcaccctgtatttcatgtctctctgcttaagcgctccatcaaacctggagtagtggctgccggccttcctcctggactggaggttgctgatgttgatcctcttgagcccgaagccatcctggcctccagagaagggaagtctaaagccttggagtggctaatcctgtggaaatcacgaccagttgaagatgcatcctgggagtccgctccttccattcgagccaggtttccttcctttggccttgaggacaaggccaatttcccaggcagcggtattgatagaaaccttgtcaagccctttaggctctattactcccgtaggcccaaaaggccaaatgagactttgcatgcaagttag

SEQ ID NO: 84479 - DNA, 570 bp, Glycine max
  Peptide Sequence Number=SeqID_201257
atgaaggagcttattttcaaagactgtagaaaattgactgatgcatcgataaaagtcattgctgaacactgtcctgggttgtgtgcacttgatcttatgaacttggacaaattgacagatttatccttaggatatcttacaaatagttgtcaagcacttcgtacattgaagctctgccgcaatctattcagtgatgaagcaattgctgcattcttggagattactggagagtccttgaaagaactttcacttaacaatattaagaaggttggccaccacacaaccatatcacttgcgaggcatgcaaaaaatttgcataccctagatctatcttggtgccggaatttgacagacaacgagttgggtttcattgtagatagctgcttctcactgaggttgcttaaactttttggatgctcactggtgacagatgtttttctgaacgggcactcaaacccagagattcagatccttggattgaagatgtcccctttattgcaaaatgtcaaagtgcctgaaccctatcaaggtcccttgcgttattcaccagtttcagtagatttggtataa

SEQ ID NO: 84480 - DNA, 2688 bp, Glycine max
  Peptide Sequence Number=SeqID_201258
atggagaggaaccggcgtcgttccgacggagagagtagttccgtttccgctgaggacactcgccggaagcgcgccagagtctacttcgatttcgatggccctcattgtattgtgaagtgttcaaatgctgggaaatccagtgcatctgttgatgaatttgtggattatgataattttcaaagatcgtctcttcgatccaacgatgatgatgcattgaggtcgatgtctgctggtgaggagagtaactttgacgaaggagatgacagtgacatctcaaaagtggatgatctagaggtcaagatggatcttacggatgacttattacatatggtcttttcgtttttggatcatcccaatctctgcaaagctgctagagtctgtaagcagtggtggactgctagtgctcatgaagtcttctggaagagtttgaattttgaagatcggagcatatctgtagagcaatttgaggacatctgtaggcgttatcctaatatcatggcaatccgtatgtctggtcctgcctgtaaccagcttgtcatgaaggccatttcttcgttaagaaatcttgaggctttaacattgggaagagctcatataatggataattttttccatgctttggccgattgttctatgttgaaaagactgaccatcaatgatgctatacttggcagtggtattcaggagatatcagtcaatcacgacaggctgtgtcatctccaattgacaaagtgccgtgtgatgcgtatagcagtcaggtgcccacaacttgaaactatgtcattgaagcgcagtaacatggcacagactgcgctcaattgcccccttttgcaagagcttgatataggctcttgccacaaacttcctgattctgctattcgttcagctgttacatcatgctcgcaattagtttctttggacatgtctaattgttcgagtgttagtgatgaaacattacgagaaatatccatgaattgtgctaaccttagttttcttgatgcatcgtactgccccaacctattcttggagactgttagactgccaatgttaacagttctgaagcttcacagttgtgatggcatcactgcagcctcaatggctgcaatatctcacagttatatgttggaggttttggagcttgataattgtagcctattgacatcagtgtctttagaccttccccgcttgcagaatattagattggtacactgtcgcaaatttgctgatttgaacttgatgaccctaacgttgtcgtctatcttggtgtccaattgccctgtgctccatcgtatcaacatcacttcaaattcacttcaaaaattaacaataccaaagcaggacagtttaaccacattagctctgcaatgccaatctttacaagaagtggatctctctgagtgtgaatctttgaataactctgtatgcaatgtttttaatgatggtggaggttgcccaatgttgaaatcgttagttcttggtaattgtgagagtttgacatcagttcagttcatcagtacctctctaatcagtctttcccttggtggttgccgtgcaataactaatcttgaactcacatgccctaatctagagaaagttattttggatggctgtgatcatttggaaagagcatcattttgtccagttggtcttttatctctcaatttaggaatatgtccaaaattgaacacactcagcattgaagcaccgtttatggtttcacttgagttgaaaggatgtggtgtactatctgaagcattcattaattgtccactcttagcatctctcgatgcttccttttgcagccaactaacggatggctgcttgtctgcaacaactgtctcatgcccactgattgaatcattgatattaatgtcatgctcatcaattggttcagagggtcttcgatctctgtattgtcttccaaatttgactgttcttgacttatcatacactttcttggtgaacatgcagcctgtctttgattcttgtttgcaactaaaggttttaaagctgcaagcatgcaaatatctcactgaaacatcacttgaacctctttacaaaggaggtgctttgccagcacttcaggagttggacttgtcttatggaactctctgtcaatcagccatagatgagcttcttgcttgctgcacaaacctaactcatgtgagtttgaatggctgtgtgaatatgcatgatttgaattggggaagcagtcgtgggcaaagtgacaatttccctgctgtaaacaccccatcctgggcaagttctaatgagattatctctgaatcaagtgagcactctgctcgcttactacaaaacctctactgtgttggatgtccaaatattaggaaggttgtcattccattgagggaaaattgttttcatttgttatttttaaacctttcgctctcggcaaatttgaaagtggttgatgtcacatgtctcaacctatgctttcttaatttaagcaattgttcctctttggaaattttgaagttagagtgtccaaaattgaccagtctattccttcagtcttgcaatattgacgatgaagctgttgaagctgctatatcaaaatgcactatgctggagactcttgacgttcgcttttgtccaaagataagctcaataagcatgggaagattacgcacaatttgttcaagtttgaagcgaatatttagcagttag

SEQ ID NO: 84481 - DNA, 597 bp, Glycine max
  Peptide Sequence Number=SeqID_201259
atggagattagggtttgcccaaaaatggaatcggtgccaaacccaaacaacggggaggaacccacttcgtgggatgagctatacaacatcaatttgatgccttcagagttatttctcaagttccgaaaagaacttcagggcattcgagttggtctcaatatggagttctataatgccccagtcaatgaatatcaagcaaagcttgtattgaagcctttaacacctgaatggaagtggaagataatctatgagccccttcatcaagatgttcgtgttctttcaaaaaagatccccatcactaaatttcttaatcttcaggttggtgtgggacacaattttcaaatgcatgctactggttggaaatggaagctcaccacatgtttgggtggagatggtatatcccggatccgaaataagacatcaattggcttgtttcccggttttgatttacggtttggatggagagcagactatgttcttcctgaaattactggggcactgggtactgatgagccaatgttcaacatgcactcaggacggctacaagcatcactagatagagttgaggccatcttaacccacactgatgctccttga

SEQ ID NO: 84482 - DNA, 918 bp, Glycine max
  Peptide Sequence Number=SeqID_201260
ggttcaaaaattggggctactctctggcaagaactgttcactaagttgcgggacaagttacattgtggttcttcgtatttgattcagaacctgaggattgttgacaaccaatctgaatacagagtcagtcaagttccacttttggtttatttcctgaaaactacatctgtcaaggaaatccaacgtccagaaattgcttctaatattgacctaattactccttttgctgatataatctctggggtggcaccctgccatactttagtggacatcgttggtgtggttgctgatctcattgatgttaagacagttaatccccctcacaggatgacagactatgctattcagctccatgatgctattgacaaaaaccttctgcttcaggaaccatttgttgttatgttgaccctgggtaaaatcaaggatgctataggtcagtgtggtgttgacaagtatcctctaaacgtgcaaaatgtcaaatttggatctagattgtatgtgaacactgacattgcaaagatacaacaatttcgtcaaagtttgtgtgtcccattttactgtggtggaataacccatgataaaggtggttctcagtcccaatctagccagagtaatctggtggagaagtttttgcacaatgctcgggtggtcagtataggtgaaattaacaacctcagacaggattgttactgcttgactgttgggacagttgaagaaatcatcattgatgctccatggagttatgacagttgtcctaactgtaccaccacatttgattcatcaaaaggtggctcagcttgttgttcttgccaaaacagtgtgaccgatacagttccacgaaacttccttttctgggatgcaacatgtatcaagctgtttggtaagactgctgcagaatgtcgagatgaattgatagcg

SEQ ID NO: 84483 - DNA, 917 bp, Glycine max
  Peptide Sequence Number=SeqID_201261
atggattttgggtcttctttcttcgtgacccaagagaagttcaacctgttccacagaatggacagagaactctacaagattcttgtggtgagccttttccgcgatccagcagagtccatgcaagtccatgcaatgtggctgtggctggagagggtggggtttcgtaacgtggtgaagagggtattggccttgcccaacatattgatcaacgacgttgcagatgaaacagtaatgtgcctgaactgcatcaacagtaacaacaataacttaaagatgtcatctttattctcttccgagagcagcgagattccccttctccagagccttgtggataaggaaatctctctccaattcgtgtatgaaaaccgaagcagcgcgcttcaaggagtggccaaagtgatgcaagaggtgtgtgtgagggcattcactgacatcatgcagcaagccatgataagaaactcaaacgacagagcaataagacaaagtagttcatcagagaataacaaccataatcatgggcctgtgtggtttgggtcaattgggccagctaatttgaggggtgaagaagtgccagcggatgataggactttgttcgtgacgttctcgaaggggtatcgcgtggaagagtgggaagtgagagagttctttgccatggcgtatggggattgcatggaggcattgttcatgcaggaagtgcagccgaatgaacaagcactcttcgctcgcattgtttttcgtaatgtttccaccattgacatgatactcagaggagctaacaaagccaaattcaccatcaatgggaagcatgtgtgggctcgaaagtttgtgcctaaacgaaacgccacaaggagtttgcttgcaacatcattcaacaactttcccggggaatcctccagctctagctctagctctagacc

SEQ ID NO: 84484 - DNA, 240 bp, Glycine max
  Peptide Sequence Number=SeqID_201262
atgacacttaaaaactctttggctatttactctcatcagtttcaagaagaccgtatgaagggtggccaactcagatcctcaacaacgtatagcgagaagaatgtgaagaagtatgccagaacaaagaaaacatgcatgagtcagaaaccgatagtttctgggacgtgtccagatgtgcaagctcagaatcagttgcagacggtttttggtcatcatcataggaagcagaaaactagttaa

SEQ ID NO: 84485 - DNA, 897 bp, Glycine max
  Peptide Sequence Number=SeqID_201263
tacgtcgacgtttcgggaggggcattatgggaagacgtccttaaacgctgcgtttcggagtttggcctcgccccgaggtcgtggacggattatctcagcttaacggtgggcggaacgctctcctacgccggcgtcagcggtcaaacattccgttacggtcctcagacatcgaacgtaacggaattggaagttgtaactgggaaaggagacacactgtgctgctcccaaacagaaaactctgaacttttttttggcgcgcttggtggcttaggacagttcggtatcattaccagagccagggtcgttcttcaagaagctccagatatggtgaggtggataagagtggtatactctgagtttgaggagtatgctagggatgcagagtcgctggtggaggaatattgttttgattacgtggaagggttcgttctggtgaacagtgataaccgggccaatggatggcccacagttccattgggcccggaacaagtgttcgacccgactcatatccctttcactgctggtcctgtcttgtattgcttggagctcgctcttcactatcgtaacgcggatcatccttctcgtgtcgatacggatgtggatggattgcttggacggctacgattcattcagggtctgaagttccaggtggacgtgacatacatggagttcttgctgcgtgtaaagcgtgtggaggagcacgcgaaaggcaacggaacctgggatgcacctcacccttggctcaatctgttcgtgtccaagtcccacatcgttgattttgatcgtgaggtgttcaagaagattctcaaggacggagtcgatggacccattttagtctaccctctcttgcgaaacaagtacgtacttggttcccttcctacccttcatcaactataa

SEQ ID NO: 84486 - DNA, 1548 bp, Glycine max
  Peptide Sequence Number=SeqID_201264
atgactttctcattcttcaccgctattcgagcttcccattaccgtactcttactcaggcaacagcttctgataaagggttaatcataacaacacctgattcctggtttttgggttattttcgtgagcacttaactccttctcatgttttggaggttgttaaaaggtttaacaatcccaacctgggtttcaagttctttcggttcactagggagaggttgagtatgtctcactcattttggacttataatatgcttttgaggtccctttgtcaagcaggtttacacaattcagcaaaacttctatatgattctatgaggtctgatgggcaattgcctgattctaggcttttgggatttttggtttcttcttttgcactggctgacaggtttgatgtttcaaaggaattgcttgctgaagctcagtgcagtggggttcaagtagatgtgattgtttataataactttttgaacatattgataaaacataatagattagatgatgccatttgtctatttagggagcttatgagatcacattcttgtctagatgccttcaccttcaacattttaatccggggtttgtgcacggctggagacgttgatgaagcttttgagcttctcggtgacatgggaagttttggttgttcccctgacatagttacgtataacattctattacatggtttatgtagaattgaccaggttgatagagcacgggatttactggaagaagtttgtttgaaatgtgagtttgcccctaatgttgtgagctatacgacggtgatatcgggttattgcagattgagtaagatggatgaggcctcttctcttttttatgaaatggttagatccggaaccaagcctaatgtgtttacctttagtgcccttgttgatggttttgttaaggcaggtgacatggcttctgcactaggaatgcacaagaagatactctttcatggttgtgctcccaatgtcattactttaacttcattaattaatggctattgccgagctggatgggtgaaccatggcttggacctatggcgtgaaatgaatgcgaggaatattcctgcaaatttgtatacctactctgttcttatcagtgctctatgcaagagcaatagactgcaagaagctcgcaaccttttgagaatattgaagcagagtgacattgttccgctggcttttgtctacaatcctgtaattgatggatactgtaaatctgggaacattgatgaggctaatgcaattgtagcagaaatggaggagaagtgcaagcctgataagttgacatttaccattctcattattgggcattgtatgaaaggaagaacacctgaagcaattggtatcttctacaagatgttggcatctggttgtaccccagatgatatcactattagaactttaagttcctgtcttttgaagtctgggatgcctggtgaggctgcacgcattaaggaaactctatttgagaaccaggaatccattcttaaaaaatcttatcatgaaagtatgaatgcagataagaaaattcctgttcattaa

SEQ ID NO: 84487 - DNA, 279 bp, Glycine max
  Peptide Sequence Number=SeqID_201265
atgaatgtcattgcctctggtgactgggaaatatgttcttctattgttttctggatcggttccttcgccaaacattacagcaaaaaagaaggagtagagacgagaatcatcatcacggaaagggcaggatggacgaaatcagtgtcttatctttgctttcctcttatctccgatgagagatatttggcaccctttgttgcacaatatgtgaagtcccgagatgtgccgaaaatcaaaaggaagcaggcttacgcgatccgtgaaaattccgtgatgtga

SEQ ID NO: 84488 - DNA, 1302 bp, Glycine max
  Peptide Sequence Number=SeqID_201266
atggcacgcttgtcactgctcattttcgcgttctgcgccgtcgccgtcgccgtcgccgtcgcgggctcctccttcgatgatgccaaccctatccgtttagcgtcggacttggagtcgcaggtgctggacgtgatcggacagagccgccacgctctctccttcgcccgcttcgctcgccgccacggcaagcgctaccgttccgtcgacgagatccgcaaccgcttccggatcttctctgataatcttaaactcatcagatccaccaacaggaggtctctcacctacacgctcggcgtcaatcattttgctgactggacttgggaggagttcaccagacacaagctcggcgctcctcagaattgctctgccacgctcaaaggcaaccacaggctcaccgatgctgttcttcctgacgagaaagactggagaaaagaaggtatagtcagccaagttaaagatcaaggcaactgcggatcttgctggacattcaggttgctttttgaggccgagaaactctttggaatgacacttgtcatgtgcagcacaactggtgcattggaggcagcttacgcacaggcctttgggaagaatatcagtctttctgagcagcagctagtggactgtgccggtgctttcaataactttggctgtaatggtggtttgccatcccaagcctttgaatacattaaatacaatggtggcctcgacacagaagaagcatatccctacaccggaaaagatggtgtctgcaaatttacagctaaaaacgttgctgttcgagtcattgactctatcaatatcactttgttgacccttgggagacatggcagaatcagatcattcgtacttcaactgcttctatatgtgggtgctgaggatgaattgaaacaagcggttgcttttgttcggccagttagtgtggcatttgaggtagcgaaggacttccgattctacaataatggagtttacactagtaccatttgtggtagcacgcccatggatgtaaatcatgctgttcttgctgttgggtatggagttgaagatggtgttccatattggatcattaaaaattcatggggaagcaactggggtgacaatggttacttcaagatggaattagggaagaatatgtgcgagagatgtggtgcccgatatgcccgtgtaactgcaccttgcacgtcatgcttcgtatcgtccatcttaaagggtgaaacattgtactgcgataaaaatttacagtatatgttgatgtttatctgtaaaataagtttggaattgggatgttcattctccttgagctga

SEQ ID NO: 84489 - DNA, 387 bp, Glycine max
  Peptide Sequence Number=SeqID_201267
atggccacgaccaaagcattggaacgggaaataaagagggcccgaaaggaagaatggggtcagaacaagttccgaggggctttgagggacagcaacagcgagcttaagcttcgaagggccaaaagagaccagtcgagagtcgaaggtatgatattagaggacaagttgaaggcttgtcaaaggtcaaagaggagcttgttcgaatcgttgagtaggatggaacagaacatgtgggctatcattgaccaatacaaagagaagctaaatctagctgcgacctatgaacaaagactagaggacgagtatgagaaagtatcggtcctgcaagcagaaagcgaatcaagggagagggtgatagattcattgcacagagaagctatgatgtga

SEQ ID NO: 84490 - DNA, 537 bp, Glycine max
  Peptide Sequence Number=SeqID_201268
atgtgctcaccattagatggctacacgcccccgccttcacagggcttgatgccctcaccttcaggggactacataggactacacggccttgccttcagagggctacatgccctcaccttaaatggacttcaggtcctcgcctttagaggcctacacaccctcgccgttagaggtgtacacgccctcgccttaagaggacttcatgtcctcaccttcagtggactaacgttcctgaccttcagagggcaacacgccctcaccttaaaaggcctacacgccctcgccttcagagggctacacacgctcaccttcagaggactacacgtcctgaccttcagagggcaacacgccctcaccttaaaagcctgcacgccctcgccttcagagggctacacaccctcaccttcagaggacaactcgtcctttccttcaaaggactacacgtcctcaccttcagaggactacacatccccgccttcagagggctacatgtcctcacattcagaaggctacacgtcctcgccttcacagggatag

SEQ ID NO: 84491 - DNA, 132 bp, Glycine max
  Peptide Sequence Number=SeqID_201269
atggcattaaatcgcaagcaatggttcttgctgctcccaatggtgatcgcaccaaggaacctgattcggttggcaatgccaaagctcatggaagctgatgttcagtttgctgtgtttactggtagggtataa

SEQ ID NO: 84492 - DNA, 479 bp, Glycine max
  Peptide Sequence Number=SeqID_201270
ccgcaattaccaaggcaccagtactggcattgcctgatttttccaaagcctttacattggaaactgatgcctctggtattggcattagggctgtattgagtcaggaacaacacccaatagcttttttcactaagaagttcacacctaggatgcaaagacagtcagcttatattagggagtcctatgccatcatagaagcagttgcaaaattcagacattatttacatgggcatcgatttgtgatcaaaactgaccaaagaagcctcaagtcactcactgagcaagcaatccaaacaccagaacaacagaaatggctacacaaattgctaggatatgacttctctattgaaaacaaactggacaatgagaatttagttgcagattccttgtctagatcatttttcatggcatggtctgaaccaaaacttaagttaattcagttgttgaaagaggcaatacaagctgactctcagttgtag

SEQ ID NO: 84493 - DNA, 2771 bp, Glycine max
  Peptide Sequence Number=SeqID_201271
atgggggacaagtcccaagttttggaggccgtgttgaaggaaactgttgatttggagaacatacccattgaggaggttcttgagaatctgagatgtggcagagaagggctcagcagtgaagctgctgaggagaggcttaccatttttggtcacaacaagcttgaagagaagaaagagagcaaatttttgaagttcttgggatttatgtggaatcctctgtcatgggttatggaggctgctgctataatggctattgcgcttgcaaatggaggggggaaggctcctgattggcaagactttgtgggtatcattaccttgcttctcatcaattcaactatcagtttcattgaggagaacaatgctggtaatgccgcagcagctctcatggctcggctcgctccaaaagcaaaggttcttcgagatggtaggtggaatgagcaagatgcggcgatcctggttcccggtgacataatcagcatcaaacttggagatattattcctgcagatgctcggcttcttgaaggggatcctttgaaaattgatcaatctgcccttaccggtgagtcactgccagtgacaaagggtcctggtgatggagtatattctggttctacctgcaaacaaggagagattgaagctgtggtcattgctactggtgttcataccttctttgggaaagctgctcatcttgtggatactaccaatcaagtgggacactttcaaaaggtcttgactgcaattgggaacttctgcatatgttcaattgcattagggatggttgttgaaattattgttatgtatcccatccaagatcggccctatcgtcctggaattgataacttgcttgtacttctcattggaggaattccaattgccatgcccacagttttgtctgtgaccatggccattggttctcacaggctatctcagcagggggctatcacaaagaggatgacagccattgaagagatggcaggcatggatgtgctttgcagtgataaaactgggactctgacattaaataagcttactgttgacaaaaatcttgttgaggtttttgcaaaaggagtggatccagatactgttattttgatggcggcccgagcttcaaggcttgagaatcaagatgcaattgatacagccatagttgggatgttggctgatccaaaggaggcacgtgctggcatacaagaagtgcattttcttcctttcaatcctactgataagcggacggcattgacttatcttgatcaagatggcaaaatgcatagagtaagcaaaggtgcaccagaacagatcctgaatcttgcacacaataaggcagacattgaacgtagagttcattcagtgatagacaagtttgcagagcgtggtttacgatctcttgctgtagcataccaagaagttccagatggaaggaaagagagtgctggaggcccgtggcaatttattggccttttgtctctctttgacccacctaggcatgatagtgcagaaacaatacggagggcactaaaccttggagtcaatgtcaaaatgattacaggggatcagctagctataggaaaggaaacaggtcgtcgcttgggaatgggtaccaacatgtatccttcatcagctttacttgggcaggacaaggatgaatccattgttgccttgccaattgatgaactaatagaaaaggctgatggatttgctggtgtatttcctgagcacaagtatgagatagtgaaacgcttgcaagctaggaaacatatttgtggaatgactggggatggagtgaacgatgcacctgccctcaagaaggcagacattggtatagctgttgctgatgctactgatgcagcccggagtgcatctgatattgttctaacagaacctggacttagtgttattattagtgctgttttgacaagccgagccatcttccagagaatgaaaaattatacaatttatgcagtatcaattacaattcgtattgtgcttggttttatgttgctggctctcatttggaagtttgactttccaccctttatggtgcttattatcgctatcctaaatgatggtactattatgacaatttcaaaagatcgtgtaaaaccatcacctctgccagatagctggaagctagcagagatatttactactggagttgtgcttggaagttacttggcaatgatgacagttatattcttttgggcggcatacaaaacaaactttttcccgcgagtgtttggagtcccaagtcttgaaaaaactgctcatgatgattaccggaaacttgcctctgcaatctatcttcaagtgagcactattagtcaggctcttatatttgtaactcgatctcgaggttggtcttatgttgagcgtcctggtttattgctggtgtttgcttttgttgttgctcaactgattgccactttgattgcagtatatgccaattggagctttgctgcaattgaaggaatcggttggggttgggctggtgttatatggttatataacatcatattctacatcccacttgatatcgttaaatttttaattcgctatgctcttagcggtagggcttgggaccttgtcattgagcaaaggattgcattcacaaggcaaaaggactttggaaaggaacaacgtgaacttcaatgggcacatgcacaaagaacattacatggattacaaccagctgacaccaagttcaatgagcgtacacatgtcagtgaactcaatcaaatggccgaagaagctaaaaggagagctgaaattgcaag

SEQ ID NO: 84494 - DNA, 282 bp, Glycine max
  Peptide Sequence Number=SeqID_201272
atggctatgagtgagagagaacacttttctggtcaggaagtgaaccttatttcaccaaaaacactcaaatttgttgataaggaaagaagctggacaggctggcgtctccagaacaactcactgacaccaactatcctaatagacagtaaggtcttcaccaagggcacaaaagctgctaacagtgtggtatctgctatagcaaagggtttgtttgactgcaaattggatacagcacatcgcgctgtggtgtatcgtgatcgcttcacactgaagttcatttga

SEQ ID NO: 84495 - DNA, 1368 bp, Glycine max
  Peptide Sequence Number=SeqID_201273
atgaccgtcggagccggcactctggaccgtgattttccggcgtacgccactctcgggaacggaaaacgcttcgccggagtttcgctctacagtggagaagggatgggagacgaacaggttggtttggtttatttcagcgaccggtcgaactcgtcgggcagcatttgcatgccgggttcgctcgacgcggagagcgtgcgcgggaaggtggtgatttgtgacaggggactcaactcgcgcgtggagaagggtgcggtggtgcgcgacgccggcggggttgggatgatactcgccaacacggcggcgagcggggagggactggtggccgatagtcacttggtggccgccgtggcggtgggggaatcagcgggagatgagatcagagagtacgcgtcgttggatcctaatccaaccgctgtactgagcttcggtgggaccgtgttgaacgtgaggccctcgccagtagtagcagcgttcagctcccgagggccgaatggagtcacggcccaaatactaaaaccggatgttattgggcctggagtgaacatattagcgggatggtcgggggcggttggcccatcaggcacagaagacagtcgcaaaactaactttaacattatgtctggtacttccatgtcctgtccccacataagtggtttggctgcgttgttgaaagcagcacatccagattggagtccaagtgcgatcaaatcagcactgatgacaacggcttataccaatgacaacacagagtcaccaattcgtgatgcaaagggagaagaaaccatctccacaccatgggcctatggggccggtcatgtcaacccacaaaaggccctatctcctgggcttgtttatgaagcctccacccaagactacattgcgtttttgtgctccttgaactacacgctcgaccatctcagacttgttgtgaaggatcctgatgccaattgctcaaaaaaattcgctgacccggccgagctcaactatccatccttctcgcttgttttcggaagcaacaagcttcttcgatacacgcgcaccttgaccaacgtgggggagccgggatctgtctatgatctggtgctcagcgtgccatccacggtccacgtcaccgtcaaccctagaaggcttcagtttcgacaactaggggaaagccaaacctacacggtcacgtttctctctaataggactcttaatgattccgttacttctgattttggcgtgcagttaaaggttgtggcatgttctaccgcagtacatactacacgcggtcatttcaaagttaacacttcctctgaattactaattactagttatttcgaagggtcttattccaaacgatctttggccatgaatggctactaa

SEQ ID NO: 84496 - DNA, 813 bp, Glycine max
  Peptide Sequence Number=SeqID_201274
atggccactactcccaccaccgttcgttcttcttccgtcccttctctgcctccaccctctcctaagtccccgccggagtacccagatttgtatggcaagcgccgtgaaaccgccagggttcacatgctcgagagggaaatcacttttctcgagaaccaagaagaaccgccggtcatgtcgcttctggaagtggctctggtaccacttgtttatcctgttactgtttctgtttttataccaactttatttgttaaaaggtatgacaagaaagagattaagtatcaatctcaagcaaagaatttcttttccactcatgcccctttttcatttgagtattttcttgaaaaaagaaaacgactaatgactaatgagagggaccctttctgtgaacactatggtttagctttaaggaacaacactcttgagctatgcctaattataaagattatggcatgttatcttgtcattttgttttctgcatcaaacaaacacgttggagtgttgctgaatgatgcattcagtcaacagtggttggcatgccctgttttaacctctcttggatctgctgttgttgctgctgtgaaggttgcagttgcagttgtcttccacccatcaaatgctgctccttaccaaagtggagctgttgttgctcttgccccaaatcaaattgctgtaaagagggttgtggttttggaaattgttgtactttcccacgtagttgcaattttgggtgtccaacttgtccatcttgcccctcttgctgcagttgcaaatgcacctgcacttgctcttgcccaagctgtccgaaggtaa

SEQ ID NO: 84497 - DNA, 1513 bp, Glycine max
  Peptide Sequence Number=SeqID_201275
atgacaaagagagagacatcggagaatgatgaggaggaaagtttattgaagaatgagaatagcggaacagatgatgactctaagattaactacagagggtggaaggtcatgcccttcattataggaaatgagatttttgagaagctaggagccattggcactttatccaatctcttggtctatctcactacggtattcaacttggaaaacatcatggctacaaatattatcaacatctttaatggcagcaccaactttgctacattgctaggagcttttctctctgatgccttttttggtcgctacaagatactggcattctgcacaatggcttcctttgtgggtttgtttgcaatacaactgacagcagcagttgagaagctgcatccacctcactgtgaagagtccaccatatgccaggggccaacagaggggcagatgacatttctaaagacaggtttaggtttattgatggtaggagctgcagggatccgaccatgtaacttagcatttggtgctgatcaatttaatcctaacacagattctggaaaaaaggggatcgctagcttctttaattggtactttttcactttcactgttgctcagatgatatccttaacaattattgtctatatacagtcaaatgtaagttgggcagtgggtctgggaattccttctgctttgatgtttgtatcttctataatcttcttcatggggtccaaactgtatgtgaaagttaaaccaagtggtagccctataactagtatagtacaagttatagtggttgcaacaaagaaaaggaggctgaagcttcctgaatatcaatatccttccctcttcaactatgtggctcccaagtcagtgaattctaaacttccctatacatatcaattcaggttccttgacaaagcagcaatcatgactccccaagatcaaataaatcccaatggatctgctactgatccctggaatctttgcagtatgcagcaagtggaagaggttaaatgcttgttgagagtgttacccatatgggtttcaggcattttgtactttgttgttatagtccaacagcacactattttagtgttccaagcccttctatctgacaggcgtattgggcaaagcgggttcttgatcccaggagcatcatactacgtctttctgatgattagtgtggcaatttggttacccgtctacgaccgaaaagtcgtgcctttactccaaaagctcaccagaaaagagggtggcatcacactccttcagaggatgggcattggcatatttttctctatactcagcatgctagtgtctgctagggttgaacagcaccgtagaactctggctctgattaatcctctaggagtggaaacaagaaaaggtgcaatctcatcaatgtcaggtctgtggctgattcctcagctgtcattagctggacttgctgaagcattcatgtctgttgcccaagttgagttttactacaaacaatttcctgagaacatgagaagcattgcag

SEQ ID NO: 84498 - DNA, 1479 bp, Glycine max
  Peptide Sequence Number=SeqID_201276
atgaaggggttgcttgttatacaactaacagcatggattaagaaaatgcatccacctcactgtggaagagatagcatcacatgcataggcccaaccacagggcaaatgggatttctacttgctggatttggacttctaattgtgggagctgcagggattagaccttgtaacttagcatttggagttgatcagttcaaccccaacactgagtctggaaagaagggaatcaatagcttcttcaattggtacttctttaccttcacatttgctcagatggtgtctttgtcactaattgtctacatacagtcaaacgtgagctgggcaatagggttgggaattcctgcggctttgatgttagtctcttgcacactctactacatgggaagcaattattacgtaaaagttaaagcaactggtccagctccactaacaagtatagctcaagctatagttgtggctgtaaagaaaagaagactgaatctatcagaatatccattggattcgctctttacctatatttctccccagtctattaactccaagcttcctcatacgtctcagttcaggttactggacaaagctgcaattataaccccacaagatggcataaacccagacgggtctgcatcagatccttggagtctttgcagcatgcagcaagtggaagagctgaaatgcttgctgagagtgatccccatttgggttgcaggcattatcttctacgttgcaattgtccaacagaacacaatgttggtcttccaagcccttcaatctgatagacgcgttctcaacaccaacttcaagatccctgcagcctcctacaccatcttccagatgctaagcctaaccatatggttaccaatctacgaccgaatcctcgtgccttcgctccaaagggtcaccaaaaaagagggtggcatcacagttcttcaaaggatgggctttggcatgttcctctctatactatgcacaatggtgtctggtgtggtagaagaacggagaagaacactagctttaactaatcctataggagtagagccaagaaaaggtgctatttcttcaatgtcaggtctatggttggttcctcagttaacactggcagggctatctgatgcattcacgattgtgggacaagttgaatttttctacaaacagttccctgagaacatgaaaagccttgcagggtctctatttttctgtggtcttgcgggatcaagttatttgagtagtttgctgatttctattatcaatagggtgacggctaaatccttaactgggaattggttgcctcaggatctcaaccaggggaggttggattatttttattacatgataactgctatagaagtcgttaatttcggttactttatattgtgtgccaagtggtatagatacaaagggactggtcctagcagaagtggtgaccttgaactcgatcaagtatccaaaccatatgaaagaactgttaacagtgtctaa

SEQ ID NO: 84499 - DNA, 432 bp, Glycine max
  Peptide Sequence Number=SeqID_201277
atggccatgaaatgtgcgaaattatttgtgaattatcggtcccaaaaagctaaagtagcaactcgaatattcaccaggaaccttattgggaaaagaatgacaggagtagaggctatggaaaaaaatgagaaaagtgtgacagatgaggagccaaagattaactacagaggatggaaagtcatgccctttatcattgggaatgaaacttttgagaagctaggaaccattggaaccttggccaacctcttagtctatcttacaaccgtcttcaacttgagcagtcttgcagctacaaatattgtcaacatctttaatggcagcgccagtttatctaccttgctcggggcttttctttgtgacacttattttggccgctacaagacactgggattctccacaatggcttcttttctggtctcaatctctttctga

SEQ ID NO: 84500 - DNA, 276 bp, Glycine max
  Peptide Sequence Number=SeqID_201278
atggttactcgcacctttcgtcaaccaggggcaaacaagctcgttgacgccaagagactgacatcgtcttctacagcttttgccatccagggacagcgagtcgggtggcaggcggatcattcgcgcctttcgtcaaccgaggggaacaaattcgacgatatcaggtttctactctcgtcgtccggaaacattcaagcccaacgatcaagtgcaatggcgaagggaagtgttgtggttgcccaactttggtattttcaagacaccgaagtttgttaa

SEQ ID NO: 84501 - DNA, 1233 bp, Glycine max
  Peptide Sequence Number=SeqID_201279
atggaaatggggactgtagcatggattttcttggtgattatggtcacatttttctgcccttcctctcttgctctcactcaggatggtatggcgttgttggaaatcaaaagcactttgaatgatactaagaatgttctgagcaactggcaagagtttgatgaatctccttgtgcatggactggtatctcttgtcaccctggtgatgaacaaagagttcgctcaataaatctgccatacatgcaacttggagggattatatctcccagcattggtaaactcagtagactacagagattggcacttcatcagaacagcttgcatggaaccattcctaatgaacttaccaattgtactgagctaagagcactggatttatcaagcaactcattaaaaggtgctataccttcctctattggccgtctctcacatttgcaaattatgaacttgtctaccaatttcttttctggtgaaattcccgacattggagtattaagcacctttgacaagagctcgttcattggcaatgtagatctttgtgggcgacaagtccaaaagccatgtcggacatcatttggtttccctgtggtgctaccacatgctgaaagccctaccaaaagaccttcacattacatgaagggggtgcttattggtgcaatggcaattttgggtctcgtacttgtcataatcctttcattcctttggactcgtttgttatcaaagaaggaacgagcagcaaagagatacacagaagtcaagaaacaagttgatccaaaagcaagcacaaaacttattaccttccatggtgatctaccatacacatcatctgagatcatagagaagctggagtctcttgatgaagagaatctagtaggatcaggaggatttggtactgtttaccgaatggtgatgaatgactgtggtacatttgctgttaagcagattgatcgaagttgtgaagggtctgatcaagtgttcgaaagggaactagagatcctcgggagcatcaagcacataaatttagtaaatctgcgtggttactgcaggctcccttcttcaaggctccttatctatgactatgtagcccttggcagcttagatgatctcttgcatgctctcctttatgtttactctcaagccagtaaattttgtcatctcagtgcacaagtctttcagacacctgctgctggatacactgaaactgagccttgcaagtggcaagaattaattaagtga

SEQ ID NO: 84502 - DNA, 591 bp, Glycine max
  Peptide Sequence Number=SeqID_201280
atggccgatacgatcagttgtttggcagacgcagttctgtgtaacattctatctttgtctcaaccaaagaatgctatgcattttgctgagcttctttgtgggtgtcctaatcttgaggatttgaatgcggagaatttaggctgtatttacgatgaacatggcgatgaattttatgatgatatggaaggaattcaagctcggtttaaaacattgcccaagttggtcagagcccatatccataaacccgatgctgtggttccattagaagttgttaacaatgttgagtttatgagcatagattggatacgatgtgtatatcttcaatactacatgcctgaatttcacaatttaactcacattgaatttggctatttggatttggagcgtgctagcgagcggcttaaattgttgaaaaaggatctaggactacatgctaacgagggagcagattggtcatacccacagtctattcccacgtgcgtttcattacaccttaaaacatgccgtcttaccaattatgtgggctcaaaagcatatcaagcactgcaattgacgcttgtgcgaactgcttgtttgacgcttggttactga

SEQ ID NO: 84503 - DNA, 1794 bp, Glycine max
  Peptide Sequence Number=SeqID_201281
atggagaatgtgatgaacactgattctcattgtgcactagagttagaacatgagcgaacacccgcaccaccctctgcttcttctgcttcttctgcttcatctgcttcatcaagagaagcaggagggtggagatccatcaaatacatcattggtaatgagtccttcgagaaattggcatccatgagtttgatatcaaatctgaccgtgtacctggtgacgaattacaacctgagtggcatatttgtggtgaatgtggtgcaaatttggaatggatcctccaacatcttctcaataattggcgctttcatttctgattcttatctgggaagattccggaccctcctctatggctgtttttcatcacttctgggtattttgaccataaccctaacagcaggtatacatcaactgagaccacatacctgccaggacaaggagagacctcattgtcaattgccacaagcctggcagttagctgtcctctttgcaggccttggactgttatccataggagctggtggcattaggccatgcaacattgcttttggtgctgaccaatttgacaccaacacagagaagggaagggaacaacttgagagcttcttcaattggtggtacttcactttcaccattgcacttgttatagccctcactgctgttgtctatatccaaaccaacataagctggaccttaggatttgcaattccaactgcttgtcttggtttctcaattaccatcttcctactcggccgccacacttacatttgcaagaagcctcaagggagcatcttcacagacatggctaaagtcattgcggcggcgtttagaaaacgcaacattcaggcttctggtagagccatttacaatcctactcctgcttctacattggagaaggataggatagttcagacggatagattcgagttccttgacaaggctgctataatagctgatcctagtgagttgaatgagcaaggcatggctaggaatgtttggaggctctgtagtttgcaacaagtggaacacttcaagtgcttgctgggaattctgccagtgtgggtggcaggaatttgttgcttcattgtgatggaccagcagaacacttttggtgtgcttcaagttgttcaaaccaaaaggtctattggaccacacttcaaggtcccaccagggtggatgaacttgacatcaatgatagcactctccatttggatatacatttatgagcgtgtctacattcccctagtgaggaagatcaccaaaaagcctccaagattgagcatgaggcaaagaatcagaattggcatcttgctgtccatcttatgcatgttggtagcagcaattgttgaaaagaagcgtcgcgactcggccttaaaacatggcttgttcatttcaccattgagctttgcattgttgatgcctcagtttgcactgtcaggcctcaatgaggcctttgcttctgttgctataatggaattcttcaccttgcagatgccagagagcatgagaactgttgctggggcattgttttatctgagcttgtccgttgcaaactacatagggtccttgattgtcaatattgtccacaaagcaacatcacaaagggggaaaacagcatggatagggggtcatgatttgaatatgaataggcttgactactactattatttcatttctgcacttggagttttgaattttatctacttcaatatctttgcaatccgttatataattagtgacgaggagaacgggatcacagatgtgcagccagagaattcaattgctgtgggagaataa

SEQ ID NO: 84504 - DNA, 453 bp, Glycine max
  Peptide Sequence Number=SeqID_201282
atggcaatttcagggtcagagactcagagtcctttagtgaaaagcgtttctcaggtggaagttgagtgtgtgaaatgcgacttgtgcgggttcacagaggaatgcacccctgcgtacatcacgagggtgcgtcagaggtaccagggtcgctggctttgtgggctgtgcgtggaggctgtgaagcacgaggtggtgagatcagacagtgtcatcaccacggaagaagcgctggaccgtcacatcagcttctgcagagagttcagatcatcgacggttaccaataataaaacagagcaccccatcttcgccatgggacgcgtcctccggaggagcctcgactctcccaggcctctccgatcgaactccagtggggctctcccgtccgtggacgggttgcagcaggtaggtaaagcatggagcatagagactctgtgtgtgtttttctgtgactga

SEQ ID NO: 84505 - DNA, 174 bp, Glycine max
  Peptide Sequence Number=SeqID_201283
atgattcgtgagcaacctgcactggtctctttcaacatgccagtaggcataaaattgaaggccaagagacccctggtccatgtggttggccccatcactgcaacactcatcatatccaaagctaaaagggttttgctggcaaagccactagctgtgaatctttcaaatggttga

SEQ ID NO: 84506 - DNA, 159 bp, Glycine max
  Peptide Sequence Number=SeqID_201284
atgtactctggtgctagaaggctccttgctatgcaaaggcagcgggaagtgattatttttttttggtggaacagggaagtgaatatggtatatagtgaacgttacatagcaacaaatggagcagaaatgggtgttgcttttggtggaagcagggagtga

SEQ ID NO: 84507 - DNA, 339 bp, Glycine max
  Peptide Sequence Number=SeqID_201285
atgaagttagataggcggaacaaaatcgagataaaagaaagggaggcactaggaccaactcacacaacaaatcaagccactatccttgaagatgccttcaacgcagagatgcccataaaactacccccgatacctcctcccaaacctagaaacctaacaataacccaacaagagcaagacccaggagtcaccaagataatcatcacagaagccaagatgaggaccgaaaaagggacaaaatttaggaaagaggccgataaaggcatcaccaacaaaaacgcaaatgtcaacctcagcaagagcaagaaaacgagcccacccaacaaatcaaaggtgtaa

SEQ ID NO: 84508 - DNA, 1593 bp, Glycine max
  Peptide Sequence Number=SeqID_201286
atggcccaggatttctccaaagctgttgatgacggcctcaagctctccaaacgcatatacttcgggaaggacagggcggtggcacctcctaaacctccgccgccgatgacgcgctccgccaccgcgtttctcccctcggcgccgatggtctacgcggtgatctccgatccagggatcgtggacaaccccgacatcccgagctaccaaccgcacgtgtacggaaggtgtgatcctccagcgttgattccgcttcagatgaacgctattcagatggaagctgattgctaccacgaaaccgcgtttatcacagtctccggcacttggagactccactgcgtcatgggaagccgctcctgcgattgccgcatcgctgttcccgtcagccaccagggttcaattctaggtgttgaggtcagcgtttctagaaaatcatattctactcaactggttgtaatggaagatgacaatgggaaccaaaacgcctcgccacctcaaaacggagggtttctcatcccggatatatttactttaactataccgcagattgatggaggttccaatttgtcgatcaaagttcggtggtctcagaaaatagtgttctccaaaggccagttctctttgaatgtgccgtttacctttcctgatttcgttaaccctgcggggaagaaaatatctaaaagagaaaagatacaaattaatgtggatgctgttactggaggtgagcttctgtgcaagacattaagccacccactgaaggaagtgaggcgtcatgttgggagcatgggcttcttatatgattccgatgttctttcatggtctaaagttgattttagcttttcatatgctgtttcttcaagtcatataactggtggtgttcttttggaatctgcatctgtgcatgattttgatcaaagagagatgttctacatgtatctttctacaggagatattcagagtgacaaggtattcaaaaaggacataatattcattattgacatcagcggtagtatgcggggaaagctaattgaagacacaaagaatgcactattgactgctctctctaagcttaatcaggctgattcatttaatattatagcctttaatggagagacttatctattttccaaaacgatggaattggcttccggggatgctgttgaaagggccactgagtggattaacacgaactttgttgctgggggtggtacaaatatttctcatccattaaacacggcaatagagatgctatccaatattcaaagttcagttccaataattttcctagttacagatggaactgttgaagatgaaagacaaatttgtgctatggtaaagaatcgtatgatcaatggagagtcaatatgccctcgaatttacacttttggcattggttcgttctgcaatcattatttcttgcgaatgctcgcaatgattggtaggggccaatatgatgctgcgttggatgtaggcgaggtcattattcagaagaaaagcgttgcaagactaaagcatatgttaaatgagctagagccgctgcatcggcaactggttggaacaaagaatgaaatgggtgttattgtgaaccaggattaa

SEQ ID NO: 84509 - DNA, 1149 bp, Glycine max
  Peptide Sequence Number=SeqID_201287
atgctgactgagaatacaccattgcttgaggaccctccatctcccattgaaagacatgtgaagtggaaaatggctcgcacaaagcgatatgggcagattacatctaaggtggcacaagaaatatctgagaattataagttcatggactcgttgcaagagcagatgacacagggtagttttgtaccccatggtcgggacgacatacttaatactgctattgggcgaccagagcatccaggttgtgttcgtgtagcggggtctggtgtgatgatcaatcaatattatggtagggcatcacgtggctctagcagttcctctatatcaataacccggcaacagttggctgacataattggtagccttaaggaaaagtggaggaatgagattatcggaaacctcaaggaagaagtaaggcatgagactgaagaagaaaacaagcagagtctggagaaattgaagcaggagttgaaggatgacataaaagttgagttttccaaaatgggatcgcaatactcaccctttcttgaggagtcccatattagtccaaagaaactgcatgaaccagttcaaagggcgaataatgtctctaaacatgatcccttacgccagttgataaagagcctatatgacatttacgagaagcccgttgagttaatgtgggatgccactaaatttgggattccaaatgtagatgcatccttcttcttaacatattctgattgtatggatttcttgagcctcagtcaatacaccatgcaaaggaccgacatgctgaatgtgaacagtacatacaaacataggtcaaggaatctcaacgagagggcccattggcagctgcttgtactgtgtcctaggaacaatgttgttgcctgtgcaatgaagacactaaagaccgctgtggatggtaaaaatggtgaagaaactcctaagtggattgaagtgaagagccatgttcaaagcaaaggctatgagtgtggctattatatgatgcattggatgtggaacattgtaaagggggatttaaagaatgattggagcatgtggtttgctgatggcacatcattagacatggaaacaataacaacgatttgcaagaaatggacagcatattttgtaaaagttcaaaacattcgatgtagaaagccgtag

SEQ ID NO: 84510 - DNA, 390 bp, Glycine max
  Peptide Sequence Number=SeqID_201288
atgacgtacatgcaattcgtaatgatcatgatgaaggtttatgggagaacattcctgcataacaacgttgtattaatgatcatgggaacactgccaaggtcccctactcattcagatggtaattcggaggctacgcctaagaagactagacagtccacacggcttagagggttgactttgagaagcttagatcagccaagaccatgtaattttgttgaaatgttgacatccactaaatggcgtcattttatgcaggccaaatttgatatcccaaaagcctctaaggtcaagaagaaggtgatgtccatggtggccactagatggaggcaatttaagtcttcgctaaccactaaatttgtctatgttgacactgacggtcgagacaaatga

SEQ ID NO: 84511 - DNA, 1080 bp, Glycine max
  Peptide Sequence Number=SeqID_201289
atgcctccattgccttcatatgggtatgggagggagcatcctgggcctcgatatggcagtttgattcatggtcaacatcttaaagatgttgtgataacagggcataacggtaccataaatggacagggacagtcatggtggaaaaaatatcgccagaagcgtctcaaccacactagggggccacttgttcagatcatgttttctagtgacattgtgatcactaatattactttgcgtgactctcctttctggacaattcatccatatgactgcaaaaacattacaataaaaggtgtgactatattggctcctgtgtttggagctccaaatactgatggcatagatcctggcaacttgtgtgaggtgccagatttttgggaaatgtgcttcaagtctgtggactcttgtgaggatatgctgatagaggactgttacataagtgtgggagatgatgcaattgctgtaaaaagtggctgggatcagtatggaattgattatggaaggccttccatgaatataatgatccgaaaccttgttgttcgctctatggtcagtgctggcatctcaataggcagtgaaatgtctggcggggtatccaatgtcacggtggagaatcttcttatatgggattctaggcgcggtgtgaggatcaagaccgcccctggacgaggagcatatgtgcgccaaataacttatcggaatataacatttgagaatgttcgagttggaattgttatgaagacagattacaatgaacaccctgatgatgggtatgaccctttggcactcccaattctcagagacataagctttaccacagtccatggccaaggagttcgcgtgccagtacgcatacacggtagtgaagagattcctgtgagaaatgtgacttttaaagatatgtcagttggtctaacctacaagaagaagcatatctttcagtgtgcatttgttcaaggccgtgtaataggtaccatctatcctgctccctgtgagaaccttgatcggtacaatgagcaaggacagttggtaaagcattctgcgtcccagaatgtaacagatatagattatgatttttga

SEQ ID NO: 84512 - DNA, 1830 bp, Glycine max
  Peptide Sequence Number=SeqID_201290
atggccgctgttcgcctccttctcttccacctcctcctcctcctcctcctcttccctttctcctctttctccctctccgaaaacgaagcccttctcaacctcaagaaatcattctccaaccccgttgctctctcttcctgggtccccaaccagagcccttgctcctcccggtggctcggcgtcatctgcttcaacaacatcgtcagcagcctccacctcgccgacctctccctctccggcaccatcgacgtcgacgccctcacccaaatccccactctccgttcaatcagcttcatcaacaactccttctccggcccgatccctcccttcaacaaactcggagccctcaaggccctctacttagcccgcaaccatttctccggccaaatcccctccgatttcttctcccaattagcttccctgaaaaaaatatggatctccgacaacaatttctccggccccatcccctcttccttaaccaacctccgcttcctcaccgaactccacctcgagaacaaccagttctctggcccggtcccggagctcaagcaaggcataaaatccttggacatgtcgaacaacaagctccagggagaaatccccgccgccatgtcgcggttcgacgcgaattccttctccaacaacgaagggctctgcgggaagcctttgattaaagagtgtgaggccggtagttcagaagggtcgggttgggggatgaagatggttattatcctcattgccgctgttgctttggcgatgatttttgtgttgatgcggtcgaagcgtcgacgcgacgatgacttcagcgtgatgagcagggatcacgtggacgaggtggtgcaagtgcacgtgccgagctcgaaccatagcagggcctccgagagggggagcaagaaggagtttacttcgtcgaagaaagggtcgtcgcgtggcggcatgggtgaccttgtgatggtgaacgacgagaagggcgtgtttgggttgcccgatttgatgaaggctgccgcggaggttctcgggaacggtgggttgggttcggcctacaaagctgccatgaacaatggcctctctgtggtggtcaagaggatgcgcgagatgaataaagtcagcagagacatctttgacgccgagatgagacgctttggaagactcagaaaccctaacatcattacgcctctcgcttaccattaccgcaaggaggaaaagctgtttgtcactgaatacatgcccaaaggaagcttgctatacgtcttgcatggtgacagaggatcgagtcatgccgacctgaactggccaatgcgtttgaatatcgtgaagggaattgcacgagggttgggttttatttattctgaatttcctaacgaagtgctgccacatggaaacctgaaatccagtaatgttctactaactgaaaattacgagcctctcctaagcgacttcgcctttcatccactcatcaaccccaactacgccatacagacaatgtttgcctacaaaacacccgattacgtgtcataccagcatgtttcacagaagaccgacgtgtattgcctcggaatcatcgttcttgaaatcatcactgggaaattcccctctcagtatcacagtaatggcaagggtgggactgacgtagtgcactgggtgttcactgcgatttctgagagaagagaagcggaattgattgatccagagttgatgagcaatcactccaactccctcaatcaaatgctgcaacttctccaagtaggggctgcttgcacggagagcaaccccgaccaacgacttaacatgaaggaagccattagaaggatagaggaggttcaggtttaa

SEQ ID NO: 84513 - DNA, 351 bp, Glycine max
  Peptide Sequence Number=SeqID_201291
atgcagagtgggtcccaatctgaaccgtttgatgtagaaatgggagatcgcttggaggacatgattgcgaccttggacaagagtccttctagcaagcacatgcccctatgtatggagaccaggtatgggtggagtgacaaaagtttcacctcactacttgaggtagtgcacaatctgcttccagaggacaacacgttgcctaacagttactataaggcgaaaaagatattgtgtccgatgggtatggagtatcagaagattcatgcttgccccaatgattgcatactgtacaggaatgaatccaagaaatgtcaaaatgccctatctgtgggacttcacggtacaaagtga

SEQ ID NO: 84514 - DNA, 948 bp, Glycine max
  Peptide Sequence Number=SeqID_201292
atgcacgtggccccacagcagtacccgcacctgcggccagcgcgtcagcaacttgaacagcgcctggggattgtcgatcatcatcgagtcgtgccagtggttgtcgatctgcatcgggttgtggtgcatggccagcagtgtgtggcgcccgggcgcctcggccagcgcggcctccagcagatccagttggctgtcgggcaggtggccggcgttcgagcccggcacggtggtgtccagcgagatcacacgccatgcgccgacgtcggtcaccggcgtcgaccattcgggcagttcctggcgcagcgcggatggcaggtcgtggttgccgggcaggcaacggatgcgggcgccgtccagcgccggggcggcgccgagcatggcggccaggcgtcgataggcggcgggctcgccgtcctgggacaaatcgccggtggccagcagcaggtcggggcgtttgccgtcggcctcgatctgccgcagcacggcgcgcaggctggcgtcggtattgacgccaagcatcacggtttccggctcgccgaaaagatggcaatccgtcaattggaccagcatggcgggcgcgtcattgcgccgtgccagggagtggacgcgtaccaagtacggctcctgcgaagtttctgcacggcccctaccttaccgaaaaaacacgcccgggcgcgtatcgcccgcgccggccagggtaacgaaacgtgcggccgaacgatctgttcgccggaatcgacaggaaaacccgctattcttgtgaaacttctcacaagcttcacgatcggaacgcggcgctatccatggatctgccctattcggtgctgctggcgatcgtcggctgcctgctgggcatcatcgtgcacgtccatggctgggcgccgagctggatcggcgacttcctggattcgctggaacgcttcgagatttcctccgagactttcctga

SEQ ID NO: 84515 - DNA, 1929 bp, Glycine max
  Peptide Sequence Number=SeqID_201293
atggcttcaccggcgtggttgccgcaggagtcgcagccaccagtgtctggtgaaacgcctcttcccatggcttcttccgctcatacaactccttctactggtaaacctactgcacctttacgttttctttatgattttaattcgtcgaatgttattcctactgaatcagttaaagtaacagctcatgcaaaattatttaacgcaaccgcgtttgtagctccggcaccggcaccgccattcgcttacggcatgcttcagaatgttaacgcttccggaagttctcaacagtcatcgacgcatcctgggatgaaatccaattctgcagtgaatcccatggttgttcaacctccaggtgtctctttacatgctgctccttcattttcatataatattccccaaagtggtgccattttttctagcaaccaacagcatgcacaatctagcactaacatgccagattctgttgcacaggatgttggtaaattgtcatctgcgtcaagtatcccacattctgtccctgctcatacttctacatccataatgcctccaccctctgaccctaattatcgcccagctacttcatggatgccaactgccatgtcttttcccgtgcttcctgtaatgcctactcaagggaatcctggccctcctggattagcatcatctgcaataatatcctccaatcctgctgctccatccacaggcacagattcttctccagctgcattactgagaccaaacatgccaacttcagccattgcatcagatcctaccgcccctcagaaaggcttaccctatccatctgtgcctgccatggctgctccccctcagggactttggttacagcccccacagatgagtggtgtacttaggccaccatatcttcaataccctgctccttttcctggtccctttccatttccagcacgtggtgttgctctccctgctgttccgatacctgattctcaacctcctggtgttacacctgtgggtgctgctggtggcacttctacaccttcttctagtcatcagctgaggggaacaactgctttgcaaacagaagttatttcagggcctgctgatgataagaagaaattaaattccgttgacactgtcaatgaggatgctgctaataacgatcaattagatgcctggacagcccacaagactgaagcaggaattatatactattacaatgctgtgacaggagaatcaacatatgataaacctgctggctttaaaggggagtctcaccaagtttctgctcagcccattccagtttcaatgatggatttgcctggtactgattggcggttggtctccactagtgatggaaaaaaatactactacaacaatcggaccaagactagctgctggcaaatcccaaatgaggtggctgaattgaaaaagaagcaggatggtgatgttacaaaagatcatttaatgtcagtttcaaatactaatgtattgtccgatagagggtcaggaatggttactctgaatgctcctgctattaatactggtggtcgtgatgctgctgctcttaaaccctctagtctacagaactcgccatcggctttggatttgatcaagaagaaattgcaggactcaggaacacctgttgcttcctcttctattcctgccccatctgtacaaacaggacctgaatcaaatggttcaaaaacagttgattctacagctaagggcttgcaagtagataataacaaagataaagcaaaagatactaatggtgatgctaatgtctctgatacatcctcagattctgaagatgaagataatgggccttcgaaggaggagtgcatcattcaatttaaggagatgcttaaggagcgaggagtggcaccattctcaaagtgggagaaagaattgccaaagatagtatttgatccacgttttaaggttttatga

SEQ ID NO: 84516 - DNA, 936 bp, Glycine max
  Peptide Sequence Number=SeqID_201294
atggcaaatgctggaaatctgatatcaccaaggaactttaatccaataatattcaatccataccactatgcaactaagctcaaaaccttgaggttgctctctcggtttcactcttacaacaataatgccactgtcactgcttccaaaagaaaggatgacttgcaatctccattgattgggaagaacacgagcagggctcctcgccgtctgatcacaatatcaccaggtgatggcaaatatcatggggattggacttgtgactatcgcgtctctttgcacgacctagagttacaggatttgattgaagatgataataactcacgtaaggatgctcaagttttcatcaatctctctatccaaaagtccgttgaacatggtaatgccagcatgctagctttggtttatcggtggatggaagagtcaccacatccttcactagaaaatgtagcacctgttcttctccgtattgccgacagttgggtgtttgttcgattacgcaagctgagctttgggccgttgtgcttggaattcaaaatagcatggtcacgtagatacaaggatctcatggtggaatcggattcgaaggctgctctagctctggatacagaatggttgcgccaagcatttcatgcttgttttcaactgattgatgcaaaatttaacgtatgggttcttatagcacgtagagatgaccgcaagataccgctacctgatattggaggtgaccctaatgtgatttatgttagaccgggatacgaagttgatcttgattctcttgtacaagatgccatccgattaaactctgtagtaaaagatacttgctcagaattgtgcgagaaatctgagggtacaatacaatatataactggacaaggccaagcttctgttgataaaaggtggtcaagactattggaactaaagaaagaaaatttatga

SEQ ID NO: 84517 - DNA, 210 bp, Glycine max
  Peptide Sequence Number=SeqID_201295
atgatgaaaaatagttggggcttatgtacgaatagagaggccatgtgggtgaaattggttagggcaaagcatttgaaagtgttgcctgaaatggagataggaaaaggggatacagtgagcttctcgaatggaattgtgttagggaaacttatctataaagctacttgcaatgttcctgcggagcatattgatagaaaagtcagcgagtaa

SEQ ID NO: 84518 - DNA, 832 bp, Glycine max
  Peptide Sequence Number=SeqID_201296
atggcagaattttggccttcttccatgttccgccatccaccattaataacactgagggaagtttatcctgctctgattttatttccagcagaaaagaagcagcctcttctttatgaaggagatatggctgtaattgacgttatgaagtttgtggctgagcacggaagtaacttccatcaacttataagagacaaagttttgtgggtatctgaaggagcagtcaagaatcagaacttacatgatactttgcaaactgatatccacccggaatcacttcattcacgtaacaaatatcatggagccccaggtccagacagaatgctagaccaggtggtcagacctaacctgatgaattcacctgcatcaaatgaactgcatgaagcatcacctcacgtggttattggttcagtgttaattgccacagaaaagcttttgggggttcatccatttgatggatcaaagattctcattgttgcagccaatcaagtaactggatttcaaggtcttattctcaacaaacatatacaatggagttttctgcctaaattggaagaaggcttggaaaatttgaaagaggctcctctgtccctggggggtccagtaatgaaaactggaatgcctcttttatccttaactagaacagtttccggaaataatttacctgaaatcatccctggaatttacttccttgatcaagtaacaacaattcgtaaaattgaggagctgaagtcagcaaatcaaccggttggggattactggtttttcttggggtattcaagttggggatggaaccagttatatgatgagatggcggaaggagcttggaacttga

SEQ ID NO: 84519 - DNA, 207 bp, Glycine max
  Peptide Sequence Number=SeqID_201297
atgccacattgtatgcttgcttctctgtatatcctagttgttcctaatagcaccacttttgtgtgctatagtggtgctgtggagcagctgactgccgctcctaagaggtgcattgcgctgcacctcactgttgtggccgtcacgccgctcttcatggccaaaatcgcggagttttgtgacagatgcagttgcaacagccaggtttaa

SEQ ID NO: 84520 - DNA, 2001 bp, Glycine max
  Peptide Sequence Number=SeqID_201298
atgctcatgcacagaaataccgagaagcttctagcggattccataggtgctactgctacccccgatgaaaccacactcttttatttccattattctgtttcttacaagtaccgtggaagactcagagctcgcaatattctctcctcgttgtatccttatatatcccttgcgcccgaggaggttcctctcgcggcgctcaacactcctctggatttcagattatttgttgactccacggaaagagctcttgttctcgttgacttttgtggatggacgcctaagttgctcgccagtgataataacggaacgcaaaatgctttctccgtgcttgggaatcaccatggaatgggttttagcagagggaataatagaatgcctgtgtcaaaggggaagactaacaagaaggtggctgaggaggacacgtgcaaggctgaactcggtgttgataaagggttttgtgaagttccttggctgggggagtttacctcgttaaattatggtcccttggagggctccaaggataggaatcatcatgttctacattcttgttcatctgaagaatttgagcggtttcattctttctacttgaaattcatgactgttgtgagagaatactttttgcctccagagaaaaatagatttggcttggtttcaagtaggtctatgctttcatccctaggtgttggtgattatggcccatggtttgcagttcactacctagctggatgttcaagttgttcaaatattcttaaagatgaggatgacctgaaatatgttttgcagatgaataattattttgtcaaagagctggaaggtaatggacatgatcaagagcccgttctaccagcaaataagccatctgtacttctatttgttgatagatcatctgactcctcagaaactagggggaaaagtaaggaggctcttaaagcttttagagtattggcacaacactatcatcgtgtgaatcagactggtaacaagaataataacagtcatgacaaattttctattcgagattatcatggcttcaagagtacatctgaacatcctaggttaaagttgtctaggccagctcagaagattaaactaaaggagaagatttcttccatcatgattatgaatgagggtaagcaagttagtttggacaatattcctttggatcttcaagggagttctttgaatgatatattggcttatcttctccagcaaaagaaggatggaaaactaagctccctagcaaaggatttaggcttccaacttttatctgatgatattgatgtcaggttagccaatacacaacaatcacattcagaagttcagtcaaatcaatttccaacagaaacttctcaaaaaggccatacagatattgtgatgctggatggagatacatatagatctgctggagagcttgaggaaaatcccaaatctactgagctatcttctcggaaagatgaagtaaagagaccttctattgtcacacatgaagagataaaatctgtggaaactgaagaatcgattgcagatcatgaactttctaccgctaaatttatgctaccagaaacagatgattcttcaggtggaaacaaggatgagggtgagcaggctcattttcttggttttaatgggttttttttctattctgatggtaattatcaattacttgaaagactcacgggtggtcgtggaattccatctttggttatcgttgatcctttttggcagcaacactatgtttaccctgatgagaaaagtttcaacttttcttcactgtgtgattttctttctgagtttcttaatggaaccttacttccataccagcagtcagaacatgttcttcaaggtcaaagggaggccacccatcctccatttgttaatttggattttcatgaggtggattctatacctcgaatcatggctcatactttctctgaacttgttattggttttaacctttctaacaaagaaaatacttctaattcatggaataaagatgtcctg

SEQ ID NO: 84521 - DNA, 763 bp, Glycine max
  Peptide Sequence Number=SeqID_201299
tgatgcaagggtaatgtgggatcagaagacaggccgttccaggggatttgggatgttttggttctgtgattcaatttatcaggatgctcaaagtgctataaatgatttgactggaaaatggcttggaagtagacagattcgttgtaattgggcaaccaaaggggccagtgccagtgatgaaaagcagacttcagattcgagaagtgtcgtggagttgaccaatggatcatctgaagatggccaagaaacaaccaatgatgacactcctgagaagaatcctcaatataccactgtttatgctgtgaaattgcaggttacttctgttgatctccatcaacattttcattctcttaatgccggaactattgaagatgttagggtgcaacgagacaaaggttttgggtttgtgagatacagtacccatgctgaagcagctcttgctatacagatgggtaatgctcgaattctatttggcaaacctatcaagtgttcatggggtagcaagcctactcctccagggactgcctcaactcctctcccaccacctacttctgcgaatgtgtcgggattttctcttgctagtcttgcagcttatgaacgccaaatggctttgagtaaaatgggtggtgcacatgcccttatgcatcaacaaggtcaacatgccctaaaacaggtagccatgggaatgggtgctcctggggctggttatgatgcaagattccagaatgttgcgaccacccaacacctaatgtactatcagtaa

SEQ ID NO: 84522 - DNA, 162 bp, Glycine max
  Peptide Sequence Number=SeqID_201300
atgaatccggtccctgagctcatcccttcgaatctcagtcttatacaccatctagagagtggaagagagagagcttggaagaaccaaaacaagaaactcttcatagcaatggctggaggtcagccgtcagagattatgaatatctctcaactcattggttag

SEQ ID NO: 84523 - DNA, 1818 bp, Glycine max
  Peptide Sequence Number=SeqID_201301
atgaaaattggattcggtgtaagagctctcctcatttcctctcgaaacagtaaccctctctcgtcgccgccactgctctcactcttctctccctttagcgccgtcagatcccttcattctccgccgcctttctccgcagccgaagccatgcccgaaactgagactcacgatgtggagtggccggcgaagcgcgttagggacactttcatcagcttcttccaggacaaaaatcacgtcaactggaagtctagccctgtcgtccccttcaatgaccccactctcctcttcgccaacgctggtatgaaccagttcaagcccatctttttgggaactgcggatcctaacactgccttgagcaagctctctcgtgcttgcaacacacagaagtgcattcgagctggcggtaaacacaatgatcttgatgatgtagggaaggatacttaccatcacaccttctttgagatgttgggcaattggtcctttggggattactttaaagtagaagccatcagctgggcgtgggagcttctaaccaaagtttataaattaccatcagatcgcatttatgccacatattttggtggtgatgataagtctggtcttgcccctgaccttgaggctagggatatatggcttaagtttttacctccggggcgtgtgcttccttttgactgtaaagacaatttctgggagatgggtgatactggtccttgcggaccttgcactgaaatacattttgacagaattggtaaccgtgatgctgcatcattggttaataacgatgatcctacctgcattgagatatggaaccttgtctttattcagttcaatagggaggctgatggctctcttaaacctcttccagcaaagcatgttgatacgggaatgggttttgaacgtttgacctctatacttcaggacaaaatgagcaattatgatacggatgtcttcttgccaatctttgatgttattcagcgggatgtcacagagaagaacctgtggtaccatttcaagaagtgggatgatgtgaggaagattttcatctctaaacaaagaaacaagaatggtaggagatacggttttgatagattcaaaggagggaaggacgtgcacaatctagaaaggcaactggaccagattgtcatcggtggtttgaagctgtacattaacatacctaaatatgggagagagatggcgagaaaggtagcagcacaacccaaaccaatggggtacgaggagaaacacgaaaatacaacagcttggtggagacaaccacaagcgagaatgagttccacttcgtacgcgacagtggtggccagaaacatgtgcagttctgggcaaaggaaggtaacatacaatgagccccacagccctgttgcctcactatcattagtacatcttgacataccactgaacgacaagaaatggttcagtgaagcttgggtagggcgactgaaaaaccttgcgttgtttgatagagtcgaagacgacctattgtgggactttggagcagacataacttcaaagtacatgggggatgacatggttctgttacctagcctcactgatgccaaagtagaacaaatgatgcaggaggaaatggacggagaagattccttgttccattcgttggagaaatggaattcgagtctacgtataggtcacagattaacgtgggtccaatgttggggtattccgctactagcctgggatatgacgtatatccagaagatcgtggctgccatcggggatatggtggaggtagatgacgatgtcaaggaggttcggagggtggacagagcaagggtgctcatttga

SEQ ID NO: 84524 - DNA, 2307 bp, Glycine max
  Peptide Sequence Number=SeqID_201302
atgggtcccaattctagtgtccagactccaaggtcttgtagtagctttggattttcaaatatgtggccagaccttattcaaaaggccaaagatggaggcttagatgttatccaaacctatgtgttttggaatggacatgagccttctcccggaaagtattatttcgaggataggtacgacttggttaagttcatcaagctggtacagcaagctggtctctatgttcatctccgcattggtccctacatatgtgctgaatggaactttggggggtttcctgtttggctcaagtatgttccgggtattgctttcagaacagacaatgaacctttcaagatagaaaacgaatatggaccagtggagtgggaaattggtgcccctgggaaagcttataccaaatggttttctcaaatggctgtgggtttagatactggtgtcccctggattatgtgcaagcaacaagatactccggatcctcttattgacacctgcaatggatactactgcgaaaactttactcccaacaagaaatacaaacccaaaatgtggacagagaactggactggctggtacactgagtttggaggcgcggtccctcgtagacctgcagaagacatggcattctcagttgcaagattcgtacagaatggtggttcatttgttaattactatatgtaccatggaggaactaactttgatcggacatccagtggcctcttcattgccaccagctatgactatgacggtcctattgatgaatacggacttctaaatgaaccaaaatgggggcatcttagagatttgcataaagcaataaagctatgtgagccagctttagtgtctgtagatccaacagtgacatggccaggaaataaccttgaggtacatgtgttcaagacttctggtgcttgtgctgcattccttgcaaactatgacaccaaatcttccgcatcagttaaatttggaaatggacaatatgacctaccaccatggtctatcagcatccttcctgattgcaaaactgcagttttcaacactgcgaggcttggtgctcaaagctctctgatgaagatgactgccgtgaacagtgcatttgattggcagtcatacaatgaagagcctgcatcatccaatgaggatgattctttgacagcatatgcactctgggagcagattaatgtcacccgagattctacagattatttgtggtatatgacagatgtcaacattgatgcaaatgaaggttttataaagaatggacaatctcctgttcttaccgtaatgtcagcaggccatgttttgcatgttttaattaatgatcaactttcaggtaccgtgtacgggggactggactctcataagttaacatttagtgacagtgttaagctgagggttggcaataacaagatttctttactaagtattgccgtgggtctcccgaatgttgggccacactttgagacatggaatgctggggtgttaggtccagtcacacttaagggtctaaatgaggggactagagacttgtctaaacagaaatggtcttacaagattggtctcaagggtgaagccttaaaccttaacactgtcagtggtagttcctccgtggaatgggtacaaggatcattattggctaaacagcaacctttggcatggtacaagacaacttttagcacaccagcaggcaacgatccgttagctctggacatgattagcatgggaaagggtcaggcatggataaacggtcgaagcattggacgccattggcctggatatatagcacgcggtaactgtggggattgttattatgctggaacttacactgataaaaaatgccggacaaattgtggagaaccctcccagagatggtaccatattcctcggtcgtggctgaacccaagtgggaactatctggttgtgtttgaagaatggggaggtgatcctactggaattactttggtgaaaagaacaacagcaagtgtgtgtgctgatatataccaagggcaaccaactcttaagaacagacagatgctagactctggcaaagttgttagacccaaggctcacttgtggtgtccacctgggaaaaacatctctcagattaaatttgctagttatggattgccacagggaacttgtggaaactttagagaaggaagttgtcatgctcacaaatcatatgatgctcctcaaaagaactgcattggcaagcaatcttgcttggtgactgtagctcctgaagtttttgggggagacccgtgtccgggaattgcaaagaagctctcacttgaagcactatgcggataa

SEQ ID NO: 84525 - DNA, 1563 bp, Glycine max
  Peptide Sequence Number=SeqID_201303
atggtggtgaagaagccgcaaattgtgataattggagcaggaatggcaggcctcactgctgccaacaagcttcacagtgtgagtgcctcaaaggacttgtttgaggtgtgtgttgttgaaggtggaaacaggattggtgggagaatcaacacatcagagtttggtggtgaccgaattgagatgggtgctacttggatccatggaattggaggcagcccaattcacaaaatagctcaacaaatccatgcacttgagtctgagcaacattgggagtgcatggatgggaatgagaataaggccaccaccattgctgaaggtggctttttggtaaacccttcccttgttgaccccatcacaaagcttttcaacaatctcatggatcatgctcagggaaagataccaacaacaacaacaacaacaacaaggacaggcctcgatgcttattgtggttcatcaaaagaggaagaggagctcaaagggtttggaaaatggagcaaaaagttactcgatgaagcaatctttgcagttcatgagaacacacagaggacttacacatctgctgctgatttgttcaatctagattatgcagcagaaagtgaataccaaatgtttccaggtgaggaaatcacaattgctaaaggctacttgagcataattgaatctttagcatctgtgctacctcctggtttggttcagttgggtagaaaagtcacaagaattgaatggcagccggagagacacgaggcgatgaatttggaaaatggaagaccatgttcttctaggcctgtgatgctacatttctgtgatggctctattatgtctgcggatcatgtcattgtcacagtttcacttggagtgttgaaggcttctattcgtgatgatgattcaggtatgttaatgtttaatccccctttaccctctttcaaggccgaggctatttcaaggcttggttttggtgttgttaataagttgtttatgcaattgagtgagcctccacatgaacattccaaagggttccccttcttgcaaatggtttttcattcacctcaatctgagttgaggcacaagaaaataccctggtggatgaggaggacagctaccctttgtccaatttacaacaattctagtgtcctcctatcttggtttgctggggaagaagcactggcacttgagtcactcaaagatgaagagatcattgaaggggtttcagacacaatttcatgcttcctatcgaattcacttgagttttgcaacgggaatgtgaattctgagaagtattctcacgaatataaggtgaaattcagtaaggtgttaaagagcaagtggggaacagatccattgtttttaggctcatacagtcatgtggcagttggatcaagtggtgatgatttagatacaatggcagagccattgccaaaatgcctcacttgtgcttcaccaccacttcaaatcttgtttgcaggggaagcaactcacagaacccattattctacaactcatggagcttactttagtggccttagggaagccaataggcttcttcaacactattcactgtgttaa

SEQ ID NO: 84526 - DNA, 672 bp, Glycine max
  Peptide Sequence Number=SeqID_201304
atgctggatatcgactatttcaagcgctacaacgatacctacgggcaccaggcgggtgacgaatgtctgacgcgggtggcgcgggtgctgaagcagtcggtgcgcacacctgaggatgtggtctctcgctacggcggggaagagtttctggtgattctgtttaattgccctgaagccatcgcggaaaaggttgccctgcgtattcaggacggcctgcgcgcagaggccatcccgcacggtgcctcagcggtcagcgaccatgtcacggtgagcatggggattacgagtatggcggaggggctagccggcaccgaaatcatcgcccgcgccgacgcggcgctgtaccgggcgaaagaggccgggcgggatcggtggtcacgtttcacaccagccgtccagccagtccgggccaaagtcgcgtccagtgccggactgcttcatcccgccgaacggcaggttggcgtcaatcagcgtgtggctgtttacccaaacggtgcccgcctgcagcctgtcggtatactccagcgccttgctgatattctgcgtccagacgctggccgtcaggccatattcggtgtcgtttgccagctggagcgcctcttccccgtcggagacgcgcaccaggttgaccaccgggccgaacacctcttcgcgggtcaagcgcagcccggc

SEQ ID NO: 84527 - DNA, 234 bp, Glycine max
  Peptide Sequence Number=SeqID_201305
atggcagtgatggcacatcctatctacaacatgcttttattccgaagcctaataaggctctcaaagccaaggagtagtgcaatagacacagagaaagtccaaaaaaatgcgatttctttatgggaatctgatcataactttaacatagttccatgttcacggacactgccactaggaaagaatcttaattatctgccacaaccgccggcttcttccggttctcagcgaacctga

SEQ ID NO: 84528 - DNA, 210 bp, Glycine max
  Peptide Sequence Number=SeqID_201306
atgagggagggggacgttttctgcccccaaaaactcccccccccccccctcattcaaaagagagacctcacgaagcttgcggtttttgctcccccaagccacttttggtcgcatttttctttcattttggtattcctactcactccagcaattttggggctttttatgcttgatttgttagaattgagggattgtaggggatggccttag

SEQ ID NO: 84529 - DNA, 228 bp, Glycine max
  Peptide Sequence Number=SeqID_201307
atgtggtaccatgtcagtgaaaaacctcatcgagcgcctaggagtacatggcaagacaaaccacacactaggagaccagtcagggtcacgctgttttgcaagaatgctccaaccatgtgggatcggtacaggcttaaaggagcactcaaaccgggtgtatttaccctcaaggcctatactctgaagagtctatcagggtctctccctcctgatttaggtccaacctag

SEQ ID NO: 84530 - DNA, 339 bp, Glycine max
  Peptide Sequence Number=SeqID_201308
atgggtgcaaaggattcatcgttcatgaacaggtgcgatcatccagaggtgaggtgggggcatcctgggctggcaatgatgtatccggtgctggagtgggtcagggatcccaggtgttctgcgctgctgccatgtctgcaaacatattctatgtctgcagcgccgtctctctccttaggtgcctcagatggtgtggcagcaggggtatcttcaggtgtctcctcagcctctgcctcggcctctggctatgactcctgggcaataggagcctgggctgtaggagccttacttcccccaaaagagaaggctggactcctggccaggccacctaggccataa

SEQ ID NO: 84531 - DNA, 594 bp, Glycine max
  Peptide Sequence Number=SeqID_201309
atgggatgttacaggacaccggagcatgtgacatgtggtgtcacatacgttgttgacaatgccgtcgtggggagggtagagcccgatgacgatggagtagtggttggggaaggtgagggtgggaaagatagggatgagcttggtctcggcctgggtgtcgtttttatcaaatgcatgttgggagcagggggtcttgaatcggtacccgaatcggaagtcgtcggccttgatgccacgtttttctctgtcccacaacaaaaccactaccctcaaacgctctttattctgctccactgtttcccacgcttctctgcaaaacccatttcgagaaactccttcacttgcgctctcacacattcacccactcacaagtacgtgtaccccgacccagttcccgaattcgcagagcacgagacccagaagttcaaatttgaactcttttggaagctttcggaggagggcgtggacgagttcggggacgaccttcattcggtcgtagatgtttgcgcgcagtgggatggttcactttggatatgtttggataagattgtgatttgtttattgtacttgagagctagactgctaggtgtttga

SEQ ID NO: 84532 - DNA, 582 bp, Glycine max
  Peptide Sequence Number=SeqID_201310
atggggaattgccaagctgtggatgctgcagcacttgtgatccaacacccttctgggaagatagagaggttgtactggccagtgagtgcaagtgaggtcatgagaactaatccgggccattatgtgtctttgatcataccattggctgtgcctcctgatcaagggcagatcaatcaggcgcagaaggccgtgctttttacgcgcgtgaagctgctccggccgaacgaaactcttactcttggccatgcttacaggctggtcactactcaagaggttgtgaaggcagtgaaggcaaagaaacacgcaaagatgaggaagccacaggtgaaggcaatggagggcaatgagaacagacagatacagactactgagttccacacatgccgcgctgaagccaaaatcatggcgtccctctttgcagagcatctcagagtctgcaagttgagtagtgctaggttgttacattggaatgaatacctgatatatgggcaaaagaagttcagcaaaggtttgaactacagacttctcttccatcaccagtcacaccctcaactaaataaccatgttccagtgacaacatga

SEQ ID NO: 84533 - DNA, 465 bp, Glycine max
  Peptide Sequence Number=SeqID_201311
atgaattgtgttttcgttcatgcgtcctccacccacaagtttggagccatgcgtagtgattgcttagtgcaattctccattctcatcccttttttggagcccatgaattgtgttttcattcatccgtcctccacccacgagtttggagccatgcgtagtgattgcttagtgcaattctccattctcaacccttttccggagcccatgaattgcgttttcgttcatgtgtcctccacccacgagtttggagccttgcgtagtgactgcttagtgcaattctccattttcaacccttttttggagcccatgaattgcgttttcgttcatgcgttttccacccacgagtttggagccatgcgtagtgattgcttaatgcaattctccattctcaacattttttcggagccccatgaattgcgttttcgttcatgcgtcctccaccttcgagtttggagccatgcatag

SEQ ID NO: 84534 - DNA, 616 bp, Glycine max
  Peptide Sequence Number=SeqID_201312
gcggcgggcccgatgatacgcggagataccttacggttattcgcacccttgtgtcatccagaggcggcggacccgatgatacgcggagataccttacggttatccgcacccttgtgtcatccagaggcggcgggcccgatgatacgcggagataccttacggttatccgcacccttttgtcatccagaggcggcggacccgatgacaagcagagacaaaatttggtcattctgcacccttgtgtcatccagaggcggcgggcccgatgatacgcggagataccttacggttatccgcacccttgtgtcatccagaggcggcgggcccgatgatacgcggagataccttacggttatccgcacccttgtgtcatccagaggcggcgggcccgatgacaagcagagacaaaatttggcggcgggcccgatgacaagcagagacaaaatttggtcattctgcacccttgtgtcatccagaggcggcgggcccgatgatacgcggaaatacctgagtggttatccgtataacattcttttgctatctgtaagacagacgcttgatagcatgcagagactgacatcgtcttctgcaccttttgttcccccgggaacaacaa

SEQ ID NO: 84535 - DNA, 596 bp, Glycine max
  Peptide Sequence Number=SeqID_201313
gccgttcgccagcgtgcgtgggaccggctggccaccaacctggacccgcagaagctcgaaagcaccgtgcagctgattgggcttgccgaggtgctggacgtctacgaccagatcatcccaggcaaggtgcgtgggcggattgttgtggatgtgaatgcgtgagcagatcgtctggatcaactgcatctgatgcagtttccatgctgcggcgaatgccaacgccgctcgcatacgctcgggttcccatcgctgcctggacacctgacatgccaatgaccgcgttcgcacttgccgctgcgctttcgggcctgcccgacatcaccttggagcgcgagcgcgccgaggatgcgcaccagctcatgctgtgccagatccatcgcgatgcgctgaagcagaacgagggcaaggaagatgcctatccgcgtgccaaggcggtctgcgacctgctggcgcgcgagtacaaggacaagtgggatttcgatgcgcaggacgcgctggccgcttcggcggtggatttggatgagctgattcgacgtggtgatgtggtggaggccctattgaagcttgcaaggcagtatctggatgtctatggaatg

SEQ ID NO: 84536 - DNA, 177 bp, Glycine max
  Peptide Sequence Number=SeqID_201314
atgacgtacaagaacatacaaggacatcaacagttgtgtgtgtgtggtagcaaaggatcattaaattgtaaacatcatgagccacatgatgagggaagcagtatcaaatcagtgctttacaagcttttggtcaatctaagaagtggtgtcttcatgctgcaaattgatggtttctga

SEQ ID NO: 84537 - DNA, 1169 bp, Glycine max
  Peptide Sequence Number=SeqID_201315
atggtacatctacttgggttgttgactgagaacaagagagggtacatctcttgtggatcagttctagtggagggtacatccactagattgttcaaggagcacaagggagggaatgaaagtgaggctatcaaaactattgttgaaaatgttatgcgtttgttagacaagacagagttgttcattgctgataatccagtcgacgtagaaccacgagtccaggaaatgattgaactaatagaccaaaaacaatcaaatgatgttctactactcgggatgtgggggatgggaggcatcggtaaaatgactattgaaaaagccatttacaataagattggccacaattttgagggagaaagcttcctcgcacatattagggaagtttgggagcaagatgctggtcaagtatatctacaagaacaacttctatttgatatcgaaaaagaaacaaacacaaagatacgtaatgttgaatcaggaaaagttatgttaaaagaacgacttcgccataaaagggtacttcttatacttgatgatgtaaataaattgcatcaattgaatgttttgtgtgaaagtcgtgaatggtttggttcagggagtagaataatcatcacaactagagatatgcatatacttagagggagaagagttgacaaagtgttcagaatgataggaatggatgaagatgaatctattgagctttttagttggcatgcatttaagcaagcaagtccaagagaaaattttattggactttctagaaatatagttgcttattctgcgggattgccactagctcttgaagtccttgggtcctatttgtttgatatggaggttacagagtggaagaatgtattggagaaactcaagaaaattcctaatgatgaagtacaagagaaattaaaaataagctatgatggtttaactgatgatacagagaaaggaatattccttgatatagcttgtttctttataggaatggaccggaatgatgttatacatatcttaaatggttgtgggctttgtgcagaaaatggaatacatgtcttggtagaaagaagccttgtaactgtagattataagaacaagcttagaatgcatgatttgctgcgagacatgggaagagaaatcattcgttcaaaaacaccaatggagcttgaggagcatagtag

SEQ ID NO: 84538 - DNA, 201 bp, Glycine max
  Peptide Sequence Number=SeqID_201316
atgccaattactcctagggcaattttggggagattgcctgtacatgaggtaacattatttaagctgagatatggagaaaatgtggtagaagtccaccataacacaaaatggacttgcctccttgtcgggatatttgccactacagtccttgccgcaggggaaaaggttggatgtctactggcaaaatatacagtaggttag

SEQ ID NO: 84539 - DNA, 264 bp, Glycine max
  Peptide Sequence Number=SeqID_201317
atgtacatcaagtatggcccaaaatacatcatgaagcatagccaacaaaacaagcttgtagtgagcttcaaaacaaggaaaaggaaacaaggctcaaaagggctatcaaaggaattaattcaaggtaagtccatttggctagaagcttataataacaaaattgcctcaatcatttccaaatatgcatgtgaattaggaagcatcaacaagaatcaagccaaggctattgtgcaagcaatcaatggggcaaaacacaccaaatga

SEQ ID NO: 84540 - DNA, 621 bp, Glycine max
  Peptide Sequence Number=SeqID_201318
atggctttgaaggttgcttacagccaactctaccgcaccaggagtgtttggtgtatgccaccagcctttgcggtggacgtcattaatggaagtccagtggaaactctaattcaacattatggaaaggattggatgcctccattttccaacttgaacctgatttacattacgattgttcaaaattcagctcattggtatctcatggtcatagacattaatgacagaaaaatttatcatctagattgtgacctcacaagtgaaaccgcatatgaacgcaaagatagcattaaaatcatggccaatgtcatgctcagtgttctagaaattgtgtttccaacacaagaatttgttattggctttgatggaatggattgttgggatattgtggaagccagaggaatcccaaattgtggatccagtgagaaatcctcattatgggtccttgaatggatgcaaatggaggagtcatttgtcagtctcttgtatggagtgctagaagaaaaggccgtcagaatgaaggtggcaatgatcgtgctgttagggacacacaaccagtgcaagggagagttgattagaaatgcagagcgcaattggcatgactgtatccatgccaaacactga

SEQ ID NO: 84541 - DNA, 294 bp, Glycine max
  Peptide Sequence Number=SeqID_201319
atgttgtttcaagatatctcaagcggacaaagcgagggtatacttgccattgttggtggtaaaaataaggcacatctatggtgtcctgcaaaaaccatcgtcagaaaaacaaaatcagaatatggcaatgaaaatgaaagaaaaaaagaagccaagaaaaatggggatcctaacaggagtgccttacatttaatcagcatgcatgagtggaatattgcgattttaatatcaacgaacacaaaaaacaccgcaaaaacaatagttttattgtggtgtgtggtagtgaaaggataa

SEQ ID NO: 84542 - DNA, 635 bp, Glycine max
  Peptide Sequence Number=SeqID_201320
gcgttgaattcgcgccagctgtagatgtgttccaggcatccgtagttggggaaggaattctgcgcgctgaaacgggagctggcaaagcgcgtatcgacgccctgcgcatggcacaggtacatcgcttcgtccccgtcgttgacgccgaggtggatgtgttggccgaacacgcaggccagcttggaaagatagccaaagcggctggccagctgcctgtagcgcgcgttgtcgctgatgacctgcttgcgccagtcgttgctcagatggcggccgccgccgcagacgtcacagcccaggcgctgcgcgctgcgccggacggtatgggtcagggcgcgcagctcggcgtgcagctcatcgagatcgcggtgcaccgagctgttcagctccaccatcgatttggtgagctcatgtttgacgcgccggcggtcgccgaccgcgctgaccacccggtcggcccgatccgtaagatcgtagtgcttgtcatcgaccagctgcagctctatttcggtgccgatggagagcctttccgaacgtttgaatgtgagcggcatggtgcctccttcctgcaagaacagcataaagataagttaacgggagtgcgacatgacgtcattgacgccgctgaagctgtttaa

SEQ ID NO: 84543 - DNA, 558 bp, Glycine max
  Peptide Sequence Number=SeqID_201321
atggcttttcagattccaaaacatcaaatcatgagttcgaaatggcgcctcttcagttccgtctctgttggtcgatttgaaagtgcaaatgcagtcacgttaacgttacacaactacattgaggtccccagagcttatcataagcaatgggctccacattaccctgcttatgtgcagatacaatataatggagcgccgcacttcattaaggttaggaaaaatggtcagcaatactacctggccgatggactgaaagacttcagaagaaacttcaacatacatgaaggtgtattgttgttgcctatcgaggctgtcgattttgttgatgcttcaagaccatgtatgaccgtgcaacataggagtgacgttcgtgacatatggaccatctccatgcataatggtgaacaatatgtggatgacccttggcacagattcttaacggacaatgacttgatgggtggagatgaggtcgtcttctattatcggcctaacgaacatgtgtgggagatcatcttcaggaaggagcccatatgggatgaacatgacgagtccacttga

SEQ ID NO: 84544 - DNA, 168 bp, Glycine max
  Peptide Sequence Number=SeqID_201322
atgcctaaggaagaactacgtaggtctgatttcctctccaaaggagggtttagtgcctccaacaaaaatactactttccatgtcttcttgagaactcctcgatatagacaaccatccgcaacgtcacccgcaacaaccagacggcatgtgctaccagccgaggtttaa

SEQ ID NO: 84545 - DNA, 600 bp, Glycine max
  Peptide Sequence Number=SeqID_201323
atgcacacacttcattggaagcgtaaggatcatgctgatagagcacctacacgtggcatacgcttatacctcgatgttcttaagatggtattacttttacaaagcaacactaacttgatggctattgttacgaggaagatactcacttctatactcttcaacgaatattacttctacaaagcaacactaactttaggctactgttacgggaaagatactcgcttctatactctgaagccggtatcacttctacaaaacaacaccgacttggggctactattacagaaaatatacttgcttctacactcttatgccgatattacttatacgaagcaacatagacttgggggctactattatgagaattacactgacaataagtggcaaatttccccatctggggtggaactcgccaccatgactggcgagtctggtctaaatgttgggaaaccgccagtcaaactggcgggttgggtgcaggctagggttgctttttcagtgcaatttgcagttgctttttgcaggggtgcaggcctaaaggggagttgcagctgccactggcgatttgagtgcaagttgcaactcccactggcgatttag

SEQ ID NO: 84546 - DNA, 384 bp, Glycine max
  Peptide Sequence Number=SeqID_201324
atgcatgcaggacccaaaccgccagaactagtggcgagtttggtgtccttgagcaaatcgccagcaccaatggcgatacgtgcatgcagagaggaaaccgtcagtccaaatggcgatatacttagcgctttgggaaccgccagtcaaactggcgagttccatggacgtgtagctgcaggctacgtcctgccatggcagtgtagctgggtcagtgcaggcgaaaccgctattaccattggcggtttgccttgcatagggattgccaagaaactgctattaccattggcgggttgcttggggtgtgctgtgtttcactgttggtacgcgatttctctcctcttcatattacgtgagttctctgtgcttggtttagttagaatgtga

SEQ ID NO: 84547 - DNA, 363 bp, Glycine max
  Peptide Sequence Number=SeqID_201325
atggctcatattgagcccatgggcccaaaatctacgctaagactcatgagaaccctagagccttctcctgcatctctgacccaatcttcttggagtcttttatccaatgcccttggggggcattacttcaaaagctcatcggttgtcgttggtgtcaatgacgttgacgacaacaacgggggagctcgcatcacaaaggatgttagagaaggagcaatgcctaggtttatgttcgatggagagatgaatttgacaagtggaaaacaagtgttagggaagaggggaaagatgaaaggacgatggattgaggttccaaggaaagacgatggtgaatttgtgtggaattttggagcattggcttaa

SEQ ID NO: 84548 - DNA, 705 bp, Glycine max
  Peptide Sequence Number=SeqID_201326
atggagggagtgctgtccgcgaatgagcaacagagcatggtctcttctttcctggaggtcgctcagggccagaccgccgagactgcgcgccagttcctccaggccacaagttggaagcttgaggaggctcttcagctgtttctgatagggagtgaaggtggggccgtgccgttgccggtgccgccgcctccgttgttgcacactccgcctttggaaaatgtcgattcctggaccgatcaacagcctttgagtgaaccgaggaaggacgctgcggctgcaagtgaaagtattggcctcaatgatgcggaagaggtgcgccctcccttgcctgtaataagggaaactctctacgacgacgcgatgctgtatggagcatcaagggctgggcatcgttcacatgaaccgagctccctagttgcatttcgtaactttgaagaggaaatgagacaaccaggggtttgggagtcggaacaaggtgctgcttctacagcagaggcttctcgagataatcttgcttcactttatcgccctccatttcatctaatgttcaatggtgcttttgataagctaataaaccttaacacttgcatatacatgtcttgcattttgaaaaatgcactacacttaaatccatttaagcataataagcaaggaatgaaggggtcatcagtcaacaatcaaaaccccaacatggctgttagttga

SEQ ID NO: 84549 - DNA, 459 bp, Glycine max
  Peptide Sequence Number=SeqID_201327
atggcgcagagcacaagactaacaacagaaatgacgaaggaagtgattcacggtcacaactctacaacgcctcggagaaaacagcctttgagtgtagggaaatttgcccaggcgagttgcttgcttaatggtgaaggtatctactcacccatgcgagttgcttgcttagggctgaagttacatcttagcccaggcgagctggatgctagtttgcgcgaatttaggagaaagtatgcccttgacatcctggaagagactggcctattcaatgccaagccactgggcactcctatggatcctagtatcaagttactacccaatcagggggagcccttattgaatcctgggagatacaggagttgcccaaatattgcctttgcagtgagtgtggtaagtcagttcctaaactctccctgccaagatcactgggtgaaatacattaagaaggctcctggctaa

SEQ ID NO: 84550 - DNA, 468 bp, Glycine max
  Peptide Sequence Number=SeqID_201328
atggtaaatgaagagtgtaaggaggtaagtgtctccttcaagaggttagctaagaaagaaagtcattttgcaataaagacaaacattaaagaaacttcccttcttagacaacctccacatcttctcctttgtaaaaggacacttattagcattgtcacacctattgggcttgaggttattcctcaagtaaaggagttattggatgagggtttggttcgtattatgaggaaccgaatccctatgttaggtgatatgatgaatgtgttgagtggtgcaaccctcttttgtaaaatcacccatgcatccaacatcatcatgattcacatacataaggactcattaggtgttgagggaagaagtccagagtttcaagaacctatggatttgaggtcaaatccttttcaagggggaaggaatgatgcaatcctacccccaagggtattggatagaagactccaagaagattga

SEQ ID NO: 84551 - DNA, 288 bp, Glycine max
  Peptide Sequence Number=SeqID_201329
atggtgtttttagtaagctacacgaaagcaaaagctgaaaacgttcaagtgagaaatggtctcggacacggaaacgtcgcgtacactccagatatcttcccgaagatcctaacgaccaaattttgcgaagatccaatagttaacggaggctgggcagcatttttaccaaggcagctcatgtggcttcctcaagaagcttcattaagaggcttcctcaagaagcttcctcgtggcttctttgagaagctagatccttatctacccacacccctctataaactaaattaa

SEQ ID NO: 84552 - DNA, 234 bp, Glycine max
  Peptide Sequence Number=SeqID_201330
atgtctatcgaccgagactactttagtctcccccttcgtcaaccagaggcaagcgagcgcattgacacgcaaagaccactatggtcatcttcaccctttgtcgaagactcaatgtctatcgaccaagactactttagtctcccccttcgtcaactagaggcaagcgagtccgttgacatttccctttactatctggagactatcaagtctgatggcatgcaaagacaaacatag

SEQ ID NO: 84553 - DNA, 243 bp, Glycine max
  Peptide Sequence Number=SeqID_201331
atgggtgaaggtgaaaagatgaagaataagaaggttgcagtagctggtgtctcgctaagcgaggaatatgcgcttagcgagcaacatccgctaagtgagacatcagctcacttagcgagtgaggagaatctgccatgcatgcacgtgctcagtgcgccatcagatcgcctagcgagtcatttgtctcttctggcgtccagcgtgcctaactcgctcagccaaaaatcactaactcgtgcttag

SEQ ID NO: 84554 - DNA, 285 bp, Glycine max
  Peptide Sequence Number=SeqID_201332
atgcctgcctcttgcagagcttcaaagataaaccttcttgaggatgacaacaagtccctgtatgacattggtattggggtgaacttcggaagcttctttactggagggtttctccctgcattggagttcatgccaggattggcatcgccggtgggacaagggtgcgccagagtcgagtatactagtgagtattatgaggggtttgctggaattccggccaagcaggagccgaggggagacatagtcaaacttccctctatcgcatttaccaccggtccctcatga

SEQ ID NO: 84555 - DNA, 267 bp, Glycine max
  Peptide Sequence Number=SeqID_201333
caatcaccaaggcagcagtacaagagatttgaagagttcattgtctctcataagtatatcataagtccctatgactcatgtgtttatcataacaaggtggaggatggttcccacatctatctactactatgtgtagacaacatgctcatagcatctcaaaatgtgttggcaattcagaagctgaagtcaccactcaatagtgaatttgagatgaaggacatgggaactgctaaaaagataatgggcatagagatcaagaaggattga

SEQ ID NO: 84556 - DNA, 494 bp, Glycine max
  Peptide Sequence Number=SeqID_201334
atggaagaccaagatctggaaatgattcttttagcctctcttcctccttcctacgagaattttctgtttgggaatggtgatgaagcctctacatttggatttttattagtatttgattcttctaaaaggcagaagaagaacacaggcaaagactgtccaaagaaagattatgttgttgctcttgttcagaataactcctcatcgaaaagggatttggttttggctattggtgaacaactacaacaaaattttaaacagtgggtgttagacttaggttgttcttatcatatgtgtccatacagacattgttttgtgacatatgagaagaagtctagtggtaacgtccacatcggtaatgatgctccttcactacgtctatgggaactagcattggatgaagtttccataagttgtgcacacaacaaaggccatgttggactacatccattatgtctgatgggagcctttgagagtttcatcactggaggggcaag

SEQ ID NO: 84557 - DNA, 204 bp, Glycine max
  Peptide Sequence Number=SeqID_201335
atgtcacttgaccttatgggtcatgatgacaaaggtgcagaagaagatggaagtcttcgcgtgtcaacgggtttgcttgcccctgatcgaaaaagggtgcagaagacgacgttagtctctgcatgctaccagactctaagtctgacggatagcgaaagagtgtttatacggataaccacttgggtatctccgccggccacctaa

SEQ ID NO: 84558 - DNA, 144 bp, Glycine max
  Peptide Sequence Number=SeqID_201336
atgaagacacgctcagtaactctccaccgtgacactctcacaacaccttctctatggcctacgcactcacaaaagatttgcacacagggagtgatacagagcaactgcctcattattgttgcatcaataaggtccacctcgtaa

SEQ ID NO: 84559 - DNA, 321 bp, Glycine max
  Peptide Sequence Number=SeqID_201337
atggaagacgcacccgtgagtctcgcgtcgccctcccgccgaagggtaggagaagagcataaaattcaagattacctcggagaaactacgaaagaaaggattcagagcttgttttatactgaatctttgaggtgggttctaaggatttggcggcaagcggtgacggctcgtggtggcccctggtggtcgtgggtggtggagaagatctcgcttagcataattcttctcgggttgggatttgcactgagcataatccctcgtgtgttgagtgtgacatttcgcgctgagcataattccctcataggttggaattgcatttag

SEQ ID NO: 84560 - DNA, 162 bp, Glycine max
  Peptide Sequence Number=SeqID_201338
atggatacgactcttctcaagtcaagaatgtcaagtgaggccagcgagtccctcgaagtaaccaaaaatgtccttagtcgacttatcacaactcaaaatcccccagatgttagaggacgtttcccactaagtatagggtcataccctcaattcccaacatga

SEQ ID NO: 84561 - DNA, 183 bp, Glycine max
  Peptide Sequence Number=SeqID_201339
atgaggagagaacacaacaacaataggagaagtgctcccaatgtcattctctccttgatcactggcacttctcttgcaatgatatggaaggtgtttcctggatacaagagtttcatggagtctctagctaagaggcaaaagtgcaaggaaaaggtgttctatgtgaccttcatgccactttga

SEQ ID NO: 84562 - DNA, 522 bp, Glycine max
  Peptide Sequence Number=SeqID_201340
atggattcaattcaagaatttatggagtcgtgtaacactgacatcaccaccaccaccgcaacaaccaccagcaacagcttagttggtagctccaattccccttctgcttcctccaccaccagcagccgctacgagaaccaaaagcgccgtgactggaacacctttggccagtacctcaagaatcaccgaccccctctctccctctccaggtgcagcggtgcacacgtccttgaatttctcaggtacttggaccaatttggcaagaccaaagtgcacactccgatctgtcccttttatgggcaccctaaccctccagcaccatgtccatgtcctctaagacaagcctggggtagccttgacgccctcataggtcgtctaagggcagcttttgaagaaaacggaggaaaacctgaaaccaacccttttggagcaagagctgtgaggctctaccttcgtgaggttcgtgaacttcagtccaaagcaagaggaatcagttaccgagaagaagaaaacggaaaggcg

SEQ ID NO: 84563 - DNA, 384 bp, Glycine max
  Peptide Sequence Number=SeqID_201341
atggctctacatttgtatatatctttacagttaaatagaaggtataaacaaggattgcctttagaaggccaagcagctgtgagatcttctgctattgaaatagaacaagaaaagaagtcaaagtctgtttataatacaacagcaaaagctgaacagttaagagaatgtctgaggaatctcaagcgtaaccatcagggtgaggatgccagagtcagaagggcctttcaaacaattttagtctatgttggaaatgttgccaagaatcccaaggaggacaagtacaggaaaattcgactgaataacccattattccagccaaaaaggaaacatgttttgaaagttttaatcagtagtgcaaaaattgagagctaccaaaacttataa

SEQ ID NO: 84564 - DNA, 1554 bp, Glycine max
  Peptide Sequence Number=SeqID_201342
atggattctgttctccccgatacttccactaatgccattgcctcttctacacccacttcacaccctcattcccaaccctcactcccacaaaccctcttagtccccaaacccgaacccttctgggatacccacatcgaaacctccgacgaactcgacctctactccgagttcaatcgcgtcactgagctctttcacttcgccttcggagccaccaacgttgtcgaccctttcggagccaccaatgttgcatgccccgaacagactccgctggttcctgttcctcaggagctcgattcagcggcccagcccgacccgaattcgccctccgaggacgtcttgcgagcgatcgttccggtaccgccggagcagcaggacggcgcggtggccaccgccaccgtgccgaggcggaagcagagccggcagaaggagctgggacgaggctcatttgcgcgagaccgtgaggaggacaaggctcatatacgactcgctgcgagtgttgacctccgtggaggaggagaagcgagtcgcctcagtggcagcggcggcggtggcagcagcagcagcagtgacaacactagagggctgtctgccggtggatggctccaccggcaagttgcggcgtctccggggagacctgcgggctgccagcctgatgagagagcgtggactgtggctgaacccgctggaatagattttcttcctgcaagcatgagttccactggagaacctattgctaccagtgtcattgtttctggtggctatgaggatgacatggatgatggtgaggttatagtttacactggccatggagggcaggagaagaattcctccaggcagatctctcatcagaagttggagtcagggaaccttgcattggagaggagtatgcattatggtgttgaggtaagggttatccgtgggatgaagtatgaggggagtgctgctgggtctggtaaggtgtatgtgtatgatggggtgtataggattgttgattgctggtttgatgtggggaggtcgggttttggggtttataagtttaagctttggaggattgaggggcaggctaagatgggtagtgctattttgaaggaagctaggaatgttaggaggagtgagctggatttgaatcccacatctgctgatatggctaacaggaaggagaatgttgcagttcggctttttaatgactttgatgatgatcggggtcctctttgctatgaatatcttgtgaggacttgttttccgaagtttgtgtttcatcagagtgggaaagctactggctgtgactgtgtggatggttgtggtgatggatgcttttgtgctatgaaaaatgggggtgagtttccttacactctgcaggggcatcttgtgagagggaagcctttgatttttgaatgtggcccattttgctcctgtcctcctcattgtcgcaatcgtgttgcgcagaaggggctgaaatataggttggaagtgtttaggtctaagcagacatcttggggagtaaggggttgttttgaccagggagcaagctcaactcttaacaatgaatggtga

SEQ ID NO: 84565 - DNA, 248 bp, Glycine max
  Peptide Sequence Number=SeqID_201343
atggctagctttggttgtgtgactctcccaagtgtttgtcatagattagtcaaaggactagtgcgcaaccagcttgtgtggggtaccaagactgcagaacatgagaacccacgacagagacctatgttctctgagttttctacttctctctcgtgtgctgcttcacaacctctccctccaatggtgacttatacgccagcagcaacttcactggtgaccttgttcggctctgacaactgccatctccg

SEQ ID NO: 84566 - DNA, 540 bp, Glycine max
  Peptide Sequence Number=SeqID_201344
atgaacaaagaacaattgatgtatattaatatcatgtttgaagaagttgatatgaatgttaaaaataaggaagatgttgacgtgaaagtagaacatgtcgattgctctgatgcctgtaagacaccaatactagtgaaaggagtagtgagtataaataagtctaagaaaaatgatttcgtaagaacatgcattggcagtagaaaatgtggatgcacgtttaagttgcgtacgaagtcagttttgggaggagaaagatggatggtgaagttaatttgtggggttcacaatcacgaaatagcaaagacattagttggacatccatatgcgggtcgactcacaaaggatgagaagattgttgttgctgatatgacgaagtccatggtaaagccaagaaatattctcttgacattgaaggagcacaatgtcaacaattatacaataatcaaacaaatttacaatgtcagacatgcttactattctcccataagaggaagtaacaccgaaatgcaacaactcatgatgttgcttgatggagattaa

SEQ ID NO: 84567 - DNA, 714 bp, Glycine max
  Peptide Sequence Number=SeqID_201345
atgagtgatgcaaaagagataaagactcttatgcatcccaccgcacatcttggattggacgaggaatcaacgaagatgggcaggtctcaatatagagcaatgattggctccctgctctatcatactacatttaggcttgatataatgtttattgtttgcttacatgcaaaattacaaaaggaaccaagggaatttcatttaactgtagttaaacgcatattcagatatttacttggaactcctaaccttggtcttatgtttaaaagaagagaaagttctaggctcacgagctattgcaatacggactatgttggtgataaagtcgacaaaaaaagtacaagtggaagctatcactttataggtggcaacatagccacttggatatgcaagaggcagagatcaactgcattgtccattgttgaagcggaatacatgtcaacagcaaactattgtgctcaactcctatggataaataaccaacttgaagactatagtgttgcctttacagctctatcatcatatgcaattgttcatttgtttccttcacaatggactccttcagtgcaactaactattgttaagatgcctccctattggctagcacttggaactcagcaacgagttggaccttccactgaggtgaccccctctcaatcttggcatagtataaagaagttgaaggacaagaagaactcccaaggcagtatctcttag

SEQ ID NO: 84568 - DNA, 558 bp, Glycine max
  Peptide Sequence Number=SeqID_201346
atgacctcacaagttgtcctacacaacaatttcgaaaccaaaccctccgccaccgtcaccaccatcgtcgagtccccatccgtcgcgccgccatcgctcgccgtcgcgaagagaccttccaccaaggaccgccacaccaaggtcaacggccgcggccgccgcgtccgcatgccgccgctctgcgccgcgcgcattttccagctcacgcgcgagctcggccaccgatccgacggcgagaccatcgagtggctcctccgccatgccgagacctccattatagccgctaccggctccggcaccgtccccgccgcccccgtctcctccgttgggccctccgctccctcctccgagcccatggtcgcctgccccgtcacggcggtcggcgctcagggaatgttcgccgtgccgccgcagccgagttgccggctcgacctttccccgccgcctgggatggagttcgcggtgaacggttaccggcacatgccgttcactgcgcttctgttgcagccggcgacggcggacgaaaatcagaacgacgagtctctcggcgaacaatga

SEQ ID NO: 84569 - DNA, 387 bp, Glycine max
  Peptide Sequence Number=SeqID_201347
atgactggtatcgtaaaatggttcaacgctgacaaaggtttcggcttcatcactcctgacgatggctctaaagacgtgttcgtacacttctctgctatccagaacgatggctacaaatccctggacgaaggtcagaaagtttccttcaccatcgaaagcggcgctaaaggcccggcagctggcaacgtaacttctctgcgccatcagcagatggcgcctgttgtcattcagaggacggtaaaatgccagcccgtttccctccactccagacaatgggtcagcttcagaccctgtaaaaatgcctcgtcatgcgataccaccagcatcgcgccgggaaacgtcgccagcgcgctttcaattgcctgggtcgacgccagatcgaggtga

SEQ ID NO: 84570 - DNA, 204 bp, Glycine max
  Peptide Sequence Number=SeqID_201348
atggtactgcttcctaggccttggctcagtgctcatgccaacacagaagcatggctacacaacggcgaagaatgtagaatttcgctcgctgcttcttcaccagttggctgcacttctgaccaaaagacttgcagggatcacaattttgatgctgctgctgctgatgattgctttggcttgtgttgctttcctgcactgccatga

SEQ ID NO: 84571 - DNA, 465 bp, Glycine max
  Peptide Sequence Number=SeqID_201349
atggtgtatttcaaaatagccggcggtgaaatagtgccggagatacaaatgacgttatccgccaccgtttatgatctgaagcaaaagatcaggaatgagttggacgtggaagtacacaggcaaagcctctggcaccacaacagaatgctgagagaccatgaatacatcgagaactgcgattttcaggtgagggaaacactgtatctcagtgttgatccgctgccacctcaccagaacatccatgttttggtgaagtctttgggcagtgatgggtatgtgagggtgagagagaccgataaggtgagcgacctgcgcaacttggttgagaggtattggggcactccttcgaaccgtgtcacacttaggcgtcacaatgttgtcatggaggattgtcttcctctttatgcttattatgtcaatgagggttctgaggttcaactctctatttcaattgaacctcgttaa

SEQ ID NO: 84572 - DNA, 363 bp, Glycine max
  Peptide Sequence Number=SeqID_201350
atggtgcttttcaaaatagatggtggaaaacgagtgcctgagatagaaatgtcgttattagacaccattcttgatctgaaacagaagattcaggagttggatgtagaagtttacaggcaaaggctctggcataaagacagaatgttgagagacaatgagttaattcatgaccaagccttctgcgcaagtaaaacacttcatctcactgtcaccccgctatcacctcaacacacactcagtgtcaaggtgaagtttgtgggcagtgatgggtatgtggaggtgaaagaaacagataaggtgagggatttgtgcagcaaagttgagagacaatggggcattccttcagagctcatccccctttaa

SEQ ID NO: 84573 - DNA, 276 bp, Glycine max
  Peptide Sequence Number=SeqID_201351
atggttctgtccagtggtgtggatagtgctgctagccctcgctttgtggcgccgagccctgattcgagagagcgtgttgcgagtcccacatcgggtgggcacccccttatgaataattttttaagggaacctttcggatgtctggttggttcttttttttctctcatggccatggctgccattgatgattctaaccccttcattcttcattcttctgacaatcttggcattgccttagtttctcatcctttcatcgtgttctcggcaaaggcttag

SEQ ID NO: 84574 - DNA, 387 bp, Glycine max
  Peptide Sequence Number=SeqID_201352
atggatgacgacacgtggttatcaagtcaggggaccaaattgtcatggaaatgtttgcctttaaacctcataagcttaccattcattgttgcagagaaggccaaggtcgttcattcttcctgtgttctacaaagctattggcaaatggtgatgatgtctttgcaaacaatcagctattggtcgtgtgaagacgagagacaacgatggattaggaaaaaattagtcaaaattgtgcattctttgtttgatgttccacttgattattttgtcttaatgttgaagaaggatatatgttgggaaaataatgaagatgttggggaggatgatgatgttgaagaagaaggtgatgaatcttctatgatggtgatgatgatagcacttaagtaa

SEQ ID NO: 84575 - DNA, 2436 bp, Glycine max
  Peptide Sequence Number=SeqID_201353
atggccaaccaacccgagtcctctgatgctaagggaacgaagagagactttagcacggcgatcctggaacgcaagaaggcgccaaaccggcttgtcgtcgacgaggctgtgaatgatgacaattccgtcgtggtgcttcatcccgacactatggagaaactccagctcttccgtggtgacactattctgctcaagggaaagaaaaggaaggatacaatttgtatcgcgcttgcggatgagacttgtgaggagccgaagataaggatgaacaagattgtgaggaacaaccttagagttagacttggagatgttgtctccgttcaccagtgcgcggatgttaagtacggaaaacgtgtgcacattcttcccgtggatgataccattgaaggggttactgggaatctctttgatgcttacttgaaaccttatttccttgaggcatataggccagtgaggaagggtgatatgttccttgtgagaggggggatgagaagtgtggagttcaaggttattgaaactgatcctgctgagtactgtgttgttgctccagacactgagatcttctgtgagggagagcctgttaaaagggaagatgagaatcggttagatgaggttggttatgatgatgttggtggtgttagaaagcagatggcgcagattagggaactggtggaactgccattgaggcatccacaattgttcaaatctattggtgttaagccaccaaaaggaattcttctatatggaccacctgggtctggtaagactttaattgctcgggctgttgcaaatgaaaccggtgccttctttttctgcattaacggccctgagatcatgtcaaaattggctggtgagagtgaaagcaatctcaggaaggcatttgaggaagctgaaaagaatgcaccctctattatcttcattgatgagatagattcaatagctccaaagcgtgagaagactcatggggaggttgagaggagaattgtttcccagctcttgaccctcatggatgggcttaaatcccgtgcacatgtaattgttattggagccacgaatcgtcccaatagcattgaccctgctcttaggaggtttggaagatttgatcgggagatagatattggtgttccagatgaagttgggcgtctagaggttcttcgtatccatacaaaaaatatgaagctcgctgaagatgttgatttggaaaggattgccaaggacacccatggatatgttggtgctgatttggctgctttgtgtactgaagctgctcttcagtgcatccgagagaaaatggatgtcattgacttggaagatgagaccattgatgctgagatactgaactcaatggcagtgacaaatgagcatttccagactgcccttggaacaagcaatccttctgctctccgagaaacagttgttgaagtgcccaatgtcagctgggaagatattggtggtcttgaaaatgtgaagagagaactccaagagactgttcaatatccagtggagcaccctgaaaaatttgagaagtttggaatgtcaccttccaagggggttcttttctatggtcctcctggttgtggtaaaacccttttggcgaaagctattgccaatgaatgtcaggcaaatttcatcagtgtcaaaggtcccgagctactcacaatgtggtttggagaaagtgaggcaaatgtgagggagatttttgacaaagctcgtggttctgctccatgtgtcctattctttgacgaacttgactctattgcaactcagagaggcagcagtgtaggagatgctggtggtgctgctgacagggttttgaatcaattgcttacagagatggatgggatgtcagcaaagaaaactgtgttcatcattggggccactaatcgaccagacattatagatcccgcacttctgcgaccaggtcgtctggaccaattgatttatatcccactcccagatgaggattcccgtcatcagatatttaaagcttgcttgagaaaatctcctgtctcaaaagatgttgaccttagagctcttgccaagtatactcaagggttcagtggtgcagatattactgaaatttgccagcgtgcatgcaagtatgctataagagagaacattgagaaggacattgagagagaaaggaggaaaagagataaccctgaggccatggaagaggatattgaagaggaagaggtagctgaaatcaaggcagcacattttgaagaatcaatgaagtatgcacgaaggagtgtaagtgatgctgacattcgcaagtaccaggcttttgcacaaacattgcagcagtcgagagggtttggatctgacttcacttttgcaaataccagctctggtggtggtggtgctgccactggcactgcatccgacccttttgcaagtgctggtggagctgatgaagatgatctttacagttag

SEQ ID NO: 84576 - DNA, 183 bp, Glycine max
  Peptide Sequence Number=SeqID_201354
atggtgcatattaatgattggagatggttaaagactgacaaggattctttaaattttaataaggacagatttgagaatatttttggtccgaagcatttgttggaagctagaatcaaaggtaatagcaattggacctttattcaaagtaacttcattattgagagactgagagaggtacattag

SEQ ID NO: 84577 - DNA, 294 bp, Glycine max
  Peptide Sequence Number=SeqID_201355
atgttgtcaccaccattgccatcaactgtcactgtcgctgcctccatgttcatcatcgtcaccactaccaccaccgacgatgacgacagtggtggtggcagcaacgacaacgacaacgacgacagtcatgatggtggaggtggtgatagtcgtggtgatgacaataatgacgatgacgacagtcatgttggcgaaggtgatgacaatcatggtgatgatgatagatgggcgaagaaagaaacttttgttggagttggtaatgggttatttggttggagagaagggaaaagataa

SEQ ID NO: 84578 - DNA, 144 bp, Glycine max
  Peptide Sequence Number=SeqID_201356
atgtcgaccacaaagatgatcgaggtgcaccgtgtgaaagagttctttcttttcattcggatacgagtaataggagctaaaaaggtgggaagtgaagcggttgtagctggtgtgaatgtgactactactcacgtaataaattaa

SEQ ID NO: 84579 - DNA, 207 bp, Glycine max
  Peptide Sequence Number=SeqID_201357
atgactgtcactacctctgtcggcatgaccattgctattgtcatcaccatcactgtcatgaccgtcatcgttgtcattactgtcgctgccaccaccgccaataacaatggtgacaacaacaatcatggggacaacgatgtcatggtggtggcaacgacggtgacgaaggtcatgacagcaaaggtgacctcaaatgtcattacatga

SEQ ID NO: 84580 - DNA, 588 bp, Glycine max
  Peptide Sequence Number=SeqID_201358
atgaattggttaagttgggaaaggttgttgataccaaaggagaaacgaggcatggggttcagggatttaagagggtttaatatagccctccttggtaaaaagtattgtatacgcacctcaaaggctcttgtgaaaggagcccactggagagtagggaaaggaactcgtattcagggagtcttcaacgagagggatgctagggccatttatagtattcttgtggaggttacaagtgatgaagacatgatcatttggagcttctcaaaggatggaagattcacagagaaaattatgggctttaaaggtatcccactaaaagaaaaattggatgagttaaacattgttctaatgaagcttcatggcattgatgtcaaaatagaagatgaagatttagaaataattctgttagcctctcttaagaagaagaagaagaataagaagaagaaggaggaggaggaggaggaggaggagaaggtagcaagaaaagcaaggttgatccaaaaggcattcaacgactcttcatctaaaaacaatttggttttggtgaaaaactatagcaacattctcaacaatgggtattggacttag

SEQ ID NO: 84581 - DNA, 255 bp, Glycine max
  Peptide Sequence Number=SeqID_201359
atggcttcaatcaagatagcttttgcagtggtctttcttgctttaatagcttgcaatgggcatggtttcaagaacatacgaagaatgacagctcttggtgaaaatcatgaaactgatgaatgctggaagactggttgttatcataaaggaaagccacaatgtaatgtaaatcgtgattgctggtttgcttgtcctgattattgtgatatcgcgtactgtgatatgagtactcgcaaatgtgtgtgcccttgttag

SEQ ID NO: 84582 - DNA, 296 bp, Glycine max
  Peptide Sequence Number=SeqID_201360
tcctggttgagtttagtccaacaagaggaatctacggacgatgcttgatcaggattaggctaaactatcatgatgaatcgggatctcccataagcaatttagttcctctggacttagaaattgaagctacatcaggaaggaacaaggccaagaggagaaggaaacttctgcaagttagaacagttgcatccatacttgaggaggagactcatttctctgacttattatcacctgattcaccatcatcaagggaatccgaaactcaattacctgaagtcattaccatggcagaatag

SEQ ID NO: 84583 - DNA, 165 bp, Glycine max
  Peptide Sequence Number=SeqID_201361
atgggtgagttttgggaactcgtgctcagatctttgtttgtttctattgcaaggatttggtttgtgaaactcgtgctcgcttctgtttggggtgctcactcgtgctcgcagggtctcattttgagtgaggtcattcagattgctaggtgtcctttgaatgcttaa

SEQ ID NO: 84584 - DNA, 123 bp, Glycine max
  Peptide Sequence Number=SeqID_201362
atggaaatctcacaggtgtcaaatgcacaagatttgggttctgctcaagagggtgtgcacttcctcaaggtttccaacaagttttttttacctatgcaagacctccaacaaaaatggacataa

SEQ ID NO: 84585 - DNA, 237 bp, Glycine max
  Peptide Sequence Number=SeqID_201363
atggagagtctgagaaacttttaccttagcttaagtgggttcatgggattaatccctcatcaactaggaaacctctcaaacctgcaacaccttaatcttggatacaattatgctcttcagatagataaccttaattggatatcaaggctatcttccttagagtaccttgatttgagtggttcagaccttcataaacaaggaccaccaaaaggaaaaaccaacttcacacatctctaa

SEQ ID NO: 84586 - DNA, 186 bp, Glycine max
  Peptide Sequence Number=SeqID_201364
atggaagaaaagagtgaaggttgcaatcattactctactgatggtggcggtgtaactagggttgtaggctgcaaaaaagttattggcagctccttatttattgtgggagagattggaggcaatgattatggctatcctttgtctgaaagaaaaagtgggacaagtgataagaaaagaattgattga

SEQ ID NO: 84587 - DNA, 687 bp, Glycine max
  Peptide Sequence Number=SeqID_201365
atgtcgatcctgcgaccgggaaggccgacggtccccacagaaagaactgaatttgatgtccctgaagcatctgatttgaggacacaaaagaaaatacttcagactgtgggggagcggtggagacaattcaagtatgatttgacgtcgaaatgggcacttgcagttgacaaggaaagtgtcgacgacactgtatgcgagaagtatgacattagcaaggagaagtgggcccaattttgtcagacccacaaagaccctttgtgggaggcacaagccatccagaagaaaaacactgcccctcacgtgttgtcttatgggggttatcaatatttagaaaacaagttgatggatgagaagagaaagaaaaaattggaggaagttgctcaatctggaatcactgacaccatgattgatccttcatctcccatcagacgacatgtgaaatggaagatggcccgcaccaagaaaattgggcaaatgatgtctgaggcagcaaaggaaattgctgacaagattggttcctttgctgcccatggacgtcaggatatactaactgttgccatttggcgactagaacaccctggtcgtatgcgtgctactggagccggtgtcatgatcaagcaatactttgaaccgtctccaaggaccccccacacgtcttcctccatggctcccaaagacctagagtag

SEQ ID NO: 84588 - DNA, 396 bp, Glycine max
  Peptide Sequence Number=SeqID_201366
atggaaaatgaaaaaggactgaaaaatgttcgtgtgactttaaacaaaatcaccaagtacaagaatctaatgaaagacccttccactaactttgtttttgtgtccaaaggcaagaacaaagagagatttggtacatgccccttgttgctggaacacagacttctagcttatgtgctcacttggatcatcactctcagggggagtaatcatgttcaattgacagaaaaataccatattctcatcaaccttatgccgggacagatgaagatagattcggtcaacgttgttgtggacaacatgctaaagaccaagaggattgagccagattttgaagtgaaggctaaggttttcaagaagataagctacattgaagctgaagaagaaggaagaggttag

SEQ ID NO: 84589 - DNA, 354 bp, Glycine max
  Peptide Sequence Number=SeqID_201367
atgatgttagcttgtagacaaagaggaaaaggaaaatttgttgaagctagtggtaggggagttcaagcaactatgaatcaattatggaaaaaagatgacaaagaaaaagttgatgagcaatgtttcgaatttttgtacaaaagtgccattccattcaatgttataagaaatccagcttttgcaaaattctgtgagatggttgggagatatggggttggctataaatctctctcttatcatgatattagagacaagcttttgaaaagagtagtagatttgaagactctgtcacttggccacggtcatggtacaattaacacgatcgtgttattccacaatgtcccagtgtcataa

SEQ ID NO: 84590 - DNA, 450 bp, Glycine max
  Peptide Sequence Number=SeqID_201368
atgggtttcatatatgagatgcctagtgcaaaagaaaagataaaatgcaactttaataacgttaagaaaagctataagcctatttggaaaattattgatgagagagggcttttctctgtggaagatgcaaaggactctaggaaggctatgcaacctagagaatggtgggagatgtttgggaatggaactccatggttgaagaggtttgttatccgtgttttgagcttgaattatagctcttctaggtgtgagcaggaatataaggttgagcttgagcatcctcaaggtgaagatgatggtggcattgacaatgctgaatttgtgggaaatgttggaggaagttcaagtgatcaaactctaaatgctttggatttagataatttagttttgtttgaacctgatgttgatgatgctgaggaatgtagaagcaaatatgatatgaagttttga

SEQ ID NO: 84591 - DNA, 1107 bp, Glycine max
  Peptide Sequence Number=SeqID_201369
atgattccaaaatccatatgtcgtaaattcagagtgcggttccattatggccatccagatgtgtttgatagacttttccacctgacaagagggggggttacaactctacattacgtgaaggcaatgtcactcatcacgagtacatacaagtgggtaaaggaagggatgtgggtcttaaccagatatcaatgtttgaagcaaaaatcgctgctgggaatgataactgtcctcacagtttatgtattcctttatggacgcctctatcttgcccttagtggactcgaagaaggtttgaaccaaaaaagagctattcgagacaacaaagctcttcaagtagctcttgcttctcagtcagttgtgcaaattggatttttgttagccttgcctatgttgatggaaattggcttggagaggggatttcgtgaggctttaagtgaatttgtactaatgcaactacagttggctcctgtatttttcacattttctcttggaacaaaaacacactattatggaaggacattgcttcatggaggtgcagagtacaaaagcactggtcgcggttttgttgtgtttcatgccaaatttgctgataactataggctttattcccgcagccattttgttaaagggattgaattgatgattctgcttgtggtctaccatatatttggccatgaatacagaggagtgcttgcctatattttaattaccgtaacaatgtggttcatggtagggacatggctttttgctcccttccttttcaatccatcaggttttgagtggcagaagatagttgatgactacacagattggcaaaaatggataagcaaccgtggaggcattggtgtatctcctgaaaaaagttgggaatcctggtgggaaaaggaacatgagcatctccggcactccggaaagcgtggtatcgctactgagataatattatccctccgctttttcatttatcaatatggccttgtttatcacctttcaatcactgataagactcaaagtgttttggtttatggtctttcttggatgataatctttgtaatattgggtttaatgaagggaatgctgctgagtgctcactgcctccacatgcaatag

SEQ ID NO: 84592 - DNA, 1014 bp, Glycine max
  Peptide Sequence Number=SeqID_201370
atgagagagagtgaaggtgagactgagagagagagagggagtgggagagagagagagagagagggagtgagtgagtggatcaccgtgagaaacaggaggggaggcaaaccaagaagagaacatctgagtgatagagaggatcccaggcaactctacagaggaaacgggctcggacaacatgctaattaccaacatcaaaattggaggaacagaacggacattacctcttactatttcacgaggttccctgatgatgcctcagagaaggacctttggacccttttcaaactatggggggacgtcaaggaagtcttcatatctaagcagagaaatatgagaggtcggaggtatgggtttgtgaggttcaagggagtgtctgacaagaacagattggaaaagcagcttgatagcatcattttcggcggcctgaagatgtatgtcaacttaccaaggtacgggagagcaaaagcaatacctcgtaatcgtacacctgataacggtaggcaagggcaacaacagaaacagaaaggtggagcagcagtagccccaagttcgacactacgcaatgacgcatccaacaggacatatgcagagatagtggctacaaacaaacagaaggaaggacaccgaaggtactccagctctgaacatggcggtcaaggaagatcacactctacggtcaccctcaatattccacaaggtcccaaaaggtggtatacggacgcttgggtgggaaggttaaaaaagatagatacgttcgaaagagctgaagacgaaatcacctggacgttaggatctgacgtaacgcctaagtatttaggagacgatatggtcatcctactcggactcatggacatgaaggcagaagagttagttaacgaagaagctgataagggcacgtcgttgttttattccctggagaagtggaagccagagatgaaaccgggagttaggctggtgtggattcaatgttggggcttaccgttagatgcatgggatatccagtacctttga

SEQ ID NO: 84593 - DNA, 1632 bp, Glycine max
  Peptide Sequence Number=SeqID_201371
atgcaggaaatgtttatcgtcaatgtatatgctccgtgtgacatagatggcaagcgagctctgtgggactctatcaggcagttgaaaaaccctcagaatgagggcttgtggtgtgttttgggagacttcaacagtatcaggcatccatctgagagggtaagcttgtcccaaaggaagggggaccttaacagcatcacagaattcaatgagtggatatctgacctagcggtagaagaagtatcttgcttgggcaggaaacatacttggatcagaccaaatgggaccgcaaagagtaagccggataggttctttgtatctgacgaatgggtatctaaatggcctgacagcactcaatttatcctagatagagatttttctgatcactgccttatcttactgagatctaaaaccattgattggggacccaaaccttttagggtccttgactgttggttgaagaacaagcagttccaaaacatggtcaaggaaacctgggcaaacactcacccaggaggttgggggggattctctttgaaagagaaacttaagatcctgaagcaaaagataaagctttggaacaaagaccacttcggagacatatctgagaagataaaacaaattcagctggagctaaaccacctggaagtgagcagcaatatcagccttttatctcctgacacagcggcagcacgtaaaaaattacaggaggacctgtggacagcggcccaagcccatgagtccttgcttagacaaaaggcaaggacaaagtggatcaaggagggggactgtaattcaaaatacttccacaggctcataaattataaccgcagggtcaacgcagtaaaaggagtgcagattggagggtcatgggtcgaggagccaactagagtaaaagaagaagtccgcaatttattccaaaacagattcaatgagcctgattatgatagaccagaaattaacggggcatatttccgaagtatcggacatcaacaaaacgaaatactggttggccgcttccatgaggaggaaattaaggcagctgtatggcagtgcgggagtgataagagtccaggacccgacggcttgaactttaagtctattaagcaattttgggagcttcttaaacctgacatctccagattccttgacgagttccatgtcaatggagtttttccgaagggtggaaatgcttcttttatcacccttatccccaaggttaagcatccccagtctctcaatgatatcaggcctatttctcttattgggtgtatctacaagattgtggcgaaaattttggcaaacagattgaaaacagtgctgccggatttaattgatgagaggcaaactgcatttttgaagggcaggcatctgctgcatggtgtgctgattgctaatgaagttttggaggaggcaaaaagggtacccggcaaagtagtagacaagttagtcaagattcagcgtaatttcctttggggtggaggtgtggagcaaaggaggatcgcatgggtaaagtggggcacagtttgtttacctaaggagagaggagtggagatgggagatgttccatcagaatggacagctgtggaccagaatcttgaactcaaagtatgggggatggagaaatttagatga

SEQ ID NO: 84594 - DNA, 744 bp, Glycine max
  Peptide Sequence Number=SeqID_201372
atgatgtatatccgacaagcattggagctacaggcttttcttgatatggcaaaggatgaagaattaatgaaaggttacaaggctgcagaactagagagcaaggaaagtacaaccggtgagcggtcgttgtggactcaatgtcaatcattagctgacatgaagttcacttatgtagtttcatgtcaacaatatagtattcataagcgatctggtgatcccagggcaaaagaaattttaaagcttatgattaagtacccatctcttcgagttgcttacattgatgaggttgaagagcatagcaaaggctcatcccgaaaaacagataaggtttattattcagctctagtgaaagctgcattaccagcaaaatcaaatgattcatctgaagcagttcagagtttagaccaggtaatttacaagataaagcttccaggacctgcaatattgggtgaggggaagccagaaaatcaaaaccatgccataattttcacacgtggggaaggcttgcaaacaattgatatgaatcaggataattatatggaagaagctttcaaaatgaggaatttgctgcaagaatttctcaaacaacatgatggtccaagaatgccgacaatacttggactcagagagcatatatttactggcagtgtttcatcccttgcgtggtttatgtctaatcaggagcatagttttgtgacaattggacaaagattgttggcttaccccttgaaaatactaacctga

SEQ ID NO: 84595 - DNA, 750 bp, Glycine max
  Peptide Sequence Number=SeqID_201373
atggatctcatgcttgtaccatattcggccgaccgttctttgaacctcatccagtggccacctttcttacttgctagcaagatcccaatagcagtgtccatggccgaagacagtttagggaaaggacaagaactggagaaaagattgtcaagagacaagtacatgaaatctgctgttgaggaatgctatgcttcttttaaaagtattattaacttcttggttcttggagagcgtgagacaatggttatacagaatatttttcaaagagttgatgtgcacatagaaaacaaagctgtgctgaatgaattgaatctgagtgctgtccccagtctatatgaacgatttgtcaaactgattgaacgtttgttggagaacaaagaggaggacaaggattcaattgtgattctcttgcttgacatgctagagattgtgaccagagacataatggatggagacattgagggtttgctagactcaagccatggtgggtcttatgggaaagatgaaaggttcacaccccttgaaaaacaatatacattttttggcaaacttcaatttcctgtcaaaacagatattgatgcttggacagagaaaataaaaaggcttcatttacttcttactgtcaaggagtcggctatggatgttccatccaacttggatgctaggaggcgtatttctttcttctctaattcattgtttatggatatgccacctgctcccaaagttcggaatatgatgtccttctcgtaa

SEQ ID NO: 84596 - DNA, 1233 bp, Glycine max
  Peptide Sequence Number=SeqID_201374
atggcatttgagttgtatgggatgttagctgggaatgttagtccactgactggtgaacctgtaaagcctgcctatggtggtgataatgaggcttttcttatgaaagtagtaaaaccaatatatgatgtaatagccaaggaagctgagagaagtaatatgggaaaagcaaagcattctcactggagaaattatgatgatttaaatgaatatttttggtcagttgattgttttcggctaggttggcctatgcgtgttgactctgatttcttctctgttccttttcctcaacagcaacatcaagttaacaaacacgaggaaaacagaggtcctgcttcagaccggtggagtgggaaaactaattttgttgaaatacgcacattttggcatatatttagaagttttgatagaatgtggagcttttatatactctgtttacaggcgatgataatcattgcttggaatggttctggaaaattaagctcaatatttgatggtgatattttcaagcaagttctcagcatcttcataactgctgcaatattgaagcttgcacaagccattctggacgtattccttagttggaaagcaaggaaagtcatgtcgcttcatgtccagctgcggtatatatttaaggcaattttagctgcagcttgggtcataattttaccagttacttatgcttacacttggaaaaatccatctggctttgcacaaaccataaagaattggtttggcaatggtacaggttccccttctttgttcattttggctgtcttcatctacttatctccaaatatactctctgcactgttatttgtgttcccattcattcgccagtttcttgagaggtctaataatggtgttgtgaagctcatgatgtggtggtctcagcctcgactctttgttggaagaggaatgcaggagggtccaatttccttgttgaagtacacttgtttctgggttatgctaattctatctaaattagcattcagctactacctggagattaagcctcttgtggctccaacaaaagccatcatgaatgctcgtgtatcagtttacagatggcatgagttcttccctcatgccagaaacaatattggtgtagtgattgcaatatggtcccctatcatacttatttggtatgccatcttctctacaatagtaggaggcatatatggtgcatttcgacgtttgggagagattattaggattgacagtttccatatttag

SEQ ID NO: 84597 - DNA, 777 bp, Glycine max
  Peptide Sequence Number=SeqID_201375
atgtctgcagcggcgcgtttgggtagaagagtaggcacaacagcaaaggaagaactgagaagaaacaaaggagcatggcgcgatcctcttccggccgccgcttctcgcgcaatcgcggagagaatcccgttggcggatctcgttgtccaagtcagagacgcaaggattcctttgtcctctgaatgtgagatactcagaaactaccctccttccctgaaacaaatcgtagcgctcaacaaaatggacctcgtgggcacatcgaatgtgaaggcatggatgggatattttagggaaaggaactgcatatcttgtggggtcaatgctcataacaaggagaacatcaaacagcttcttagccttatacaacgccgggtgagtgaattgaagggagctgatcaatgtgacaataattataccgctacagtcatgttagttgggattccaaatgttggaaagtcggcacttgtcaatgctttgcatcaagtggggagaatcagtgcagcagaaaaaggaaagttaaagcatgcaactgtgagtccagagccaggggagactaaagacatacgaagttttaagattggtagccatcccaatatctatgtgttagacactccagctattttatctcccaaggttcctaatgttgatattttatctaaattaattttaacaggtggcagtttaagtatcttgcatcaatcatataatgaggaggaaatagagggtgatgtaaatcataagattcaaacaaggtggatgagatggaagaatgcttaa

SEQ ID NO: 84598 - DNA, 300 bp, Glycine max
  Peptide Sequence Number=SeqID_201376
atgacagtgagaagaagccatttccttattccactagcagaagatttattagatgaattggagcatgctagtgttttcaagcttaagatcttaaacagggataccaccagattcagatcagaacagaagacacagtcaattgttttctattctgtgacaccccgagacacaaatcttaaactaaagccacgttataatggaccaaatgctccaacaaacaacaaaaaggacaaagaatccagccagaatagtaaggagaggaggtccttgagcagcattgctagtttcatttacatctga

SEQ ID NO: 84599 - DNA, 1353 bp, Glycine max
  Peptide Sequence Number=SeqID_201377
atggcattcttcagaagcgtttctgcactttctcgacttcgctctcgcgtgggccaacaatctaatctggcgaattcagttagatggctccaaactccgagctccagtaacactgtattctcttgctctacccttaacggtgtttctattactgttattgtgatggagtttggaattggatattgtagtttggatctttattctgagttgaaggaactggttccagagtatcaggaacgtgttaagaagctgaagaaagatcatggaagtgttgaattaggaaaaatcactgttgatatggtacttggtggaatgagaggaatgacagctttagtatggctaggctcagctgttgacccggatgagggaattcgctttaggggcatgtcaattcctgaatgccagaaaaagcttccaggtgcttttcctggtggggagcctttgcctgaggctgtactgtggcttctattgacaggaaagataccaagcaaagcacaagttgactcattatcccaggaattgcgaagtcgtgcaactatcccagattatgcttataaggcaattgatgcattgcctgtttctgctcatccaatgactcaattcacaactggtgtcatggcccttcagagtgagtttcagaaggcatatgagggtgggataactaaggcaaggtactgggagccaacttatgaggatacaatgaatttaattgctcgtttgccagccattgctgcttatatttatcgacggaaatataaggatggaaaaatcataccattggacgattctttggattatggcgcaaactatgctcacatgttagggtttgatgatccggaaatgctggagtttatgaggctgtatatttccatccacagtgatcatgaaggtggcaatgttagttcacacacagcacacctagttgctagcccgctatcagatccttatcttgcatttgcggctgctttgaatgggttagctgggcccctgcatggtctggccaatcaggaggttctacgatggatcagatcaatagttgcagaatttggaactcctaacataagtactgaacaattggctgactacattaataaaacattgagtagaggccaggttgtgcctggatatggacatggggttttacgccagacagatccaagatacacatgtcagagggagtttgctttgaagcatttgcctaatgatccatatttccagttggtgtctaagataaaagaggttgtgcctcccattcttaccaagttaggcaaggttaaaaatccatggcctaatgttgatgctcacagtggagtgctactgaactattatggtctaactgaggaaaagtatggg

SEQ ID NO: 84600 - DNA, 105 bp, Glycine max
  Peptide Sequence Number=SeqID_201378
atggaaatggaactagttagggttttggaatcgaaagaagagcttaccgacggtgacaaagttactcaagtttcccaccgtgggaaagtaattttccaccgttag

SEQ ID NO: 84601 - DNA, 291 bp, Glycine max
  Peptide Sequence Number=SeqID_201379
atgaaacagtttacaagcttaaaaagagttcaggatcaccctacagatacagccaagaatttcacaatagatgggcatgcaggtagaatttcatttatcacatcgatgactgagcatttttgtgctggttgcaatagattgcgactactagctgatggaaactttaaagtctgtttatttggtccttcagagattagcttaagagatcccctgagacgtggtgcagaggatgatgaacttagagagataatagcggcagcagtatgcacttcttctgattattattgctaa

SEQ ID NO: 84602 - DNA, 426 bp, Glycine max
  Peptide Sequence Number=SeqID_201380
atgacaaagctaggaattaacaaagattcacatttggtctcaaaaaccaagccaaagatcaggataattcatgtgtatactccagaaatcatcaaaactgatgctgcaaatttcagagagttggttcaaaggctcacaggaaagccaaaagaagaaggaacaggtggaagcaagtccgaaactgcactaaccaaagaaccaatggattcacaccccaagaaggccatgatcatgcaagatgaagaggagtttctgagtctacaaaatgggacaaggctaaagaatgaacataaagaggaggaagttcaagatgatgtgtggaggtcaaagtcaaacgagaagttcagtggtttccttgatgggttctcagaattggatggttttatggaagagttaagtactttgcctgcagggaatcaaaattaa

SEQ ID NO: 84603 - DNA, 201 bp, Glycine max
  Peptide Sequence Number=SeqID_201381
atggtgcatgcaccagagaaaggtggcacgtggtggcatgtcaagctgagaagggtggcgcaaggcggtaggccttgggccaagtggtgtgtgacaatgatgtgtggttcaccggaggatgacggttccgatctagtgatcatgccggagaaaaggcacgatgactgccaaagaagcttcacaatagggacagacacttaa

SEQ ID NO: 84604 - DNA, 351 bp, Glycine max
  Peptide Sequence Number=SeqID_201382
atggctttccaacatttccctcacactcaaagctacccgtctagaggaggctcttcgctatgcgaaggtatgggggagggatattgtacgcagccttacccttgcatatacaaagagactgtttccggattcgaacccatgaccaacaagtcaccaaggcacaactttaccgctgcatatgcaaaatcgacttatatagtgaggattgcttctcattcctcactcatgcatcctatctcgacattatctttaacgaatgagagacttcaacatactctcttttgccaacggttacctgcctcaatgtgggacatcaacacattcctctttgtccacgactacccgccataa

SEQ ID NO: 84605 - DNA, 336 bp, Glycine max
  Peptide Sequence Number=SeqID_201383
atggagagcagcttaggagacatgttggttaaggttgtggtgttcattctagttcaagccttggtttaccttatcctctccaattcatcaaacgtgttcaacaagaacatgaagaaatctaacagcttcaggccggcacgttcggtgagcattcgccggatgctcgctttgatctctgattttcctccagaagaagaaccctctccttcaccgaagggtgctaaaacaacatcacttcatcaaaacaatttcagcttatcgggtggccatattaaggctcagaaacctccaaatgttgcggctgctgtggtggttacaaactgcaatttagactag

SEQ ID NO: 84606 - DNA, 480 bp, Glycine max
  Peptide Sequence Number=SeqID_201384
atgcttcccgagtgtttggctcgttcctcctctgattgcgtcttgctttgtgtcgtcaaaggtggtagccaccgccctgctgtgagcccttttcttatagtctgccacttccctcggatgaatgggaggccatcctcttgtcaaatttgggagttgacaaagtttgatagagtgcaattttggagcaacatctatgatttttcaatcgatgaattaggcatctatccacacttcttttacagcgtgggcggcgtcatgattagaaacagaagagggtcactgctgataattgttcaggggcaattagtctattccttagaccttgagacacagatccttatacaacttccaattgcagaggggggtttatggactctataccctgcttattacgctgagagcctgtttctacttgacaagcttgaagtggtaggacctggtggatcacccgatgggcatgctgatgatgatcaccattga

SEQ ID NO: 84607 - DNA, 431 bp, Glycine max
  Peptide Sequence Number=SeqID_201385
caagccgaatcgccaccttgagtttccccaatctgggcgccgcgattctcgttctcttggatgagcgcgtggcgcgaggcaatgtggttgagcgtggtcctcagcccgtagaaatcctcttccgtcagcaccgtcagcctggcaataatctccctcctgatcttcgtcataacgccggtaattgtttggcttcggcgtggggggtaatttggtctttgcagacggcgcagcgaacgacgccgttggggtcgagggaggagaggagggaggggagcgtcttggaaaacgacgtcgaagagggaggattcggtgtcgttttgggagagggttggggagtccatgagctcgaggaagtgggtgtggcagtgcgggcagaggagaggggagggtgggagcgtcagggacacgctcatgtcgcactcgtggcacca

SEQ ID NO: 84608 - DNA, 708 bp, Glycine max
  Peptide Sequence Number=SeqID_201386
gagagtgggcgagtcacgctttcagggcttttgaatttcaccgatgggttgtggagctgttgcggtgaagagaggattgtggtctttacaaccaaccacagggatagtgtggaccccgcgctcctcaggtgcggccgcatggacgtccatgtcagcctcggcacgtgtgggacacacgcattccgtgagctcgcgcgcaactacctcggagtggactcgcatgtgttgttcgaggcagtggagggatgcatccgcagcggtggctccctcacgcctgcgcacgtgggagagatactgctcaggaacagaggggatgttgacgtggccatgagggaggtcttggcagcgatgcaggggaggatgctagtcgccacagctgccgctgatcagccggaaaatgaggaggcgtcgacggctgccggagttaggtcgccagagagcgtgctgatgatggggtcgccggagaattgggatgtgaagaggaaggaacaacatgggtgtaataatttggataagaaagtcaagtttttcgttagcaaattttattttctggtgttgatcaaggatggcaatctaagggacacagggggcctaggtgtgtcgaatatggcagataattgctacttactgagacaacgaggctttattgctttaaccctaagctatggcagtgatggcacactagatttaaccgttaaatataattaa

SEQ ID NO: 84609 - DNA, 1566 bp, Glycine max
  Peptide Sequence Number=SeqID_201387
atggagatattatcacaaatgtggtctctgttagggttacttaccgttctccagaacgttcttccatcgcagcttctctccttgcttcattctctatacgaatctctgcaagatctactttctccgtattcgtatttcgagattcctgaattcaacggctactgcggcgtcgaactcaacgacctctaccgccatgtgcacctctacctcaacgccgcgaaccacgcccccgccgccgcgtgccgccgattaactctctcctgctcgccgtcgtcgaaccgtatctccttcgccgttgcgccgaaccacaccgtccacgacgccttccgcggccaccgcgtcgggtggacgcaccacgtggagactgcgcaggactcgctcgaggagaggcgcagcttcacgctccgtctcccgaagcgccaccgccacgcgctcctctcgccatacctcgcgcacgtgacctcacgcgccgaggagttcgagcgcgtctcgagagagcggaggctcttcacgaacaacaccaccgcttcgggctccttcgaatcgggttgggtctccgtccccttccgtcacccgtccaccttcgaaaccctagccctcgagccagaactcaagaaacagataaaaaacgacttaacggcgtttgctgacggtaaagagttttataagcgagtgggccgggcctggaagcgtgggtatttactccacggcccaccgggctcgggtaaatcgagcttaatagcggcaatggcgaattttctctgttacgacgtttacgacttggaactaaccaaagtctctgataactccgagttacgctcattactgatccaaacgacgaaccgttcaattatagtgattgaagacattgactgttccgttgacttgacggcggatcgaacggttaagaaaacgcaggctgggaagctgtcgttgaggagtagtaataagaagacgacgacgacgtcgtcgtttacgcgctgtgaggagagtgggcgcgtcacgctttcggggcttttgaatttcaccgatgggttgtggagttgttgcggcgaagagaggattgtggtgtttacgacaaaccacagggatagtgtggaccccgcgctcgtgcgctgtggccgcatggacgtccatgttagccttgccacgtgtggggcccatgcgttccgcgagctcgcgcggaactacctcggcttggagtcgcacgtgctgttccaggcggtggaggggtgcatccgcggcggtggggccctcacgccggcgcaggtgggagagattttgctgcggaatagaggggatgctgacgtcgccatgagggaggtgctggcggcgatgcaggggaggatgttggccgtcgccgccgccgccaatgaccaggcagagaatgaggaggcggttggagttaggtcgccggagagcgtgctgctgatggggtcgccggagaattgggatgcgttcagtgggaagaagaggaaggagcagcatgggtgtaacaatttggataagaaagtcaagtttttcgttaggttaaggtcgttgaccagatctgatcctggtagataa

SEQ ID NO: 84610 - DNA, 237 bp, Glycine max
  Peptide Sequence Number=SeqID_201388
atgaatcacggcgcatgcaaacacccggggtttcttagggaatgggtctatgagattgagatgcatatagatcttaaagtcatgcagatggtggtggtatctgcttataaaatggttgaaattttgagaaagggaacacggaaagagaaaataaaagaaggaggaaaagaaaaagaggcatgtgtatggcacattaaaagccacgaatatggagatggggcaaaaatttcagtgtag

SEQ ID NO: 84611 - DNA, 201 bp, Glycine max
  Peptide Sequence Number=SeqID_201389
atgtgcaatggtggttccgacaaagagcctctgaatgatggaggtggtgataaaaaatgtgtctcctttaaggatacgatgatggctaacaagactcctttggctccacattcaaaagtggatttgatcgagcagaagctagcaatgattgtgtttctagacgacaatccttttaagcctatggttcacatagcggattaa

SEQ ID NO: 84612 - DNA, 771 bp, Glycine max
  Peptide Sequence Number=SeqID_201390
atggagagtttcatggaccaagtgaagttggttctaatggtttctccccttctgcttctgctagttgtgcacttcctttgcaactatggtagtggaggggttttgtcttcactgattcctcttccagagagagagtcactgcacagagcaggtggaactccttggggtgttggcttggttcttgttcttcttctcttcatggatttattcggtttattgagacaggcggttggtaggggagacttctcctgtgtaggggttggaaagaaggatgtaaaagtgtcaatgcttcagtttacgcatgatacttcgatctttgcaaaatcgaatttgaagactgtcatttgcattaaaagcattttgagatggtttgaaattatgtccgggtttaaactcaattttcacaagagtagtctcataggggtgcagcaagtggaggaaggtttggtgaagaggtttgctaatcttttgaattgtaggatctccactcttccctttgaataccttggaattcaggttggagctaatccaaggtctcaattgggggaacctatcattcaaaagatcaagaagaggttatccacttggaagcaaaaacaactcttcttgggagtgaaagtggaggatgttgaattctcaacaaaatttatgttgcaaggtgctgaaatcaaggagagtgtggttgaaaataacttggctggacatgtgggtaaggaatgctatgctgagatgtggaaacgcaaaagaataagtataattccgtctacttga

SEQ ID NO: 84613 - DNA, 567 bp, Glycine max
  Peptide Sequence Number=SeqID_201391
atgggtaccatcgttgaagcagataacacatataccaagatcctaggaagatggccagtcttttattatggcatgggacacatgctcaatgacataactgctgcttgttggttcacatatttattattgttcttgacagatattggactttcaccaaggaatgcagctgttgtgatgctttctggtcaagtggctgatggatttgtcaccatatttgttggtgaactgatagacaggtttggacacttcaagatatggcatggtgctggatctttattggtggcaatttcattttcttctgtttttggtggttgtttaccatgcaaactgtttagttccaattcaggtacttttgaaactttgagttacagcatgtatgcagcaatcttcaatgtgggctgggccgctactcagttatgtgatatctatattgggataagccataattttgttgagaaaagccattcaaatgaaaggatgatgactgtgtcttctttgattgctcttttgaaggtccatggtgagttgcatcacgctgaactctacaagcagagtggcactggctag

SEQ ID NO: 84614 - DNA, 351 bp, Glycine max
  Peptide Sequence Number=SeqID_201392
atgaatgcaaactcaaacaaaggacgaccacgatttcttcattggggtgacgcgacacagatctcaatggggtcgaggtggccgatgtggcacgatggcgaaggaaggtggacgatagatcttgtgagtttaggtggacaacgcagtagcgtagtcatgggtgacagtggagaacaacacatggtcaggggagtgggaagtcatggggtcagaagaatgagtgaaaggagagggggtgagaacaatttggagagtgggcagaagagaaagttggtagtcttaacaaattgggtagtgagaatagttatttctcctcacccttgtcttcaacttgtcatgagaatagtttaa

SEQ ID NO: 84615 - DNA, 612 bp, Glycine max
  Peptide Sequence Number=SeqID_201393
atgcctgcatttgaatttccaatgaagcataacaataatattatggcataccttgctttctttgtcatcaatgacctacaaatggcccaatcagccaaagctttggttcctgctctcatatacatctgcagctttgttgtgtctatagcattacaggagattgcatggactggccgaatgcttaaggcctactactctgctggatgcattctttggattttttgtggtgcagtgatccttcttttaaccacaaatatgagttatgtcatgtacatagtatcggtattcattggcatagcaaatgctctcatgatggtaactggagtaagcatgcagaattttctcattggagagaaccttaatggttgtgcatttgttgttggatcattgagttttttggacaaaatttcatgtgggcttgctttatatgttcttcagtcaaaccaaaatctctctccgcagctccaggcaacaacccaattccccttttcagttacaaggattggtttgggtcttgttcctgcattttgtgcactagttggggtggtagtgacttgcaccatggatttccacaatccttcaaagtctttgacggcaccactattagcctag

SEQ ID NO: 84616 - DNA, 206 bp, Glycine max
  Peptide Sequence Number=SeqID_201394
gtagctttgcagcttcaggtgaagtgggagctaatgacccttcaatccacatccatcatagctcctcaccccatgattttctatttccctggccatatggtaaggtagtagatgggacaggtaagagttatgcttctttcctcctttctaagtcactgaaaagggtactagaagaaggtgtgatagggttgtacttcctaatttga

SEQ ID NO: 84617 - DNA, 297 bp, Glycine max
  Peptide Sequence Number=SeqID_201395
atggaaatacatgtgaagcttcatgccttatcagacctatgttttgaaggaaaagaatccaacttggctgcaatagttagactggcttcatctctggactacacatcatccaaatcaatgcttaagttactcttaacgctagtgcagggtcgcatcgtaatcgattacacaaatatggtaatcgattaccagagagcaactttgccagaaataactgcttgtaatcgattacactattatggtaatcgattaccagtggttattttagccagaaaacaaaaaaagaaggctttctaa

SEQ ID NO: 84618 - DNA, 530 bp, Glycine max
  Peptide Sequence Number=SeqID_201396
atgagggataaggaggttgaggtgaatttgctacaatatgcggatgacaaaatatttgtgggggagttcaaattggagaatgtggttgttgttaaaagcactttgaggtgctttgagcttgtatctagtttgaaagtgaacttccataagggtagatttgggggcattggtgtggatttggaagagatagagagggtgttagactcaaaatacgttgcttctcaaggcttatgtgaggatgagaaagaattagcgaaggagttcaatactttggtcaacactgccaaagtggaaggtgtagggtgtgacacttggcttcggttgatggaaactacacataatttttcagtgaagtctacatactcttctctgcataatctgcggattgggtctcatgagaatggggaaggagctatttcatgtgtgttatgtaatgagaatgatgaagacgctcagttattgaacatttcagtcataactcccagggtcgttatagtccaaaagctagggaaacaagatggtgttcaaag

SEQ ID NO: 84619 - DNA, 144 bp, Glycine max
  Peptide Sequence Number=SeqID_201397
atgagtgagtacaagccaccgtcagagagaacaacccaccacagagagagtgagctgattgaattaccgtatccaaatgcacacttagtgaacaacatcagcaagttgatcatgactccgatcaatttgaataatctggtttga

SEQ ID NO: 84620 - DNA, 141 bp, Glycine max
  Peptide Sequence Number=SeqID_201398
atggcactaactcatgggaggacgtgtcctctcaactaccttctatgggacaaagaagataagaacttatgcacattgtgcaaagcaatccaaagggatcacaatactagtacccaacttggacaacaacaccactgttga

SEQ ID NO: 84621 - DNA, 1623 bp, Glycine max
  Peptide Sequence Number=SeqID_201399
gtgaacgggagatcgtgccgcgcctctcctcaacctcccccattacagagccgcggctactttttaaaactctcggactccctccactccgcctacgtctccgtccccgacgccgacgccgacctcatctgcgccggcaagctccacctcggccagttcgtctacgtcacacgcctcgacgccgcctcccccgtcccccttgtccgcggcctcaacgtgctcccccgccggaggccctgcgtcgggaaccctactgagttggttcccagcgagaggctttgcgtcgccactccgaagaaaaagaagagagaagaggttgttaagaaggagaaggggttggagatgatgaggaggttgagtttggattcttctagaagggtttgggatcagagtccggttgcaaaacggaaaaccgcttctgcgagttcgctttcgaacaatcttaaggccaagaagtctaactctaaccccacttcgcttaacgtgatagacaagaaggttgtttctgtcaaacctgattctccactaaaatctccaacatcaagtgtctcacccttgaagaataaaaacgagaacctgtgtccaaaatcattgacaatcacacctccgaggaagagtactagtactagtactaggtcaccctgtggtggcactgttcatagcccacttgttaaggtccccctcaatttcaagacttggtgttatgatactcctgcatgttgggaagatgtctcactccccatgtgtgatcttggaaagcaagttgtgactcatagaactgttgcctttttagcggctgtgcggtctcttgaagaagcatctgctacagattctgtgatccaatgcatgtgcatgtatgcagaactttgccagtctggtcaaacacattctcctggatcacttgtgaagcagtttttggagcttcacctgagtttgcagagagtaacagtgctgtttgattcgttactcaacccacttcctgaaacaaagtcaagcagccactctaccctacagtgtctaacagaagatgcatgcaaagttcccacccgaaagaatgctatatcttgggtacaagctgccgtaggtaccaatctttccaaattcaatctatttgaaacacaggcgaaaagtgaggttctaaatggtgagaaatgtcattatgttgtcattgagaatactcccgaggacatcaatactgagacttcacctgctcaaaacaagcaaaatcgtgtaactcaagcaaaccacttgccaaattcaactgctaaaagacttccttcttcaaagcggaatctcttggcagcaaagaacaaggatgctgacaaacatgatcgatcaaaagaaatcaaattaaaagaggctgcgagtttggcagaaaaactgcttgaggcatctagcgaatggttcctgaagtacttggaggagtctctgagtaatgagttcgggttgaaaaatgaagggaacactgaaattgcaagtcttcttggacaactcaaacaggtgaatcactggttagataatttggctggtggagataaggttgatcaccgggtagagaagctaaggaaaaatttgtaccggtttctacttgagcatgttaattctgccgttacttctaattag

SEQ ID NO: 84622 - DNA, 519 bp, Glycine max
  Peptide Sequence Number=SeqID_201400
atgatgagaggagaccgtgtgcatgccgatggacctctggcaaggcactgcctgtttccacgcaggcgtctggatagactgacccctgacgtgactattccaccacatcttgctgcgtctttgctctctgatgaagaaattgatgatagatggatgcagtttatgcatggccactgttcgccagatgacttggattggttttacatgatctctcacccattcatgagtctggcgcaactaggggatcctcccagagttctgccagttcaacaatatgacacatttgttgaaccagatgtgtatcagcaaccgatggcgacagtgacacctaatgaggtagacgttgatgtgcatcatgttcgacatgcagtggagaagctactgaacctgaggatcctgactgaaggaacagaagcctatactgttactgaagaatgtctaggcatcgcaagaagctacattggccaaccaactataggtcacaagtcgaggcgtaggtggcatatagacagtcattga

SEQ ID NO: 84623 - DNA, 324 bp, Glycine max
  Peptide Sequence Number=SeqID_201401
atgacaaacaattcttggatgaaatttactaccagcagtcattcacagatacagttattatgcaccattagtagaacaccagatccatatggaatattaaacttacttgaaggcactatgacccctactcatgaggcgcttctatattacaatgggaggtggaacatgccacgccaaaacaactttgtaggttatgccttcacaggaaaaaatccaaaaaaatttgacattccttcaggatgtaccatcgatgaactaaaggatttgataaagcaagttgcacctcaagggattcctcctcatggaattcatgaatcacaaacg

SEQ ID NO: 84624 - DNA, 749 bp, Glycine max
  Peptide Sequence Number=SeqID_201402
atgtcttccagaaaaagaaaaaagcattggtgcaaggcccacaactctatgacacaagaagatttcactccttcgaggcctggaccagatacatagataatgtgctaggaagacatatactagctaagaggaaggtagaaatataccatacggaattggatgagttcaaggctgaattggagaggcgtaacttccataagcgcctcaccaatttagctgacagcaacttcgacctagccttttgtgaaggagtttcatgccaacctttacaatcccgaggggccttcaccaaaacaaacagcctcaacaccttcttggagacacctgtggtactggctgagggagaatccttacccgcttactccagatactgcaggatgcccactaataacagagagattgaggctgctttgcgtatacccagccgaggatttgttttaaatgttgaaagccatcctaggaagatcctcatgaaagatctgacaactcttgctcaggtttggagtgttctctcatactccaacctggctccgacttcccacacctctgatttgactttagatagagctaggttaatctttggtctagtctctcagttggacatgaatgtaggagctctcatctctggccagatcacatctatggctcagtctaactcctctacacttgggttccctgctcttatcacaactctatgtaggtccagaggggttgcttctaacagcctagtcttcgaacgcttgagcccg

SEQ ID NO: 84625 - DNA, 372 bp, Glycine max
  Peptide Sequence Number=SeqID_201403
atgtctcttcttcatcaatggagtcctttgcttcttgaagatcaatggaagaaaaatggagaaggaggaaagctatggttcagcccactaatccaagaacaagtccaagattctccactaagtgtgcttaggtgtcatgagcccatgggcccaaaatctaccctaaggctcatgagaaccctaggaccttctcctgcatctctggtccagtcttcttggagtctcctagccatggctctcgtgatgggtccgctcctgggaggattgcatcaaaatggggtcactctattttgcgaaaatgctccaaccatatgggatcaacataggcttaaaggaacattcaaaccgagtgtctttacccgcaaggcctag

SEQ ID NO: 84626 - DNA, 444 bp, Glycine max
  Peptide Sequence Number=SeqID_201404
atgggtaaggactggggtcctggcgctgctggtgcagggtatactggtaaaaggtctcgttcaactgcacctgacccctatggttggccacctgctgtacttcttaatgaaagacctgttaataggaggatggatgagctttgtgggcataactggcatcccatagaactggcagatactcgtgatcaaagccagaaatcccagtgctctattagacttttctgggtccactgggtgtcttggaggcgtgatccctacaaattgtgggagatcaaaattatgatcgctgggaaggatgttgctgaggagaagcatcattcagatttgtgtcaaggtggtcatgctagtgcgcatgatccacacccgccttctcatcatgcttcgtgcaaagtcctgtcccggagagcacaacagctggcatatggtctcctcatcaaatcctga

SEQ ID NO: 84627 - DNA, 405 bp, Glycine max
  Peptide Sequence Number=SeqID_201405
atggagccattcagaataaaattgagtcaaggctatcgcaacctacccttcggcggggtgcgaaaaggccaaaatagatgggccaaagcgttcgtctccaagggagaaaatgagcggagtcgccaccaacatttatttgaggaaaatgttagaaaaaccaaaaagagtctgcgtattttgaaaatgagggttcgagagttgtttacgcacggggaagcaaaaaaggcatttgggacaaaggcggctcgcccaggtgagctgttgcttcactctgaagtaaccttgctcgcccagggaagtaaagataaggacactaatttcgttcaagagatccagccattcgaccaggcaactggcgaaaatcaagtgaaagctagaaaacatgaggacattgaagttatgtag

SEQ ID NO: 84628 - DNA, 204 bp, Glycine max
  Peptide Sequence Number=SeqID_201406
atgaaggtgaggccgtgtagccctttgaaagcgagggcgtgtagccctctgaagacgagggtgtgtaaccctctgaaggcgaggacgtgcaaccctctgaaggcgaggacgtgcaaccctctgaatgtgagggcgtgtagtcctatgaaggcgaggaaatcctacccctcaaggacattggatagaagactccaagaagattga

SEQ ID NO: 84629 - DNA, 162 bp, Glycine max
  Peptide Sequence Number=SeqID_201407
atggtgaaggcaaaggacaaaggagagaggccatgggagagttcaacagttcaccgccaaaccttaatctcatctgtttattcacaaggaaccttgacacagttgaagggaggaaaaagtgttaagaactggaatatcaagtataataaggagtacatgtaa

SEQ ID NO: 84630 - DNA, 234 bp, Glycine max
  Peptide Sequence Number=SeqID_201408
atggatcatgcccacaaaacaccaagtcgacccggagaagtccaacagggccctagggtttccagctctggttatgggcctgtgtctgttttaccgggtacctgttcccccgagcaagggatcgcgcccacaagacacccagtggacccagaggagtccaacaaggccctagggtttccagctctgattatgagccttagtcaattctacggagagcccatcgcccccaacaag

SEQ ID NO: 84631 - DNA, 493 bp, Glycine max
  Peptide Sequence Number=SeqID_201409
gtcctcgccttcagaggattacacgccctcgccctttagaggactacacgtcctcaccttcagaggactacacgccctcgcctttagaaggctgcacgtcctcacctttagagggctacacgccctcgccatcaggggactacatatcttcaccatcagaggactacacatcctcgcctttagagggctgcacgccctcgtcttcaaagggctgcacgccctcacctttagaggactacacgtcctctccttcaaagggttacacgcccttgccttcagggggctacacgtcctcaccttcaggggactacacgtcctcccctttagagggctacatgccctcgccttcgtagggctacacaccctcaccttcgatggactacacctcctcgccttcagagggctacacgccctcgccttcagaggactacacctcctcgccttcagaggctgcacctcctcgccttcatggggctccacatccgcaccttaa

SEQ ID NO: 84632 - DNA, 457 bp, Glycine max
  Peptide Sequence Number=SeqID_201410
atgaagaatattccagatttgggagttgtatttgcgtttgaggaaggtattagcacctctcacgtcgacaaaagcggggctcttgctcctacgtaccctccatcgaagaggaaatcagacctacgtggtccttttaagacgttggaccttaaaatgatccatttttacatggtgagacaaactgagaacagcccccttcagcctatttgtaggaaaaagggggaagaggttgccgcccagctcgcccagagggtgcgaagcacctcgaagtggtcaatcaaaggttgcatgccatcaaacaatagtccccggatgaaattagggtatgacaaggcttatgcaggatgccccacattgccccagtgctcatgcacggtgcccctcattgccccagtgtatggctctgaggtaccaatcgttgtctttcgtcatgaccttgtagcagggaacctattgg

SEQ ID NO: 84633 - DNA, 252 bp, Glycine max
  Peptide Sequence Number=SeqID_201411
atgtgtgccgagaaagggaaagtatattgggaaaatctcttggctggcatggtaggcgcatcagttaattggttcccccgatggaaggaaggaggggccgaagttgtgtcctcatgtgaagggttcccgaacgtccccttgatgggaacgaggggttgtatcaattctaaccctgtgcttgccataagacaacttggctaccccatgagaggagcgccattggaagaaagtatcacacctttcatcccatga

SEQ ID NO: 84634 - DNA, 237 bp, Glycine max
  Peptide Sequence Number=SeqID_201412
atgttgaaaagggaaggaagtgaaaaattaaaccgtgttctggaccttctagtgctagtgcggcgacggtgccggtgcgagtctaacagcgttttctggtgcgacgacagcgtggtctggtgcgaggtcgttgacaacgaggttcagattgtgagttgtgacgaagaagacactgtttggttcgagttcaagcagcgacgtcagcgaggctgtatcgtgcaacgacggcgccggtga

SEQ ID NO: 84635 - DNA, 291 bp, Glycine max
  Peptide Sequence Number=SeqID_201413
atgaaaatctgggaaggcatctttacattcacagttgacagaatacaaaaacttagcagtgtcgacgatggaggctccgttcaagtaactgacccgcgctggtggcggtccgcttcggatggcctcgtcggcggatgccacatggagcgagtccctgtcggcgtcgctttaaacggcgatgtgtttaataaaatttaccctatgcagcaagaagagtgtgagttgcgagtttgcatggtcaggtcagggatgggtcctggtatctgctcctcccctatgcagcaaatctaa

SEQ ID NO: 84636 - DNA, 1836 bp, Glycine max
  Peptide Sequence Number=SeqID_201414
atggctcttggaggatttttttctaagattgctttaaagtctggctatcatcagatacgggtgcatgagcaagatatccataagacagcttttagaacccacaatggccactatgaatatctggtcatgccttttggattgatgaatgctccagcaacatttcaggcaacaatgaatgatatattcaaaccctttcttagacagtttgtgctggtgttttttgatgacattcttgtttatagcaagaatgaacaggaccatttgaaccatgtaaaactagtgctagaagttttggtgaagcattgttttgtggcaaacaagaagaagtgcagttttggttgttcacaagtggattatttaggccatatcatctctgctgctggtgtgtctgttgatcctagtaaagtgaagtgcataatggagtggcctgagcctaagactgtaaaaggggtgaggggtttcttaggtctcactagttactataggaagtttgttaaagactatggtaaaattgctagaccactcacagatttaataaaaaaagacaacttcttatggaatgagtctgctagggaagcttttcagaagctgaagacagtcatgaccacatctcctgtcctagcattaccaaactttgatgtggcttttgaagtggagtgtgatgcagctggtaggggcattggagctgttcttatgcaaaatagacaatcaattgcctatttcagcaaagccttgtctgaaaataacttggctaagtctgtttatgaaaaagaattaatggcattggttctttcaatccaacactggagacactacttgttagggaaggaattcgtagtgtatacagaccataagagcctgaagcatttcctacaacaaaagatttcttcaccagaccagcaatgttggttggctaagctgttaggctaccaatttgaagtaaagtataaaccgggtttggaaaacaaagctgcagatgcattgtccagatgctatgatgattgtgagttagcagttatggcttattcacctgtgtggataggtaggcagcaactgctgaaagatgtggaaaatgatgtgtcggttcaggaattgctaaagaaagtggtggaaaatcctgacaagtaccctggttttgtgatacatcaaggggtattgttgtatcaggatcgtttggtgataggtaagaattcatcaatgattcctcagctgttaaaagaatgtcatgaaacaccaatgggaggtcattctagatttttgagaacttacaagagagtagctgagaacttgtattggataggtatgcagaaaacagtcagggactatgttagagcatgtgatgtgtgccaacgacagaaatatgttgctacaactcctggagggttactacaacctctacccatacctaatgccatatgggaggacttgtctattgatttcataactggattgcctaagtctaggggttatgaggcaatattggttgttgtggataggctctctaaatacagtcatttcattttgttaaaacatccctacacagctaagaccatagcagagatttttgtgaaggaagtgataaggctacatggcattcctatgtcaattgtgagtgacagagaccctctgtttattagtcatttttggagagaaatttttaagctacaggggacaagtctgaaaatgagttcatcttaccatccagagacagatggacaaacagaggttataaaccgatgtttagagagctatcttaggtgttttgtggctgaacaacctaaaacctggtcttattgggtgtcatgggcagagtattgtacatactacctaccatga

SEQ ID NO: 84637 - DNA, 1882 bp, Glycine max
  Peptide Sequence Number=SeqID_201415
atgggtgatcggattgaagctctggagacacagatgggaaatgtcacaacgacattgcaagagcttgctctgcaaatgtcacaacatgctcagcagatgcaacagcagagtttggttttaactgagctcagtaaacaaatcggtcagaagggagcaacgcaagaaggtgaggcttctgtgggtgattcatcacagaacgagtctcgtctcgccggaaagaaggtgaaactacccctcttcgaaggtgaggatccagtggcgtggatcacacgtgctgagatctactttgacgtgcagaatacaccggaggagatgcgtgtgaagctgtcacgattgagcatggaaggatccacaatccattggttcaatttgctaatggaaacagaggacgatctttcatgggagaagctgaagaaggcactaattgcgcggtacggtggccggcgattagagaatccgtttgaagagttatctacattgagacaaacgggaagtgtggaggagtttgtcgaggcgtttgagctgttatcgtctcaggtgggacgtttacctgaggagcaatacttgggttactttatgagtgggttgaaagcacccatacgacggagggtaaggactctcaaccctgccaatcgtatgcagatgatgagaattgcgaaggatgtggaggaagagcttcgcgaggaagacgatgatgaaaacagagcctctatgaagaagaatgtgggtcgtagtgaatatgggcctggatctaaattctggactgggtccaacctggcccagaaggaaataacccgtttctcaaaatcgggttggactaacccatctcgcaaaactgtttctattggatccacttccaatacgacgtcgtcgttgagttcaacaggaaggaaacacgaaggggatcgtcgtggtggtacgaacgatcggtggagagggattagtagtgaggaaatggaggaaagacgagctaagggcttatgcttcaagtgtgggggtaagtaccaccctactcaacacaaatgccctgaacgttcactacgtgtgcttattttgggtgatggtgagtctttgaatgatgacggtgagattgtagccatggagggtgaagagtcggaggaggaagagatgacggaggcggagtgtaagttgattggagttctggggaagatgggggagtctcaaacaatgaaaattgaagggaagttggagcatgttaatgtgggtgtgctcatcgatagtggagcaagccatagtttcatctctccagagttggtcactgctttaggtttgaaggttactccaaccactgtgaagaggatcaagttaggggatggtcacaaggtgttatctgaaggggtttgcagaagagttagacttgtcctagggtctaatgagtttgaaattgatgcgttggtattaggactgggtggtctggatgtggttctaggagtctcttggctcagtactttgggcaaggtggtgatggattggaaggatttaaccatgcagttttggcataatggtgaaatgatgactttgaagggtcaaggtggaaggcagttagttcaaggatgtttgcacacatacttagaagggaaggacagagctatgagtcctgttgagttatggtctcttgaagagaagctattggacagtaatgtgaaaattcaaggaaacattggtgatttactcacaacttttcctgaagtgtttacagaacaattatcattacctcccataagaagtcaggtacatcagataaatcttattcctaattatggacctgttaatatgcgaccatataagtatcctcatcaccagaaggaggagattgagaagcaagtggctgagttacttcaagctggagtaatcaggccta

SEQ ID NO: 84638 - DNA, 309 bp, Glycine max
  Peptide Sequence Number=SeqID_201416
atgaatgatgaactacaggcaaaagttaacgaattgaagggtgagaagaatgagcttcgtgatgagaacaataggttgaaagaagagaaagaaaagttggagcagcaaaaattagaggcatgtaggcatctaattgctaggttttatcttcattattctccggataagttaagtttttttttgcctgcttctttctacatcggtcgtaaaaggaccgtcgtagaacacgtgacaaactacatcggtcgtaaaacgaccatcgtagaatacgtgataaacgaggtcgttcctacgacatcaccgatgtag

SEQ ID NO: 84639 - DNA, 294 bp, Glycine max
  Peptide Sequence Number=SeqID_201417
atggaagaaagaattgaggggttgttctccaccgaatccttgaggtggattttgaggattctgctccgattaaaacgttcctctcgatgtggtggttcagcgacaagcaacaatggcttgtggtggccaccggtggtcgtgggtggaggaggaggaggtgctagggcttggatctcgcttagcaagctcatctcgctaagcgggagtccacttttggcgctatgtgcaacttttggtgctgagcacaattcctctcaagttggtatttgcgttaagcatgacaattcatgctga

SEQ ID NO: 84640 - DNA, 370 bp, Glycine max
  Peptide Sequence Number=SeqID_201418
atgcgcagaacgcctttcaatcccggaatgaaaccgacgctgctggccatgctggtcagcgccggttgtttgccagtgatggctgctaccactaacaccagtaatgcacctcagggcgctaacgaacagccgacgctgaccgtcaccgccacgccgcagagtgaattcaaacccggcggcaacgacttagtaccggcctttctcgacggccagattgcccacggcggtcgcctcggcatgctgggcgagcaaaacgccatggacgtgccgttcaacgtcatcggctatacggcaaaaatgattcaggaccagcaagcgcaaaccatcgccgatgtggtgcgcaacgatgcgggcgtgcagaacgtcaaag

SEQ ID NO: 84641 - DNA, 1311 bp, Glycine max
  Peptide Sequence Number=SeqID_201419
atgaaacgtatgggcgcggcagacgaagtcgctggcctggccagctatctgatgtcggatatcgctggctacgttacgcggcagcgggtagtggttaccggtatgggcggcgtcacggctttcggtgagagctggagcgcggtggcgcagcgcattaaacagggccagaatgcggtacgtaaaatgccggagtggcaagtctatgatgggctgcacacgctgctgggcgcgccgatcgatgacttcacgctgccgccgcactacacgcgtaaacgcatccgcgccatgggccgcgtctcactgctggcgacgcgtgccaccgagctggcgctggagcaggccggcctgattgaccatccggtgctgaccagtggtgaaaccggcatcgcttatgggtcttcgaccggcagcaccggcccggtgagcgagttcgccaccatgctgacggaaaagcacaccaacaacatcaccggtaccacctatgtgcagatgatgccgcacaccacggcagtcaacgccggactgttttttggtctgcgcggtcgcgtgatccccacgtccagcgcctgcacttccggcagccaggcgattggctacgcgtgggaagccattcgccatggctatcagaccgtgatggtcgcgggcggggcagaggagctgtgcccctcggaagccgccgtgttcgatacgctgtttgccaccagccagcgtaacgacgcgccgcacacctcgccggcaccgttcgatcaacagcgcgacggtctggtgattggcgaaggggcgggcacgctaattctggaatcgctggcacatgcgcaggcgcgcggcgcgaccatctatgcggagctggtcggttttcacactaactgtgacgcggcccatatcactcagccgcagcgtgaaaccatgcagatttgtattcagcgcgcgctggacagtgcaggggtgacggcagcgcagattggttacattaacgcacacggtaccgccaccgatcgcggcgatattgccgaaagccaggcgacggcagcgatttttggcaatcgtacgcccatctcttcgctgaaaagctacttcggtcacacgctgggtgcctgcggcgcgctggaagcctggatgagtattgagatgatgcgtgagggctggtttgcgccaacgctgaatctgacgcagcctgccgccgaatgcggtgagctggattacatcactggcgcgccccggcagctacagaccgattacgtccagtcaaacaactttgcttttggcggtatcaacacctcgctggtgtttaaacgctggcgcgacgcctga

SEQ ID NO: 84642 - DNA, 2763 bp, Glycine max
  Peptide Sequence Number=SeqID_201420
atgattttagcttggctcttggttttaatggctctctccaatgggttcttttcaaatggggacggcatgcataattccacaataccagattttgtaaatattggggctctcttctctttcaatactagtgttggcaggagtataaaaattgctataaaagctgcgattgaagatataaactctgatcctactattcttggtaaaaccaagctgaacctctcactgcaagaagattctaagtatagaggtttcctgagcatttctgaggttttgcaggtcatggcaagacgcacggtggcaataataggcccccatagttctgtaacagctcatgtcataactcacattgcaaatgagctccaagttcctctgctgtcattttcagctttggaccctaccctttcttcacttcaattcccattcttcattagaacctgtcacagtgatctttatcaaatgactgcaatagcagacattgtaaactaccatgattggaaagatgttattgctgtctaccttgatgatgataatgggagaaatggaattggtgcattaggcgataagcttgctgagaggcgttgcaggatatcatataaagcacctttgagcccggacgcatctatggaagagatttctaatgtgcttgttcaggtggctctggcagaatcacgggtaatagttgttcatgcaaatactcaatttggccccaagttgtttagtgttgcaaagaatcttgggatgatgggaactgggtatgtctggatagccactgctttcctctctgctctgcttgatatcaacagtcccctctcttcagattcattggatgacattcaaggagttcttacaccgcgtatgtacacgccggattcacagctccaaaggaggtttgcttctaggtggaaaaacttgactagtgggaatactgctaatgcccaccttggattgagctttttacctatatacgcatatgacactgtttatgtgcttgctcatgcacttgatgcatttttcaaacaaggtaaccaaattacattctcaactgattcaaagctatctagcatacatggagataacttgaatcttgaagccttgaaaatcttcaatgaaggaaatttgttacgcagtaacatctatgaggttaacatgactggtgtatcaggtccattcaagtacacatctgatagaaaccttgttaatcctgcatatgaaatcattaatgtcattggaactggaactcggaggatcggttattggtctaattactctggactatcagttgttcctccggaaactctttattccaaaccagccaatctttccagggaaaatcaaaagttgttcgctccaatttggcctggaaacactggtgagagacctcgtggttgggtttttccaaacaatggaaggctcttaaagattggcgtaccaaaaggtgttagttacaaagaatttgtctcacaaatagaaggtactgatacgtttgaaggattctgcattgatgtatttcttgctgcagtgagcctgttgtcttatgctgtcccctataagtttgtcccatacggggaaggtaagaacaatcctagtatgactgagcttgtccgtctgatcacaactggtgtgagtatcatggataacttttttgtggagtttgaaagttttatggaatttgatggtgcagtaggtgacattgcaattactacagaaagaacaaggatggtggattttactcagccatatattgagtctggtctagtggtagtagcaccggttaggaaggaagaatccaatgctttggcctttttggccccttttaccccaaagatgtggtgtgtcacagctatctttttcatattagtgggagctgttgtttggattttggagcatagggtgaatgatgaatttagaggaccacccaaaaaacaagtagttactgttttatggtttagtttttcaacaatgttcttttcccacagggaaaatacagtgagcgcacttggtcgctttgtgttgattatatggttatttgtagttcttataattaactcgagttacacggcaagtctaacatcaatcctcacagtgcaacagctttattcgcccattaaaggcattgaaagtttagtaattggcaaagagcctattgggtacacacagggttcttttgctagaaattatttagttcatgaaattggtattaatgagtccaggcttgttcctctaacaacaacagaagaagctgctaaagcactgagaaagggtcccgaaaatgggggtgttgctgcttacattgatgagcgtgcctacactgacatcttcctttccagccgttgtgatttaactgttgtaggtcaagagttcaccagaaacggttggggatttgcctttccacgggactcgccattagcagttgacctgtcaactgccatattgcaaatgatagataatggagatttacaaaggatccatgacaaatggcttttgagtagcgcttgcttatcacaaggtgcaaagcttgaagtggaaagactccaacttaaaagcttttggggcctctatgtgatctgcgggcttgcctgcttgcttgcactcttgacgaaaaagaagagaccgttaagagccggtccaagagaagaaaaatggagaggatctcatacagaagcagtgaaggaagctcatccatcagctctaataagggatatgctccacgcagaagtgaatgtgctagcgaagtatgaccaatatttctacatgattttctag

SEQ ID NO: 84643 - DNA, 948 bp, Glycine max
  Peptide Sequence Number=SeqID_201421
atggagaatccagtaggatgtgaaagacacaagtacggcatatggagcgtcttgactttcacttttattttgaaacacagggatgtagtttctggacttgttcatttgcatgaactaggaataatacatcgagatttgaaaccccaaaatgttttgataataaaagaaaaatcattatgtgcaaagctttctgatatgggaattagtaaacgccttcttgaggatatgtcttctttgggtcacactgttactggctgtggaagttcagggtggcaagcaccggaacaacttgttcaaggacgtcaaacacgagctgtggatttatttagtttaggttgtgttctctttttctgcatgactgcaggaagacatccatttggagaacgtcttgagcgtgatgtcaatattgtgaaaaatcaaaaggatcttttcttagtggagtttattcctgaagctgatgatcttatttcttgtttgttaaaccctaaccctgatctcaggctaacggcgattgaagtattgcaccatcctcttttttggagctctgagatgagactttcatttcttcgtgatgtaagtgacagggtggaacttgaagatagagaaattgattctgatcttttgaaggcactagaaagcattgctccactggctttaggtgcaaaatgggatgagaagctagatcctgatttcataactaacattggtcgttaccgaagatataaatatgacagtgttcgagacttgttgagggtcatgagaaataagctaaatcattacagggaattgcctcaagaaattcaggaactgataggacctgttccggaaggattcaatgactactttgcaagtcgatttccaagactcttgattgaagtgtacaaagttatatacaaaagttgcaaggacgatgaatgctttcaaagatattttagaaacattaactag

SEQ ID NO: 84644 - DNA, 168 bp, Glycine max
  Peptide Sequence Number=SeqID_201422
atgagtggtgttggtggtgggtgcccctgccccaggggcaatagtgagtgttccatagaggatctgaatggcgatacagtggggaatttgaatcagaatgctgccaaacctccaagggaccattcggttatgcgccattgcatcagctcttcttggtctgctgaaacg

SEQ ID NO: 84645 - DNA, 948 bp, Glycine max
  Peptide Sequence Number=SeqID_201423
atgaatattgttggacttaaatcaagcacagaagaaaaatcgaacttttcacttgtaatgcgatctggaagctgttctgataaaggaccaaagcagtacatggaggatgagttcatatgtgctgatattcttagtgaatgtgtcgatctaggggaagaccttccttctcctgcagcattttatggggtatttgatggacatggaggtgttgatgcagcatcatttgccagaaagaacattctcaagtttattgttgaagatgctcacttcccatgtggaattaagaaagcagttaagtgtgcatttgtgaaggctgatcttgcatttagagatgctagtgctcttgatagttcatcaggcaccactgctctaatagcccttatgttgggaagttccatgcttattgccaatgcaggagattctcgtgctgtattgggcaaacgaggcagagccattgaactttccaaagaccataaaccaaattgcacatctgaaagattaagaattgagaaactgggtggtgtcatctatgatggatacctctatggccaactatcggtggcacgtgctcttggagattggcacatcaaaggttctaaaggttccaagagccccttaagttctgaacctgaactagaggagattgtgctgacagaagaagatgagtttttgataatgggatgcgatggattatgggatgtgatgagtagccagtgtgctgttacaatggtgaggagggagctcatgcagcacaatgatcccaccacatgtgcaaaagtacttgttgctgaagccctccaacgcaacacctgcgacaatctgacagttgtggtggtgtgtttctccaaagatccaccttctaaaattgaaattcctagatcatataggaggaggagtatttctgctgagggccttgatcttctcaagggtgtcttgaatggtagatga

SEQ ID NO: 84646 - DNA, 927 bp, Glycine max
  Peptide Sequence Number=SeqID_201424
atggctagggagtttcataggaagagcatgatggcaagtgggcttattaagtccagaggggttgccccaaacactgtggtttacaacactttgcttcatgcactttgtaggaatgggaagtttgggagagctaggaatttgatgaatgagatgaaggatcccaatgatgttacctttaatattttgatatctgggtattataaggaagggaattcagttcaggctcttgtccttctggagaagagttttagcatggggtttgtgcctgatgttgtaagtgtcactaaggtgctggagattctgagcaatgctggccacgccacggaggctgctgaggttttagagagagttgagagcatgggaggtttgctagatgttgtggcttacaacaccttgataaaggggttttgtggagcagggaaggtgatggttgggcttcattttttgaagcagatggagagcaaaggctgtcttccaaatgtggatacctataatgtactgatatctgaaggaagaattgaagatggcttttctactttggagttaatggaggaaagcaaagaaggctctagagggcacatcagtccttataatagcataatatacggcctggtgtgtgatcagatgattgatgaaggtggaattccaagtattctagtttataactgccttgtacatggattttcccaacaaggtagcgtccgagaggcagttgagctgatgaatgaaatgattgctaataaccgttttcccattccatctacattcaatggtgtcatcagtggtttttacagacaaggaaaagttgagagtgccttgaagttggtgggagacatcactgcaagaggtcgtgtacccaacacagaaacttacagtcccttgattgatgtcctatgtaggaatggggaccttcagaaagccatgcag

SEQ ID NO: 84647 - DNA, 456 bp, Glycine max
  Peptide Sequence Number=SeqID_201425
atgaccggaaggcttcttgctggttcattggcattcgaatgccgcatcatgcactactttattatctgcattctactccctagatcatccaaccttacacatccctttgtcaaagtcaagagatccttctctatctgttcgaatgtagtctcctctttcggataccgcaaagagagggatggctcttgggtaaagaaggatgctccagtacaggccgctgaagaccgctctccatcaccacaacctcagagagatgactcttcatctcttatgcacaacattcttgacaggttggatggactccacactttcgtcggagaacgctttgactcgttggatacctgtattgatgccatggatgcacggtttgcagggatggacacacgtatcaccaaacttgaggaggatgttagctttgttcgtcagtgctttgaccttccaccaccatcctcatag

SEQ ID NO: 84648 - DNA, 2085 bp, Glycine max
  Peptide Sequence Number=SeqID_201426
atgaatggttttattcagcacgctttgcttgccaagcccaaccagcggcgtcaccgccaactcatcgttgccggccttaccgcggaagtgatagccggcacggcgcagggcgaaacggaacaggcgggtctcgattttgatctccgggcttttcggccgatcgctgcgatcgaggcgctgtacggcgccggcggtgagcagatgctgcttgatgtaatcgatcagggtatcggccaacacctcgttggtgatcagctggtagcgatcgtaacggtatttctcatgctgatgcagataaacgtcgttgatgctggcgccactgtagatcacggtatcgtcgaccacaaagcccttcaggtgcagtacgcccaacgcttctcgggtattgaccggcacgccgtaaataggcaccgactgctcgggatgttggccggccatggcacagtaccagtcggcgttggtattggcggcggcggcgccgatgcggccgcgctgtgcgcggtgccagtcgaccagcacgcagatttccagctcgggccgccgctgcttggcttgatacagcgcgttgaggatctcgcgcccggcgtcgtcatgctccagatacagggccaccagatagatgcgttgggtagcgttggcgatggcgtccagcagcgtggtgcgaaaatcggacggcgcgtacaacgtacgaacatcagcaaccgtctgggggagtttgggcagttgtgcaagtggtggattcgtagcgcattgcgacgcaggtcactgcgcgtcggcggcctgcagcggcagcgtcagattgacgatgccgtcctcaagctgcacctcaatgccaaagcccagccgctgcgccaacgcgatcatgccgcggttattcggcatggtgatgccgctcagacgggtcaggccatgggcgcgcgcataggcgatcattttctccagcagctggcggcccaggcccaggcctttcaggtcggaacgcaccagcacggcgaattcggcgtcggtgttgtccggatcggacagcgcgcgggtcacgccgatgatctcgtctgcgcgcaccgccacaaaggccatttctcgatcgtagtcgatctgcgtcatgttggccaaatcgtcatgggtaaactcgttgatctcgctgaagtagcgataatagaggtcttccttggtcacccggtcgatgaaatgcttcagcgccggctcgtcttccggcaggatcgggcggaacaggcattggctgccgtctttcaacgcgatggtttcttccagctcatgcggataagggcgaatcgccagccgcgcctgcggatcgccgctgaacggcgcgagctgcatcgaaacgtccagcagggtgaattcgctgccggaggccagcaccgggtgaatatccagccgggcgatctccgggcagtcgaggatcaggttggagacctgcaccagcaggcggctcagcccggggatatccaaaggccgcagcgcgctgcggccgcggatcttgccgcctttcaccgcctgcagcaccagataacgcgccagcgccatgttcagcggcggcagcgcgaccgccacctgattttcctggcgccattccacgccgccttcgcccagcatgatcagcgggccgaaaatcgcatcctgctccaccgcgatgcgcagctcctgggcgccggcgcggttggccatgctctgcaccagcaggccgtgaatgcgcgcctgagggtaggtgcgctttacgcggtcgaggatcgcctccgccgcgcgctgcacttcggtcgcggtgcgcaggtagagcatgacgccctgaacttccgatttgtgcgggatatccggcgaacgcagcttcagcgccaccgggtagccgatctgttcggcgatgtgtaccgcttcggcgctgtcttcggcgatccaggtcggcagggtgctcaggtcataggcctgcagaatggattgcacctcgtgggtatccaactgggtggcgccttcggccagcgcctgatggataaggcggtgggcgtcggcggtgttggcggtgaggccgatcggcagcgctggcgtctctttcaactgcttctggttgcggcg

SEQ ID NO: 84649 - DNA, 318 bp, Glycine max
  Peptide Sequence Number=SeqID_201427
atgcgcaatcatggatcacgaggacttgttcaggaaactgtctttggtgggaaacttggctctgagggaccgcttcatgtgtcgcaagctgttggatttcccctgtgtcgcaacctatccttcggcgggacggcgacgcaagggctcacgggtgcgtcttccatgggaggaaaatgtgcggagtcgccaccaatgtttattcgaggaaaatgtcggaaaaaccagaaaggaacgttaaggcgttggaccattaacgatctctttggggtggtcgacaaaagcggaacttttgctcctacatatcctcaattgtcatga

SEQ ID NO: 84650 - DNA, 561 bp, Glycine max
  Peptide Sequence Number=SeqID_201428
atgaacgaatcaacaccaaatatagagagttacctctatctccatccaagcgagaacccaacagtggccctcgtatcaccagttttagattcaagcaactatcactcatggagtaggtccatggtcacagcactaagcaccaagaataaagtagagttcataaatgggaacgcaccagaacctctgagaactgatagaacctacagtgtgtggagtcgctgcaataatatggtagtatcgtggatagtgcattcagtatcggtcgcgatcaggcagagcatcttgtggatgaacaaagctgaggaaatatggaatgacctgaagtcacgatatgcgcaaggagacctcttgagaatctctgatcttcaacaagaagcttcatcaatgaaacaaggaaccctttccgtcacggagtacttcacaaagcttcgtatcatatgggatgaaattgagaacttcagacctgaccccacttgttcttgcaccatcaagtgtacatgctcagtcctcaccatcattgcccaacagaaattagaagaccgagccatgcaattcctatga

SEQ ID NO: 84651 - DNA, 327 bp, Glycine max
  Peptide Sequence Number=SeqID_201429
atggatatcgcatttcatcagctgggtttatacagagagctaaacccacctgaccaaactggaaagttcaatgaaaggctagcaaatgatatacaaggaatgttgagcttgtatgaagcagcccaactaagatttcatggagaagagatacttgaagaagtacatgatttcactctcacccagttaactaagtcaccaaccacccaattaagccatttccttgctgcacaagtgaaacatagcttagggcaatcacttcgcaagggaatgcctagattggagacaagatattatatgtctttctaccaagaagatcccctcacataa

SEQ ID NO: 84652 - DNA, 474 bp, Glycine max
  Peptide Sequence Number=SeqID_201430
atggaggagtacatgcaagttgcgactatgtcatgtggttttgctatgctgacaattgtatctttccttggaatggaagacacaacagaggaggttctcatatgggcgacaagtgacccaaaaattgttgcagcggcttcaattatttctaggctcatggatgacattgttggaagtgagtatgaacaagaaagaggacatgtggtttcaagccttgattgctatatgaagcaacataatacctcaaggcaagataccattgaagaactactaaagttggttgagagtgcttggaaggacattaatgcagcttgtcttaatcctactcaagtaccaatgaaatttcttatgcgtgttgtcaaccttgcgcgcatgatggatgtgctttacaaagatgaagatagttatacaaatgcagggggaataatgaaagattacatcaaaattttactagttaataagatatttgattaa

SEQ ID NO: 84653 - DNA, 252 bp, Glycine max
  Peptide Sequence Number=SeqID_201431
atgtctcctaattcaagcacaagggggaatgccacctcaaaccgtctttgctattgttgtggaagagctaccattcgaataacaaggacggcaaggaataatgagagactgttttatgtttgtccattaccacaacaagatgcagatcgatgtaatttcttttcgtggattgatgaagacattgatgttggtgcaactgaaataggtagaatagaaccaataccagactttggtctaaggttgagactgtag

SEQ ID NO: 84654 - DNA, 351 bp, Glycine max
  Peptide Sequence Number=SeqID_201432
atggcttctaacactatcatccaatgcagtccttcaactcatacaaaaaggaaatatgacgtgtttgtgagcttccatggtgaagactcacacaacaactccactagttttctctttgaagctctccgaaaaaaaggcattgatgccttcagagatgatgcaggtctcaacaaaggagaatccatagcacccaagctgcttcaagccattgaagggtctcgccttttcattgtggtgttctcaaagtactatgcttcctctacttggtgcttgcgtgaactaacacacatctgcaactgcattgaaatatcgccaagactgcctattttttacgatgttggtccatcagag

SEQ ID NO: 84655 - DNA, 213 bp, Glycine max
  Peptide Sequence Number=SeqID_201433
atgtggtaccatgttagtgaaaaatctcgtcaggtgcctaggaggagactagtcagggtcacgctattttgcgagaatgctccaatcatgtggaatcggcacatgcttaaaggagcactcaaaccgagtgtatttacccccaaggcctacactcttaagagtccgttagggcctctccctcctgattcatgtccaaccgagaaaacattttag

SEQ ID NO: 84656 - DNA, 237 bp, Glycine max
  Peptide Sequence Number=SeqID_201434
atgacgattattttatgtgtaaaaaccccgcctgtgagccctcgagcaacatcgatccttcttcctagaaggccaaatgctttgagatcaagaagtggaacaccgttgtcagggccgtgtacaaacattttggggcctaaggcgcaagggtgctatttgatacgtgttgtattgctgcgtacccagagtcatgcccgtgaaatgaatcgttccaccaatccatcgggatggagatga

SEQ ID NO: 84657 - DNA, 1326 bp, Glycine max
  Peptide Sequence Number=SeqID_201435
atggcgcacacgggcagcaacagttcaatgcaccggtcgagttcacggcctcagctggatctgagcaaagcagaaattcaaggaaacttcgaagagaagtatccaaccattttgctacccaatcagtctcatgatatatctcacctcgctcttgatattggaggatctcttataaagttggtgtacttttcaagacaccaagaccaatcaacctatgacaaaagggtgaaaaatgtgaagaatcgactgggatttccacccaatggtaacaggagaagctatcctattcttggtggaaggcttcattttgtgaagtttgaaactagcaagattaacgagtgcctagacttcattagctcaaagcagcttcactctgctggtggaggggaatcacgttattctgatgccaggactgattcaaatgccataattaaggctactggtggtggggcacacaaatttgctgaccttttcaaagaaagactcggactgagtcttgacaaagaagatgaaatgagctgtcttgtagcaggagcaaatttcttgctgaaggcaattcgtcatgaagcttttacacacatggagggccagaaagagtttgttcaaattgacactaacgacttgtttccttatcttctagttaatattggatctggtgttagtatgatcaaggttgatggggacggaaaatatgagagggtcagtgggactaatgttggtggtggtacttattggggcttgggaaggctgttaacaaagtgtgagagctttgatgaattacttgagctgagtcagaaaggagataatagtaatactgacatgcttgttggggacatttatggtggcatggactattctaagattggcctatcggcttctaccattgcttcaagttttggcaaggctacctcagaaaaaaagggacttgaagattacagacctgaagatatatcgctctctcttctacgaatgatttcatacaatattgcccagatagcctacttaaatgcattgcggtttgggttgaagcgtatcttttttggaggattttttataaggggtcatgcctataccatggatgctatttcttttgcaattcatttctggtctaatggggctgcacaagcaatgttcttgcgacatgaaggatttcttggagcattaggtgcatttatgagttatgaaaagcatggtttagatgacctaatggtgcatcagttagttgaaagattcccaatgggtgctccatatacaggaggcaagattcatggccccccacttagggatttgaatgagaaggcaagaagtgattatagtgtgaattga

SEQ ID NO: 84658 - DNA, 183 bp, Glycine max
  Peptide Sequence Number=SeqID_201436
atggtggtcacagtggtgatattagtggcggtggtggtgacaacaagtggtgatagttgtgtggtggtaacaatgacaaaagtgatattagtggtagtgacaatattgatgatggaggtggtagtgacaacaaaaaagtgtatcattgttaaatatggggaatttatattttgtttaaactaa

SEQ ID NO: 84659 - DNA, 930 bp, Glycine max
  Peptide Sequence Number=SeqID_201437
atggagcccctacgattgaagaccaactaccgctgcgtccccgctctgcagcagttctacactggcggccccttcgtcgtctcatcggactcctccttcatcgcctgcgcctgcggcgagtccatcaagatcgtcgattcagccactgccgccatacgctccaccctcgatgccgactctgaatccttcaccgccttggctctcagccccgacgaccgcctcctcttctcctccggccactcccgccaaatcagagtctgggacttgtccacgcttaagtgcgtccgctcctggaagggtcacgagggtccggttatgtgcatgacgtgtcacccttctggagggttgcttgctactggtggagcagataggaaggttctagtgtgggatgtggatggtggttactgcactcactactttaaaggtcacggtggtgttgtttcttgtgttatgttccattccgatcctgagaagcagcttcttttttctggcagtgatgatggtggtgatcatgcaactgtaagggtttgggatatttccaagaccaagaaaaagaactgcattgcaacactagataatcatagctcagcagtgacttctttggcattatctgaagacggatggacactgcttagtgctggaagagataaggcaggctctattagtctccatcttactatttgttttactttaccttttcaaatgaatatagttgtaacattgtgggatcttcatggttatagtggcaagaagactgtcattacaaatgaggcagttgaagctgtttgtgtaattggtgctgggagtccttttgcttcatctctcgatttatatcagcaaaatgcaaaaatacatgatggttccgaaatattctatttcattacagttggtgaaagaggcattgtacgcatatggaattccaaagggtaa

SEQ ID NO: 84660 - DNA, 819 bp, Glycine max
  Peptide Sequence Number=SeqID_201438
atgtataaacctactggagctttgcagattcgggtttatgacctttcatctatgtcatgttcgtatgtcttatctggtcacactgaaattgttctatgccttgactcctgtgtatcaagttctgggaaaccactgattgttactggaagtaaagacaacagtgttaggttatgggaaccagaaagtgcaaactgcattggagttggtataggtcacatgggagctgttggagccattgccttttcaaaaagaaagcgagatttctttgttagtggcagtagtgatcatactcttaaggtgtggagtatggatggtctcttggacaatatgacagtgccaattaatttaaaagcaaaagctgttgttgcagctcatgataaagatataaattctgtagctgttgctccaaatgatagtttagtatgtagtggttctcaggatcgtacagcttgtgtttggagacttccagatctagtatctgtagttgtatttaaaggtcataaaagaggaatttggtcagtagaattttctcctgttgatcaatgtgtagtaacagcatctggtgataagacaataaggatatgggctatatctgatggctcctgtttgaagacatttgaaggacacacttcaagtgtgttaagagcattgtttgttactcgtggaacacaaattgtttcttgtggtgctgatggcttagtaaagctgtggactgtaaaaactaatgaatgtgttgctacttatgatcatcatgaagacaaggtgccagttgatcctttgatatatttattttctgatgatttttctttcaattcttaa

SEQ ID NO: 84661 - DNA, 528 bp, Glycine max
  Peptide Sequence Number=SeqID_201439
atgtggctggtaactaggattccatcgaagggggagagaagagaggaaatgcaaacatctgaaaggaacatatgtggtcatttgagttctaataagtggcattttcttttctgcaaaaaagtcatggttaacaaggaggaatctatggacaacataaccctcttctcaataataacggttatgtcattcttgttatcagtacctgtaactttgttgatggagggtgtcaaatttacccctgcttacctgcaatctgctggattaaatgttaacgaagtgtacatcagatcacttcttgctgcactatgtttccatgcatatcagcaagtttcttatatgatactgcagaaggtgtcacctgttacccactctgtaggaaattgtgtgaaaagggttgtggtcatcgtgagctctgtcatcttcttccaaacaccagtatcaccaattaacgcattggggactgctatagctcttgctggtgttttcttgtattccagggtgaagcgacttaagccaaagacaacttaa

SEQ ID NO: 84662 - DNA, 1470 bp, Glycine max
  Peptide Sequence Number=SeqID_201440
atgtcaccctcatcagtttctgttactcctcttatggacaatattgaaacaaacctcacagaaaactatgcctcagagtcaaagccaatgcatttgcaagaaaactacttgaaaccaagcatggaagatcagcttccttttggaactccttccacgcagggtttcttgcaagattctcatcacattgatcatcttcagtttcacgtgaatggctcctcatcatccaatccaatttttggggtacaaactccaaattttgatccctttgatcacaatgtaacatgtgaatctgcacctcctgattttgaagcttatgagtgcaagctttttgctgagagtaatggtagtggacatgctcatcttatggacaatttccaatatgtaggttacagtttgaaccttcctcggacgaatcaactggatttgatggttgcaaaccaaagttatgtgccctttaatgctcttgaaaccaagcctttgaattttgttgtaccagatgaagtctcatgcatttccccaccaaattattataagagagttggtttgaataaaaacctcagggaatctccaagcactaggataacattcaaggctcggaagaagtccaacatagtgaaggggcaatggacatcagatgaagacagattgttgattcaactggtcgaacaatatggactgaggaaatggtcacatatagctcaggcgttgcctggaagaatagggaaacaatgcagagaacgatggcataaccatttgaggccagacattaagaaggacatatggaccgaagaagaggataagatactgatccaagctcatgcagagattggaaacaagtgggctgaaattgcaaaaaaattgcctggaaggactgagaactcaatcaaaaaccattggaacgcaacaaagagaagacaatattccaaaagaaagtgtcgttcaaagtaccctagaggctctcttcttcaggaatacatcaagagcttgaacttggacaaaaatccaccaatagactatcgaaaaaaatctgataaaaatgccaatgccaagacaaacaacaacggcaaagcagcagctcagccccagtgtgctgatcaattttgtcccaatggccagattgtgccaaggtatgattttaacgaggtcccagatttttctttggatgataacttgtttgaagaggggtgcagcattgattctctgctagatgatatgcaaagtgcttctactgttgatcatgagaaagactttgatggaaaaataatgcaatgtgctcctactatggatggaaaacaatctcatcatcaggttggcatacagtgtgttcatgttgttgatgaacatcatcatgatcatgagactgagatggtggcacacacgatggggaatgaagttaagaaggaatttgatttggtggaaatgatgtcccacatgaatggaagccattatagtacacactcaccacgttga

SEQ ID NO: 84663 - DNA, 1884 bp, Glycine max
  Peptide Sequence Number=SeqID_201441
atggaagaaacatttgttcccttacgtgggatcaagaatgacctcaaaggaagacttatgtgctacaaacaagattggactagtggaatccgggcaggcatcaggatccttgccccaacaacatatatattttttgcttcagcaattccagttatctcttttggggagcaactagagagaaatacagatggaactctaacggcagtgcagacccttgcatcaaccgcactatgtggcattatccattcagtcttaggagggcagcccctcctcatactaggcgtagccgaaccaacagttctgatgtatacatttctgtatgactttgcaaaggacagaaaggatttggggcacaaactattcctgccttggactggatgggtgtgtgtttggactgctgtgttgctcttcttgttggccattcttggggcatgctccataatcaacagattcacacgccttgcaggagaactatttggtctgctaatcgcaatgctctttatgcagcaggctataaggggactagtggaagagtttggtgtgctccagtctcagagagaaggtaccaatcagattgcactccaatcctcttggctgtttggcaatggaatgtttgctttggttttgtcatttggccttctgtttactgcacttagaagccgtaaggctagatcttggcgatatggggcaggatggttgcggggatttgtggctgattatggagtcccactaatgattcttgtgtggactgctgtgtcctatataccaaccaataaggttccaaggggaatcccaaggcgacttttcagtccaaatccatggtctcctggtgcatactcaaattggactgaaatgttgaatgtgcctctcatctatattattggagcatttataccggcaactatgattgccgtgctttactactttgatcatagtgttgcatcacaacttgcccagcagaaggagttcaatctaagaaaaccctcatcttatcattatgaccttcttctcttgggcttcttgaccatactgtgtggacttattggaatccctccatccaacggcgtgattcctcaatctccaatgcatactaaaagcttagctactctaaaacatcagctcttgcgcaataagcttgtatctgctgcacgaaaaagcatgcagaaaaatatgaacctgtgtcaattataccgaaatatgcaagaagcatatgaccaaatgcagactccattagcccgccaaataccacctgccctggggctaaaggagctgaaggaatccaccatccaactggcttcaagtcatggatacattgattcccctgttgacgaggctgttttcgatgtagataaggatgttgatgaccttttgccagttgaagttaaagaacagcgcctcagcaatctgctgcaggcattgatggttgcagcttgtgttgctgctatgcctctcttgaagaagataccaacctcagtgctttggggttactttgctttcatggcaattgaaagcttgcccggaaaccagttttgggagagaatactatatcttttcactgctccaagtcgaagatacaaagtgatggaggaacaccatgcagcctttattgagaccgtgccattcaaaacggttgccatgtttaccttattccagacagcttacttgcttctctgctttggtctaacctggataccaattgctggggtcctattcccattgttaatcatgcttctaatcccagtacgccaatatttccttcccaagttttttaaaggagcccatcttcaagagttagatgctgcagcatacgaggaaacgcctgctattagtttcaacttgtcattcgatgtaggattcaggaagtcagacaacaacagtcaataa

SEQ ID NO: 84664 - DNA, 576 bp, Glycine max
  Peptide Sequence Number=SeqID_201442
atggctcccgaagaactcgagcagctgactcaacaaatcagggaccagctggaggagtcgatcatagaaaaagtgactcggcagttgatgttatccttcagccagatgcagtcccagttccaatcacagatccaatcacagggacttgcactgcctccggagcctaaggttggtccctcaattgctcgtgtcagcacaaaggggagttgtgttgatccctcagcgaccgatccagacatgggtgactcagacaaatgcgggttgtacatcaaagaaaatccttctcgcttggttgccctaggaagagtttatgagggatccacaatggttcacaacatccctttgttgcatggaagtgaagctgggtctccagcaaaacctgcagataggccggatcatgaggtcgatgatcccctatattttgatgacattgaccatcccacaactttttttgaagcctctccaggttatgggggattgtcgcaacctaccctttggcgggagggcgacacgagactcacgggtgcgtcttccaagggaggaaaatgcgcggagtcgccaccaacgtttatttga

SEQ ID NO: 84665 - DNA, 285 bp, Glycine max
  Peptide Sequence Number=SeqID_201443
atggacaacccaatatcagcaatttgtccattattttacttgagaaacaaagaagtgtcagaacaaaatatctccatcaacaggggtcatgacgacaacagagaatgtggtggtaatgatggaagcaacaacgatagtgtcaatagtgttgacaacaacaatggctataacaacaacaacaacgatgatgataacaacaataacgatagttgtagcgatagtgatttaggggacattggtaggagtgtaaatgacccaaagaatgttgggatggatctaatttaa

SEQ ID NO: 84666 - DNA, 684 bp, Glycine max
  Peptide Sequence Number=SeqID_201444
atgatgaggtcaaagatagtgttgtttggagactccatcacggagcaatcgatccgagagaatggatggggtgttcctcttgccaatgcctattctcgcagggctgatgtacttgttcgtggttatggtggatacaacactaggtgggctatgttcttactgggccatctcttccctctggactcaactaaaccacctactgctaccacaattttctttggcgctaatgatgcagctttgttaggaagaaccagtgaaaggcaacatgtacctattgaagaattcaaagagaacctcagaaaatttgttcgacacttaaaggattgctcaccaactatggtaattgtgcttattactccacctccacttagtgaggaaggacgcctggcatacgcaagatccgtatatggtgagaatgctactaaaatacctgaaagaacaaatgaagtaactggtcaatatgcaaatgcctgtgttgaggtagcaaaggaaatgggcgtgtgggatggattgcacctgacaacagaaggaaatgcagtagtctacgaagaagtgataaatgtgttcaatgaagcagggctttctgctgataacatgccaatggatttccctcaccactcaaaaattgattccaaacatcctgagagagctttccagcagaatgtttgtgatatcccattgtga

SEQ ID NO: 84667 - DNA, 1050 bp, Glycine max
  Peptide Sequence Number=SeqID_201445
atgaggtttatgacaggctctccaaaaggcacgtggcaaccgattatgactgcagatacaacaacacaaagttactggctgaattggagggttttggtttgtgccattttggttctgttttcagctatcatttcttcattgattatattgaagtatgaagtttcacggaagaaagcaacaagaaatggtaacaaggaaggagagaaagaaacatcatcgactttgtacgaggatgaaatttggaggccttgtttgaaaggaatcaaccctgtctggttgctcgggtttagagtttttgcctttgctgtgcttttggtgcttctcatactcattgctactgaggatggaggaagcattttctacttttacactcagtggacttttgctgcagtcaccatttattttgggctgggatctttgctctccatgcatggatgttaccaacatcttaaaaaagcgagtggtggtaaggttggaaatgtagatggatatgcagaacagggaatttatgatgctcctacacccccacagaattctaatccatcaaaccatgagaaaggcttaggagctccacaagaacatcttgttcgccaaactgcaggcacatggggttatatctttcaaatattgttccagatgattggcggagctgtaatgctcacagattgtgtgttttggtttattattgttccgttcctaaccatcaaagattacaacataaatttgctaataatcagtatgcacaccatcaatgctgttttcctactaggcgatacggctctaaattccctgaggttcccttggtttcgaataggatacttttgcatgtggacaatcacatacgtcatattccagtggattgttcatgctatagttaaactctggtggccatatccatttcttgatttgtcatccccttatgctccattatgttacttttccatggcattactgcatattccgtgctatggcatattcgctttgataatgaagctgaaacacagcgtgttgtcgacgcggtaccctgactcgtacctatgtgacacataa

SEQ ID NO: 84668 - DNA, 1164 bp, Glycine max
  Peptide Sequence Number=SeqID_201446
atgacgcagttattcaatcttattagtacctggctaatactgacatcgtcctcgttattaatcccacatgcggcttcctacgactttgggatacacgagacgggtctcacgtgcggggcttctgagagcccaggatcgagcgcgtccaagttcatggccataatggacacggtgtcgtttcaggtcaaagagcgaggctggggagcgcagacgctcctcggttccgggcctccgatgtacgcattgggccagtgccgccgcgacctgaggcccacggagtgctacacgtgcttcacccaagcgaggcaggtgctatcgcggtgcgtgcccaagacagctggcagaatctacctcgacggatgcttcctccgctacgacaactactcgttcttccgcgaaagcgtggacccccacgcgcgacatcagcgtctgccagtcgtcgccggggcttcggaaagacggggaaggacgggtggcagcagcggtggcgaacgcgacgaagggcgcggcggagtgcggtgctgggggacgctggataaagggacgtgcgagagatgcttgaatgcagcggggacaagagtgcaggaatgtgtgcctaatgctcagggtaggagtctgtttactggttgctttttgaggtactcaacgcgcaagttctacaacgacgttgcactgcatggcatcaaggattctacaaattctagaggtatacaacatacgattgtagggcttttgctcgtcgtccttgctgcatttatatgccggaaaagaatagcatcatcgcgtagaaataaaataagcgacagttgcggtgcgtcacctggttttgcctacgtgactggcttcagttttaggtacgatttgcttgagaaggccacaaactatttcgatcccgcaaacaaattaggggagggtggagctggttctgtgttcaaaggaaccctgccctcgggagggaccgttgctgttaaacgactgttttttaatgcccggcaatggacagaggggttcttcaatgagctcaacttgatcaatgagattcaacacaagaacgtggtgaagcttttggggtgcagcattgatggtcctgaaagccttttggtttatgaatttgtgccccgtggaaatcttgatcaagtccttttcggtgagttcttcacttaa

SEQ ID NO: 84669 - DNA, 417 bp, Glycine max
  Peptide Sequence Number=SeqID_201447
atgatacatacaacagcaaggagtgagactcagctgagcataaaccacttcaacgatttcgtagtgcaaatgaaacgaaggaggaggagggctttaatagggaagcgtagaaggaagccaacacttcctaatcctgtcccacctcccctgccacctagtcacgccatgccacgtgttgctattatggagaagcggccaacagaaaagcacattgtaataaaaaaacagactcacgaagtaaataatttcataacagacccatttagatcggttttcgagggagggctttgtttgttcgctgctaattgggccacgaactggcgtgagaattcttcgaaacttgtgatcggtccgtccctcaaaccactaaaccagtcaagagctataccggttagggttcttgggcatcatcagtag

SEQ ID NO: 84670 - DNA, 807 bp, Glycine max
  Peptide Sequence Number=SeqID_201448
atggaagctcctgacaactcagaagccaccgttccatataattctccaaaactagctggaacagttaactggggcacggcaactgtcgttggagtatttgcaggcatgttatatggcggtagcaaggaggcagctgcttctgttagcaaggatgcagaagttatgttgaaacttgggagcacagaagacaagcgtgagcaatatcgattgatgagagatgcaatggagaaacgattcattcgagttacacggggctcaatagttggaggggtacgcctaggaatattcactgctgcattttattgcttacaaaatctgcttgcagagaagagaggtgttcatgatgtttttaatgttgttggagctggatcagccactgcttcagcttttggtttaatcagatcactccgttggcgagcaaggaatatggcactagggtcggtgctgggagcagcattttgctttcctcttggttggatccatctgaagctggtagaaatggctaatgaaggtaatccagctgcacatccacactcagatcagagacaagtgaagagtggggttagtgctgcaattgagaggcttgaaggaaatttaatacgagtcaacttatccagacaatctaagccaggcattctggaaaagctaaaatcaatggaagagctgattgggctacttaacctgttatcaatggaagaacgttgcagattaatagcgtcaagccttgctcattctagcttagttatgacttcggagaacattacagaagaaataagagtgaggggaattacgggtagctccttttag

SEQ ID NO: 84671 - DNA, 186 bp, Glycine max
  Peptide Sequence Number=SeqID_201449
atggcgatgaagcggtggcgtggacggcggcggcgagggagaggggaaggagaggagggcgaagagggtgcgcgtgcagagggacgagacggaggcgtcacaggactcgtgtcagacggcgacgcgtgcgacgacctcgaggtggaggacgcgggatcggagggggaagatgaggttgaaggctag

SEQ ID NO: 84672 - DNA, 549 bp, Glycine max
  Peptide Sequence Number=SeqID_201450
atggctcctgagtatgttatcaacggacaattgacagaaaaggcagatatctatgcttttggggtattggttattgaaattgtcagtggtaagaagaacagtgattatataccagagtcaacttcagtactccacagtgtgtggaaaaattacaatgcaaatattatcacatcatccgttgatcccactctacatggcaagtttacggcagaagaggcatcaaatgcactccaagctggccttctttgtacacagtcttctgatactctcagaccatccatgtctgaagtagttcagatgctaacaaagaaagactatgttattccctccccaaatcaacaaccattcctcaattccatagcccgcattctatcctcaaatgggcatgcaagtgcaagatcctccttccacagcaccaccagttccctaattccaaatgatgatgtaacagtacttgagaattcattttctccttattccaggttcaaccctacggggagtcctgactcaaatatccaaatattggggtacctgagccaaggtaggtga

SEQ ID NO: 84673 - DNA, 393 bp, Glycine max
  Peptide Sequence Number=SeqID_201451
atggaagacgctgggatcgtgactacaaggcacccagtggacccggaggagcccaatagggccctggggtttccagctctggctacaggcctctgccagtcctacagggcgcccgtccccccagcatgttcatgccatcgtgacataggtgagtatgcacatctctcaactgatttccgatgtcatctattgtttgtggggatcacgcttgcaagacactcagtggacccagagaagtccaacagggtcttggggtttccagctctgattacgggcctctgtcaattctacggagtgcccgtcacccccagcaaggtcatcaggcctcctactaaccgagctttcatcaagaagtattgcgcccccaggcaggcagagggcgagacaccataa

SEQ ID NO: 84674 - DNA, 354 bp, Glycine max
  Peptide Sequence Number=SeqID_201452
atggctggagaggctcatggacagagttttacccaacttgatagaaggaatgtggaggcttacgttgacgatatggtggtgaaatcaactttggaaaacatgcatggagccgatctacaagaaatcttcgatatgatcaacaggtaccggttgaagttgaactcgagaagaaatgctcgtttgacattcaagcaagagaagttcctcaatttcatgctttcacaaagagggatcgaagctaacctagataaatgctttgcgatcgttgtggagtccaaacagcataaaggaagtacaataatagttaataggtcagattgcttccttatctggctttctttcaaaatctggtga

SEQ ID NO: 84675 - DNA, 579 bp, Glycine max
  Peptide Sequence Number=SeqID_201453
atgacttgttctagaaggttccgaaatggacgctacaaaactactgcacaaaaggggggggaatggacgctacatatggaaatatgtggtgaggcgatacagggaacaaaaatgtcttctatagaaatagtggatttatgcaatagtgatgatgacgaagtggaaaatgtaggttccgaacctgcaaagaaactaattgaaatcaagaaggaaacatgccaagtaacggagaatataatacaagtagcgtctgaaggaaatagaagctctagtgctctaagcacttgtcatagctattccactcgtcaaatggaagaaatggtagcgccgttgtatgttgacgttgatgacacaactggtctttctctgccaccattttgtagaaacttctggagagctggataccatcatgataataatggcctttcttctaaactcaacttcccaaatactggaaactacttgcatgttcaccctttcttccttcactcaaatgcaacttcacataagtgggtatttggtgctattgctgagcttatcgataatgcagttgatgaggtgattctcttcggtgcttga

SEQ ID NO: 84676 - DNA, 255 bp, Glycine max
  Peptide Sequence Number=SeqID_201454
atgaaggggaaggctcctatgacggaaatatcctctgttgaggttgaaaaggggtcaaaggttgatagggagaaggaactccgtacgattcaataccttcaacaaattggtgaaacctttgtttttgggggaatcaatcgtatatataatatggttggaaaggtgtatgaagtaggttcaggactgattggtgctagtgaggatttacaaccagtgtgtgtgtgctttttgacacttagagcactatctggatga

SEQ ID NO: 84677 - DNA, 516 bp, Glycine max
  Peptide Sequence Number=SeqID_201455
atgagggcgagccctggtgcagcggtaaagttgtgccttggtgacttgttggtcatgggttcgaatccggaaacagcctctttgcatatgcaaggaaaaattgggtgttacaatgacaaccataaggtgagagtaatccttcgacttaaagtcactatgattcctatatgtatgagtaaattgaaggctttaacgctatcaaacgtcatatgtaacacggtgatcataaaaagagtacttgggcttgaaatgaatcattttgaggaatgggaggtaggagagtgtgggggtcgtgtcggagggaggagagggtggaggtttgtcgcatggcggagagttcaaggtgagggagcagatggtggtggtgagtggtgcggtggagggtgtgagtgggggcgggtgacacaacggagggtgagggcaaactggcaaaggaatgcaaacccaatgtctactctagagtctagggaggaaatggacagaggccatatcaagccgaaaaaggtagagaaataa

SEQ ID NO: 84678 - DNA, 435 bp, Glycine max
  Peptide Sequence Number=SeqID_201456
atgtttaatcaccatggacagaagcttacatcaacaaatagaagaacacaaaatctgtcttctatgaggacttttcacaaacactttgtgaatcaagaacaaccaaggcttaaccatccatggcagaagctaaaacaatacttaaccaccttggacaaatgcaaaaactgggcagtgctagacatggagagaaccttgagatctaccaaactcaaggtcatcaaattcaacatcaagcctgagataatagttcgatatgcatcctcgtcagcaatcaccactcacgacagaggaaggcggtgcacagcggccggcctcacggcagaaaaggccaaaaagatagaggggttttgttgcggagtaaagcagcagttgaaaattgttgtcccggcgaagtacgaggttggaaatcgccagtgtgataaagcacggtga

SEQ ID NO: 84679 - DNA, 141 bp, Glycine max
  Peptide Sequence Number=SeqID_201457
atgaccctgactggtctccatatgattttacctagtgagagtgacctgacttaccagggcatgaagcagatggttaggtggattgcttcaaggaacattgtgctgaaggacatcgggacacaatgctctgataggatatga

SEQ ID NO: 84680 - DNA, 735 bp, Glycine max
  Peptide Sequence Number=SeqID_201458
atgagacgtgtgttccaccttggaagtaccggtttctatgtggagtttataaggccttggatgctaactatagcaactagcttttgtagtgtgatgctcccaagtctacggatagagagtaatctctgtaagggacttgtgtgtctgggacagcaaccattttggaaggttgtaaactatacaaatactaggggtagaggagttgttggaatcttgcaagcagattatcttgagccaactcataataagcaggattttgagagaacttccctgtttcaaaaacttgaactacgcctgaagcaaatgacatgggagtactgggattatcactgtcatctgattgggtattgtaaaagaagcactggagatccaggtgctcctcttaataaaaggaagacacatggatctatagaccttcataagatgaaaaggcaagcaatgcaagaaaatgttacagttgctggatgtgatcagaatgtactgacaactgcatctcctacagaccagacggtagaccaaagaattataaacttgatggaagtgcagaaaaaactcttgaaagaatgtttgaaatatgaaaaggcagaggaagaacttaatcttaaggttacacagcttagaagaaaaactcaggaagctaagcatgagtatgatacacttatggccgaagtaaagtcccttggattatatttatgggaagaaaatggtagtgtagctgtacctcttgttttttag

SEQ ID NO: 84681 - DNA, 2817 bp, Glycine max
  Peptide Sequence Number=SeqID_201459
atggccaataatgcaacagattcctacttgcttctcaaagttaaatcagaattggtagatccattaggggcctttagcaactggtttccaacaactcaattctgcaactggaatggaataacatgtgcagttgatcaggaacatgttataggcctcaatctgtctggttcaggaatatcaggttctatttcagttgagttgggtaacttcacttctcttcaaacacttgatttgtcttcaaattctctttctggctccatcccttcagaactgggtcagcttcaaaatctaagaatattgcaactatactcaaatgatctctctgggaacattccttcagagataggtaacttgaggaagttgcaagttcttagaataggagacaacatgctgacaggtgaaattccacctagtgttgccaatatgagtgaattgaaagtgttggctctaggctactgccacttaaatggaagcataccctttggaattggtaaattgaagcatctaatatctcttgatgtacaaatgaacagcattaatggccacatacctgaagagattgaaggctgtgaagagctccaaaactttgcagcatcaaacaacatgcttgaaggagacttaccttcctctatggggtctcttaaatctttgaaaattctgaatctggccaataacagtttatctggatcaattcctacagctttgagtcatctttctaacttgacatacctgaatttgctaggaaacaaactacatggagaaattccttctgagcttaatagtctgattcagatgcagaagctagacttatccaaaaacaacctctctggatcaatacctcttcttaatgtaaaattgcaaagtcttgaaactcttgttttgtctgataatgctctgacaggtagcattccaagtaacttctgcctcagaggttcaaagcttcagcaacttttcttggctagaaacatgctctctggcaagtttcccttggagctactcaactgctcctcaatccaacagttggacctttctgataacagctttgaaggaaaacttccttccatcttggacaaactgcagaaccttacagatcttgtgctcaacaacaacagctttgttggatctctacctcctgaaattggcaacattagtagcttggaaaatcttttcctatttggtaacttcttcaaaggtaaaattccattggagattggaaggctgcagaggttgagctccatttacctctatgacaaccagatgtctggacttataccaagggagttaacaaactgcacaagcttaaaggaaattgacttctttggaaatcacttcacagggccaattccagaaactataggtaagctcaaggacttagttgttcttcatcttaggcagaatgacttgtctggtccaatcccaccaagcatgggatactgtaaaagccttcagatattggccttagcagataacatgttgtctggttccattccacccactttcagttacctctcagaactcactaaaattaccctttacaataactcctttgaaggacctatccctcattcactctcctctcttaaaagcctcaaaatcataaacttctcacacaacaagttcagtggaagtttctttcctctcacttgttcaaattccctgacccttctggacctaactaacaacagcttctcaggtcccatcccttccactctagccaattctagaaacctcggccgtctcagacttggacagaattatctcacaggaaccattccttctgaatttggccagcttactgagctcaactttcttgatctatcattcaacaatttaacaggagaagttccacctcaactctcaaactccaagaaaatggaacacatcttgatgaataacaacaggttgagtggtgaaatatctgattggttgggaagcttacaagaactcggtgaactagatctctcatacaataacttcagtggtaaggtaccttctgagcttggtaactgctcaaaactactcaagctttctctccatcacaacaatctctctggtgaaatcccccaagagattggaaacctcacttccctcaatgtcctcaatttgcaaaggaacggcttctccggcctaattcctccgacaattcagcaatgcacaaagctgtatgagctccggctctcagaaaacttgttaacaggtgttataccagttgagctaggagggctagctgagttgcaagttatattggacttgagtaaaaatctcttcactggtgagattccaccttctctaggaaaccttatgaagctagagagactgaacctttctttcaaccaacttgagggaaaagttccttcttcacttggcaaactcacaagcctgcacgtgttgaatttatcaaacaaccaccttgaaggcaagattccttcaacattttcaggattcccactaagcacattcctgaacaatagcggcttgtgtggtccacctttgagatcatgctccgaatccatggtgcagggaaaaattcagctatcaaacacacaagtggcaataatcattgtggccattgtctttacttccacagtgatatgcttagtgatgctgtatataatgctcaggatctggtgcaactggagaaaagtgacaatttcaagtgcagagggtggtggcactgttggtcacaagacaagaaatggagagtattggaatatgaattcctttgggttcatcccttcaccagataagcagaattcagcaacaacaacttcattctacaatctcaaaatggaaacaatggaaaatacaaatatgtaa

SEQ ID NO: 84682 - DNA, 213 bp, Glycine max
  Peptide Sequence Number=SeqID_201460
atgaagcaaagcccttgtttattttctctttttttcctttacagatgtttggaatatgaaaaggcagaggaagaacttaatcttaaggttacacagcttagaagcaaaattcagaaacctaagcatgagtatgatacacttttggctgaagtaaagtcccttggattgtgggaagaaaatgataatgtagctgatgtacctcttgcgatctag

SEQ ID NO: 84683 - DNA, 282 bp, Glycine max
  Peptide Sequence Number=SeqID_201461
atggagcaagagttacaggaactacatggctattccattggccaggtcaaacccattgtgaccattggaattgtaatactaagctgtctaatcatcagggaagcaatagaagagaagtattcctttaccaaatgcagggtcagagaatcgctgttgtttgcagaaggatcatccagttgtttgggtctcaatggtctagtagaagaagaaaaatcgcaactccacaatagaaaattgcttcttgtgagaacaataggaggaaaactggagcttaaaaattaa

SEQ ID NO: 84684 - DNA, 333 bp, Glycine max
  Peptide Sequence Number=SeqID_201462
atggtaaacatgacacacagttcatctgctcttggtctcagtaagattattaacttacatgaaatagaattagactcctctaaatcgcagggaacagttcagagttggaaacgagagtgtaccggatatagctggaaaatccgtcgcctcggagaaaccctagagaagcaattgcagaaaggtgcgaagagaggggaaggagagggagatctgtgggagttagaggcgatgggtttcggatcggagaggaagagaagggttcgctggagaatgagaaagagaaaaaagaaagagctgaaagacgtaacagttgagttaccttaccatccgtga

SEQ ID NO: 84685 - DNA, 1611 bp, Glycine max
  Peptide Sequence Number=SeqID_201463
atggaagtccccaaatccccttccaaatacaaacgaatcgccaaacacaaatggctcataaaattcgctttactcattctgatgatgctgttattgtttctgggtttttatctcgagtcagatactaggggaaaactcaatgcgtcgtcgtattacaccgtggttgtggattgtggaagcaccgggacacgtgtgaacgtgtatgagtggatggtaggggtaaagggaataagcaaagggaacttgccaagtttgctgcactcttatcctgataatacaaccaggagtagctcactctggaaaaattcttgtcaatatcactgtatgcaaaccgaacccgggttacacagctttgttaatgattctttaggagtgagaaaggctctggagcctctgattgtgtgggcagaacatctggtgccgcgcgaaatgcaccggaaaactcctgtttttgtcttggctacagccgggttgaggaggcttcccgggttggaggcggaatgggtcttgggagaggtcgaggctgttgtgaaagatcataactttatgtttagcaagagctggataagggttttgagtgggagggaggaagcctattatggttgggtggctttgaactacaaaatgggcagcttttatagctatcttgactctcccactttgggacttgttgatttgggtggctcttcgttgcaggttgtggttgagactgatggtgctggggatgatgtgcatatgatgagatcgaagctcagctcaatggaacatcagattatggcgttctcattgcctgcatttggcttaaatgaagcgtttgataggacagttcttatgctcagaaacaatcaaagtgaggaaagaactgagctcagacatccttgtctggtctcaacttttctacaaaactatacatgccattcttgctctggattggcttccatttatcagaaaaatcgcagccaacaccaggaaggtgaacttcattctttacgtcttactggagaacctgattgggagcaatgtaaagaactagctattgctgctgctatgaacttgagtgattccaaattgtcacagacagttagcaaaaattgccaagctagttcattttctggtattggtaagggcactggtatacttaatttaacagctgttgcacacccaatcaagtttcatgctttatctggcttcttttttgtctacaataagctaaagttaagcccaagaaccaacttaacaatggtttgggagtcaggcaagcaattatgttcaaatttatggtctggtttgagcaatgtttctgacaatccaaagtatgctggacaattttgcttccgggtggcttatatggcatcattgattgaatatggtctgtgtcttggtgatgttgaaatggtatttggtccaggtgacatttcgtggaccttaggagctgcattgattgaagggaaatttctgtgtcaagttaagctaccaatgccaagcaggagggcttctgctcctggctcatctttgccatcttatactcatccagaggattctgacatggaatatggattatatttgcactataggattgaagctgaactgccctcttttcaagctctttaa

SEQ ID NO: 84686 - DNA, 1131 bp, Glycine max
  Peptide Sequence Number=SeqID_201464
atgccatcaacagtgagggatcacgggattgttcggaggatggcaagtctccctcgaagcataatggagtttataggaagaggaagaagaagaaatcagcacacaaattttcctttgcagcctcaagaccaccatcatgatccacaaccacatggtcaagtagtagttcaagatgaatggagttttctagagagttttgagcagcaatttggcaccaaacatcctttcttctatgcttgccggttcatggaagctattaagttagctgagcatgatcacaagttcttgttcatgtacctccactcgcctgaccacccttttgcaaacgttttctgcaaggaaacgctgtgttcagagccggtgatccagtttcttgatgtgaattttgtttgctggggtggacttgtggatagaggagagggtgtgcaaatggtagcaacactaagtcctgctacttttccttgttgtgctgtcatagcccccactcctggtgagagcatagcagtgctgcaacagctagagggacccctttcgccagctgagctagcagggattctacaaagaacattggaagaacaaggggtggcttttggaagtgatagggctaagcaggaagaaaagatccgagcagaccgtaggcttagagaagagcaagatgctgcatatcttgcagctttgcaaattgacaaggaaaaagacaaaccgaatagtttacctccaagagagagacttcagaagccgggtgaagctcacaacaacagaaattatgggaaattgttgaacaattctatcaatgtcactaaacagaacagcaaagtgaatgagtccaataaagaaaaacgagacaagggagttgcaagtaaaggaagcgagtctcagcccacacagatactcataaggtttccaaacggggaaagaagagagcatactttcctttacacagacagaatccagtccattttctcatacattgattcattaggtttgccatggattggaaactacagattgatatcaaattttccaagaagagcttatggagttgatcaaatgagaatgactctcaaagaggctggcctgtatcctaaagctagtgtgttcctggagcctttaggaactagagtcccataa

SEQ ID NO: 84687 - DNA, 651 bp, Glycine max
  Peptide Sequence Number=SeqID_201465
atgcagacagacgaagagacagagcaaaagatcaaggaacacaaagacaccaccagcgaagacgcttgtcaaacccaaggttcgtccttggtaagccttgaaaaaacccaaataggtgcatccctagttgtagctccaaaggctcatcaaacccaaggtctgcccttagggagtctcactcccaaatgctcgtcaaacccaaggttcgtccttggtgagtcacctttctccaaagactcgttaaacccatggcctgcccttggtgagtcttgcttctccaaaggcttttcaaacccatggcctgcccttggtgagtctcattctccaaaggctcatcaaacccaaggtttgtccttgctgaatcttgcttctccaaaggctcatcaaactcaagttttgtccttggtgagtctcgcttctccaaaagcttgtcaaacccaaggttcttccttagtaagtctcgcttctccaaagactcatcaaacccaaggtctgcccttggctcttcaaatcaaaggttcacccttggtgagcctcgatgcatctgtacaggcttgtcaagcccaaggtccacccatggtgagccttgccaaaacccaagacgaacacatccctggtctgaagctcattaaacctaatgtccacccttag

SEQ ID NO: 84688 - DNA, 1383 bp, Glycine max
  Peptide Sequence Number=SeqID_201466
atgaagggatattcagtttcctggacaaaacaacatcagaaagagctattttttgcagctcatcacacaacaagacaacaccaatgcatacaagcaaatcatgatgccacagaagaaacaagctcacagcaacaaaatcaatattccctgaaattggctctttcttccacttcccaaaatactatgctacatgcttttgttgctttgctgctacttgttacttcaattggcacagcattctctcaccccaccattgcctccaattcttcttcaactttgccagcagcactctctcacttccatgctaataacaacacattgagaccttctgcagtgttgcaaaagttgaggagaatcagagctcatctcaacaagagcaacaagcctgctagtccagatggggatttgattgattgtgttttgtctcatcagcaacctgcttttgaccatcctcaactcaaagggcaaagaccattggatccaccagaaaggccaaagggtcacactcacaccaatggagaaacagtcatagagagctttcagctttggactgattctggtgaagcatgcccagaaggaactgttccaatcagaagaacaactgaacaagattttctacgagcaagctccgttagaagatttggaagaaaaccaagaaatgtacggagggactccacaggcactggtcatgagcatgcagttgtttctgtaaatggagatcaatactatggagcaaaagcaagcataaacgtgtggacgcctagcgtaaccgatccatacgaattcagtttgtcacagatatgggtaagtcctgagctatatggagacaactatcctaggttcttcacttattggacaacggatgcatatcaagcaacaggatgctacaacttactatgttcaggatttgtccaaaccaacaacaggatagcaataggggctgcaatctcaccaagatccatctacaatggcagacaatttgatattggattaatggtttggaaggacccaaagcatggacattggtggctggagtttgggtcggggcttctagttgggtactggccagcatacttgtttagtcacttgagaaaccatgcaagcatggtgcaatttggaggggaaattgtgaattctcgttcaaggggctaccacactggcactcaaatgggtagtggccatttttcaggagaagggtttagaaaagcagcatattttagaaacttacaagttgttgattgggacaataacttgcttcctctatcaaatattcaccagttggctgaccattccaattgctatgacataaggatgggatcaaacagtgtttggggaacttacttttattatggaggtcctggaaggaatgtgagatgcccatga

SEQ ID NO: 84689 - DNA, 2898 bp, Glycine max
  Peptide Sequence Number=SeqID_201467
atgcctgtaaatccatggaccctcttcttcttatgcatttcccttcttctacttccattccattctttcatagctgctgcagtgaaccaacaaggggaaggtcttctgtcatggaagagaaccctgaatggatccttggaggtattgagtaactgggacccagttcaagacaccccatgtagctggtatggagtgagttgcaacttcaagaaggaagtagtacaattggatctgaggtatgtggatttgcttggaagacttcccactaatttcacctcattgctttccttaaccagtttgatcttaaccggaaccaacctcactggttcaatcccgaaagaaataggtgaacttgtggaactcagctacttggacttgagtgacaatgccttgagtggtgaaatcccaagtgagctatgttacttgcccaaactcgaggaactccatctaaactccaacgacctcgtggggtccattccagttgcaattgggaacctcatgaagttgcagaagctgatcctctacgacaatcaactaggcggcgaagttcccggcaccgtcgggaaccttaagagccttcaagtgttaagagcaggtggaaacaagaacctggaaggtcctttaccacaagaaattggcaactgttcaagtttggtcatgttgggtcttgctgaaacaagcctctcgggttctctcccaccaagtcttggctttttgaagaaccttgaaaccattgccatttacacttccctactctcaggtgaaataccacctgaacttggggactgcacagagctccaaaacatttatctttacgagaactccctcactggatccataccaagcaagttgggaaaccttaagaaactcgaaaaccttctcctgtggcagaacaacctagttggaacaatccctcctgagattggaaactgcgacatgttgtcagtgattgacgtgtcaatgaactcactaacaggaagcatccccaaaactttcgggaacttgacatcactgcaagagcttcaactcagtgtgaaccagatttcaggtgagattccaggagaattggggaagtgtcagcaactcacgcatgtggaacttgacaacaatctcatcacgggtactataccttccgaattgggaaaccttgcgaatctaactctgttgttcctttggcacaacaagctgcaaggtaacattccctcttcacttcccaattgtcaaaacctagaggctattgatctgtcgcagaatggattgacgggtcccatacccaaggggatattccagctcaagaatctcaacaagctcttgctcctctccaacaatctctcggggaaaatcccttctgagattggtaattgttcctctcttattcggttccgagccaacgacaacaacatcaccgggaacattccctcgcagattgggaatctcaataatttgaatttcctagacctagggaacaatcggatttctggagttctcccggaggagatctccggctgccggaatctagcttttctggacgtacattccaacttcatcgccggaaatttgccggagagtctgagccggcttaattcgcttcagtttctcgatgtgtctgataacatgatcgaaggtacactaaaccctacactcggcgaactcgcggcactctcgaagctcgttctggcgaagaatcgaatctccggctcaattccgagtcaactcggttcttgttcgaagctacaattgctggatctcagcagcaacaatatctccggcgaaatccctggcagcatcggcaacattccggcgctggaaatcgctctgaatctgagcctgaaccagctctccagcgagatccctcaggagttttccggcttgacgaagctcggcatattggatatatctcacaacgtcctcaggggaaacctgcaatatctcgtgggcctgcaaaatctcgtggtgctgaacatatcatacaacaaattctcgggacgcgtcccggacacgccgttcttcgcgaagctcccgctgagcgtgctggcggggaacccggcgctgtgcttctccggcaacgagtgcagcggagacggaggcggcggcgggaggtcaggccggcgggcgagggtggcgcgcgtggccatggtggtgcttctgtgcaccgcgtgcgtgctgctgatggcggcgctatacgttgtggtcgcagcgaaacgaagaggggaccgcgaaagcgacgtggaggtggtggatggaaaggacagtgacgtggacatggccccaccttggcaagtgacgctttaccagaaactcgatctgtctatctctgacgtagcgaaatgtctctctgctggcaacgtcattggccacggccgatccggcgtcgtttacagggtcgacttgcccgccgccacgggactggccattgcggtcaagaagttccggttgtcggagaaattctctgcggcggcgttctcgtcggaaatcgccacgctggcgcgtatccgtcaccggaacatcgtgcgcctgctgggctggggggccaacagaagaaccaagttactgttttacgattacttacagaacggtaacttggacactctcttacacgaggggtgcacaggattaattgattgggagacgcggctcaggatagcgctgggcgtggctgagggtgtggcttacttgcaccacgattgcgtgcctgctatcttgcaccgggacgtcaaggcgcagaacattctgttgggtgacagatatgaaccctgtttggctgattttggtttcgctcgcttcgtccaagaggatcacgcttccttttccgttaatccacagttcgctggctcctacggctacattgctcccggtagagttagggtggatattgggattttttcacatgaattttga

SEQ ID NO: 84690 - DNA, 747 bp, Glycine max
  Peptide Sequence Number=SeqID_201468
atgtgtagatgccatagaaatttgggaaatcttagaagtgactcgtcaagaagtgctaaagttgatgtctcgctaagcgagctcaatgcgctcagcgagtgtcatccgctatgcgaggcatcaaagcgcttagccgataggaggaatctggaagggaatctgtcacgcaggcacgcgcttagcatgtcatcaactcgctcagtgagtcatttgtcaccttctaggcttagcgcgagtttgtcgatgagcgaaagttcacttactcgcgctaagcgcgacgtcgagctcttggaaaaacatttgaaagagaggcattcaatgtacaagttccaaaaagtctcaatagagcttggcaacccaaaagaagagacaaagggaaatttcaaaagaatagcacaaaaaatctatacatgctttgagtgtgagaaacaagatcacataaaggtgggttgtccaaccttccttaagaagcaacaaggaggtgaaaagatgtcattcaagaagaaaagagcatacatagctttggataacaatgatgaaagttcctcaagagactcaattgaggaggaagaagctaatctatgtctcatggccgaatttgataaagatgagactaaaataaatgtaagtgactcttcttccaaatccaatactaattatgacaatctacttgaagcatttaaagagttaaatgaagaggcacaaagactcaactttgtgaacaaaaactctaaaaggctaagttaa

SEQ ID NO: 84691 - DNA, 432 bp, Glycine max
  Peptide Sequence Number=SeqID_201469
atggtaccagtggtgagtgaagagcgttgggatggggtggttgtgacccaatcaaacttcctagcacttcaagcgttcaagcaagagttggttgatcccaaaggcttcttgagaagctggaacgacagtggctatggagcttgttctggagcttgggttggcatcaagtgtgctcagggacaattcattgtgatccaacttccatggaaggggttgaagggtcacataactaagaggatttgccaacttagggggcttataaagcttagccttcatgataaccaaattggtggttcaatcccttcagcacttggacttcttctcaatctaagaggggttcatctcttcaacaataagttcacagggaccatccctccttcgttagggtcatttcctttgcttcagtctttggacctcaacaataatttgtaa

SEQ ID NO: 84692 - DNA, 134 bp, Glycine max
  Peptide Sequence Number=SeqID_201470
atggcaagcacaaccaaaacttacattgtcattgtgagtacaaagacgagcaaaaactgcttcgtgccaatggaatggctacaaggaaaccaacgaagctcgttcaaagacaatagcagtgacttgaggatggg

SEQ ID NO: 84693 - DNA, 462 bp, Glycine max
  Peptide Sequence Number=SeqID_201471
atgactactccacccaactctcctcatcctcctcctcctcctactgatgcaacatcacaatcgctatctagcttgaagcggacaagaaaagccacacaactaagatcattggtgactagaccagctggggcagagagactcgtggtccatgtcaatcctgcgaccaagaaggccgacggtcctcacaaaaagaagttaaaaacatatttggggatcatcactcgtgataaggtcgatgtgacatacgagaattggaagcaagtccctactgctcagaagcatttgatatggcaggatattcagattgtgggggagtggtggagacaatttaagtctgatttgacatcgaaatggacacttgcaaccgacaaggacaatgtcgatgacactatatgcaaaaaatacgacattagcaaggagaaatgggcccaattttgtcacagctgcaaagacccttcgtga

SEQ ID NO: 84694 - DNA, 672 bp, Glycine max
  Peptide Sequence Number=SeqID_201472
atgcaatcacagggacttgcactacctcctgagcctgaggttgttccttcatctgctcgtgtcagcacaaaggaaagttgtgttgatcccttagggaatgatccagacacgggtgacttagacaaatgcgggttgtacatcgaagaacatcctccccgcctggttgccctaggaagagtttatgagggatccacaatcgttcacaacatccctttgttgcatgatcaagtgaaggttagtgttgaggacgttagagatgcagatgctcctattcctgtacccactgaagaggttaatttagtgggaaatgcacttaacaccttccttgcttggtcgacacatctcgtcaaacgtttttcagaacatgatgctaccgtgttcggggtgtttaatgaagacttccctttgtacataaaacatgaagatctatctaaaattgcacatggtgatcaatgtctcaacatctttgttatacaattgtggattcttgcacataggcaaatggttgtcattttgcctaaggaaaatcttgtcgtctggttttgttcattgcataataggcctaattttgtcatatatttcaatgatgctagaccactggaactagagagattgaaggcgtttcgcatccagtgggcaaagtattatttgaaagttagaaatgaaacttag

SEQ ID NO: 84695 - DNA, 422 bp, Glycine max
  Peptide Sequence Number=SeqID_201473
atgaccggccctctcgatgagtcaatctcttgctttctcataagggtggacccttgggtactagtacctattgcctttattagagggctgcacgcccaagccttcagaggattgcacatcctcgccttaagagggctacatgtcctcgccttcagagggctgcacaccctcgccttcagagggctacacgccctcgccttcagagggctgcacgtcctcccctacagagggctacacgccctcaccttgagaggactgcacgtcctcaccttcagagggctacacgtcctcgcctttagagggctacacgtccttccctttagagggctgcacgcccttgccttcagagggctgcacgccctcgccttcagagggctacacgccctcgccttcagagggctacacgtcctcgcctttagagg

SEQ ID NO: 84696 - DNA, 361 bp, Glycine max
  Peptide Sequence Number=SeqID_201474
actcatcttctccttgaagcggcgtctcctctctctcttccttctccattccgctgcccttcatcttccaagaagcaaaggaagccattgatgaagaagatcctaggtctacaagctccaatggagcttacatcaatacccaaagaagaagtgtgcacaattgctattcgtatattggcttatggatcacctgctgacagtgtggataaatacgttcaaattggtgaaacaactgtagtggaatgcttagagcgatttgtatcaggcatctgtaccatatttgggaatgaatacttgaggagaccaaataacaaagacaccaaacgaatactacaaatgggcgcgacacgcggatttccag

SEQ ID NO: 84697 - DNA, 501 bp, Glycine max
  Peptide Sequence Number=SeqID_201475
atgggagtaacaaagaccttagcacgcattggtgaaaattttacttggtctggaatgaagcacaacgttagtcaattcgtagcggcttgtgttgactgccagtgcaccaaatatgtcaatcgaaaacagggagggttactctgtccccttccaatcccgtctcacccatggaaggatatctcccttgatcaattctccaaagggatacacctaggcattctccagacgcacttcactgcttacacagttgcactttttttcatggacatcatggacaaaatccatggaatgccctatagcttaatctcagatcaatacccgttgttcatatgccacttatggcaagaattgtttaagctcagtggcacgaagcttcgcatgagctcggcctatcatccacaaacggatggacagacggaggtgcttaatcgagtggttgaacaatatttacggacctttgttcgtcatcagcctgcgtcctggggaaaacttttgatgtag

SEQ ID NO: 84698 - DNA, 480 bp, Glycine max
  Peptide Sequence Number=SeqID_201476
atgggggagacacatgaaatatcccatcgcaatctagcagacttcgagcctcacctcggatatgccactaaagggaaagcagttggtggtgtacccctgcaaaacactttggagagccctcaatttcgcccccaaccacaacccttgcattctgcaacaggaaaaatcccccttgctatggaaaaaatgggaaagttggatcatctagaggaaaggcttagggccattgaagaaggcagatattatgcctttgctaacataaaagagttgttcctagtacccaacatggtcattcctccgaagttcaaagtgccagagtttgataagtacatagggactgcttgccctaagaatcatctgaaaatgtactgtcagaaaatgggggtgtacgcgaaagatgaaaagctgctgatgcatttctttcaagagaaccttattggggcggccatcacatggtacactaatcttgaaccctcctga

SEQ ID NO: 84699 - DNA, 243 bp, Glycine max
  Peptide Sequence Number=SeqID_201477
atgaaaaactccccattgaaaatttccttgagacataaatgcacaaaaatatcccttcctgtacctttgcatcctcttggtatgtctgtttcggtttttaatgggttaaatttttctggttggagcgaacaagtccaatttcacttaggtgtgtcagattttgatttggctcttcaagttgaaaaacctgctgctattactgatgctagtagcaatgaagagaaaacccattataaggcctag

SEQ ID NO: 84700 - DNA, 771 bp, Glycine max
  Peptide Sequence Number=SeqID_201478
atgagtgaaataaaggaggtgcaagagcagatgaaggttgacatggaggccatgaaagagaaaatgaccacaatgatggaagccatgatgagtatgagaaaaatgatggaggtcaacatggctacagtcattgccgtaagtaccgccactgaggtggacccaactcactcatttggcctcaaccaagtccaaagcaagaattccttcccaccatatggcttgcctcccaactatacaccacccaatgttgcacacgctcccgatgagaatgtcgataactctgctcctatactcattgagagccaacaaccccaatctggtcaggcacaagtccctcaacccatgggggagacacatgaagtaccccgaggccacactttagccgactccgagccttgcctcggatatgccactgagaggcaagcgtttggtggcatacccctgccaaacactttggggggcactcaatatcgcccacaaccacaacccttacattttgcggtggaaagactgcctcttgccatggtggaaaaaggaaaatttgatcacatagaggagaggctgagggctattgaaggaggcggagattatgcctttgctgacatggcagaattgtgcctagtgcccgacgtcattatccctccgaagttcaaggtggcggatttcgataaatataaggggactacttaccccaagaatcacctaaagatgtactgcaggaaaatgggggcatacgcaaaagatgaaaaatcattgatgcatttcttctag

SEQ ID NO: 84701 - DNA, 444 bp, Glycine max
  Peptide Sequence Number=SeqID_201479
atgggtggagaagggaacggtaaacagcaaagctacgcgagaacaaattggagggaccatcacaacatttcttcgttctacttcacccgttttcccgaagaagcaacggaggctgaactatggcaacatttcaaaaaagtgggtgatgtaagagaggtcttcatttccagaaagaggaatagaagtggaaggagatacggctttgcaagatttaagggagtggatgatgtgaaacagctagagaggaggttggataatattgttttgggagagacacacatgaagggagacaaccagaaactagagctcaggcaaccaccagacaataggtacaagaagggagaggggcgtatcgggcacagaagtttccagcggcactgggattcaagcacagaacttttgcggatgtcgttgcacggagaaattcaagaagggaccacctga

SEQ ID NO: 84702 - DNA, 186 bp, Glycine max
  Peptide Sequence Number=SeqID_201480
atggtgatgtttttgagaatgatgatgttgaacgcattaaatctgccacaggctttgcctttccaagagctgccttggatcaagtctccacatcatactattggactgagttatgggcttagtgaaagaagcaaacttgtccttgacagagctcctcctaatctaacacagacttttctgaaatag

SEQ ID NO: 84703 - DNA, 588 bp, Glycine max
  Peptide Sequence Number=SeqID_201481
atggagtaccgcaacaaacttgttctcgctcctatggtccgcgttggcactctcccatttagattactagctgctcaatatggtgcagatatcacttactgcgaggaaatcattgaccacaagatgctaaagtgcgagcgccgaattaacgaactcattggatccactgattttgtggagaaggggacaaacaatgttgtgtttagaacctgtgatgaagaaaaagatagggttgtgtttcaaataggaacatcagatgctgtgagggccctaactactgctcagttagtgttttctcactgggaccagttatgccatgtagaaaataacaccactcagtgtaatgatgttgctgcagtagatattaacatgggttgcccgaagtcattttctgtgagtggtggaatgggtgctgctctgttgtccaaaccagagcttattcatgatatcttaacaacattaaagaggaatttgaacacaccagtaacatgtaagattcgacttctaaaatcaccacatgataccgtggaattagccagacgaattgagaaaactggtgtttctgctcttgcagtccatggaaggtaa

SEQ ID NO: 84704 - DNA, 930 bp, Glycine max
  Peptide Sequence Number=SeqID_201482
atggaggaatacactagtaataatcacttgagtgaaaacacaggtccaagtccaagtactccaaggccaaatttcttgtactcttcagctagtggtggaaaccataatcatcagcatcagcatcatagccatcaccaccaccaccaccaccagtttccaatcaacacctttcatcttcaatcgggtggatcagatcattgctttcagtctgatcaagtttcaccacacccttctgtcaaatccgaagccagcacttctcagctccacgctccgattttccactaccctttaatgagaggaaaccttcacaacactatgcatcatcctcagcaacaaggagggagcccaactagctccactggtgaagttgaagccataaaagctaaaatcattgctcaccctcagtactccaatgttttagaagcctacatggattgtcaaaagataggagctccacccgaagtggtggcgcgtatggctgcggctaagcaagagtttgaggcacggcaaagatcttcagttggttcaagggaaacttcaaaagaccctgaacttgaccaattcatggaagcatactatgacatgcttgtgaagtatagagaggaattaacaaggcctattcaagaggctatggatttcatgcgaaggatagaaactcagctaaatatgctttgcaatggacccgtgcggatcttctctgattcaactatgtgtaatacgtgccgggggcacaaaattttgaaccgagttctgcagttcttgaaattcgtaaactcgagtgttctctgtactgagccaggaaactttgaccgaaaattttacctacctacagatcgtaggagggaagggacccagagagtggagatgatatttcatcaagcacagaaccctaatcagtacccaatatataaaatatatttttgtttataa

SEQ ID NO: 84705 - DNA, 171 bp, Glycine max
  Peptide Sequence Number=SeqID_201483
atggagaagtatttcggaaacgcttatcgtggcgacccgggcgtgccccattcggacccggatcgcttcgtcaacatatgggtcggatccgctgccttcgctgttctcacatatttcaatccctacatgtggcagctctctaatcagttcaacattatatttgtagcataa

SEQ ID NO: 84706 - DNA, 285 bp, Glycine max
  Peptide Sequence Number=SeqID_201484
atggagttaaaacctggagattcagctgcaaaaaaggagctttctcaactattgcaagctcaaagtgctctagaaacaactcactccctatatgatttgggcaacttctcaaaatctttggaatatattgataaagttgttcttgttttttcttcagcttgcaataaggctaagcttcttatagtgaaggtgttaattgttgataaagagtatgagagtgctattgttgagtctgggtttcttctcaaggaagatgaaaataatttagaggcattcatgttataa

SEQ ID NO: 84707 - DNA, 381 bp, Glycine max
  Peptide Sequence Number=SeqID_201485
atggtagagaacaatgaagaaaatgtgaaaaaagaccttgagcttcctttagttgaccttgctacaattgtcaaagctactgatgggttctcaattaacaataagctgggagaaggtggatttggggttgtatacatgggtaccctagacgatggacatgaaattgctgtgaagaggctctcacaaagttctggacaaggctataatgaatttaagaatgaagtcatattgattgccaaaattcagaatcaaaacctagtcaagtttcttggtcgttgcattgaaggagaggagaagatggttatatatgaatgcatgcctaacaaaagcctaaaatcctttatctttggttatgatttcttcacatcttatgcaatttaa

SEQ ID NO: 84708 - DNA, 435 bp, Glycine max
  Peptide Sequence Number=SeqID_201486
atgcttcaagatgaaatctttatcctcaagagatcactgtatgaatcagaatttgaattcagaagattgaaagcttcatatcagatgctatccttagagtgtgatgagctaaaagctaagaatgtatcttacaatcgaagaatctcaacaactgagaaagttacatcagagttggaggactgcaagtgtagtaaaattgagcttgaggaaaaaaatttacgcctgcaatggaatctaaccataaaagaagcttcttgtcacaataatgctcaattaaagtatgaagttgcacaaatcaaggactggcacttgagaatcctagaaggtgtaatgctagagaggtccataccagaaaagactaagtcaacaacatgttctctattggcatcacaagaaacccctttccatgaacagatggaagcagagaagttgtag

SEQ ID NO: 84709 - DNA, 408 bp, Glycine max
  Peptide Sequence Number=SeqID_201487
ggcccgactcatatatggtttggtgatgaagatggacctggatgtgggcaacctcatttctcttcagatcagctagatcgcccagtccagcacttccaggctcagggacccgccgcactcgcaccagagcttcagcgtcggcatctgaggctcctcttccatcccagcctccttcttagcctacttcccagagaccgcgccatccacctacatccacctcagcacccctggacatgcatggcttatcgtcagcaggatgcctggccaggagaccagccctccattgacaggggggaagagccttctggagccaccgctactgaggatcatgcagttgatgaagacctcatggctgacttggctggcgctgattggggcccatgggcaaacttgggcggaggcaactga

SEQ ID NO: 84710 - DNA, 147 bp, Glycine max
  Peptide Sequence Number=SeqID_201488
atgcagagtgaatgggttctacggcaaaacgcttattacgagtacgcagcaacggtgttacccttggacttggtatctgaaaacggaaaagaagaacctacatcctattcagggtacatgggatggaatcatggaaccgagaagcgg

SEQ ID NO: 84711 - DNA, 390 bp, Glycine max
  Peptide Sequence Number=SeqID_201489
atgacacttaggacttttgttgggaagatagaaaggggtgtttcacactttgttcacagaaggccttcactgaactacttgagtgaagccacaaccacaagtgtggtgccagatgatgttagggaaggatattttgctgttcttgcaacaaagggtggagaatccaaaaggttcgttgttggcttacattacttgactgatcctggtttcttgggactgctagatcaagctgaggaagagtttggtttcaggcaaaagggagctcttgcaatcccttgtcagccacaagagttacagaaaattctagatggttgcagaatgcggaagatggagtgtaggaaggtcttttactgggtcggagggtttaaacagcagctgaaacggtgctaa

SEQ ID NO: 84712 - DNA, 773 bp, Glycine max
  Peptide Sequence Number=SeqID_201490
atttggacgacaccttgtacccctccagcaccggaattgacaagtgcgtcaagaaaaacatccaactctttctcatccagaaatgcggattctcagaatccaaagccttgacccaacgagttgagctcttcaaaacctacggaagcacccttgccggcttaagagcacaaggcctcgatatcactgcagaggactaccacggtctaaacttttcgttcttctcactccgaccaagtttcgtgcacggaaggctaccttacgactccatcgacactgatcatcagttacggaacctcctcttgagcatcaaacaaagaaaaattgtttttactaattctgacaggattcacgcgatgagggcgctggataggcttggggtcaaggactgtttcgagcaaatcatatgcttcgagactataaacccgaaccttccctattcaacccgacccgacgaattccccatcctccttaaaccttcgctcgacgccttcaagatcgcgcttgacgctgccaacgtggatcctcgtcgtacgttgtttctggatgacagcgttcgcaatattgccgcgggaaaagaaatgggtctccacactgttctggttgggaagacaatgaaaagcaaaggagctgactatgctgtggagagtgtgcataacttggcacaagtgatcccagagatatgggcaaacgaaatggacggtggtgatccaacgatgacacgttcgaagagtgaattggaggccgtactcgcttgtgctctggttggagcttga

SEQ ID NO: 84713 - DNA, 465 bp, Glycine max
  Peptide Sequence Number=SeqID_201491
atgaagaagattgaagaactacataataatcgtagagactcaatgcaaatgaagattctcaaatcttttattgcaaaggtacacgatggtctcgcagtagtctttgcaccaataaagagatcatttacactgaccagcaacgacgattcagcaacaacagaggtgccgggtgacgttttggaagggcactttgtggttcttgcaaacaagggtgaagaaaccaaaaggtttattgtggagttgcactatttggatgaccctgcatttttgggactgctggagcgggcaagagaagagtatggtttcagacagaagggggttttggtaattccctgccaccctcaagagctagagaagattctagaacaaccaagggatcatgaaagtgttggaggagatggaggcaaattaacagattcaattcaagatattagtgaatgtagcgtcatttcctgcagtagttga

SEQ ID NO: 84714 - DNA, 650 bp, Glycine max
  Peptide Sequence Number=SeqID_201492
cttcccgagtatggtatggtagaattgatcagtacttcactaatcatggatttaagaggagcaagagtgagtcaacattgtacatcaagactcaaggcaacaatttgaagatgatgaaagaattcaaagaagacatgatgaagacattcaagatgattgagcttggcttgatgaattacttcctcaacatagaggtaagacaacaaaaagaaggaatacttatctctaaaaagaaatacattgaagctctattgaagaaatttaagatgtatggatgcaaatctattacaattgcactcacgacaaatgagaagttgcaaaaagacgatggagcactggaagctgacgcgtcacactataggagtttgatcggaagtctactatatctcatagctacacgacttgacatcatatatcgcgccacaacggcgggccaagatgatgttatgaaaggttattttgcggttcttgcaatcaagggtgaggaaaccaaaaggtttattattgggttagactacttgaatgatcctgcattcttggtacttctgaatgaagctcaggaagagtatggtttcagacagcaaggagttcttgcactctcttgtcgccctcaagaattacagaagattctagatgctcccaaagcatag

SEQ ID NO: 84715 - DNA, 315 bp, Glycine max
  Peptide Sequence Number=SeqID_201493
atggcagctcgcctaggcaagctgaggcttagtcctgaagtaactggcttgtctaggcgagctgattccttcaccctgaagtcatttggtggcccaggcgagtcagaggctagcctgggcaagttagggtccaggaaactcaatgaaaagacccttttgcccctcctttttggtatcttctgcgttcttgatcaaaacattgaacgatctttcgtcttgtgcggtaactggtgtcaaacaacgcagttcgagcatttacatcacgttagccaccaaatgatagaaatcgccatcaaaatacctttgctctcctaa

SEQ ID NO: 84716 - DNA, 189 bp, Glycine max
  Peptide Sequence Number=SeqID_201494
atgactagaaccattattcatggtaatgcggatggtaatggtagcctaaccattggccacatcacatgtggtatagagtttagtctaccaatgaggccaaagtggagtggaacaacgggagttgttttccagtgcttccactctggcactataaataccacttgcaaattgatgattttcttagtttag

SEQ ID NO: 84717 - DNA, 2029 bp, Glycine max
  Peptide Sequence Number=SeqID_201495
cccaaaccggctgaccacgccgctgattcgtgaaaacggccagttccgcccggctagctgggatgaagcgctgcagcgggttgccgatggcctgcgcgcggtggcacgccagcacggcggtaacgcgattggttttattggttccagtaaagccagcaatgaggaagcctatctgacgcagaagatcgcccgtctgattttcggcaccaataacgtggacaactcctcgcgctattgccagaacccggcgacggaagggctgtttcgcaccgtgggctacggcggcgatgccggtacgctgcgcgatctgcagcagaccgacctgatcatcaccgttggcagcaacctggcggaaaaccacccggttttcgcgtcacatatcaagcagagccacaaacatcgcggacaaaagctgctggtggtcgatccgcgccgtcacgaaatggccgagcgcgccgactgttatctgcgcatccgccccggtaccgacatggtgtgggcatcggcgatggcgcgctacatgttcgatcacggttatgccgatgaagcattcctgcgcacgcgcgttaatcaggtggcggaatatcgcgcctcgctggctccgtttacgcttgagatggccagtgaagtcaccggtctgagcgtggcgcagttgaccgaagccgccgagatgatcggcaacgcgggcagcgcctgcctgctgtgggcgatgggcattacgcagcacagccacggtgcggataccagcaccgcgctctccaatctgctgctggtcaccggcaactacggccgccctggcaccggcggttacccgatgcgcggtcacaataatgtgcagggcgccagcgattttggctgcttaagcaatgtctatcccggctacgaaaaagtgaccgatgcgcaggtgcgggaaaaatgggcgcgcgcctggggcgtggcaccggaagcgctttccgatgaagccgggctggataacttcatgatggtggaagacgcgcataaacagcgggtgcgcgccatgtacatcatcggcgaagagaccgccttttctgatgcggactcgaccaaagtgcacgaagcctttagccggctggatttcatggtggtgcaggacatcttcatgagccgtaccgcgcagtttgcggatgtggtgctgcctggctgtccgagcctggagaaagagggcaccttcgtgaataccgaacggcgcattcagcacttctcgcctgcgtttgcgccgctcggcgacagccggcctgactggcagatactgactgaggtcgccgcgcgtctcggccatcactggcactacccgaatcccggcgccatcatggcggaagctgccggtatcgccgcgctgtttgccggggtcagctatgagaacctcgtcggctggcagtcacagctgtggccggtaaacgccgacggcagcagcacgccgctgctgtataccgaggcgttcgcctttcctgatggcaaagcgcgtctgtatccactgacgtggcagccgccgatggaagcgcccgatgcgcagtacgacctgctgctgaacaatggccgcatgctggagcatttccagtcgaccaatcagaccgggcagggcggacgcatcaaatcgctgtcgcccaactggtttgttgagatttcgccgcagctggcgcaggagcggcaattacagcagggcgactgggtggagctgcgttcacgccggggcagcgtagaggtgccggtggtggtgactgaacggatggccggcaatgtgttgttcattcctatccaccacggcaaaccgggggtgaacgggctgaccgctgaacaccacgatcccgacgtcaacaccccggcctacaaagagattgcggtgacgatgcgtaaactggcgcatgcgccacagccgcacccgattccgctacacaacttccgccacggtcagcgcacgccgctggatcatctgcccgttgaacaaaaatggcagcagcctgaataccggctgccgcctgaacacgtttcgcatccggagaaaagctaa

SEQ ID NO: 84718 - DNA, 414 bp, Glycine max
  Peptide Sequence Number=SeqID_201496
atgcaatacacgggaacacgtcattcactgtttggaaaaaccttacctagagtgaagaccgtgtgtgttttcagcataaatagcaaaaatctgaatacgaggactccaagctctaaaacttctaacacatactctatcagaacaagaaggcctgctgcattcagctacttcagtgaagatcgtgccacaaccgcggcaccggatgatgttaaggaaggctattttgctgttcatgcaattaagggtgaggaaaccaagaggtttattgttgggttagattacttgaatgatcctgcattcttgggacttctggaccaagctcaagaagagtttggtttcaggcaaaagggagctcttgtactcccttgttgccctcaagagttacagaagattctaaatggtcccaaagcatag

SEQ ID NO: 84719 - DNA, 249 bp, Glycine max
  Peptide Sequence Number=SeqID_201497
atgaggatttcgattaagtcaacagtgtgtgggggtggcgacgacgaacacatcggtgggtgcggacccaatagaatccttcgcctcatcaagtggctccctcgacattgtgggacagaagtagaagaatccgaggatgatgccgttgttgaagtggttcagtggttagattgtatggccgtgtcggggtttgctatgtgggttgagctttggtgttttgatgtgggtgatttgtgcggaattttttga

SEQ ID NO: 84720 - DNA, 399 bp, Glycine max
  Peptide Sequence Number=SeqID_201498
atggggatgatgatgaggtatgctttgagggtgtttgtgtcggggaagcacatgacggcgaacgtggtggaggggaacaacgggagggtggtggcgggtgcgttaagtgttgagcacgcgctgaggggcgcgttcgagtgggggagggggtgcgacgcgagggcggcggcgtccgtcagggaggtgttggccatgcggctgaagacggaggcgccggagctcggagggggaggtggggttcactttgatgctgagagggagatccagaagaagactgtggacaacggagataaggtgtcatggttttcgtcgccggtgatcgcaacaattcaggtaaagaaaaaggatttccaaggtatttatctctttaagaaaaaaagagtatcatgggcattttaa

SEQ ID NO: 84721 - DNA, 483 bp, Glycine max
  Peptide Sequence Number=SeqID_201499
atggagaggagcaagagggtaaaagggagagtggttttgatgaagaagggtgtgttggacttccatgacatcaaagccaacgttctcgatcgagttcacgagttattgggcaagggtgtctctcttcagctcattagtgccactactcctgatccagaagtagaagagtacacaatggatccaataacaggattgagagggaagctaggaaaggtggcacacttggagaggtgggtatcgacgatcacctctctgacatcagcaacagacacagagttcactgttacatttgagtgggatgagagcatgggtgttcctggggcattcataatccgaaacaatcaccatagccaattctacctcaagacagtgaccatcgaagacattcctgggcatggtcctgttaattttgtctgcaattcctggatctaccctgctcatcgttacgcccatgatcgtgtcttctttgccaacaaggcataa

SEQ ID NO: 84722 - DNA, 204 bp, Glycine max
  Peptide Sequence Number=SeqID_201500
atgggcgtagtaaaaaactgtaaggctaaagctttgggatgttgtggaatgactatggccataatggtgcgagccacgattgtggtgaattcaccgtggccatcgtcagaatgcttacattgtttagaagggaagtcaacatattaccatggtcgtactacttatcatgactatgctgaatgtaccatagtcgtagtcaagtga

SEQ ID NO: 84723 - DNA, 495 bp, Glycine max
  Peptide Sequence Number=SeqID_201501
atgacattgcttcaggagacaaatgtgtttctttgttgcttgttaggtttctgtcaaagttcttcacagaggacgattaaggatttggtgcaattggaggaagattacggtgttaaagcttctggtcccaaaagtgaagatcgtgtgtttgctatgaatgatcaaagattgtggaaaaatgctaaaaatcgtagttctatcttgccacctgagtataagaggggttcaagtagacctaaaaagctaagaaaaagggagcctgatgaggatctcaatcccactaaattgaagggaaaaaaacaactaagtaccaatgtaaaagagaatgaaggcactgctattcaactagtgaatgaaggcaatgcagaacatgacactattgttgaaagcacaattgttgtgaatgacaacatagtagttgttattcagttacaacaagttgagaatggacctgctattaaggcgcaacatcctgaggcaacaaggaacatatag

SEQ ID NO: 84724 - DNA, 831 bp, Glycine max
  Peptide Sequence Number=SeqID_201502
atgggaaccggttcgaccttggccagtaaggaagttccaatagtcggaagcgacgctgttcgctggatcgatctctccgttccgtcttcctccaacattgccgccgttgacgacggcggcgccgcccctctcaccaccgacgaccgcgcctcctgcttcgtcatcggagatcctcctacttatcttatctggagaattcacaaggctcagcctcactctctcgagttgctcgaactcgccgcttccaaagagtttccgcgcgtaggactcagattcactttccctgatgcgctttgccccttcgctttcatctgcaaaaacgagatttctggtgcttctagagttccttacttgctttacgtgttgactgtgtctggcgtggcttacctattgaaaattcgaaatgtttctgtgtatgcgtccgtttctgttttccccgtggatgagcttttggaggttaatgtgcgtggttacattcccaatcatgctgccacgataactgccgtgacagcaaccgtcgggggtcttgttgttggcacaagtgatggttctgttttctgtttccagcttggtgtactcgactctagtgctcctggtttcatgcatgagctgagagatgatgctggaatcagtcgcttgtggggtttaatatcacgggggaaaatggtgggtactgtacaagagttggcgattttggagttacatgagaaaaagtttgtgtttgtgcttcatttggatgggacgttacgaatttgggatcttgcatctcatagcagggtttttagtaataacatggggactatggcaatggcaggccaccataaacattga

SEQ ID NO: 84725 - DNA, 603 bp, Glycine max
  Peptide Sequence Number=SeqID_201503
atggtggtggtgtcagtagcaacggctgtagagatatcagtggtgattgcactgccagtggcggtagcggtggtggtagcaatgcaaatggtggtggtagtagcggtgatagtaatagtggtggtggcaatggcattgctggtggcaatggtggtggtggtagcggtggtagaaatgtcagtggcgatggtggcagctagtggtggcgatgacaaagttggtattggtggtagcggtagtgacggcagtgacagtggctgtggtggtggcattagtggtggtggcattggcggtggcgatgatagtgacattgatggtagtgatggtggtggtagtggtagcagcaaaaagtacaattgccaaatggagtatgtatcaatgaggagtataggtattggatatttggatccatatctgatatggatgcgtggcaccctggcagatgcatggactattctgttttgcaacattgtaaatgtcttcaagtgtgctaatgtacgtgcagctgttgcagttggtaactcaggctctagtacacttgtgacatgtgagttgtgtgcaagtgcatgtcctccttatgcatattcaattaagtttaattaa

SEQ ID NO: 84726 - DNA, 339 bp, Glycine max
  Peptide Sequence Number=SeqID_201504
atgggaggcaaatgtccgcataggaacgtgaagaagagaagatattctcacaagacagcgcggcgtacgaagtttgagttgaaaggggacgacatggtttatgcgcagctgaacaaacccgatgaagagagagcccctttacccctcgatgaagatttgcctgggatgggccatcggtacttttccaatgtagccgtgagggatgagcactttaagaccaaacgacacaagaagcgtataaaacaaatgatgggtcctgcaccacatactcaacttgatgccgatgtagctgctgggatgggtatgccagacaatggaccaaagctaatgtctatgtaa

SEQ ID NO: 84727 - DNA, 354 bp, Glycine max
  Peptide Sequence Number=SeqID_201505
atggatccaccattgatgaccctagaggccttcatccagcaggttgcttggccaggagttcagccctctactgatggggggcaggcgtcaattcaagtagtggagtatgaatcacaacaaagagatgaatggttagcatgtctgaaagaaatcatgggtttaagagagcataagggttttagtcatgttatgtccctaatttgggggagggttgggggtaaggattgtcttaagaaggtaaaacaacacacaataaggcaccctcaaaaagcttgcaagccaaagtttctttccaaaaaagaagaagaagaagaagaagggcagaaaataaataggtactataagtgctgttag

SEQ ID NO: 84728 - DNA, 1803 bp, Glycine max
  Peptide Sequence Number=SeqID_201506
atgaagtcttcatctggaaatggtgcatctgaggctctgcagagtttatctgatgacttaggaattccatatcttggctttagtggttgtacatcaattgctgcatggaagcttcaatactatcaatgggcaatgcagttatttgaacgttatagcattagtgaaggtgcttgccagtttgctcttgctgcacttgagcaagttgatgaggctctatatatgaaagatgacaagtgcacaaacaactcagttaatgaatcagtgacaaccatcaaaggacgactatgggcaaatgttttcatatttgcgttagaccttggtcgattttatgatgcatattgtgcaataatttcaaatccagatgaggagagcaaatacatctgcttgagacgtttcataattgttctttatgaacaaggagctataaagattctttgcagcgataaacttccccttattggtttagtggagaaagtggagcaagagcttgtgtggaaggctgatcgatcagatatttctgtgaagccaaacttgtataagttgctttatgcatttcaattgcaccggcataattggcgacaagcagcaagctacatgtacatgtattccgctcgtttgagaactgaagcagctttgaaagattgtgtaggcagttccttgatgttgcaagagaggctgaatgcactctctgctgcagtcaatgcactgcatcttgttcatcctgcatatgcctggattgattcattagctgagggaagttctattgtgaatgaacattatccaagtaagaaagctaaaagaaccccagatgaacattcagcagctgataatgatgctgagcctcaaggttggcagtcctctattgatattgaaaaacttgagaatgagtttgtgctaacttcagcagagtatatgctgtcactggtaaatatcaagtggacattttctggaaaacacggagctctatcagacttggctgatcttcttgtccaaaacagtttatatgatatggcttttacaatccttttcagatttttcaagggttctggactgaagagggaactggaaagagtgttgtctgctatctcattgaaatgctgtcttgacaaagtggaatcaacttgggttgaggaacacagtcatttattgaactcatcaaagcatgagatggtcgtccatggttcacctgttacagtttcctcgactccacaaactgacagaaacagtcgttgggcaacactcaagctttaccttgaaaagtataaggaacttcatggtagattaccgattattgttgccgaaactcttctacgctcagatcctaagattgaattacctctttggcttgtacaattgttcaaggagggtcaaaaagaaaggtcgtgggggatgactggcagggaatcaaatcctgcatctttatttcagctttatgttagctatgatcgatatgcagaagctacttatcttttgctcgagtgcatagactcatttgcttcaatgtttgtgtctatcaatgtcgaaatccaagctattcttccctgtcttatcctatgtacgaccaagggtgccatcagcttgcaacagagaccagcagatataattagaaggaaaagaccattagctgtttggttcccatacacaactattgagcggctactataccaacttgaggaattaatcagaatgggccacatggtagatcactgtgacaagctcaaaaaaatgttacatggttctttacagaatcatctgaagatgttgaaggtggactctgatgatgctgtttctgtatcttcttga

SEQ ID NO: 84729 - DNA, 1509 bp, Glycine max
  Peptide Sequence Number=SeqID_201507
atggcatggtttgatcaggaggaaaatgagagtgctaggattgcagcaaggctatctcttgatgccaacaatgtcagatcagccattggagacaggatttcagtaattgtgcagaacactgcacttatgctagttgcctgcactgcagggtttgtattgcaatggcggcttgcgcttgtactagtagctgtcttccctgttgttgttgcagccacagttttgcagaaaatgttcatgactggtttctctggtgacctggaagctgctcatgccaaggccacgcaactagcaggagaggctatagccaatgtaaggacagttgctgctttcaattcagaaaagaaaattgttggccttttcacttccaaccttgaaactccactgcggcgctgcttttggaagggacaaatttctggaagtggatatgggatagctcaatttgcactctatgcttcctatgcacttggtctttggtatgcttcttggcttgtgaagcatggtatatctgatttctctaacacaatccgagtttttatggtactcatggtctcagctaatggtgctgctgaaactttaaccctggctcctgacttcatcaagggtggtcacgccatgagatcagcctttgatctccttgaccgaagaactgagattgaaccagatgatccagatgctacccctgtccctgatagccttcgtggtgaagtagagcttaagcatgttgatttctcttatccaactagaccagatatgtcagtttttcgcaaccttagtcttcgtgctagggcaggtaaaactcttgctctagtagggcctagtggctgtggtaagagctcagtcattgcacttatacaaaggttctatgatccaacatctggccaggtcatgattgatggaaaggacataaggaaatacaatctcaagtctcttagaaggcacattgctgtggtacctcaggagccatgcctatttgctactactatttatgagaacatcgcttatggacatgactcagcttctgacgctgagatcatagaggctgcaactcttgccaatgcacacaagttcatatcttctctgcctgatggatacaagacatttgttggtgagaggggagttcaactatcaggaggacaaaagcaaagaatagcaattgctagagcttttgtgagaaaagcagaacttatgcttcttgatgaggcaacaagtgcacttgatgctgaatctgagaggtctgttcaggaggcattagaacgcgcctgctcgggaaaaactactatcattgttgcacacaggctatccactattagaaatgctaatctcattgcagtgattgatgatgggaaagtggcagagcaaggctcccattcacagttgttaaaaaatcaccctgatgggatctatgcacgcatgattcaattacaaaagttcacaaataaccaagtcattgggatggcctcaggttcaagttcttctgcaagggcacaagatgatgaaagagaaggctaa

SEQ ID NO: 84730 - DNA, 654 bp, Glycine max
  Peptide Sequence Number=SeqID_201508
cgctgttcatgtgtcctccactttcgagtttggagctgtgtttcatgattgcctaagtgcggaccctcaaggcaatcctccattctcccccttttttcggagctccatgaattgcgttttcgttcatgtgtcctccactttcgagtttggagctgtgtttcatgattgcctaagtgcggaccctcaaggcaatcctccattctcccccttttttcggagctccatgaatgttgttgcttcgttcatccccatgaattgcgttttcattcatgtgtcctccactttcgagtttggagctgtgtttcatgattgcctaagtgcggaccctcaaggcaatcctccattctcccccttttttcggagccccatgaatgttattgccaagcgctgttcatgtgtcctccacttttcgagtttgggagttgtgcttcatgattgcctaaggtgcggaccctcaaggcaatcctccatttctcctccttttggaacctctggtgactggggaatatgttcttctgttgttttccggatcggttccttcaccagatatgtaagagaaaaagaaggagtagagacgagagtcgtcatcacagaaagggcaggacggacgaaatcagtgtcctatctttgctttcctctaatctccgatgagag

SEQ ID NO: 84731 - DNA, 364 bp, Glycine max
  Peptide Sequence Number=SeqID_201509
gtctgcccttggtgagtctcatttctccaaaggctcatcaaactcaaggttcgcccttggtgagttaagcttctccaaaggctcgtcaaacccaaggcctgcccttggtgagtctcgcttctccaaaggctcatcaaacccaaggtccacccttggcgagtatcgcttctacaaaggcttgtcaaagtcaaggtccacccttggtgagtctcgcttctccaaaggctcatcaaacccaaggccaaaggacaccaccgaactccaaatggagcctatgaatggtccctggaaatctaagaaaaagatcttcaattttttcaccaataagctttggccaattctaccatttcgtgggtcatattga

SEQ ID NO: 84732 - DNA, 291 bp, Glycine max
  Peptide Sequence Number=SeqID_201510
atggaaacaactaaatcaactaaaggagcactccaaattgtagaaatccaggttggtgagctggcagaagcagtgactcaatttatgttcagacgagaaaaatactttgtagaggttgaagctcaagagaaaagccctgtaaaagagcatgagtcaagagaaaaagatgaggaaaaagcacaacaacaatgggagaagtactcaacagtagagaaacaacaagaaaatattctccaaatcaataactttcctcatcaactgattatcaagttaaacggcaagggaacatga

SEQ ID NO: 84733 - DNA, 327 bp, Glycine max
  Peptide Sequence Number=SeqID_201511
atggttttggaggagttaggtgcggctaagattgaaagtggcactaaactctatttatttaacttggatcatggagttgccgacgatgatatcaagattgggagatcaaagggaacaacagaagttgtgttcgtgaggcactctaatgctttagcagccatcaagaaatacaacaatatgagtgatggaaagctattgcaaattgagtttgttggaacatatgcatgttcagctactccggttgtcacgcctctttgtcaaactaacttaatgggaagaccaaatgatgtccatttacggtgtgaaattcttattctgatcgtttga

SEQ ID NO: 84734 - DNA, 1677 bp, Glycine max
  Peptide Sequence Number=SeqID_201512
atgatgcacgaaggatcggttgagttggagaccgtgctttctttaagatctcctacagcagatatggaaaatgatgacttgtttggtaaatcagggagcacaaagactactagagacacttgtggtgactggttggagaagaacttctattcaccaatgctggagacacagaatcaatggaaccaagctgcactgaggttgcagaaagtttacaaaagttttagaacaaggaggcaacttgcagattgtgcagttcttgcagagcagagatggtggaaggctttggattttgctgaactgaagcgcagttctatatcattttttgacattgagaaaccggagacggccatttcacgttggtcaagggcaagcaagagagctgccaaggttggaaagggtctatctaaggatatgaaggctcgcaaacttgctttgcagcactggctagaggcaattgacccccgccatcgctatggtcataatcttcaattttattatgtcaaatggcttcgctgtgatagctatcaacctttcttctattggcttgatattggggatggcaaggaggtacagtctgacagatgtactaggacaaaacttcagcaacaatgcatcaagtatctgggtccagtggaaagaaaattttatgaagtagttattgagaatgggaggctcttgtacaagattagtgggaaacctgttgaaacaacagaagatgcaaagtggatttttgtacttagtacttccaagactctttatgttggccagaagaacaagggcacatttcaacattcaagcttccttgcagggggagccacattgtctgctggtagattagtggcggaggatggtgttcttaagactttttcaactccaaaggcagtttggcctcacagtgggcattacctcccaacaaaagaaaattttgaggaactcatgtcattccttaaggagaataatgtggatcttacagatgtaaagaaaaatccagttgaagaagaagacttggccaaaattaaccaagatctcttccgagacaatccttcagaggcagtggaacctccaaaaattgaaactgaaagttccagcccgttagctgaagatcagcctgacttgagaaatgaggattctaatgctgattcaaatcatcaacaacccttatcaagattgtcggtacgactaggatcaaaaatagctaaacttgagataccaaaacgagtcacggtgtatgacattttcggagagctagcaaatggtcctcgcaccaaattttattctccaactgcagtatcagaatgcggttatgagacagcagaagaatcatttataaacgaggcggaattcatggtttccaaatcaaacatgtttgttgaagatcaagatgaagaagaggagaatactattccaaaggagacaatcttgaagaggatagattcacacaaaggaaggaaatcatatcaattggccaatcacttgtctaccaaatggacaacaggtgcaggccctcgaattggttgcatgagagactaccctctagagcttcagaatttgattctggagcagcaaaatttgtctccaaggacaagaacaacagctccatcacccaggataccgccgttgtctcgcttcagccctcatgttgcttttccccctcctttggatgctccaattgcctga

SEQ ID NO: 84735 - DNA, 2138 bp, Glycine max
  Peptide Sequence Number=SeqID_201513
aattctgaggagataaagacacttgagcagtggagatggtctgaaatgcagggcattgagcttgtgtcttcttctgctactgtttctaactcacatgaatccaacccagcattggaaaagaaaagagaagaaagggtaataatggaggaggtttcttcagtggcaaagaaagaggagggtgttcctaatggtgttggtggggagaagaagaaggatgggagtgttgcttctgttgggtttggtgagcttttcagattttctgatgggttggattacattctaatggcaattggaacggttggagcatttgtacatggctgttccctgccactctttcttcgtttctttgctgatcttgtgaattcctttggttccaatgcgaatgacttggacaagatgactcaggaagtggtgaagtatgcgttttacttcttggtggtgggggctgccatatgggcatcctcatgggcagagatttcgtgttggatgtggacaggtgaacggcaatcaacgaggatgaggatcaggtatctggaagcagcgttggaccaggacattcaattctttgacaccgaggttcgaacatccgatgttgtttttgccatcaacactgatgctgttatggtacaagatgccattagcgagaagttgggtaatttcattcactacatggctacatttgtttctggctttgttgtgggtttcactgcggtttggcaattggcactggttacccttgccgtggttcctataatagcagtaattggaggcattcacaccaccaccttggccaagctatctagtaaaagccaagaagctctttctcaagctggtaacattgtggaacagactgttgttcaaattcgagtggtgttggcgtttgttggggagacaagagcactacagggctattcatctgcattgaggattgcacagaagattgggtacaggactggatttgcaaagggaatgggattaggggccacttactttgttgttttctgttgctatgctcttttgctttggtatggaggctatttggttcggcaccactacaccaatggaggacttgccattgccaccatgttttctgttatgattggtggattggctttaggccagtctgcacccagcatggcagcatttacaaaggcaagagttgctgcagcaaagatttttcgcgtgattgatcacaagccggttatagacagaaggagtgaatcaggtttggagttagagagtgttacaggactagtagagctgagaaatgtggacttttcctacccctcaaggccagagtttatgatccttcacaatttctccttgaatgtgcctgctggcaagaccattgctttggttggaagcagtggatcaggtaaaagcacagttgtgtccctcattgagagattctatgatccttcttcaggacaagtattgctagatggtcatgatgttaagtcattgaagcctagatggttgagacagcaaataggattagtgagtcaagagcctgctttatttgctaccacaattcgagaaaacatactcttgggtaggcctgatgcaaaccaggttgagattgaagaagctgcaagagtggctaatgctcattccttcatcatcaaacttcccgaaggttatgaaactcaggtgggggagagagggctgcaactttcaggaggacaaaagcagagaatagcaattgcaagagcaatgctgaaaaaccctgcaattcttctcctagacgaggcaacaagtgcattggactcagaatcagaaaagctggttcaggatgcccttgatcggttcatgattggtagaacaactcttgtaattgctcatcgactctccacaatttgcaaagctgaccttgtggctgtgcttcagcaaggaagtgttactgaaattggaactcatgatgagctctttgccaaaggtgaaaatggagtctatgccaagcttatccggatgcaggagatggcacatgaaacttctatgaataatgccagaaagagtagtgcaaggccttcaagtgccagaaactctgtaagctcacctataattgcacggaattcttcttatggtcgatcaccgtacccacgcagattatctgacttctctacatctgattttagctt

SEQ ID NO: 84736 - DNA, 351 bp, Glycine max
  Peptide Sequence Number=SeqID_201514
atggctgctagcataaaactacgacgctctcgcaagagaatgagcgatgtggcttctgcaacttctggtttgggctctccttgctggtgcattgttttggctattaggaacaaaccatgttcatacctaagacagaaggcaactcctaataagttctgggttgttagaggggttttggcaccttgtgcatgtattctcgctcttatccttttctgcattcgagctcctatttatagggccatggcggaatccactcgagccaagaccaaccttgaccatttggaggacgtcgtcgctaagctgaccaccaaccaactatccttgtcagccaaaatcaacgagctcgtgtag

SEQ ID NO: 84737 - DNA, 1116 bp, Glycine max
  Peptide Sequence Number=SeqID_201515
atggcacagaattccgaggagataaagacagttgagcagtggagatggtctgaaatgcaaggccttgagcttatgtcttcttctgctcctgtttctaactcacatgaatccaacccaacattggaagaagaaagggtaatggaggaggcttcttcggtggaaaagaaagagggtgttcctaatggtactcgtgatggtggtggggagaagaagaagggtgagactgttgcttctgtttggtttggtgagcttttcagatttgccgatgggttggattacattctaatggcaattggaactgttggagcatttgtacatggctgttcgttgccactttttcttcggttctttgctgatcttgtgaattcctttggttccaatgcgaatgacttggacaagatgactcaggaagtggtgaagtatgcgttttatttcttggtggtgggggctgctatatgggcatcctcgtgggcagagatttcgtgctggatgtggacaggtgaacggcaatcaacgaggatgaggatcaggtatcttgaggcagcgttggaccaggacattcaattctttgacaccgaggttaggacatctgatgttgtttttgccatcaacactgatgctgttatggtacaagatgccattagcgagaagttgggtaatttcattcactacatggctacatttgtttctggatttgttgtgggtttcactgcggtttggcaattggcactggttaccctagctgtggtccctataatagcagtgatcggaggcattcacaccaccaccttggccaaactatctagtaaaagccaggaagctctttctcaagctggtaacattgtggaacagactgttgttcaaattcgagtggtgttggcgtttgttggggagactagagcactacagggctattcatctgcgttgagaattgcacagaagattgggtacaggattggatttgcaaagggaatgggattgggggccacttactttgttgttttctgttgctatgctcttctgctttggtatggaggctacttggttaggcaccactacaccaatggaggacttgccattaccaccatgttttctgttatgattggtggattgtga

SEQ ID NO: 84738 - DNA, 756 bp, Glycine max
  Peptide Sequence Number=SeqID_201516
atgcaggaggaggatgtatacaagatagcttttcgcacccatgaagagcattacgagtttcatgttatgccttttggtctttgcaatgccccctcttcgtttcaagcgttaatgaacaccacattccgaccacaattgcgcaaattcattatcatcttttttgacgatattttgatttacaacaaaaccttcgaggctcatgtccatcatatggagtgcgtatttcagctgcttcaggagggccaattcttccgcaaattatccaaatgtgcctttgcccagcgccaaattgagtatttaggacatacggtttcaggttccagtgtgaaacccgtgccggagaagattctcgccatccaacaatggccaccaccaacttctctccagactcttcgaggatttctaggcctcacggggttttatagatgcttcattcgaggctatgccatgacaacgacacccttggttcatctcctcactaaggacaccttcgaatggtctacggcggcacaggatgccttccaggctttaaaaactactgtcagcactgccccggccactaaatatgaaacccagagatcaactgggctcctggtgccattatctatttcccatagatcatgggaagacatgtccctcgactttattatgggattgccgccattccgagggcacacaatgttactagtggttgtggaccgcttctcaaagggtatccatttgggacttctgcctgcacaattctcggcttactag

SEQ ID NO: 84739 - DNA, 411 bp, Glycine max
  Peptide Sequence Number=SeqID_201517
atgcgggcttatgcggacgggccttacgtggggcggaccggcccgcttacccacccctattctctactcaagccgttttttcaagatgtggataatcagcccatgccactttctctcttgccaacggccttggataaccaacatgtaatcacaccattagctatccttagctcatgtcaggaaggtcaggatccagacagacgtctccaagtgctggtgcaatggaagagcctccatgtagacgacacatcgagggaagattggactacgttgaaggacacttatcaccttgaggacaaggtgattttcgatgaggccgggagtgatagaccaagtgggtcacaagcagcacaaacaaagaggcccaaaagaagaatcacagctactcgaaggttccaagattacgtgtga

SEQ ID NO: 84740 - DNA, 351 bp, Glycine max
  Peptide Sequence Number=SeqID_201518
atggaagactgggtgaatgcaagactctgctggcaacaaaagcttataggccactggtcctatgcactcgataatcttgaagggtccttaataacgccaagcaagcttgtgatgagatgctcccgtgatggaagattgtcgatgaggttgcagtttgaccattacattatcccctacctcaaaggacacctctcggcggtgcttatctgcatagtgtttcatttggtcttgcgccttaagcagcttctttcttatgctagaaaacaatgtttccctggaagtcagcagtgtaaaagcatatatgatatgaagtttttgatgatgccaaagataaacgcttctcaagtttga

SEQ ID NO: 84741 - DNA, 865 bp, Glycine max
  Peptide Sequence Number=SeqID_201519
atggattacgctcgggacgggaacgtggtgcaaataatcaccggcggcggcgggggtggagagagctggtccggcgaccaagccgattgggcgacggaggatgagtaccggttttggaacaacaacaacaaaaacggtggggactcagaaacgacgccatcgaactcgaattacgaggggcggtcgtcggagccgacgagtaagaagtcacggaattcgtcgcaagagggtagctcctcgaaccggtcgaaggcgatcgggaagatgttcttcaagacgaagctgtgctgcaagtttagggcagggacctgcccttacataacaaactgcaatttcgctcacagcattgaggagctgcgccgcccgccgccgaattggcaggagattgtggcggcccacgaggaggagaaggcggtgatgaccgagccgccgcaacagccgagggaggagtttcagattcccactgtggggtcttccaccttctctggagaaatgatgcagaggtcttacaagggaaggcattgtaagaagttttacacggaggaaggctgcccctatggggatagttgcacctttcttcacgacgagcaatcgaagaatcgcgagagtgttgctataagtttgggccctggtggttatgctggtggcggtggcggtggttgtggtagtggtagtggtggtggtggtggtggtggtggtggtggtgttggtggtggtggcagtggtggtaacggtggtgttaatgctgctgggaatggacctaattcaaagccctcgaattggaaaaccaggatttgcaataagtgggagatgacagggtattgcccctttggcaataagtgtcattttgctcatggtgccacag

SEQ ID NO: 84742 - DNA, 228 bp, Glycine max
  Peptide Sequence Number=SeqID_201520
atggcatcttcgtcgtcgtcttcatcaagtatacaaattaagtctggtccaatagaaggagacgttttatggatgcaacccaaacatgtttcagaacatgtttggaatggggaaccagacagaaaattgcatattcgacgagctgtcccgatttatcaaggtctgcctgttgatggggcaccattaattggtcagactaatcttgattgggccgaattgtgtgaataa

SEQ ID NO: 84743 - DNA, 375 bp, Glycine max
  Peptide Sequence Number=SeqID_201521
atgatggaaagacttggcttctttgagacgtggattgggtggatgagaacgtgtttgtcaatgggagcgccacaaatgaatttgttcataaagagggttaaggcaagacctgtcaccatcgtttgtgacctatcactgttgtttgtgacctgtcatcgtcgtgtcctcctcaccatcatcgcagctgaactactccacgagttggggttcatcactaccgcgaggttgagcattccgttggagttcgacatcagcgcaaggtacgtgatgcagtgggcattggatagaagactccaagaagattgggccagagatgtaagagaaggccctaaggttctcatgagccttagggtagattttgggcccatgggctaa

SEQ ID NO: 84744 - DNA, 294 bp, Glycine max
  Peptide Sequence Number=SeqID_201522
atgaagttttgccatacatactttgccaagaaggatttacgttggtggatcttaagaaactcgcttaccagaatgatcctttcatcatggcaaaacaatctgaataggtggtcagtggttttacacgagaaaacaattggtgttaatgttgaagatgatgattcacacattgatacttatgttagtcctttatccacacaaatgtcgcctaacatcgtcggagcggaagaagctgacgatgttcatgctaatcgtaatgatcatgatgaaggagaattaattaacatcgcctaa

SEQ ID NO: 84745 - DNA, 396 bp, Glycine max
  Peptide Sequence Number=SeqID_201523
atggagttgcagaggtggcggcggcaacaatttggtgaagggagtgtcagatttagtgtcttcgcggtggaggtggtaccattggaggcaccacgggatgatccattgagtgcggtggtggaagtgccatcgggggtgcataatagagagaagcgacgacgagggttagagaaggttgaaagccgaaaaaataatggcccagttacagaaagttctagcccgtgtggcccaagtgtattcattgagcatttgagttgcagaagttcctcgaggtcgaggtgcattttccctctctggctcaagtggatacacccgatatacgtggcatcagccttcatgactaacccttcgataaaagacgatatgaatacgtatcttcctgatacttctatataa

SEQ ID NO: 84746 - DNA, 918 bp, Glycine max
  Peptide Sequence Number=SeqID_201524
atgggaagagctccttgttgtgacaaggccaatgtaaagaaagggccatggagtcctgaagaagatgaaaagctaagagagtacatagagaaaaatggaactggagggaactggattgctctcccacaaaaagctggtttgaaaagatgtgggaagagttgtagactcagatggcttaattatctcagaccaaaccttaagcatggggagttttctgaagatgaagacagaataatctgcactctctatgctagcattggaagcaggtggtcaataatagcatctcagttgccaggaaggacagacaatgatatcaagaactattggaacaccaagctcaagaaaaaaatgatgggaatgaacccttcagcactgaagaaaccacaccaagttaacctttcacccatgcttcaaaactcaacaccatcatcatctttcaaaaacaaccacaactcttatttccagccccatttgcccttcacaggctctgagtccatttcatattcaagtcttccgagtgacaattattccacttttgagagccttcagaattaccaagttagtagtgtctttatggaaacaagttgcagctcttcttcagatggaagctgcaacaacaatcagatcaatcatgtcaaggaagcagaacttggatatgttggtgatggaacttttggtgaccagataataggtcgtctaagttacctcaatagtggggtggaagatcaagataccctaaagttggtgccctccaatgctggtagggttagtggggtgacagatgaagaaactagattatggggagaaagtccattagagtatggtctagaagaaattaaacagctaataagcaatagtagttgcaacaactttatgcttgatgacagcaagactggggaaatggtcatgtactactga

SEQ ID NO: 84747 - DNA, 330 bp, Glycine max
  Peptide Sequence Number=SeqID_201525
atgcacgaagaagacgcaggaacaccaagagggagaagaagcacgaacacaaagaagaagaaccaccaacacgaagaagaagaagtaggaaggcgaagaagaaccaccaacacgaagaagaagaagctggaaggcaaagaagaagaagaagtggaaaacgacgcaacggaatataaaaatgctagatgctcaaagcaactccctctttgcatcattgctaaaaagagacgaaccctcaacaaaagcccggtacacaactaccccacttggccaaatgatgaggacatgagggttcatatcaccaaaccacacaaaagaaaagccacatga

SEQ ID NO: 84748 - DNA, 726 bp, Glycine max
  Peptide Sequence Number=SeqID_201526
atgtcctcgccttcagagggctacacgccctcgccttcagagggctgcatgccctcgtctccagagggctacatgacctcccctttagaaggctacacgtccttgcctttagagggctacatgccctcgccttcagaggactgcacgtcctcaccttcagaggaccacacgtcctcgccttcagagggctacatgccctcgctttcagaggactacataggactacacatcgtcgccattagagggctacacgtcctcactttcaaaagacaacacatcctctccttcagaggattaaacattctagccttcagagggctgcatgccctcaccttcagagggctacacaccctcgccttcagcgagctacacacctcgccttcagaggactacatgtcctcacctttagagggctacgcgccctcgctttcagaggactacatgtcctcgccttcagagggctgcacgcccttgccatcagagggatccacgccctcgcctttagaggactacacgtcctcaccttcagaggaatacacaccctcgccttcggaggactacacgtcctcgccttcagaagactacacgtcttcaccatcagaggactacacgtcgtcgccttcaaagtggctacatgccctcgcttttagaggactacacgtcctcgccttcagagggctacatgccctcacttttagaggactacacgtcctccccttcaaatga

SEQ ID NO: 84749 - DNA, 528 bp, Glycine max
  Peptide Sequence Number=SeqID_201527
atggtttgcaccaaccaagcggatatgaccggaaggcttcttgtcggttcattggcattcgaatgccacatcatgcactacttgattgtgcgcatcctactccctagatcttccaaccttgcacaggcccatcttgtgagatatcgcatgcataaggcattgcgatcaaatgctccactcccatatccccatctgattactttgtttctacaacattttaatgtccctcttgactctgagccctttgtcaaagtcaagagatccttctctataggtgccaatgtagtctcttcctttggttacctcaaagagagggatggctcttggagagatgacttttcatctcttatgcacaacattcttgaaaggtttgatggacttcaaacctatgttggtgagaggtttgactctttggaacgtcaagtggacacacgattcgaggagatgaactcaaggattgcaaaggttgaagaagatgtcaccatcattcgtgactgccttgatttacctccaccaccatcagtttag

SEQ ID NO: 84750 - DNA, 1008 bp, Glycine max
  Peptide Sequence Number=SeqID_201528
atggagatcacgagcagccatagcagcggcagcatgatgtggtttttcaaagataagggctttgatgacaacagtgtgcaaggaatgttccgaaagtgccggcgcctcgagggtgtgcatcaggaaagagcaagtgagaattgggactatttgagaagcattggcattgaggaaaggaaactgccctcaattgtttcgaaatgccccaaaattcttgcactagatctttatgggaagattgtgcccactgttgagtgtctcaggacattaggaacaaaacctaatgaggttgcttctgccatagcaaagttccctcacatactctcaaacagtgtggaagagaagctttgtccccttttggcattctttcagactctaggtatccctgaaaagcaaattgggaaaatgatactgctcaaccctaggcttattagttacagcattgaaacaaagctgacggaaattgtgaacttccttgtgaaccttggtctcagtaaggatggaatgatcggaaaagttatagtcagggacccgtatattatgggttatagtgtcgataagaggcttcgccctacttcagattttctgaagtcaatagggctgagtgaggcagatcttcaagcggtggctgtgaacttcccaggaatcttgagtagagatgtgaacaagcttttggtacccaattatgcgtatctaaagaaacgtggatttgaagagagacagatagttgctttggtggttggttttcctcctattctgatcaagagcattcagaattcgttagaaccgaggatcaagtttttagtagatgtaatggggagacaagttgatgaagtcattgattatccttgcttctttcggcatggcctgaagagaagaatagagccacgatacaaacttctaaaggagaggagtttaaattgtagcttgagtgaaatgttggattgtaataggaagaagttcttcatgaagtttggcttgttagaaggccatgccttgagtaactag

SEQ ID NO: 84751 - DNA, 579 bp, Glycine max
  Peptide Sequence Number=SeqID_201529
atgcaccaccctcccaatcccacgatcctccaacaaagaacaagccgacaacaacgcaacgaaggtatactcatcaggctcaacaaaaccccctctcatctccgcaaaaatcctcatagaacaaccagcgcgacccgcacgcacaagcccattaatcaccgtgttatacgaaacagaatccctcacaggactttcatcaaacaccctgcaggcattacgggcatccccgaaaacaaagtacacctgcaaaagcgcgttgacaacaaaaacattggactcaaacccacttttgaaaacgtgggtatggacctgaaggccgagtctgggaagcgaaagcttggcgcaggacttgaggaggaagggaaaggtgaagagagagaaggctctgatgatgaggttgaagaggaagagatcagggtttgggatttgggtgaagagaagatgggagtggtgaagagcgttgctgttggcggcggcgaagaaagagatgagtggtgtcatgaggaatgggtcgtggtggcgccctgtgaccaccatttgggcgtggatttgaagcgcttggtgaatggttctgcatga

SEQ ID NO: 84752 - DNA, 1329 bp, Glycine max
  Peptide Sequence Number=SeqID_201530
atgagagggggttttgttgagcctgatgagtataccttcgttgcgttgttgtcggcttgttctttgttggaggatcgtgggattgggagggtggtgcatgggttggtgtataggaaattgggttgttttggcgagaatgagttgttggtgaatgcgcttgttgatatgtacgcgaaatgtgggtgtttggaggtggccgagagagttgtgagaaatgggaatgggaagagtggtgttgcggcttggacttctttggtgagtgcatatgctttgcgtggggaggttgaggttgcaagaaggttgtttgatcaaatgggggagagagatgtggtttcttggacggctatgatcagtggctactgccatgccgggtgttttcaggaagcactggaactgtttgtggagttggaggatttggggatggaaccggacgaggttgtggtggttgctgctctttcggcatgcgcacggcttggtgcccttgagttgggaagaaggatccaccacaagtatgatcgtgatagttggcagtgtggtcacaacaggggattcacttgtgctgttgtggatatgtatgccaagtgtggaagcatagaggctgctttggatgtgttcctcaaaacaagcgatgatatgaaaactacttttctctataactccattatgtctggccttgctcatcatggccgtggtgaacatgccatggctttgtttgaagaaatgaggttggtgggtttagagccagatgaggtcacatatgtagcacttttatgtgcctgtgggcatagtggtctggttgatcatggcaagaggctgtttgagtccatgttgagtgagtatggtgttaatcctcagatggagcactatggctgtatggttgatcttcttggtagggctggtcatttgaatgaagcatatcttttgattcagaatatgccgttcaaggccaatgctgtgatatggagagcattgttgagtgcttgcaaagtagatggagatgtggaattggctagacttgccagtcaagagcttcttgcaatggagaatgatcatggggcccgttatgtgatgctatctaatatgttaactctcatggataagcatgatgaagctgcaagtgtgagaagggcaattgataatgttggcatccagaagccacctggttggagccatgtggaaatgaatggaactcttcacaaatttctggctggtgataaatctcacccggaggccaaagcaactgagttcatgctcagggacattgatatgggactgaaatctattgggcatagtattagtgtatcaaaaatggtgtttgatgtagattaa

SEQ ID NO: 84753 - DNA, 1447 bp, Glycine max
  Peptide Sequence Number=SeqID_201531
gaatgacttggcaaacattgtcagaaggagagggcataaacaaattcaggagcttctcacaagaagctcattgaatgctgacgttgatattttaagtgctgaaactagcttagatgagaggttggatgcggcaaatggttttgaagatcctttaacaggtcagaatgagacagtggactgtttggtcaatgatgtcaaatcttcgacagagtttcttctaggaagtagttctggtagtttgtatgttgactctagttcaagtttaggtgaaggtactaacatcgctgaagaagcctcagctaatttgtttgtagaggatggacttagtaaagtagaagatcatgctgaagtgctcaacgatgtaacggaggggaatttctacccaactgaattgattattgttgataatgattatgatagttcaagggaaggtcttcatcccaacttcggtagccaaagttccatcatgcctacagaaatttctggtgaattacctattcagacagtgtcttctggaaattctgagtctgaggatagtttagtaggcaaaatggatggagagataaccttgtcattgacggaaagccattccaacacttcattcaatgattccaatattgacactgaagacaaagagtttagtcatttggaaccattagttggtttacctttggagcaaaaggacttgggtgcattagaaggtctagatgacagcaaagatgatattgctgaggatgttgccacaacctctgaagtttctgttagggaaaatttatctgatgacaacagacttaattcaattgttcattcagctgacagcagttctacaaatcttgacactttggccaacttgtctttgagggaaaaggttgcaaattttattcagaatggagatttggatccagttgaaggtacccatcttcctgaagataataatgtcatggctcatgggaactcattgacatccaaccaagttgttccatccggagcattggatttggatcagtctctttgggatgatcacttgccacatgaggatctaactactgatttcaacaaggacttggatactgaggctccaaaagtgcaaaatgaaagtgagataaatcatctcaagttcatgctgaaggagttggaactgtctcggctgaaggaacagattgagaaagaaaagcttgctttgtctgtcttgcaaaccaaggcagaggcagaaatcagcaaagccagaaaacttatatctgaaaaagatgcagagttacatgttgctgaagaaagtctttcaggactcaaggaggttcagattgagttctgtggtgatggtgatgttgtggaggtggctggtagcttcaatggttggcatcaccgaatagaaatggatcttcaacagtcaacaagtgctatagaccttgatggatcaaggttatatagattgaacatgttcaactag

SEQ ID NO: 84754 - DNA, 1035 bp, Glycine max
  Peptide Sequence Number=SeqID_201532
atggcctcttcaagcaatgcctactggccaccttcacctggttacaggccaagttccaaattcaggcctgtgaacttctatagagggtttagaaatctttggggccctcagcaccaaagcatagaccaaaatgcattaacaatatggcttgatagctcctcaggaagtggcttcaagtcaaatcgaccatttcgatccgggtactttggtgcttccattaagctccatcctggctatactgcaggagttataacagctttctatctttctaacaatgaggcacatccgggcttccatgatgaagtggacattgagtttcttgggacaacatttggaaagccttatactttacagaccaatgtttatataagagggagtggggatggaacaattattggcagagaaatgaagttccacctttggtttgatcctacccaaaactttcatcactatgctatactttggagtcctaaggaaataataaaaagcagagaagatagggtaggcaacatttcattttccactgaagcagatagaagagagaattccgtttttcctgaaattgaggataaaggaaaagaggcacttggtgacagggttaatcatataaaatcaagatcacctgaacagcacacaaagtatgaaaacagaactgttagaagtgtgggattccttgtggatgatattcccataaggagatacccaaggaagagtgctgaaacatttccactgaggccaatgtggctttatggttcaatatgggatgcctcatcatgggcaacagaagatgggaagtacaaggctgattacagataccaaccttttgttgcaaagtacacaaacttcagggctggtggttgctcagcctatacctctcgtcggtgccgcccagtctcagcctcgccatatcgctccggtggcttgaccagacgccaatattgggccatgagatgggtgcaaaaataccacatggtctataactattgccaagaccacaaaagagaccacaaactaacacctgagtgctgggggtaa

SEQ ID NO: 84755 - DNA, 192 bp, Glycine max
  Peptide Sequence Number=SeqID_201533
atggagcttccatttgaagtggaggctgtccccactaatgaccttgctttcaggagtggcatcagccatcctgtgattatttacaatatggctaaaccttgtgaggacatggaggagaaggttgaggcagatgttgaacctgttccagcagatcctgttaagcctggaagtgtagatgtcaagcaggattaa

SEQ ID NO: 84756 - DNA, 1188 bp, Glycine max
  Peptide Sequence Number=SeqID_201534
atggactccatcgccggagctccgccacacgccgacgtcacccctccgccgcctcggcagtcgccgttccccggccgggaagactgctggtcggaggaagccacgtttacgctcatcgaggcgtggggccagcgccacctcgaactcaaccgcggcaacctccgccagcgccactggcaggaggtcgccgacgccgtcaacgcccgccacggccacgtcagcaccaaggcccgccgcaccgacgtccagtgcaagaaccgcatcgacacgcttaagaagaagtacaagatcgagaaggctagggtttccgattccggcgactccgccaccacctggcccttcttccgccgcctcgattttctcatcggcgacaatttccccgccaagaagccctccccgcccgccaccgccggaataactcgccggagcaccccgccggccaagtccccgccttgggcggtcattccggtcggccctcgatccggaacaaagaagcggccggcggcggcgaagccggcgtcggcctcgccggatagcgtcgccaactcgtacttccgccggaatttctccgtgttcgcagccgcggcagcggcggcggcggcggcggcggccgacagcgagaattcgaatggttcgaaatggagcagtgggagtgagaaagggacgatgaagaagaaaagaacaagaggagattgggaatttgggtacagagagatggcagaggcgttggagaagtttggggagatttatgagagagtggagggagcgaaacagaggcaaatggtggaattggagaaacagaggatgcagtttgctaaggatttggaaacccagagaatgaaactcttcatggaaactcaggttcacttgcagaaaatcaaccgctccaaacgttcttctgcttctgagatcaaaacatcaatctgtctattgtataagaacttctggctcaggacttcagtcaaaaagagctgcaagcctattttggtttactttttctgtttttctgagggggagggtagttggtatttgagagcactgctatgttcccatgatagaagaaaatcggtgatgaatgcaaaaatgatccaaaatgacgatgaactgcctactctgttccctccagtctccctatatcatgctgccttgcataagaacctgcccagacagcctctaaccaactcatga

SEQ ID NO: 84757 - DNA, 1068 bp, Glycine max
  Peptide Sequence Number=SeqID_201535
atggtttctgatagatcaaaatctgtgagattccaagatgaagctgagacaaataagttaatgtacaacaaagaaagtcacttgccaatggtgtcctttgatgaagtgagcgataaacagaagggtgggaaggatgcaataggcaagtcctctgatggaagagaactttcaagggtcttttctgaggattatgatgcagcagagattttggtattggatcctaggggacatagagtaaatacatggaacaaaatcttcttagcagcttgtttgctttcgttatttgtggatcccctattcttttacttaccagtggctaagaaagacaagtgcattgatatgtcaactggtcttgaagtgttcctcaccataatccggtcattgattgatgcattttacattattcagatttattttcggtttcaaactgcttatattgctccttcctctcgtgtttctggtagaggagagcttatcatagactcttcaaaaattgcatcaaagtacatgcgaagagatttctggcttgatgtaatggctgctcaaccacttccacaggtattgatttgggcagtaattccatatctaaaagggtctcaaatgattgcttcaaggcatgttttacgccttgtttccattttccagtacctcttgaggttgtatcttatttatcctctatcatctgaaatcgtcaaggcaaatggggtaatgatggaaaaagcatgggctggggcagcatacaatctgatgctttatatgctagctagtcatgttttaggatcctcttggtacctgttatcaattgaacgccaaaatgaatgttggaagaaagcttgtacactgcagtacccacactgccagtatcgttatcttgattgtcaaagcatgggtgacccagataggattgtttggttaagatcaagcaatctctcacgtctatgtgatcagaacagtgatttctttcaatttggcatttttgttgatgctctcaatttggaagttacagcttcacaattcttcaacaaatactgctactgtctatggtggggactaaggaatctaaggtaa

SEQ ID NO: 84758 - DNA, 374 bp, Glycine max
  Peptide Sequence Number=SeqID_201536
gggacttgaagtttgtggctgcacaattcagaaggctgcacagcaaacaactaaggcacacttttaggttccactcccatcagtggaggacttgggctgcatgcttcatacaagcagcatggttcaggtataagagaacaaaggagacaagtgagctcaagaaaaaggagaatctgatgatggcctttgttcttggaaccggcagtgaacatttctctgcacctctgcagtccccaaagggcacaatgtatgctgcaaaactagcatccagcccaaggaaaggtaggagcttgagatatgggcctgaactagacattcttggttcattgaggaagccccttgaaccagactttactgatgatgatgacagttga

SEQ ID NO: 84759 - DNA, 864 bp, Glycine max
  Peptide Sequence Number=SeqID_201537
atgacacgccatctccaagtcaacaaattcaataagagcattgccataagtgctgagaaggaggaaaacctccaattccatagaagatttgaagcatcttcgaatgtatcaggcctttccttgagaaacgtgatgttacgatcaaatagcaatttaagtttgtcacatagtgaacccaacattgctactgcatttggtcggcgtagtcggagaaaggtcattgctgaacagaggacagctagttcaagtccagaacatccatcatttcgagcacgtggaaggtccatgcttagtggtgataggacaacgtttagagattttaccgatgatcaggctacatcaagatccagctataggtcagatggcacatcctcgtcagaagctcgtcggatacgaagaagaagcatcagcattacaccagagattggagatgatatcatgcccaggtcagaactggttgtctttctgtatctttactttcatattcatattattcaatccagagaggttgagccttgtggcggtgggttcttacaactgaaacagtatcgtatctctgctttgggggagggttgcttggtaaatatgacccgtagacctttaaatggtgggagccttttgcactgggctgccctttttttggtagtgtttggcctggcttgtattgtatgggcttctctttatttttctttaaaaggagaagctgggtcaaaagcaattttagaaaaactcttaatagagcttctaatgaagctaattggcggagcttcttcttttaacgagatgagaaccctaaaaaagctggaccaaacactacctactctgttgggatatgctctttttgctgtagtatggtgcatttga

SEQ ID NO: 84760 - DNA, 680 bp, Glycine max
  Peptide Sequence Number=SeqID_201538
atggaggagacacgagaagatgcagggccggcagagcaagggccatctaatgtgttgtggtggccttcagattttgttgaaaaatttggatctgtttctttgggttctcaagatgagaccttaagtaataaggaatctcctcgacatgttgtcgaagatgtgctgtcttctctgaaagcatcacaaacactctggcagactggaatgctttcagaaccaataccaaatggtttttactcagtcattccggtttctgatttttataagcgtcccaatgtggaaagtcctgcaaaagctgcactagatgaaacctctcacatgtttgagaatcgaggagtccagatgctggggcaaataaagcatggttcttgccgtcctcgagctatcttatttaaagtattagctgatactgttggtcttgaaagtaggctcatggtgggcttgccaaatgatggagctattgaatgtcaagattcatacaagcatatgtctgtgatagtcgtattaaattctctggaaatgctggttgatcttatgcgatttccaggccaattgttaccacgatcaaccaagtcagtttttatgactcacatttctgcaggagagagtgattcagcagaaaatgattcttgtgattcaccattagaaccaaacagccctttatttggggtttcagagag

SEQ ID NO: 84761 - DNA, 219 bp, Glycine max
  Peptide Sequence Number=SeqID_201539
atgatcagggagatagaaggagtagcaaattcaccggcagcagatccaagcattcgagtccgaatctggggagagggagagggtgtgagtcacgtgcagtgcgagagggatctgggaacctctccccgacagccagctagcaaaagggttggctcaccaacatccacaacttcttacgcgtcaaaactattatgctctcctctagcctatagcctatag

SEQ ID NO: 84762 - DNA, 276 bp, Glycine max
  Peptide Sequence Number=SeqID_201540
atgtgtttagaaatagggaaatgggtttttcatgaggagggtttaaaaattgatttaggtaaatcaatttttgataggtggagaaagagggcatgcaatgcaatcaatgagagtgaggatggagacaaggtgcttgaagaaattgtggaagtgacgatatgggtaatggaaagggtggatgagggcacaggtgttatagggcactacccactaatgttttcttattcaatcatcaatgcacattgctcaacagcactagagcaccatcttaagtag

SEQ ID NO: 84763 - DNA, 462 bp, Glycine max
  Peptide Sequence Number=SeqID_201541
atggtcttcctcgcgattttgggcttccgtttcagtggaagtcatcgtcacttgctttttgaacaaggggaggtgtggaaggtttgtgactttgtgcgcgtgagcatcacgataatcgtaaggagatggaacgccaatacttttgcaggaccccagaaaagcactgagcagagggtgattgacacatcctcaaaaaagttgaatgatgttgaggatgacgacattgttgtaattgatggagtggaggctcgggttgaagttgtggcggagggtgaagttaaagcagtggtggagggtgaaattatggctgaggggcaagttgatcaacagactttggttgaggttcaggtggaggttgaggttcaagttggtgaacaaggtttggtgaaggttcaggtggagcctgtaggggagactaatgttcaagctcagatggaggctgaagttcatgttcatgaatag

SEQ ID NO: 84764 - DNA, 912 bp, Glycine max
  Peptide Sequence Number=SeqID_201542
atgccctccccttcggagggctgcacgccctccccttcagaggataacacatcctcaccttcagaggataacatatcttcccctttagaggaatccacgtttttaccttcagaggacttcccgtcctccctatcaaaggatagcatgtcttcgcctttagagggctacacgtcctccccttcagagggttgcacgccctcgccattagaagggctgcacgccctcaccttcagaggactacacgtcctcgccatcagagggctgcgcgccctcaccttcagaggactagacgtccccaccttcagaggactaaacatcctcgccttcagagggctccactcactcagctttagaggattacacgttctctccttcagaggactacacgtccttaccttcagagggctacacgccgtcactttccatggacaacacttcctcaccttcagagggctacacgtcctcaccttcagaggactacacgtcctcgcgtttacagggcttcacgtcctcgcctttggagggctacacaccctcgccatcagagggctacacgtcctcaccttcagagggctacacgacctcactttgctacacgccctcgccttcagagggctgcacacccttaactttcgagggctgcacgccttcgccttcaaaggacaacacgtcctaaccttcagaggactacacgtcctcgccttcagagggctacacgccctcgcctttagaggactacacgtcctcgcaatcggagggctgcatgccctcaccttcagagtactacatgtcctgtctttaagaggactacacatcctcgctttcagaggactacacctcctccccttcagaggaatacacgtccgcacctttagaggactacacgtcctcgcctttagagggctacagtag

SEQ ID NO: 84765 - DNA, 261 bp, Glycine max
  Peptide Sequence Number=SeqID_201543
atggaaaaaaagggtgttgtttgctacctaccttattacatgcataccctcaaaatatggagaaccattggctcaatgtgcagaaaatgttacataaaaaggttacacaaacaattcatcttgtcgcaacgtgcccttcgcgggcgagcgagggcgacgctcacgggtgcgctttccaaaggaggaaagatgcgcggagtcgccaccaacgtttatttgtggaaaacgtcggaaaaaccgaaggaaaccggtcaaaaataa

SEQ ID NO: 84766 - DNA, 723 bp, Glycine max
  Peptide Sequence Number=SeqID_201544
atgagtgtgcttccggtatttgtcgtattcgggctgtcttttccgcccatcttcattgaactactggtttcgctggcgctgttctggctggtgaaacgcgtgctgacgcccagcgggatttacgatctggtgtggcacccggcactttttaacacagcgctgtattgcttgaaagcgctaataagaaaaatcgcgcgttacgccattacgctcctgctggttatcatcgctgttattatcatcttccgcgcctgggtgttctataccgagtcgccgtggacgcgtgacgccaaattctccgccgacgtggtggcgatttctccggacgtgaccggactgatcaccgacgtcccggtacacgacaaccagctggtgaaaaaaggcgatacgctgtttatcgtcgaccgtccgcgctaccagaaagcgctggatgaggcgcaggcggatgtcgaatattaccaggcgctggtcagcgaaaaacgccgtgaagcggcgcgccgtaaccagctcggtaccagcgcgatgtcgcgcgaagctattgagcagtcgaatagcgacctgcagaccagtgaacatcagctggccaaagcggtggcgacgcgcgatctggcggtgatcgacctcgatcgcaccaccatcaaagcaccgtccgacggctgggtcaccaacctcaacgtctatcagggtgaattcatcacgcgcggctcggtggccgtggcgctg

SEQ ID NO: 84767 - DNA, 174 bp, Glycine max
  Peptide Sequence Number=SeqID_201545
aatttcaaacaactaaaaatctggaatttcaatttccttctaaaaggtgagaaattgaaattctcttcttacagtcttcttcttcgagaaacatcctatgagattatggaacatcgatcaggcgctaaagcagttttcaattatgtgtatgagaagtctggaaatttgttctag

SEQ ID NO: 84768 - DNA, 1641 bp, Glycine max
  Peptide Sequence Number=SeqID_201546
atggcagtagaattaattgctggtgctcttctttcttctttccttcaagttgcatttgagaagcttgcttctcctcaagttctggacttctttcacggaaaaaaacttgatgagacgcttctgagaaagttgaaaattaagctgcagtccatcgatgctctggctgatgatgcagaacgaaagcagttcgcagatccacgcgtgagaaactggcttcttgaggtcaaagatatggtttttgatgcagaggatctcttggatgaaatacaacatgaatcatccaaatgggaactggaagctgaatctgaatctcagacctgtacgagctgtacttgcaaggtaccaaatttcttcaaatcttctcctgctagtttctttaacagggaaattaaatccaggatggaaaaaatccttgatagcttagaatttctctcaagccaaaaggatgatctaggcttgaaaaatgctagtggtgttggcgttggatcagaattgggtagtgcagtaccacagatatcacaatcaacatcttcggtggttgaaagtgatatttatggcagagatgaagacaaaaaaatgatttttgattggctgacatctgacaatggcaatcctaaccagccatggatactttctattgtgggcatgggtgggatgggtaagaccacacttgctcaacatgtattcaatgaccctaggatccaggaggctagatttgatgtcaaagcttgggtctgtgtttcagatgattttgatgctttcagggtaacaagaacaattcttgaggccatcactaaatcgactgatgatagtagagacctagagatggttcacggaagattgaaagaaaaattgacggggaagagatttcttcttgttttggatgacgtttggaacgaaaaccgacttaaatgggaagctgtgctaaaacatcttgtttttggggctcaggggagtagaattattgccaccacacgtagtaaggaagttgcttctaccatgaggtcaagagaacacctcctggagcaattacaagaagatcattgctggaagttgtttgctaaacatgcattccaagatgataatattcaaccaaatccagattgcaaggagattggtacgaagatagttgaaaaatgtaaaggacttcctctggccttgaaaacaatgggaagtctattacacgacaagtcatctgttacggaatggaaaagcatattgcagagcgagatatgggaattttcaacagagcgtagtgatattgtacctgctttagcactaagctatcaccatcttccttctcatctcaagagatgttttgcttattgtgccttattccccaaagattatttgtttgataaggagtgcttaatacaattgtggatggctgaaaaatttctacaatgttctcaacaggataagagtccagaagaagttggtgaacaatacttcaatgatctattatcaaggtgtttctttcaacaatcaagcaacacaaagagaacacaatttgtcatgcatgaccttctcaacgatttggcaagatttatttgtggggacatttgtttcagattggatggtgatcaaacaaaagagaggtgcctgactctgtgggtaatcttaaatatctccattccttag

SEQ ID NO: 84769 - DNA, 744 bp, Glycine max
  Peptide Sequence Number=SeqID_201547
atggagacacacgctgagataagggtgtcaaagttcaagagggtttgtgtcttctgtgggagtagccctggcaaaaagagaagctaccaagatgctgccattgaacttggcaatgaattggtctcaaggaacattgatctggtctatggaggaggaagcattggtttaatgggtttggtttcccaagctgttcatgatggtggtcggcatgtcatagggaggatcacgaaatcagagccaattatgcttgtgtcggtctctttctccattgacactatttgtcatgttattgtctcttgcagagttattcccaagacactcatgcctcgagagctaactggtgaaacagtgggagaagtaaaggctgtagctgatatgcaccaaaggaaggcagagatggctaagcattcagatgcctttattgccttaccaggtggttatgggactctagaggagcttcttgaagtcataacctgggctcaacttgggatccatgacaaaccggtgggattggtaaatgttgatggatacttcaattcattgctatcatttattgacaaagctgtagaggagggatttattagtcctaatgcccgccacattattgtgtcagcaccaacatcaaaagagttagtaaagaaattggaggattacgttccgtgtcatgaaagtgttgcttctaagttgagctggcagatagaacaacaactcacttaccctgaagagtatgacatctcgaggtag

SEQ ID NO: 84770 - DNA, 366 bp, Glycine max
  Peptide Sequence Number=SeqID_201548
gcttcgatcgtagttagtgcgcttgtcaggatcggaaagagtagaataggcggcgtggatctttatgaattcgtcagcggacgagttttttttatcaatggccaccacgtcgaggtggcagactctaaccggtcgtcagtacacggccttgatttcttggttagaggcgccaacgggaatgccgaggatatcgaagagcaagcttcagcggtagcaatggcagtggtgaaagcgactatcagccggaatttgatgcggcacaatgaaaaagccatggcgttgccggagaagctaatggcgggaaaagatgctgaaaaggacatgaaagaaatcatatttgctacttgctatattgggagcttgtga

SEQ ID NO: 84771 - DNA, 1359 bp, Glycine max
  Peptide Sequence Number=SeqID_201549
atggctttcatgaggcttggatcaaaatctgatgcatttcatcgtgagggccaaacatggaattgcacaaccggacttccaagtgatgttactgttaaagtaggcgaaacatcattttttctccacaagttcccattgctttctagaagtggattactgaagaaactcattgctgacttcacaaatgaggatgggtcaaactgtgttttgcaacttgatgacgtgccaggtggagacaaaacatttgaacttgtgaccaagttttgctacggtgtcaaaatagaagtcacagcatcaaatgtggttagtctaagatgtgcagcagagcacctacagatgaatgaaaattatggtgaagggaatctaattgcaaggactgaggcatttctcaatgaagttttcagtaattggtcagacactataaaagctcttcaaacatgtgaggaagttaaatcttgtgcagaagagttacacattgtttcaagatgcattgattccttggccatcaaggcatgttctaacccaaacatgtccaatagacatgtggaaggacaagattgctccaagtactcagctcaagatcctgccttatggaatggaatttcttctgagaataaatcaccacatccaggtgatgattggtggtacgaggatttgtcttcgctaatcttacccttatataaaagagttattttatccattgaagcaaagggtatgaaacctgagaatgttgttggatccctcatatattatattaggaggtttatccccatgatgaataggcaagcaagcttcaatgataaaaatagtgtcaatcaaggtacaaccactaatagttcgatttctgaagcagatcaaagggcattgctagaagaaattatgggcttgcttcctaataagaaaggtgtcacaccctccaagtatctgcttaggttgctctgcgcagccaccatattacacgcaagtccatcatgcatagaaaacttggagaaaagaattggatcacaacttgaccaagctgaacttgtggatcttctcattccaaatatggggtactcggttgagactctctatgacatagactgcattcagaggattattgatcactttatgtctatataccaggctgcaactgcatcaacttctccatgcataattgaagaggggtcgttgatagctggaactgatgcccttgcacctatgacaatagtggcaaatttgatagatgcatatcttgcagaagtggctgtagatgttaacttgaagctgcctaagtttcaggcccttgcttctgcaattccagattatgctaggccactggatgatgctttatatcatgcaatagatgtgtaccttaag

SEQ ID NO: 84772 - DNA, 1578 bp, Glycine max
  Peptide Sequence Number=SeqID_201550
atggctgcctcacacatcctttataatcctcctcccctttccaaaacttttattaatcaccctttgaaccaaaacccttctcctcaaaacctaattctaccactcaaagctactattaaaccgcgggttcttagagcagttcactcccagaagatcactgctaactcctcgcttcataactccgatactaggactcgttttcagcactgtttcacaaagagtgaagatgggcttttgtattgtgaggggcttaaagtgcatgaaattatggattctgttgaaagaagacctttctacttgtacagtaaacctcaaattactagaaatgtggaagcttataaggacgccttggagggtttgaggtctataattggttatgccatcaaggccaacaataatttgaagattctggagcatttgaggcagttgggttgtggtgctgtgcttgtgagtgggaatgagcttagattggctcttcgggctgggtttgatccgacaaggtgtatctttaatggcaatgggaaagtcttggatgatttggtcttggctgccaaagaaggtgtttttgtcaacattgatagtgaatttgacttggaaaacatcatagcagctgcaaaaattgctcaaaagagggtgaatgttttactacggattaatcctgatgtggatccgcaggtccacccttatgttgcaacagggaataagaactccaaatttggcataagaaatgagaagctgcaatggtttctagatgctgtgaaggagcatcctaatgagttaaagcttgtaggggcccactgccatcttgggtcaacaatcaccaaggttgacattttcagggatgctgccattattatggttaactacattgaccaaatccgagctcagggttttgaagttgattatttaaatattggtggtggacttgggatagattatcaacattctggtgctgtccttcctacacccagagatctcattgacactgaacatcttcatagcatttttggacaatttagacatgttctaccgattctttctctaaatgcttttcataagcaagatgctgtatatttttctttaattatacagttcatggtaagggagcttgttctttcccgtggtcttaatctcattattgaaccagggagatcactcgttgcaaacacttgttgcttagttaaccgggtgacaggtgtcaagaccaatggatctaaaaactttattgtgattgatggaagcatggccgaacttatccgtcctagtctttatgatgcttaccagcatatcgagctggtttcccctgccccagcgaatgctgagatagcaaattttgatgtggtcggccctgtctgcgagtctgcggatttcttaggaaaagatagacaacttccaactccagccaagggtaccggtctggttgttcatgatgctggtgcttattgtatgagtatggcatcaacttacaatctaaagatgcggcctcctgagtattgggttgaagaagatggatcagtaagcaaaatcagacatggggagacatttgaagaccacatccggttttttgagggcctttga

SEQ ID NO: 84773 - DNA, 249 bp, Glycine max
  Peptide Sequence Number=SeqID_201551
atgatttggagggctatgttagacagaatgccaactagggacaatctgctgcatagaggaattaatctggttaacacaaattgtccaatatgtcatcagcagggggaatctttcaaccatataatttggaaaagcaatacatcatgcaagtgtaccctgaggcaaatttatatgcaaatcatgggactcacgtcatcattcacgtggttgaaatacatagtatacacatatgggtacacttgtatataa
